US011459615B2

(12) United States Patent
Rabinowitz et al.

(10) Patent No.: US 11,459,615 B2
(45) Date of Patent: *Oct. 4, 2022

(54) METHODS FOR SIMULTANEOUS AMPLIFICATION OF TARGET LOCI

(71) Applicant: Natera, Inc., San Carlos, CA (US)

(72) Inventors: Matthew Rabinowitz, San Francisco, CA (US); Matthew Micah Hill, Belmont, CA (US); Bernhard Zimmermann, Manteca, CA (US); Johan Baner, San Francisco, CA (US); George Gemelos, Portland, OR (US); Milena Banjevic, Los Altos Hills, CA (US); Allison Ryan, Belmont, CA (US); Styrmir Sigurjonsson, San Jose, CA (US); Zachary Demko, San Francisco, CA (US)

(73) Assignee: Natera, Inc., San Carlos, CA (US)

(*) Notice: Subject to any disclaimer, the term of this patent is extended or adjusted under 35 U.S.C. 154(b) by 0 days.

This patent is subject to a terminal disclaimer.

(21) Appl. No.: 16/829,133

(22) Filed: Mar. 25, 2020

(65) Prior Publication Data

US 2020/0232037 A1    Jul. 23, 2020

Related U.S. Application Data

(63) Continuation of application No. 16/777,700, filed on Jan. 30, 2020, which is a continuation of application No. 16/399,103, filed on Apr. 30, 2019, now Pat. No. 10,557,172, which is a continuation of application No. 16/140,298, filed on Sep. 24, 2018, which is a continuation of application No. 14/918,544, filed on Oct. 20, 2015, now Pat. No. 10,316,362, which is a continuation-in-part of application No. 14/877,925, filed on Oct. 7, 2015, now abandoned, and a continuation-in-part of application No. 14/692,703, filed on Apr. 21, 2015, now Pat. No. 10,179,937, and a continuation-in-part of application No. 14/538,982, filed on Nov. 24, 2014, now Pat. No. 9,677,118, said application No. 14/877,925 is a continuation-in-part of application No. 14/225,356, filed on Mar. 25, 2014, now abandoned, and a continuation-in-part of application No. 13/780,022, filed on Feb. 28, 2013, now abandoned, and a continuation of application No. 13/683,604, filed on Nov. 21, 2012, now abandoned, said application No. 14/225,356 is a continuation of application No. PCT/US2012/058578, filed on Oct. 3, 2012, said application No. 13/780,022 is a continuation-in-part of application No. 13/335,043, filed on Dec. 21, 2011, now Pat. No. 10,113,196, and a continuation-in-part of application No. 13/300,235, filed on Nov. 18, 2011, now Pat. No. 10,017,812, which is a continuation-in-part of application No. 13/110,685, filed on May 18, 2011, now Pat. No. 8,825,412, said application No. 13/683,604 is a continuation-in-part of application No. 13/300,235, and a continuation-in-part of application No. 13/110,685, said application No. PCT/US2012/058578 is a continuation-in-part of application No. 13/300,235, (Continued)

(51) Int. Cl.
    | | |
    |---|---|
    | C12Q 1/68 | (2018.01) |
    | C12Q 1/6883 | (2018.01) |
    | C12Q 1/6811 | (2018.01) |
    | C12Q 1/6848 | (2018.01) |
    | C12Q 1/6809 | (2018.01) |
    | C12Q 1/6851 | (2018.01) |
    | C12Q 1/6844 | (2018.01) |
    | C12Q 1/6855 | (2018.01) |
    | C12Q 1/6874 | (2018.01) |

(52) U.S. Cl.
    CPC ......... *C12Q 1/6883* (2013.01); *C12Q 1/6809* (2013.01); *C12Q 1/6811* (2013.01); *C12Q 1/6844* (2013.01); *C12Q 1/6848* (2013.01); *C12Q 1/6851* (2013.01); *C12Q 1/6855* (2013.01); *C12Q 1/6874* (2013.01); *C12Q 2600/156* (2013.01)

(58) Field of Classification Search
    CPC combination set(s) only.
    See application file for complete search history.

(56) References Cited

U.S. PATENT DOCUMENTS

| | | |
|---|---|---|
| 4,040,785 A | 8/1977 | Kim et al. |
| 4,683,195 A | 7/1987 | Mullis et al. |

(Continued)

FOREIGN PATENT DOCUMENTS

| | | |
|---|---|---|
| CN | 1650032 A | 8/2005 |
| CN | 1674028 A | 9/2005 |

(Continued)

OTHER PUBLICATIONS

US 8,501,409 B2, 08/2013, Simen et al. (withdrawn)

(Continued)

*Primary Examiner* — Stephanie K Mummert

(57) ABSTRACT

The invention provides methods for simultaneously amplifying multiple nucleic acid regions of interest in one reaction volume as well as methods for selecting a library of primers for use in such amplification methods. The invention also provides library of primers with desirable characteristics, such as minimal formation of amplified primer dimers or other non-target amplicons.

14 Claims, 58 Drawing Sheets

Specification includes a Sequence Listing.

Related U.S. Application Data said application No. 13/335,043 is a continuation-in-part of application No. 13/300,235, and a continuation-in-part of application No. 13/110,685, said application No. 13/300,235 is a continuation-in-part of application No. 13/110,685, said application No. 13/780,022 is a continuation-in-part of application No. 13/683,604, and a continuation-in-part of application No. PCT/US2012/058578, filed on Oct. 3, 2012.

(60) Provisional application No. 62/148,173, filed on Apr. 15, 2015, provisional application No. 62/147,377, filed on Apr. 14, 2015, provisional application No. 62/146,188, filed on Apr. 10, 2015, provisional application No. 62/066,514, filed on Oct. 21, 2014, provisional application No. 61/994,791, filed on May 16, 2014, provisional application No. 61/987,407, filed on May 1, 2014, provisional application No. 61/982,245, filed on Apr. 21, 2014, provisional application No. 61/634,431, filed on Feb. 29, 2012, provisional application No. 61/675,020, filed on Jul. 24, 2012, provisional application No. 61/683,331, filed on Aug. 15, 2012, provisional application No. 61/542,508, filed on Oct. 3, 2011, provisional application No. 61/426,208, filed on Dec. 22, 2010, provisional application No. 61/571,248, filed on Jun. 23, 2011, provisional application No. 61/516,996, filed on Apr. 12, 2011, provisional application No. 61/448,547, filed on Mar. 2, 2011, provisional application No. 61/462,972, filed on Feb. 9, 2011, provisional application No. 61/398,159, filed on Jun. 21, 2010, provisional application No. 61/395,850, filed on May 18, 2010.

(56) References Cited

U.S. PATENT DOCUMENTS

| | | | |
|---|---|---|---|
| 4,942,124 | A | 7/1990 | Church et al. |
| 5,486,477 | A | 1/1996 | Carver |
| 5,635,366 | A | 6/1997 | Cooke et al. |
| 5,648,220 | A | 7/1997 | Bianchi et al. |
| 5,716,776 | A | 2/1998 | Bogart |
| 5,753,467 | A | 5/1998 | Jensen et al. |
| 5,824,467 | A | 10/1998 | Mascarenhas |
| 5,854,033 | A | 12/1998 | Lizardi |
| 5,860,917 | A | 1/1999 | Comanor et al. |
| 5,891,734 | A | 4/1999 | Gill et al. |
| 5,952,170 | A | 9/1999 | Stroun et al. |
| 5,962,223 | A | 10/1999 | Whiteley et al. |
| 5,972,602 | A | 11/1999 | Hyland et al. |
| 5,976,790 | A | 11/1999 | Pinkel et al. |
| 5,994,148 | A | 11/1999 | Stewart et al. |
| 6,001,611 | A | 12/1999 | Will |
| 6,025,128 | A | 2/2000 | Veltri et al. |
| 6,066,454 | A | 5/2000 | Lipshutz et al. |
| 6,100,029 | A | 8/2000 | Lapidus et al. |
| 6,108,635 | A | 8/2000 | Herren et al. |
| 6,124,120 | A | 9/2000 | Lizardi |
| 6,143,496 | A | 11/2000 | Brown et al. |
| 6,156,504 | A | 12/2000 | Gocke et al. |
| 6,180,349 | B1 | 1/2001 | Ginzinger |
| 6,235,472 | B1 | 2/2001 | Landegren et al. |
| 6,214,558 | B1 | 4/2001 | Shuber |
| 6,221,603 | B1 | 4/2001 | Mahtani |
| 6,258,540 | B1 | 7/2001 | Lo et al. |
| 6,300,077 | B1 | 10/2001 | Shuber |
| 6,329,179 | B1 | 12/2001 | Kopreski |
| 6,335,167 | B1 | 1/2002 | Pinkel et al. |
| 6,440,706 | B1 | 8/2002 | Vogelstein et al. |
| 6,479,235 | B1 | 11/2002 | Schumm et al. |
| 6,489,135 | B1 | 12/2002 | Parrott et al. |
| 6,605,451 | B1 | 8/2003 | Marmaro et al. |
| 6,617,137 | B2 | 9/2003 | Dean et al. |
| 6,720,140 | B1 | 4/2004 | Hartley et al. |
| 6,794,140 | B1 | 9/2004 | Goldsborough |
| 6,807,491 | B2 | 10/2004 | Pavlovic et al. |
| 6,858,412 | B2 | 2/2005 | Willis et al. |
| 6,927,028 | B2 | 8/2005 | Lo Y et al. |
| 6,852,487 | B1 | 10/2005 | Barany et al. |
| 6,958,211 | B2 | 10/2005 | Vingerhoets et al. |
| 6,964,847 | B1 | 11/2005 | Englert |
| 7,035,739 | B2 | 4/2006 | Schadt et al. |
| 7,058,517 | B1 | 6/2006 | Denton et al. |
| 7,058,616 | B1 | 6/2006 | Larder et al. |
| 7,101,663 | B2 | 9/2006 | Godfrey et al. |
| 7,153,656 | B2 | 12/2006 | Nolan et al. |
| 7,218,764 | B2 | 5/2007 | Vaisberg et al. |
| 7,297,485 | B2 | 11/2007 | Bornarth et al. |
| 7,332,277 | B2 | 2/2008 | Dhallan |
| 7,410,764 | B2 * | 8/2008 | Gocke .............. C07K 14/47 435/6.11 |
| 7,414,118 | B1 | 8/2008 | Mullah et al. |
| 7,442,506 | B2 | 12/2008 | Dhallan |
| 7,459,273 | B2 | 12/2008 | Jones et al. |
| 7,645,576 | B2 | 1/2010 | Lo et al. |
| 7,655,399 | B2 | 2/2010 | Cantor et al. |
| 7,700,325 | B2 | 5/2010 | Cantor et al. |
| 7,718,367 | B2 | 5/2010 | Lo et al. |
| 7,718,370 | B2 | 6/2010 | Dhallan |
| 7,741,463 | B2 | 6/2010 | Gormley et al. |
| 7,727,720 | B2 | 9/2010 | Dhallan |
| 7,790,418 | B2 | 9/2010 | Mayer |
| 7,805,282 | B2 | 11/2010 | Casey |
| 7,838,647 | B2 | 11/2010 | Hahn et al. |
| 7,981,609 | B2 | 7/2011 | Rubin et al. |
| 7,888,017 | B2 | 8/2011 | Quake |
| 8,008,018 | B2 | 9/2011 | Quake et al. |
| 8,024,128 | B2 | 9/2011 | Rabinowitz et al. |
| 8,133,719 | B2 | 3/2012 | Drmanac et al. |
| 8,137,912 | B2 | 5/2012 | Kapur et al. |
| 8,173,370 | B2 | 5/2012 | Oeth et al. |
| 8,168,389 | B2 | 6/2012 | Shoemaker et al. |
| 8,236,503 | B2 | 8/2012 | Faham et al. |
| 8,195,415 | B2 | 10/2012 | Fan et al. |
| 8,296,076 | B2 | 11/2012 | Fan et al. |
| 8,304,187 | B2 | 11/2012 | Fernando |
| 8,318,430 | B2 | 11/2012 | Chuu et al. |
| 8,318,434 | B2 | 11/2012 | Cuppens et al. |
| 8,323,897 | B2 | 12/2012 | Andersen et al. |
| 8,372,584 | B2 | 2/2013 | Shoemaker et al. |
| 8,389,557 | B2 | 3/2013 | Singh et al. |
| 8,389,578 | B2 | 3/2013 | Went et al. |
| 8,450,063 | B2 | 5/2013 | Dube et al. |
| 8,467,976 | B2 | 8/2013 | Lo et al. |
| 8,515,679 | B2 | 9/2013 | Rabinowitz et al. |
| 8,532,930 | B2 | 9/2013 | Rabinowitz et al. |
| 8,679,741 | B2 | 3/2014 | Hoyal-Wrightson et al. |
| 8,682,592 | B2 | 3/2014 | Rabinowitz et al. |
| 8,703,652 | B2 | 4/2014 | Quake et al. |
| 8,706,422 | B2 | 4/2014 | Lo et al. |
| 8,748,103 | B2 | 6/2014 | Faham et al. |
| 8,825,412 | B2 | 9/2014 | Rabinowitz et al. |
| 9,005,894 | B2 | 4/2015 | Ladner et al. |
| 9,051,602 | B2 | 6/2015 | Oliphant et al. |
| 9,085,798 | B2 * | 7/2015 | Chee .............. C12Q 1/6827 |
| 9,206,475 | B2 | 12/2015 | gerdes et al. |
| 9,228,234 | B2 | 1/2016 | Rabinowitz et al. |
| 9,323,888 | B2 | 4/2016 | Rava et al. |
| 9,404,150 | B2 | 8/2016 | Lee et al. |
| 9,424,392 | B2 | 8/2016 | Rabinowitz et al. |
| 9,453,257 | B2 | 9/2016 | Hoyal-Wrightson et al. |
| 9,476,095 | B2 | 10/2016 | Vogelstein et al. |
| 9,487,829 | B2 | 11/2016 | Vogelstein et al. |
| 9,493,828 | B2 | 11/2016 | Rava et al. |
| 9,506,119 | B2 | 11/2016 | Faham et al. |
| 9,598,731 | B2 | 3/2017 | Talasaz |
| 9,677,118 | B2 | 6/2017 | Zimmermann et al. |
| 10,017,810 | B2 | 7/2018 | Iafrate et al. |
| 10,041,127 | B2 | 8/2018 | Talasaz |

(56) References Cited

U.S. PATENT DOCUMENTS

| | | |
|---|---|---|
| 10,061,890 B2 | 8/2018 | Rabinowitz et al. |
| 10,081,839 B2 | 9/2018 | Rabinowitz et al. |
| 10,083,273 B2 | 9/2018 | Rabinowitz et al. |
| 10,174,369 B2 | 1/2019 | Rabinowitz et al. |
| 10,179,937 B2 * | 1/2019 | Babiarz .................. G16B 40/20 |
| 10,227,652 B2 | 3/2019 | Rabinowitz et al. |
| 10,240,202 B2 | 3/2019 | Rabinowitz et al. |
| 10,260,096 B2 | 4/2019 | Rabinowitz et al. |
| 10,266,893 B2 | 4/2019 | Rabinowitz et al. |
| 10,308,981 B2 | 6/2019 | Sparks et al. |
| 10,316,362 B2 | 6/2019 | Babiarz et al. |
| 10,351,906 B2 | 7/2019 | Zimmermann et al. |
| 10,392,664 B2 | 8/2019 | Rabinowitz et al. |
| 10,450,597 B2 | 10/2019 | Iafrate et al. |
| 10,522,242 B2 | 12/2019 | Rabinowitz et al. |
| 10,526,658 B2 | 1/2020 | Babiarz et al. |
| 10,538,814 B2 | 1/2020 | Babiarz et al. |
| 10,557,172 B2 | 2/2020 | Babiarz et al. |
| 10,597,708 B2 | 3/2020 | Zimmermann et al. |
| 10,597,709 B2 | 3/2020 | Zimmermann et al. |
| 10,597,723 B2 | 3/2020 | Babiarz et al. |
| 10,655,180 B2 | 5/2020 | Babiarz et al. |
| 10,711,309 B2 | 7/2020 | Rabinowitz et al. |
| 10,731,220 B2 | 8/2020 | Babiarz et al. |
| 10,774,380 B2 | 9/2020 | Ryan et al. |
| 10,793,912 B2 | 10/2020 | Babiarz et al. |
| 10,894,976 B2 | 1/2021 | Stray et al. |
| 11,111,543 B2 | 9/2021 | Rabinowitz et al. |
| 11,111,544 B2 | 9/2021 | Rabinowitz et al. |
| 11,111,545 B2 | 9/2021 | Babiarz et al. |
| 11,130,995 B2 | 9/2021 | Quake et al. |
| 2001/0051341 A1 | 12/2001 | Lo et al. |
| 2001/0053519 A1 | 12/2001 | Fodor et al. |
| 2002/0006622 A1 | 1/2002 | Bradley et al. |
| 2002/0107640 A1 | 8/2002 | Ideker et al. |
| 2002/0119478 A1 | 8/2002 | Umansky et al. |
| 2002/0182622 A1 | 12/2002 | Nakamura et al. |
| 2003/0009295 A1 | 1/2003 | Markowitz et al. |
| 2003/0040620 A1 | 2/2003 | Langmore et al. |
| 2003/0044388 A1 | 3/2003 | Lo et al. |
| 2003/0065535 A1 | 4/2003 | Karlov et al. |
| 2003/0077586 A1 | 4/2003 | Pavlovic et al. |
| 2003/0087276 A1 | 5/2003 | Kopreski et al. |
| 2003/0101000 A1 | 5/2003 | Bader et al. |
| 2003/0119004 A1 | 6/2003 | Wenz et al. |
| 2003/0138780 A1 | 7/2003 | Gill et al. |
| 2003/0211489 A1 | 11/2003 | Shen et al. |
| 2003/0228613 A1 | 12/2003 | Bornarth et al. |
| 2003/0232348 A1 | 12/2003 | Jones et al. |
| 2003/0232353 A1 | 12/2003 | Kennedy et al. |
| 2004/0009518 A1 | 1/2004 | Lo et al. |
| 2004/0033596 A1 | 2/2004 | Threadgill et al. |
| 2004/0067493 A1 | 4/2004 | Matsuzaki et al. |
| 2004/0096874 A1 | 5/2004 | Neville et al. |
| 2004/0115629 A1 | 6/2004 | Panzer et al. |
| 2004/0126760 A1 | 7/2004 | Broude |
| 2004/0137470 A1 | 7/2004 | Dhallan et al. |
| 2004/0146866 A1 | 7/2004 | Fu |
| 2004/0157243 A1 | 8/2004 | Huang et al. |
| 2004/0185495 A1 | 9/2004 | Schueler et al. |
| 2004/0197797 A1 | 10/2004 | Inoko et al. |
| 2004/0209299 A1 | 10/2004 | Pinter et al. |
| 2004/0229231 A1 | 11/2004 | Frudakis et al. |
| 2004/0236518 A1 | 11/2004 | Pavlovic et al. |
| 2004/0259100 A1 | 12/2004 | Gunderson et al. |
| 2005/0009069 A1 | 1/2005 | Liu et al. |
| 2005/0043894 A1 | 2/2005 | Fernandez |
| 2005/0049793 A1 | 3/2005 | Paterlini-brechot |
| 2005/0053950 A1 | 3/2005 | Ubani et al. |
| 2005/0064476 A1 | 3/2005 | Huang et al. |
| 2005/0079521 A1 | 4/2005 | Beaulieu et al. |
| 2005/0079535 A1 | 4/2005 | Kirchgesser et al. |
| 2005/0123914 A1 | 6/2005 | Katz et al. |
| 2005/0130173 A1 | 6/2005 | Leamon et al. |
| 2005/0142577 A1 | 6/2005 | Jones et al. |
| 2005/0144664 A1 | 6/2005 | Smith et al. |
| 2005/0164241 A1 | 7/2005 | Hahn et al. |
| 2005/0164252 A1 | 7/2005 | Yeung |
| 2005/0216207 A1 | 9/2005 | Kermani |
| 2005/0221341 A1 | 10/2005 | Shimkets et al. |
| 2005/0227263 A1 | 10/2005 | Green et al. |
| 2005/0250111 A1 | 11/2005 | Xie et al. |
| 2005/0255508 A1 | 11/2005 | Casey et al. |
| 2005/0272073 A1 | 12/2005 | Vaisberg et al. |
| 2005/0282185 A1 | 12/2005 | Lo et al. |
| 2006/0019278 A1 | 1/2006 | Lo et al. |
| 2006/0040300 A1 | 2/2006 | Dapprich et al. |
| 2006/0046258 A1 | 3/2006 | Lapidus et al. |
| 2006/0051799 A1 | 3/2006 | Iwaki et al. |
| 2006/0052945 A1 | 3/2006 | Rabinowitz et al. |
| 2006/0057618 A1 | 3/2006 | Piper et al. |
| 2006/0068394 A1 | 3/2006 | Langmore et al. |
| 2006/0088574 A1 | 4/2006 | Manning et al. |
| 2006/0094010 A1 | 5/2006 | Giles et al. |
| 2006/0099614 A1 | 5/2006 | Gill et al. |
| 2006/0121452 A1 | 6/2006 | Dhallan |
| 2006/0134662 A1 | 6/2006 | Pratt et al. |
| 2006/0141499 A1 | 6/2006 | Sher et al. |
| 2006/0229823 A1 | 8/2006 | Liu |
| 2006/0210997 A1 | 9/2006 | Myerson et al. |
| 2006/0216153 A1 | 9/2006 | Wobben et al. |
| 2006/0216738 A1 | 9/2006 | Wada et al. |
| 2006/0228721 A1 | 10/2006 | Leamon et al. |
| 2006/0248031 A1 | 11/2006 | Kates et al. |
| 2006/0281105 A1 | 12/2006 | Li et al. |
| 2006/0292599 A1 | 12/2006 | Ritz et al. |
| 2007/0020640 A1 | 1/2007 | McCloskey et al. |
| 2007/0027636 A1 | 2/2007 | Rabinowitz |
| 2007/0031857 A1 | 2/2007 | Makarov et al. |
| 2007/0037166 A1 | 2/2007 | Wohlgemuth et al. |
| 2007/0042384 A1 | 2/2007 | Li et al. |
| 2007/0059700 A1 | 3/2007 | Tao et al. |
| 2007/0059707 A1 | 3/2007 | Cantor et al. |
| 2007/0122805 A1 | 5/2007 | Cantor et al. |
| 2007/0128624 A1 | 6/2007 | Gormley et al. |
| 2007/0134658 A1 | 6/2007 | Bohmer et al. |
| 2007/0178478 A1 | 8/2007 | Dhallan |
| 2007/0178501 A1 | 8/2007 | Rabinowitz et al. |
| 2007/0184467 A1 | 8/2007 | Rabinowitz et al. |
| 2007/0202525 A1 | 8/2007 | Quake et al. |
| 2007/0202536 A1 | 8/2007 | Yamanishi et al. |
| 2007/0207466 A1 | 9/2007 | Cantor et al. |
| 2007/0212689 A1 | 9/2007 | Bianchi et al. |
| 2007/0243549 A1 | 10/2007 | Bischoff |
| 2007/0259351 A1 | 11/2007 | Chinitz |
| 2008/0020390 A1 | 1/2008 | Mitchell |
| 2008/0026390 A1 | 1/2008 | Stoughton et al. |
| 2008/0038733 A1 | 2/2008 | Bischoff et al. |
| 2008/0050739 A1 | 2/2008 | Stoughton et al. |
| 2008/0070792 A1 | 3/2008 | Stoughton |
| 2008/0071076 A1 | 3/2008 | Hahn et al. |
| 2008/0085836 A1 | 4/2008 | Kearns et al. |
| 2008/0090239 A1 | 4/2008 | Shoemaker et al. |
| 2008/0096766 A1 | 4/2008 | Lee |
| 2008/0102455 A1 | 5/2008 | Poetter |
| 2008/0138809 A1 | 6/2008 | Kapur et al. |
| 2008/0182244 A1 | 7/2008 | Tafas et al. |
| 2008/0193927 A1 | 8/2008 | Mann et al. |
| 2008/0220422 A1 | 9/2008 | Shoemaker et al. |
| 2008/0234142 A1 | 9/2008 | Lietz |
| 2008/0243398 A1 | 10/2008 | Rabinowitz et al. |
| 2008/0280292 A1 | 11/2008 | Wangh et al. |
| 2008/0286783 A1 | 11/2008 | Hosono et al. |
| 2008/0299562 A1 | 12/2008 | Oeth et al. |
| 2008/0305473 A1 | 12/2008 | Chowdary et al. |
| 2009/0023190 A1 | 1/2009 | Lao et al. |
| 2009/0029377 A1 | 1/2009 | Lo et al. |
| 2009/0053719 A1 | 2/2009 | Lo et al. |
| 2009/0087847 A1 | 4/2009 | Lo et al. |
| 2009/0098534 A1 | 4/2009 | Weier et al. |
| 2009/0099041 A1 | 4/2009 | Church et al. |
| 2009/0143570 A1 | 6/2009 | Jiang et al. |
| 2009/0176662 A1 | 7/2009 | Rigatti et al. |
| 2009/0221620 A1 | 9/2009 | Luke et al. |

(56) References Cited

U.S. PATENT DOCUMENTS

| | | |
|---|---|---|
| 2009/0263800 A1 | 10/2009 | Wohlgemuth et al. |
| 2009/0280479 A1 | 11/2009 | Hoon et al. |
| 2009/0317817 A1 | 12/2009 | Oeth et al. |
| 2010/0035232 A1 | 2/2010 | Ecker et al. |
| 2010/0041048 A1 | 2/2010 | Diehl et al. |
| 2010/0086914 A1 | 4/2010 | bentley et al. |
| 2010/0105049 A1 | 4/2010 | Ehrich et al. |
| 2010/0112575 A1 | 5/2010 | Fan et al. |
| 2010/0112586 A1 | 5/2010 | Stoughton et al. |
| 2010/0112590 A1 | 5/2010 | Lo et al. |
| 2010/0120038 A1 | 5/2010 | Mir et al. |
| 2010/0124751 A1 | 5/2010 | Quake et al. |
| 2010/0129792 A1 | 5/2010 | Makrigiorgos et al. |
| 2010/0129874 A1 | 5/2010 | Mitra et al. |
| 2010/0138165 A1 | 6/2010 | Fan et al. |
| 2010/0171954 A1 | 7/2010 | Quake et al. |
| 2010/0173394 A1 | 7/2010 | Colston et al. |
| 2010/0184043 A1 | 7/2010 | Mitchell et al. |
| 2010/0184069 A1 | 7/2010 | Fernando et al. |
| 2010/0184152 A1 | 7/2010 | Sandler |
| 2010/0196892 A1 | 8/2010 | Quake et al. |
| 2010/0203538 A1 | 8/2010 | Dube et al. |
| 2010/0216151 A1 | 8/2010 | Lapdus S Etal |
| 2010/0216153 A1 | 8/2010 | Lapidus et al. |
| 2010/0248231 A1 | 9/2010 | Wei et al. |
| 2010/0255492 A1 | 10/2010 | Quake et al. |
| 2010/0256013 A1 | 10/2010 | Quake et al. |
| 2010/0273159 A1 | 10/2010 | Melo |
| 2010/0273219 A1 | 10/2010 | May et al. |
| 2010/0273678 A1 | 10/2010 | Alexandre et al. |
| 2010/0285478 A1 | 11/2010 | Chen et al. |
| 2010/0285537 A1 | 11/2010 | Zimmermann |
| 2010/0291572 A1 | 11/2010 | Stoughton et al. |
| 2010/0291635 A1 | 11/2010 | Peleg |
| 2010/0323352 A1 | 12/2010 | Lo et al. |
| 2011/0015096 A1 | 1/2011 | Chiu |
| 2011/0033862 A1 | 2/2011 | Rabinowitz et al. |
| 2011/0039724 A1 | 2/2011 | Lo et al. |
| 2011/0045462 A1 | 2/2011 | Fu et al. |
| 2011/0064824 A1 | 3/2011 | Lascoste et al. |
| 2011/0071031 A1 | 3/2011 | Khripin et al. |
| 2011/0086769 A1 | 4/2011 | Oliphant et al. |
| 2011/0092763 A1 | 4/2011 | Rabinowitz et al. |
| 2011/0105353 A1 | 5/2011 | Lo et al. |
| 2011/0130558 A1 | 6/2011 | Ritt et al. |
| 2011/0151442 A1 | 6/2011 | Fan et al. |
| 2011/0159499 A1 | 6/2011 | Hindson et al. |
| 2011/0160078 A1 | 6/2011 | Fodor et al. |
| 2011/0178719 A1 | 7/2011 | Rabinowitz et al. |
| 2011/0201507 A1 | 8/2011 | Rava et al. |
| 2011/0212446 A1 | 9/2011 | Wang et al. |
| 2011/0212846 A1 | 9/2011 | Spier |
| 2011/0224087 A1 | 9/2011 | Quake et al. |
| 2011/0246083 A1 | 10/2011 | Fan et al. |
| 2011/0251149 A1 | 10/2011 | Perrine et al. |
| 2011/0288780 A1 | 11/2011 | Rabinowitz et al. |
| 2011/0294699 A1 | 12/2011 | Lee et al. |
| 2011/0300608 A1 | 12/2011 | Ryan et al. |
| 2011/0301854 A1 | 12/2011 | Curry et al. |
| 2011/0312503 A1 | 12/2011 | Chuu et al. |
| 2011/0318734 A1 | 12/2011 | Lo et al. |
| 2012/0003635 A1 | 1/2012 | Lo et al. |
| 2012/0003637 A1 | 1/2012 | Lo et al. |
| 2012/0010085 A1 | 1/2012 | Rava et al. |
| 2012/0034603 A1 | 2/2012 | Oliphant et al. |
| 2012/0034685 A1 | 2/2012 | Sparks et al. |
| 2012/0108460 A1 | 5/2012 | Quake et al. |
| 2012/0122701 A1 | 5/2012 | Ryan et al. |
| 2012/0165203 A1 | 6/2012 | Quake et al. |
| 2012/0185176 A1 | 7/2012 | Rabinowitz et al. |
| 2012/0190020 A1 | 7/2012 | Oliphant et al. |
| 2012/0190021 A1 | 7/2012 | Oliphant et al. |
| 2012/0190557 A1 | 7/2012 | Oliphant et al. |
| 2012/0191358 A1 | 7/2012 | Oliphant et al. |
| 2012/0196754 A1 | 8/2012 | Quake et al. |
| 2012/0208706 A1 | 8/2012 | Downing et al. |
| 2012/0214678 A1 | 8/2012 | Rava et al. |
| 2012/0264121 A1 | 10/2012 | Rava et al. |
| 2012/0264618 A1 | 10/2012 | Nygren |
| 2012/0270212 A1 | 10/2012 | Rabinowitz et al. |
| 2012/0270739 A1* | 10/2012 | Rava .......... C12Q 1/6809 506/2 |
| 2012/0295810 A1 | 11/2012 | Quake et al. |
| 2012/0295819 A1 | 11/2012 | Leamon et al. |
| 2013/0017549 A1 | 1/2013 | Hong |
| 2013/0022973 A1 | 1/2013 | Hansen et al. |
| 2013/0024127 A1 | 1/2013 | Stuelpnagel |
| 2013/0034546 A1 | 2/2013 | Rava et al. |
| 2013/0040375 A1 | 2/2013 | Sparks |
| 2013/0060483 A1 | 3/2013 | Struble et al. |
| 2013/0069869 A1 | 3/2013 | Akao et al. |
| 2013/0085681 A1 | 4/2013 | Deciu et al. |
| 2013/0090250 A1 | 4/2013 | Sparks et al. |
| 2013/0116130 A1 | 5/2013 | Fu et al. |
| 2013/0123120 A1 | 5/2013 | Zimmermann et al. |
| 2013/0130923 A1 | 5/2013 | Ehrich et al. |
| 2013/0172211 A1 | 7/2013 | Oliphant et al. |
| 2013/0178373 A1 | 7/2013 | Rabinowitz et al. |
| 2013/0190653 A1 | 7/2013 | Alvarez Ramos |
| 2013/0196862 A1 | 8/2013 | Rabinowitz et al. |
| 2013/0210644 A1 | 8/2013 | Stoughton et al. |
| 2013/0225422 A1 | 8/2013 | Rabinowitz et al. |
| 2013/0252824 A1 | 9/2013 | Rabinowitz |
| 2013/0253369 A1 | 9/2013 | Rabinowitz et al. |
| 2013/0261004 A1 | 10/2013 | Ryan et al. |
| 2013/0274116 A1 | 10/2013 | Rabinowitz et al. |
| 2013/0303461 A1 | 11/2013 | Iafrate et al. |
| 2013/0323731 A1 | 12/2013 | Lo et al. |
| 2013/0325360 A1 | 12/2013 | Deciu et al. |
| 2014/0032128 A1 | 1/2014 | Rabinowitz et al. |
| 2014/0038830 A1 | 2/2014 | Srinivasan et al. |
| 2014/0051585 A1 | 2/2014 | Prosen et al. |
| 2014/0065621 A1 | 3/2014 | Mhatre et al. |
| 2014/0066317 A1 | 3/2014 | Talasaz |
| 2014/0087385 A1 | 3/2014 | Rabinowitz et al. |
| 2014/0094373 A1 | 4/2014 | Zimmermann et al. |
| 2014/0100126 A1 | 4/2014 | Rabinowitz |
| 2014/0100134 A1 | 4/2014 | Rabinowitz et al. |
| 2014/0106975 A1 | 4/2014 | Stoughton et al. |
| 2014/0141981 A1 | 5/2014 | Zimmermann et al. |
| 2014/0154682 A1 | 6/2014 | Rabinowitz et al. |
| 2014/0155274 A1 | 6/2014 | Xie et al. |
| 2014/0162269 A1 | 6/2014 | Rabinowitz |
| 2014/0193816 A1 | 7/2014 | Rabinowitz et al. |
| 2014/0206552 A1 | 7/2014 | Rabinowitz et al. |
| 2014/0227705 A1 | 8/2014 | Vogelstein et al. |
| 2014/0256558 A1 | 9/2014 | Varley et al. |
| 2014/0256569 A1 | 9/2014 | Rabinowitz et al. |
| 2014/0272956 A1 | 9/2014 | Huang et al. |
| 2014/0274740 A1 | 9/2014 | Srinivasan et al. |
| 2014/0287934 A1 | 9/2014 | Szelinger et al. |
| 2014/0296081 A1 | 10/2014 | Diehn et al. |
| 2014/0329245 A1 | 11/2014 | Spier et al. |
| 2014/0336060 A1 | 11/2014 | Rabinowitz |
| 2015/0051087 A1 | 2/2015 | Rabinowitz et al. |
| 2015/0064695 A1 | 3/2015 | Katz et al. |
| 2015/0086477 A1 | 3/2015 | Mitchell et al. |
| 2015/0087535 A1 | 3/2015 | Patel |
| 2015/0147815 A1 | 5/2015 | Babiarz et al. |
| 2015/0197786 A1 | 7/2015 | Osborne et al. |
| 2015/0211050 A1 | 7/2015 | Iafrate et al. |
| 2015/0232938 A1 | 8/2015 | Mhatre |
| 2015/0265995 A1 | 9/2015 | Head et al. |
| 2015/0299812 A1 | 10/2015 | Talasaz |
| 2015/0315657 A1 | 11/2015 | Rhodes et al. |
| 2015/0322507 A1 | 11/2015 | Zimmermann et al. |
| 2015/0329891 A1 | 11/2015 | Tan et al. |
| 2016/0032396 A1 | 2/2016 | Diehn et al. |
| 2016/0046986 A1 | 2/2016 | Eltoukhy et al. |
| 2016/0115541 A1 | 4/2016 | Schutz et al. |
| 2016/0145682 A1 | 5/2016 | Woodward et al. |
| 2016/0186239 A1 | 6/2016 | Sinha |
| 2016/0186253 A1 | 6/2016 | Talasaz et al. |
| 2016/0201124 A1 | 7/2016 | Donahue et al. |

(56) References Cited

U.S. PATENT DOCUMENTS

| | | |
|---|---|---|
| 2016/0239602 A1 | 8/2016 | Shendure et al. |
| 2016/0244838 A1 | 8/2016 | Babiarz et al. |
| 2016/0257993 A1 | 9/2016 | Fu et al. |
| 2016/0289740 A1 | 10/2016 | Fu et al. |
| 2016/0289753 A1 | 10/2016 | Osborne et al. |
| 2016/0312276 A1 | 10/2016 | Fu et al. |
| 2016/0319345 A1 | 11/2016 | Gnerre et al. |
| 2016/0369333 A1 | 12/2016 | Babiarz et al. |
| 2017/0011166 A1 | 1/2017 | Rabinowitz et al. |
| 2017/0107576 A1 | 4/2017 | Babiarz et al. |
| 2017/0114411 A1 | 4/2017 | Mitchell et al. |
| 2017/0121716 A1 | 5/2017 | Rodi et al. |
| 2017/0152561 A1 | 6/2017 | Hamamah et al. |
| 2017/0218458 A1 | 8/2017 | Fan et al. |
| 2017/0275689 A1 | 9/2017 | Maguire et al. |
| 2017/0283788 A1 | 10/2017 | Khoja et al. |
| 2017/0314014 A1 | 11/2017 | Green et al. |
| 2017/0342477 A1 | 11/2017 | Jensen et al. |
| 2017/0362649 A1 | 12/2017 | Lieberman-Aiden et al. |
| 2018/0023128 A1 | 1/2018 | Yanai et al. |
| 2018/0025109 A1 | 1/2018 | Rabinowitz et al. |
| 2018/0127744 A1 | 5/2018 | Hu et al. |
| 2018/0148777 A1 | 5/2018 | Kirkizlar et al. |
| 2018/0155775 A1 | 6/2018 | Zimmermann et al. |
| 2018/0155776 A1 | 6/2018 | Zimmermann et al. |
| 2018/0155779 A1 | 6/2018 | Zimmermann et al. |
| 2018/0155785 A1 | 6/2018 | Rabinowitz et al. |
| 2018/0155786 A1 | 6/2018 | Rabinowitz et al. |
| 2018/0155792 A1 | 6/2018 | Rabinowitz et al. |
| 2018/0171409 A1 | 6/2018 | Rabinowitz et al. |
| 2018/0171420 A1 | 6/2018 | Babiarz et al. |
| 2018/0173845 A1 | 6/2018 | Sigurjonsson et al. |
| 2018/0173846 A1 | 6/2018 | Sigurjonsson et al. |
| 2018/0187241 A1 | 7/2018 | Selvaraj et al. |
| 2018/0201995 A1 | 7/2018 | Rabinowitz et al. |
| 2018/0237841 A1 | 8/2018 | Stray et al. |
| 2018/0251553 A1 | 9/2018 | McGranahan et al. |
| 2018/0265917 A1 | 9/2018 | Barany et al. |
| 2018/0288982 A1 | 10/2018 | Sinha |
| 2018/0298439 A1 | 10/2018 | Ryan et al. |
| 2018/0300448 A1 | 10/2018 | Rabinowitz et al. |
| 2019/0010543 A1 | 1/2019 | Babiarz et al. |
| 2019/0106737 A1 | 4/2019 | Underhill |
| 2019/0106751 A1 | 4/2019 | Zimmermann et al. |
| 2019/0185913 A1 | 6/2019 | Zimmermann et al. |
| 2019/0185936 A1 | 6/2019 | Babiarz et al. |
| 2019/0194743 A1 | 6/2019 | Ryan et al. |
| 2019/0194758 A1 | 6/2019 | Babiarz et al. |
| 2019/0194759 A1 | 6/2019 | Babiarz et al. |
| 2019/0203290 A1 | 7/2019 | Rabinowitz et al. |
| 2019/0203294 A1 | 7/2019 | Babiarz et al. |
| 2019/0211391 A1 | 7/2019 | Rabinowitz et al. |
| 2019/0211392 A1 | 7/2019 | Rabinowitz et al. |
| 2019/0211393 A1 | 7/2019 | Rabinowitz et al. |
| 2019/0211399 A1 | 7/2019 | Rabinowitz et al. |
| 2019/0211402 A1 | 7/2019 | Babiarz et al. |
| 2019/0211406 A1 | 7/2019 | Babiarz et al. |
| 2019/0249241 A1 | 8/2019 | Rabinowitz et al. |
| 2019/0256894 A1 | 8/2019 | Zimmermann et al. |
| 2019/0256906 A1 | 8/2019 | Rabinowitz et al. |
| 2019/0256907 A1 | 8/2019 | Ryan et al. |
| 2019/0256908 A1 | 8/2019 | Rabinowitz et al. |
| 2019/0256909 A1 | 8/2019 | Rabinowitz et al. |
| 2019/0256912 A1 | 8/2019 | Rabinowitz et al. |
| 2019/0256916 A1 | 8/2019 | Babiarz et al. |
| 2019/0256917 A1 | 8/2019 | Babiarz et al. |
| 2019/0256919 A1 | 8/2019 | Babiarz et al. |
| 2019/0256924 A1 | 8/2019 | Vogelstein et al. |
| 2019/0256931 A1 | 8/2019 | Babiarz et al. |
| 2019/0264277 A1 | 8/2019 | Rabinowitz et al. |
| 2019/0264280 A1 | 8/2019 | Rabinowitz et al. |
| 2019/0264288 A1 | 8/2019 | Rabinowitz et al. |
| 2019/0271043 A1 | 9/2019 | Babiarz et al. |
| 2019/0276888 A1 | 9/2019 | Rabinowitz et al. |
| 2019/0284623 A1 | 9/2019 | Rabinowitz et al. |
| 2019/0300950 A1 | 10/2019 | Rabinowitz et al. |
| 2019/0309358 A1 | 10/2019 | Rabinowitz et al. |
| 2019/0309359 A1 | 10/2019 | Zimmermann et al. |
| 2019/0309365 A1 | 10/2019 | Babiarz et al. |
| 2019/0316177 A1 | 10/2019 | Zimmermann et al. |
| 2019/0316184 A1 | 10/2019 | Zimmermann et al. |
| 2019/0316200 A1 | 10/2019 | Rabinowitz et al. |
| 2019/0323076 A1 | 10/2019 | Rabinowitz et al. |
| 2019/0360036 A1 | 11/2019 | Rabinowitz et al. |
| 2020/0024653 A1 | 1/2020 | Bethke |
| 2020/0032323 A1 | 1/2020 | Talasaz et al. |
| 2020/0109449 A1 | 4/2020 | Stamm et al. |
| 2020/0123612 A1 | 4/2020 | Babiarz et al. |
| 2020/0126634 A1 | 4/2020 | Sigurjonsson et al. |
| 2020/0140950 A1 | 5/2020 | Babiarz et al. |
| 2020/0149111 A1 | 5/2020 | Babiarz et al. |
| 2020/0157629 A1 | 5/2020 | Babiarz et al. |
| 2020/0172977 A1 | 6/2020 | Rabinowitz et al. |
| 2020/0181697 A1 | 6/2020 | Rabinowitz et al. |
| 2020/0190570 A1 | 6/2020 | Ryan et al. |
| 2020/0190573 A1 | 6/2020 | Rabinowitz et al. |
| 2020/0190591 A1 | 6/2020 | Rabinowitz et al. |
| 2020/0208196 A1 | 7/2020 | Zimmermann et al. |
| 2020/0208221 A1 | 7/2020 | Babiarz et al. |
| 2020/0224273 A1 | 7/2020 | Rabinowitz et al. |
| 2020/0232036 A1 | 7/2020 | Rabinowitz et al. |
| 2020/0248264 A1 | 8/2020 | Rabinowitz et al. |
| 2020/0248266 A1 | 8/2020 | Swanton et al. |
| 2020/0316498 A1 | 10/2020 | Mitchell |
| 2020/0318191 A1 | 10/2020 | Babiarz et al. |
| 2020/0347454 A1 | 11/2020 | Babiarz et al. |
| 2020/0350034 A1 | 11/2020 | Rabinowitz |
| 2020/0362415 A1 | 11/2020 | Rabinowitz et al. |
| 2020/0407788 A1 | 12/2020 | Ryan et al. |
| 2020/0407798 A1 | 12/2020 | Babiarz et al. |
| 2021/0009990 A1 | 1/2021 | Stray et al. |
| 2021/0025005 A1 | 1/2021 | Babiarz et al. |
| 2021/0054459 A1 | 2/2021 | Rabinowitz et al. |
| 2021/0071246 A1 | 3/2021 | Zimmermann et al. |
| 2021/0139969 A1 | 5/2021 | Mitchell et al. |
| 2021/0139983 A1 | 5/2021 | Mitchell et al. |
| 2021/0139988 A1 | 5/2021 | Mitchell et al. |
| 2021/0155988 A1 | 5/2021 | Rabinowitz et al. |
| 2021/0189498 A1 | 6/2021 | Babiarz et al. |
| 2021/0198733 A1 | 7/2021 | Moshkevich et al. |
| 2021/0198742 A1 | 7/2021 | Rabinowitz, et al. |
| 2021/0198743 A1 | 7/2021 | Rabinowitz et al. |
| 2021/0222230 A1 | 7/2021 | Zimmermann et al. |
| 2021/0222240 A1 | 7/2021 | Moshkevich et al. |
| 2021/0257048 A1 | 8/2021 | Zimmermann et al. |
| 2021/0269879 A1 | 9/2021 | Mitchell et al. |
| 2021/0324463 A1 | 10/2021 | Rabinowitz et al. |
| 2021/0327538 A1 | 10/2021 | Egilsson et al. |
| 2021/0327542 A1 | 10/2021 | Ryan et al. |
| 2021/0355536 A1 | 11/2021 | Rabinowitz et al. |
| 2022/0025455 A1 | 1/2022 | Zimmermann et al. |
| 2022/0025456 A1 | 1/2022 | Rabinowitz et al. |
| 2022/0033908 A1 | 2/2022 | Rabinowitz et al. |
| 2022/0033909 A1 | 2/2022 | Babiarz et al. |
| 2022/0042103 A1 | 2/2022 | Rabinowitz et al. |
| 2022/0056509 A1 | 2/2022 | Zimmermann |
| 2022/0056534 A1 | 2/2022 | Rivers |
| 2022/0073978 A1 | 3/2022 | Rabinowitz et al. |
| 2022/0073979 A1 | 3/2022 | Rabinowitz et al. |

FOREIGN PATENT DOCUMENTS

| | | |
|---|---|---|
| CN | 101675169 A | 3/2010 |
| CN | 104736722 A | 6/2015 |
| CN | 105229175 A | 1/2016 |
| EP | 0270017 A2 | 6/1988 |
| EP | 1325963 A1 | 7/2003 |
| EP | 1524321 A1 | 4/2005 |
| EP | 1325963 B1 | 9/2006 |
| EP | 1524321 B1 | 7/2009 |
| EP | 2163622 A1 | 3/2010 |
| EP | 2128169 A1 | 12/2010 |
| EP | 2902500 A1 | 8/2015 |
| EP | 3026124 A1 | 6/2016 |

(56) References Cited

FOREIGN PATENT DOCUMENTS

| | | |
|---|---|---|
| EP | 3285193 A1 | 2/2018 |
| EP | 2877594 B1 | 12/2019 |
| EP | 3187597 B1 | 6/2020 |
| EP | 3134541 B1 | 8/2020 |
| EP | 3760730 A1 | 1/2021 |
| EP | 3760731 A1 | 1/2021 |
| EP | 3760732 A1 | 1/2021 |
| EP | 3824470 | 5/2021 |
| EP | 3443119 B1 | 2/2022 |
| GB | 2488358 | 8/2012 |
| JP | 2965699 | 8/1999 |
| JP | 2002-530121 A | 9/2002 |
| JP | 2002-300894 A | 10/2002 |
| JP | 2003/521252 A | 7/2003 |
| JP | 2004502466 A | 1/2004 |
| JP | 2004533243 A | 11/2004 |
| JP | 2005514956 A | 5/2005 |
| JP | 2005160470 A | 6/2005 |
| JP | 2006-254912 A | 9/2006 |
| JP | 2008-263974 A | 11/2008 |
| JP | 2008/271980 A | 11/2008 |
| JP | 2010-509922 A | 4/2010 |
| JP | 2011/508662 A | 3/2011 |
| JP | 2011/516069 A | 5/2011 |
| JP | 2015-535681 | 12/2015 |
| RU | 2290078 C1 | 12/2006 |
| WO | 95/01796 | 1/1995 |
| WO | 1996036736 A2 | 11/1996 |
| WO | 98/39474 | 9/1998 |
| WO | 98/44151 | 10/1998 |
| WO | 00/18957 | 4/2000 |
| WO | 2001007640 A2 | 2/2001 |
| WO | 0134844 A1 | 5/2001 |
| WO | 01/57269 A2 | 8/2001 |
| WO | 179851 A1 | 10/2001 |
| WO | 200190419 A2 | 11/2001 |
| WO | 2002004672 A2 | 1/2002 |
| WO | 02/44411 A1 | 6/2002 |
| WO | 2002055985 A2 | 7/2002 |
| WO | 02/070751 A1 | 9/2002 |
| WO | 2002076377 | 10/2002 |
| WO | 02/090505 A2 | 11/2002 |
| WO | 03/000919 A2 | 1/2003 |
| WO | 03/018757 A3 | 3/2003 |
| WO | 03/020974 A3 | 3/2003 |
| WO | 2003031646 A1 | 4/2003 |
| WO | 3050532 A1 | 6/2003 |
| WO | 2003062441 A1 | 7/2003 |
| WO | 3102595 A1 | 12/2003 |
| WO | 3106623 A2 | 12/2003 |
| WO | 2004/051218 A2 | 6/2004 |
| WO | 2004069849 A2 | 8/2004 |
| WO | 2004070005 A2 | 8/2004 |
| WO | 2004070007 A2 | 8/2004 |
| WO | 2004087863 A2 | 10/2004 |
| WO | 2005003375 A2 | 1/2005 |
| WO | 2005021793 A1 | 3/2005 |
| WO | 2005023091 A2 | 3/2005 |
| WO | 2005030999 A1 | 4/2005 |
| WO | 2005035725 A2 | 4/2005 |
| WO | 2005/039389 A3 | 5/2005 |
| WO | 2005100401 A2 | 10/2005 |
| WO | 2005123779 A2 | 12/2005 |
| WO | 2007145612 A1 | 6/2006 |
| WO | 2006110855 A2 | 10/2006 |
| WO | 2006/128192 A2 | 11/2006 |
| WO | 2007/011903 A3 | 1/2007 |
| WO | 2007/052006 A1 | 5/2007 |
| WO | 2007057647 A1 | 5/2007 |
| WO | 2007062164 A3 | 5/2007 |
| WO | 2007/073171 A2 | 6/2007 |
| WO | 2007070280 A2 | 6/2007 |
| WO | 2007070482 A2 | 6/2007 |
| WO | 2007075836 A2 | 7/2007 |
| WO | 2007/092473 A2 | 8/2007 |
| WO | 2007086935 A2 | 8/2007 |
| WO | 2007/117256 A1 | 10/2007 |
| WO | 2007117039 A1 | 10/2007 |
| WO | 2007132167 A2 | 11/2007 |
| WO | 2007/147073 A2 | 12/2007 |
| WO | 2007/147076 A2 | 12/2007 |
| WO | 2007140417 A2 | 12/2007 |
| WO | 2007147074 A2 | 12/2007 |
| WO | 2007147079 A2 | 12/2007 |
| WO | 2008024473 A2 | 2/2008 |
| WO | 2008048931 A1 | 4/2008 |
| WO | 2008/061213 A2 | 5/2008 |
| WO | 2008051928 A2 | 5/2008 |
| WO | 2008056937 A1 | 5/2008 |
| WO | 2008059578 A1 | 5/2008 |
| WO | 2008079374 A2 | 7/2008 |
| WO | 2008081451 A2 | 7/2008 |
| WO | 2008084405 A2 | 7/2008 |
| WO | 2008115427 A2 | 9/2008 |
| WO | 2008115497 A2 | 9/2008 |
| WO | 2008118988 A1 | 10/2008 |
| WO | 2008135837 A2 | 11/2008 |
| WO | 2008157264 A2 | 12/2008 |
| WO | 2009009769 A2 | 1/2009 |
| WO | 2009013492 A1 | 1/2009 |
| WO | 2009013496 A1 | 1/2009 |
| WO | 2009019215 A1 | 2/2009 |
| WO | 2009019455 A2 | 2/2009 |
| WO | 2009/032779 A2 | 3/2009 |
| WO | 2009/036525 A2 | 3/2009 |
| WO | 2009030100 A1 | 3/2009 |
| WO | 2009032781 A2 | 3/2009 |
| WO | 2009033178 A1 | 3/2009 |
| WO | 2009049889 A1 | 4/2009 |
| WO | 2009017784 A1 | 5/2009 |
| WO | 2009064897 A2 | 5/2009 |
| WO | 2009091934 A1 | 7/2009 |
| WO | 2009092035 A2 | 7/2009 |
| WO | 2009/105531 A1 | 8/2009 |
| WO | 2009099602 A1 | 8/2009 |
| WO | 2009100029 A1 | 8/2009 |
| WO | 2009105531 A1 | 8/2009 |
| WO | 2009117122 A2 | 9/2009 |
| WO | 2009120808 A2 | 10/2009 |
| WO | 2009145828 A2 | 12/2009 |
| WO | 2009146335 A1 | 12/2009 |
| WO | 2010014920 A1 | 2/2010 |
| WO | 2010017214 A1 | 2/2010 |
| WO | 2010/033639 A2 | 3/2010 |
| WO | 2010/033652 A1 | 3/2010 |
| WO | 2010033578 A2 | 3/2010 |
| WO | 2010042831 A2 | 4/2010 |
| WO | 2010045617 A2 | 4/2010 |
| WO | 2010075459 | 7/2010 |
| WO | 2010/088288 A2 | 8/2010 |
| WO | 2010115016 A2 | 10/2010 |
| WO | 2010115154 A1 | 10/2010 |
| WO | 2010118016 A2 | 10/2010 |
| WO | 2010/127186 A1 | 11/2010 |
| WO | 2011/023078 A1 | 3/2011 |
| WO | 2011/032078 A1 | 3/2011 |
| WO | 2011041485 A1 | 4/2011 |
| WO | 2011/051283 A1 | 5/2011 |
| WO | 2011/057061 A1 | 5/2011 |
| WO | 2011057094 | 5/2011 |
| WO | 2011/090556 A1 | 7/2011 |
| WO | 2011087760 | 7/2011 |
| WO | 2011/102998 A2 | 8/2011 |
| WO | 2011109440 A1 | 9/2011 |
| WO | 2011140433 A2 | 11/2011 |
| WO | 2011146632 A1 | 11/2011 |
| WO | 2012/019200 A2 | 2/2012 |
| WO | 2012/028746 A1 | 3/2012 |
| WO | 2012042374 A2 | 4/2012 |
| WO | 2012-058488 A1 | 5/2012 |
| WO | 201283250 | 6/2012 |
| WO | 2012088456 A2 | 6/2012 |
| WO | 20120071621 | 6/2012 |
| WO | 2012108920 A1 | 8/2012 |

(56) References Cited

FOREIGN PATENT DOCUMENTS

| | | |
|---|---|---|
| WO | 2012/142531 A2 | 10/2012 |
| WO | 2007/149791 A2 | 12/2012 |
| WO | 2013030577 | 3/2013 |
| WO | 2013/045432 A1 | 4/2013 |
| WO | 2013/049892 A1 | 4/2013 |
| WO | 2013052557 A2 | 4/2013 |
| WO | 2013/078470 A2 | 5/2013 |
| WO | 2013/086464 A1 | 6/2013 |
| WO | 2013/123220 A1 | 8/2013 |
| WO | 2013/138510 A1 | 9/2013 |
| WO | 2013/138510 A9 | 9/2013 |
| WO | 20130130848 | 9/2013 |
| WO | 2013/159035 A2 | 10/2013 |
| WO | 2013/169339 A1 | 11/2013 |
| WO | 2013/177220 A1 | 11/2013 |
| WO | 2013/181651 A1 | 12/2013 |
| WO | 2014/004726 A1 | 1/2014 |
| WO | 2014/014497 A1 | 1/2014 |
| WO | 20140018080 | 1/2014 |
| WO | 2014/035986 A1 | 3/2014 |
| WO | 2014/122288 A1 | 8/2014 |
| WO | 2014/145078 A1 | 9/2014 |
| WO | 2014/145232 A2 | 9/2014 |
| WO | 2014/149134 A2 | 9/2014 |
| WO | 2014/150300 A2 | 9/2014 |
| WO | 2014/151117 A1 | 9/2014 |
| WO | 2014/194113 A2 | 12/2014 |
| WO | 2015/048535 A1 | 4/2015 |
| WO | 2015/100427 A1 | 7/2015 |
| WO | 2015/148494 A1 | 10/2015 |
| WO | 2015/164432 A1 | 10/2015 |
| WO | 2016/009059 A1 | 1/2016 |
| WO | 2016009224 A1 | 1/2016 |
| WO | 2016/063122 A1 | 4/2016 |
| WO | 2016/065295 A1 | 4/2016 |
| WO | 2016/123698 A1 | 4/2016 |
| WO | 2016/077313 A1 | 5/2016 |
| WO | 2016/138080 A1 | 9/2016 |
| WO | 2016/17662 A1 | 11/2016 |
| WO | 2016/183106 A1 | 11/2016 |
| WO | 2016/193490 A1 | 12/2016 |
| WO | 2017/058784 A1 | 4/2017 |
| WO | 2017/181146 A1 | 10/2017 |
| WO | 2017/181202 A2 | 10/2017 |
| WO | 2017/190106 A1 | 11/2017 |
| WO | 2017205540 A1 | 11/2017 |
| WO | 2018/009723 A1 | 1/2018 |
| WO | 2018/083467 A1 | 5/2018 |
| WO | 2018/085603 A1 | 5/2018 |
| WO | 2018/106798 A1 | 6/2018 |
| WO | 2018/136562 A2 | 7/2018 |
| WO | 2018/156418 A1 | 8/2018 |
| WO | 2018/237081 A1 | 12/2018 |
| WO | 2019/046817 A1 | 3/2019 |
| WO | 2019/118926 A1 | 6/2019 |
| WO | 2019/140298 A1 | 7/2019 |
| WO | 2019/161244 A1 | 8/2019 |
| WO | 2019/200228 A1 | 10/2019 |
| WO | 2019/241349 A1 | 12/2019 |
| WO | 2020/010255 A1 | 1/2020 |
| WO | 2020/018522 A1 | 1/2020 |
| WO | 2020/041449 A1 | 2/2020 |
| WO | 2020/076957 A1 | 4/2020 |
| WO | 20220/106987 A1 | 5/2020 |
| WO | 2020/131699 A2 | 6/2020 |
| WO | 2020/214547 A1 | 10/2020 |
| WO | 2020/247263 A1 | 12/2020 |
| WO | 2021/055968 A1 | 3/2021 |
| WO | 2007100911 A2 | 9/2021 |
| WO | 2021/243045 A1 | 12/2021 |
| WO | 2022/015676 A1 | 1/2022 |

OTHER PUBLICATIONS

"European Application No. 014198110, European Search Report dated Apr. 28, 2015, 3 pages."

"Finishing the Euchromatic Sequence of the Human Genome", Nature vol. 431,(Oct. 21, 2004),931-945.

"FixedMedium, dictionary definition, Academic Press Dictionary of Science andTechnology", Retrieved from the Internet: <URL:www.credoreference.com/entry/apdst/fixed_medium>, 1996, 1 pg.

"GeneticsHome Reference", http://ghr.nlm.nih.gov/handbook/genomicresearch/snp, Feb. 28, 2014, 1-2.

"Ion Ampli Seq Comprehensive Cancer Panel, product brochure, Life TechnologiesCorporation. Retrieved from the Internet", <URL:https://tools.lifetechnologies.com/content/sfs/brochures/Ion_CompCancerPanel_Flyer.pdf>, 2012, 2 pgs.

"Multiplexing with RainDrop Digital PCR", RainDance Technologies, Application Note, 2013, 1-2.

"NucleicAcids, Linkers and Primers: Random Primers", New England BioLabs 1998/99Catalog, 1998, 121 and 284.

"PRIMER3, information sheet, Sourceforge.net. [retrieved on Nov. 12, 2012]. Retrieved from the Internet: <URL:http://primer3.sourceforge.net/>", 2009, 1 pg.

"Db SNP rs2056688 (http://www.ncbi.nlm.nih.gov/projects/SNP/snp_ref.cgi?rs=2056688, downloaded May 4, 2015", 3 pages.

PRNewswire (Research Suggests Daily Consumption of Orange Juice Can Reduce Blood Pressure and May Provide Beneficial Effects to Blood Vessel Function: New Study Identified Health Benefits in Orange Juice, Dec. 8, 2010), 3 pages.

What to Expect (Weird Harmony results, May 1, 2015), 7 pages.

The Bump (Panorama Test, attached, Jul. 1, 2013), 8 pages.

"Blast of AAAAAAAAATTTAAAAAAAAATTT(http://blast.ncbi.nlm.nih.gov/Blast.cgi, downloaded May 4, 2015)", 9 pages.

"Guideline related to genetic examination", Societies Related to Genetic Medicine, Japanese Society for Genetic Counseling, Japanese Society for Gene Diagnosis and Therapy, Japan Society of Obstetrics and Gynecology, 2003, 2-15.

"How Many Carbs in a Potato?, [Online]", Retrieved from the Internet: <http://www.newhealthguide.org/How-Many-Carbs-In-A-Potato.html>, Nov. 1, 2014, 3 pages.

"Random variable", In The Penguin Dictionary of Mathematics. Retrieved from http://www.credoreference.com/entry/penguinmath/random _ variable, 2008, 1 page.

Abbosh, C. et al., "Phylogenetic ctDNA analysis depicts early-stage lung cancer evolution", Nature, vol. 545, May 25, 2017, 446-451.

Abidi, S. et al., "Leveraging XML-based electronic medical records to extract experiential clinical knowledge: An automated approach to generate cases for medical case-based reasoning systems", International Journal of Medical Informatics, 68(1-3), 2002, 187-203.

Agarwal, Ashwin. et al., "Commercial Landscape of Noninvasive Prenatal Testing in the United States", Prenatal Diagnosis,33, 2013, 521-531.

Alaeddini, R. et al., "Forensic implications of genetic analyses from degraded DNA—A review", Forensic Science International: Genetics, vol. 4, 2010, 148-157.

Alberts, B. et al., "Chapter 20: Germ Cells and Fertilization", Molecular Biology of the Cell, Fourth Edition, 2002, 1127-1156.

Alberts, B. et al., "Chapter 4: DNA and Chromosomes", Molecular Biology of the Cell, Fourth Edition, 2002, 191-234.

Alkan, Can et al., "Personalized Copy Number and Segmental Duplication Maps Using Next-Generation Sequencing", Nature Genetics, 41, 10, 2009, 1061-1068.

Allaire, F R. , "Mate selection by selection index theory", Theoretical Applied Genetics, 57(6), 1980, 267-272.

Allan, J. et al., "Micrococcal Nuclease Does Not Substantially Bias Nucleosome Mapping", Journal of Molecular Biology, vol. 417, Jan. 30, 2012, 152-164.

Allawi, Hatim T. et al., "Thermodynamics of internal C•T Mismatches in DNA", Nucleic Acids Research, 26 (11), 1998, 2694-2701.

(56) References Cited

OTHER PUBLICATIONS

Andras, S. C. et al., "Strategies for Signal Amplification in Nucleic Acid Detection", Molecular Biotechnology, vol. 19, 2001, 29-44.
Anker, P. et al., "Detection of circulating tumour DNA in the blood (plasma/serum) of cancer patients", Cancer and Metastasis Reviews, vol. 18, 1999, 65-73.
Antonarakis, S. E. et al., "Chromosome 21 and Down Syndrome: From Genomics to Pathophysiology", Nature Reviews Genetics, vol. 5, Oct. 2004, 725-738.
Aoki, Yasuhiro, "Statistical and Probabilistic Bases of Forensic DNA Testing", The Journal of the Iwate Medical Association, 2002, vol. 54, p. 81-94.
Ashoor, G. et al., "Fetal fraction in maternal plasma cell-free DNA at 11-13 weeks' gestation: relation to maternal and fetal characteristics", Ultrasound in Obstetrics and Gynecology, vol. 41, 2013, 26-32.
Ashoor, Ghalia et al., "Chromosome-Selective Sequencing of Maternal Plasma Cell-Free DNA for First-Trimester Detection of Trisomy 21 and Trisomy 18", American Journal of Obstetrics & Gynecology, 206, 2012, 322.e1-322.e5.
Ashoor, Ghalia et al., "Fetal Fraction in Maternal Plasma Cell-Free DNA at 11-13 Weeks' Gestation: Effect of Maternal and Fetal Factors", Fetal Diagnosis Therapy, 2012, 1-7.
Bada, Michael A. et al., "Computational Modeling of Structural Experimental Data", Methods in Enzymology,317, 2000, 470-491.
Ballif, B. C. et al., "Detection of Low-Level Mosaicism by Array CGH in Routine Diagnostic Specimens", American Journal of Medical Genetics Part A, vol. 140A, 2006, 2757-2767.
Beaumont, Mark A et al., "The Bayesian Revolution in Genetics", Nature Reviews Genetics, 5, 2004, 251-261.
Beck, J. et al., "Digital Droplet PCR for Rapid Quantification of Donor Dna in the Circulation of Transplant Recipients as a Potential Universal Biomarker of Graft Injury", Clinical Chemistry, vol. 59, No. 12, 2013, 1732-1741.
Beer, Alan E. et al., "The Biological Basis of Passage of Fetal Cellular Material into the Maternal Circulation", Annals New York Academy of Sciences, 731, 1994, 21-35.
Beerenwinkel, et al., "Methods for Optimizing Antiviral Combination Therapies", Bioinformatics, 19(1), 2003, i16-i25.
Beerenwinkel, N. et al., "Geno2pheno: estimating phenotypic drug resistance from HIV-1 genotypes", Nucleic Acids Research, 31(13), 2003, 3850-3855.
Benn, P. et al., "Non-Invasive Prenatal Testing for Aneuploidy: Current Status and Future Prospects", Ultrasound Obstet Gynecol, 42, 2013, 15-33.
Benn, P et al., "Non-Invasive prenatal Diagnosis for Down Syndrome: the Paradigm Will Shift, but Slowly", Ultrasound Obstet. Gynecol., 39, 2012, 127-130.
Bentley, David R et al., "Accurate Whole Human Genome Sequencing Using Reversible Terminator Chemistry", Nature, 456, 6, 2008, 53-59.
Bermudez, M. et al., "Single-cell sequencing and mini-sequencing for preimplantation genetic diagnosis", Prenatal Diagnosis, 23, 2003, 669-677.
Beroud, C. et al., "Prenatal diagnosis of spinal muscular atrophy by genetic analysis of circulating fetal cells", The Lancet, vol. 361, Mar. 22, 2003, 1013-1014.
Bevinetto, Gina, Bevinetto (5 Foods All Pregnant Women Need, American Baby, available at http://www.parents.com/pregnancy/mybody/nutrition/5greatpregnancyfoods/, Apr. 15, 2008), 8 pgs.
Bianchi, D W. et al., "Fetal gender and aneuploidy detection using fetal cells maternal blood: analysis of NIFTY I data", Prenat Diagn 2002; 22, 2002, 609-615.
Bianchi, D. W., "Circulating Fetal DNA: Its Origin and Diagnostic Potential—A Review", Placenta, vol. 25, Supplemental A, May 2004, S93-S101.
Bianchi, D. W. et al., "Genome-Wide Fetal Aneuploidy Detection by Maternal Plasma DNA Sequencing", Obstetrics & Gynecology, vol. 119, No. 5, May 2012, 890-901.
Bianchi, D. W., "Review: Fetal Cells in the Maternal Circulation: Feasibility for Prenatal Diagnosis", British Journal of Haematology, vol. 105, 1999, 574-583.
Birch, Lyndsey et al., "Accurate and Robust Quantification of Circulating Fetal and Total DNA in Maternal Plasma from 5 to 41 Weeks of Gestation", Clinical Chemistry, 51(2), 2005, 312-320.
Birkenkamp-Demtroder, K. et al., "Abstract 3653: Sequencing of plasma cfDNA from patients with locally advanced bladder cancer for surveillance and therapeutic efficacy monitoring", Cancer Research, vol. 78, No. 13 Supplement, Jul. 2019, 1 page.
Bisignano, et al., "PGD and Aneuploidy Screening for 24 Chromosomes: Advantages and Disadvantages of Competing Platforms", Reproductive BioMedicine Online, 23, 2011, 677-685.
Bodenreider, O., "The Unified Medical Language System (UMLS): Integrating Biomedical Terminology", Nucleic Acids Research, 32, (Database issue), 2004, D267-D270.
Breithaupt, Holger, "The Future of Medicine", EMBO Reports, 21(61), 2001, 465-467.
Brownie, Jannine et al., "The Elimination of Primer-Dimer Accumulation in PCR", Nucleic Acids Research, 25(16), 1997, 3235-3241.
Burkova, E. E. et al., "Extremely Stable Soluble High Molecular Mass Multi-Protein Complex with DNase Activity in Human Placental Tissue", PLOS One, vol. 9, No. 11: e011234, Nov. 26, 2014, 26 pages.
Burnham, P. et al., "Myriad Applications of Circulating Cell-Free DNA in Precision Organ Transplant Monitoring", Annals of the American Thoracic Society, vol. 14, Supplement 3, Sep. 2017, S237-S241.
Butler, J. et al., "The Development of Reduced Size STR Amplicons as Tools for Analysis of Degraded DNA", Journal of Forensic Sciences, vol. 48, No. 5, 2003, 1054-1064.
Butt, A. N. et al., "Overview of Circulating Nucleic Acids in Plasma/Serum: Update on Potential Prognostic and Diagnostic Value in Diseases Excluding Fetal Medicine and Oncology", Ann. N.Y. Acad. Sci., vol. 1137, 2008, 236-242.
Cairns, Paul et al., "Homozygous Deletions of 9p21 in Primary Human Bladder Tumors Detected by Comparative Multiplex Polymerase Chain Reaction", Cancer Research, 54, 1994, 1422-1424.
Caliendo, Angela, "Multiplex PCR and Emerging Technologies for the Detection of Respiratory Pathogens", Clinical Infectious Diseases, 52(4), 2011, S326-S330.
Cansar, , "Hs-578-T—Copy Number Variation—Cell Line Synopsis", ICR Cancer Research UK, Retrieved on Mar. 26, 2018 from https://cansar.icr.ac.uk/cansar/cell-lines/Hs-578-T/copy_number_variation/chromosome_8/, Mar. 26, 2018, 50 pgs.
Carnevale, Alessandra et al., "Attitudes of Mexican Geneticists Towards Prenatal Diagnosis and Selective Abortion", American Journal of Medical Genetics, 75, 1998, 426-431.
Carvalho, B. et al., "Exploration, normalization, and genotype calls of high-density oligonucleotide SNP array data", Biostatistics, vol. 8, No. 2, 2007, 485-499.
Casbon, J. A. et al., "A method for counting PCR template molecules with application to next-generation sequencing", Nucleic Acids Research, vol. 39, No. 12, Apr. 13, 2011, 1-8.
Chakraborty, R. et al., "Paternity Exclusion by DNA Markers: Effects of Paternal Mutations", Journal of Forensic Sciences, vol. 41, No. 4, Jul. 1996, 671-677.
Chan, K.C. et al., "Size Distributions of Maternal and Fetal DNA in Maternal Plasma", Clinical Chemistry, vol. 50, No. 1, 2004, 88-92.
Chang, H.W. et al., "Assessment of Plasma DNA Levels, Allelic Imbalance, and CA 125 as Diagnostic Tests for Cancer", Journal of the National Cancer Institute, vol. 94, No. 22, Nov. 20, 2002, 1697-1703.
Chen, E. et al., "Noninvasive Prenatal Diagnosis of Fetal Trisomy 18 and Trisomy 13 by Maternal Plasma DNA Sequencing", PLoS ONE, 6(7), e21791, 2011, 7 pgs.
Chen, X. Q. et al., "Microsatallite alterations in plasma DNA of small cell lung cancer patients", Nature Medicine, vol. 2, No. 9, Sep. 1996, 1033-1035.
Chetty, Shilpa et al., "Uptake of Noninvasive Prenatal Testing (NIPT) in Women Following Positive Aneuploidy Screening", Prenatal Diagnosis,33, 2013, 542-546.

(56) References Cited

OTHER PUBLICATIONS

Cheung, S. W. et al., "Rapid Publication: Microarray-Based CGH Detects Chromosomal Mosaicism Not Revealed by Conventional Cytogenetics", American Journal of Medical Genetics Part A, vol. 143A, 2007, 1679-1686.

Cheung, V. G. et al., "Whole genome amplification using a degenerate oligonucleotide primer allows hundreds of genotypes to be performed on less than one nanogram of genomic DNA", Proceedings of the National Academy of Sciences, USA, vol. 93, Dec. 1996, 14676-14679.

Chiu, R. et al., "Non-Invasive Prenatal Assessment of Trisomy 21 by Multiplexed Maternal Plasma DNA Sequencing: Large Scale Validity Study", BMJ, 342, c7401, 2011, 9 pgs.

Chiu, Rossa W. et al., "Effects of Blood-Processing Protocols on Fetal and Total DNA Quantification in Maternal Plasma", Clinical Chemistry, 47(9), 2001, 1607-1613.

Chiu, Rossa W.K. et al., "Maternal Plasma DNA Analysis with Massively Parallel Sequencing by Litigation for Noninvasive Prenatal Diagnosis of Trisomy 21", Clinical Chemistry, 56, 3, 2010, 459-463.

Chiu, Rossa W.K. et al., "Non-Invasive Prenatal Diagnosis by Single Molecule Counting Technologies", Trends in Genetics, 25 (7), 2009, 324-331.

Chiu, Rossa W.K. et al., "Noninvasive Prenatal Diagnosis of Fetal Chromosomal Aneuploidy by Massively Parallel Genomic Sequencing of DNA in Maternal Plasma (with Supporting Information)", PNAS, vol. 105, No. 51, 2008, 20458-20463.

Choi, M. et al., "Genetic diagnosis by whole exome capture and massively parallel DNA sequencing", PNAS, vol. 106, No. 45, Nov. 10, 2009, 19096-19101.

Chu, T. et al., "Statistical Considerations for Digital Approaches to Non-Invasive Fetal Genotyping", Bioinformatics (Advance Access publication), 26 (22), 2010, 2863-2866.

Chu, Tianjiao et al., "Statistical Model for Whole Genome Sequencing and its Application to Minimally Invasive Diagnosis of Fetal Genetic Disease", Bioinformatics, 25(10), 2009, 1244-1250.

Chu, Tianjiao. et al., "A Novel Approach Toward the Challenge of Accurately Quantifying Fetal DNA in Maternal Plasma", Prenatal Diagnosis,30, 2010, 1226-1229.

Cole, Neal W. et al., "Hyperglycemia-Induced Membrane Lipid Peroxidation and Elevated Homocysteine Levels Are Poorly Attenuated by Exogenous Folate in Embryonic Chick Brains", Comparative Biochemistry and Physiology, Part B, 150, 2008, 338-343.

Colella, S. et al., "QuantiSNP: an Objectives Bayes Hidden-Markov Model to Detect and Accurately Map Copy Number Variation Using SNP Genotyping Data", Nucleic Acids Research, 35 (6), 2007, 2013-2025.

Conlin, L. K. et al., "Mechanisms of mosaicism, chimerism and uniparental disomy identified by single nucleotide polymorphism array analysis", Human Molecular Genetics, vol. 19, No. 7, Jan. 6, 2010, 1263-1275.

Coombes, R. C., "Abstract P4-01-02: Early detection of residual breast cancer through a robust, scalable and personalized analysis of circulating tumour DNA (ctDNA) antedates overt metastatic recurrence", Cancer Research, vol. 79, No. 4 Supplement, Feb. 15, 2019.

Cossu, Gianfranco et al., "Rh D/d Genotyping by Quantitative Polymerase Chain Reaction and Capillary Zone Electrophoresis", Electrophoresis, 17, 1996, 1911-1915.

Coyle, J. F. et al., "Standards for detailed clinical models as the basis for medical data exchange and decision support", International Journal of Medical Informatics, 69(2-3), 2003, 157-174.

Craig, D. W. et al., "Identification of genetic variants using barcoded multiplexed sequencing", Nature Methods, vol. 5, Oct. 2008, 887-893.

Cross, Jillian et al., "Resolution of trisomic mosaicism in prenatal diagnosis: estimated performance of a 50K SNP microarray", Prenat Diagn 2007; 27, 2007, 1197-1204.

D'Aquila, Richard et al., "Maximizing sensitivity and specificity of PCR by pre-amplification heating", Nucleic Acids Research, 19(13), 1991, p. 3749.

Daruwala, Raoul-Sam et al., "A Versatile Statistical Analysis Algorithm to Detect Genome Copy Number Variation", PNAS, 101(46), 2004, 16292-16297.

Dawson, S.J. et al., "Analysis of Circulating Tumor DNA to Monitor Metastatic Breast Cancer", The New England Journal of Medicine, vol. 368, No. 13, Mar. 28, 20136, 1199-1209.

De Bruin, E. et al., "Spatial and temporal diversity in genomic instability processes defines lung cancer evolution", Science, vol. 346, No. 6206, Oct. 10, 2014, 251-256.

De Vries, et al., "Diagnostic genome profiling in mental retardation", Am J Hum Genet, 77, published online Aug. 30, 2005, 2005, 606-616.

Deangelis, M. et al., "Solid-phase Reversible Immobilization for the Isolation of PCR Products", Nucleic Acids Research, 23 (22), 1995, 4742-4743.

Deng, S. et al., "TNER: A Novel Background Error Suppression Method for Mutation Detection in Circulating Tumor DNA", bioRxiv, http://dx.doi.org/10.1101/214379, Nov. 5, 2017, 12 pgs.

Deutsch, S. et al., "Detection of aneuploidies by paralogous sequence quantification", J Med Genet, vol. 41, 2004, 908-915.

Devaney, S. et al., "Noninvasive Fetal Sex Determination Using Cell-Free Fetal DNA: A Systematic Review and Meta-analysis", JAMA, 306(6), 2011, 627-636.

Dhallan, et al., "Methods to Increase the Percentage of Free Fetal DNA Recovered from the Maternal Circulation", JAMA, 291(9), 2004, 1114-1119.

Dhallan, Ravinder et al., "A non-invasive test for prenatal diagnosis based on fetal DNA present in maternal blood: a preliminary study", The Lancet, 369, 2007, 474-481.

Dieffenbach, C W. et al., "General concepts for PCR primer design", Genome Research. PCR methods and Applications vol. 3, 1993, S30-S37.

Diehl, F. et al., "Circulating mutant DNA to assess tumor dynamics", Nature Medicine, vol. 14, No. 9, Jul. 31, 2008, 985-990.

Dietmaier, W. et al., "Multiple Mutation Analyses in Single Tumor Cells with Improved Whole Genome Amplification", American Journal of Pathology, vol. 154, No. 1, Jan. 1999, 83-95.

Ding, C et al., "Direct molecular haplotyping of long-range genomic Dna with M1-PCR", PNAS 100(13), 2003, 7449-7453.

Dodge, Y., "Bayes' Theorem", The Concise Encyclopedia of Statistics, 2008, 30-31.

Dohm, J. et al., "Substantial Biases in Ultra-Short Read Data Sets From High-Throughput DNA Sequencing", Nucleic Acids Research, 36 (16), e105, 2008, 10 pgs.

Dolganov, Gregory et al., "A Novel Method of Gene Transcript Profiling in Airway Biopsy Homogenates Reveals Increased Expression of a Na—K+—Cl-Cotransporter (NKCC1) in Asthmatic Subjects", Genome Res.,11, 2001, 1473-1483.

Donaghue, C. et al., "Detection of mosaicism for primary trisomies in prenatal samples by QF-PCR and karyotype analysis", Prenatal Diagnosis, vol. 25, 2005, 65-72.

Donohoe, Gerard G et al., "Rapid Single-Tube Screening of the C282Y Hemochromatosis Mutation by Real-Time Multiplex Allele-specific PCR without Fluorescent Probes", Clinical Chemistry, 46, 10, 2000, 1540-1547.

Donoso, P. et al., "Current Value of Preimplantation Genetic Aneuploidy Screening in IVF", Human Reproduction Update, 13(1), 2007, 15-25.

Echeverri, et al., "Caffeine's Vascular Mechanisms of Action", International Journal of Vascular Medicine vol. 2010(2010), 10 pages, Aug. 25, 2010.

Ehrich, Mathias et al., "Noninvasive Detection of Fetal Trisomy 21 by Sequencing of DNA in Maternal Blood: A Study in a Clinical Setting", American Journal of Obstetrics & Gynecology, 204, 2011, 205.e1-205.e11.

Eichler, H, "Mild Course of Fetal Rh D Haemolytic Disease due to Maternal Alloimmunisation to Paternal HLA Class I and II Antigens", Vox Sang, 68, 1995, 243-247.

Ellison, Aaron M., "Bayesian Inference in Ecology", Ecology Letters, vol. 7, 2004, 509-520.

Ellonen, P. et al., "Development of SNP Microarray for Supplementary Paternity Testing", International Congress Series,1261, 2004, 12-14.

(56) References Cited

OTHER PUBLICATIONS

EP06838311.6, , "European Communication and Extended European Search Report", dated Dec. 30, 2008, 8 pgs.
EP08742125.1, , "European Communication pursuant to Article 94(3) EPC and Examination Report", dated Feb. 12, 2010, 5 pgs.
Everitt, B. S. , "Medical Statistics From A to Z", 2003, 3 pages.
Fan, et al., "Whole-genome molecular haplotyping of single cells", Nature Biotechnology, vol. 29, No. 1, Jan. 1, 2011, 51-57.
Fan, Christina H. et al., "Non-Invasive Prenatal Measurement of the Fetal Genome", Nature, doi:10.1038/nature11251, 2012, 26 pgs.
Fan, Christina H et al., "Noninvasive Diagnosis of Fetal Aneuploidy by Shotgun Sequencing DNA from Maternal Blood", PNAS, 105, 42, 2008, 16266-16271.
Fan, H. C. et al., "Microfluidic digital PCR enables rapid prenatal diagnosis of fetal aneuploidy", American Journal of Obstetrics & Gynecology, vol. 200, May 2009, 543.e1-543.e7.
Fan, H. Christina et al., "Sensitivity of Noninvasive Prenatal Detection of Fetal Aneuploidy from Maternal Plasma Using Shotgun Sequencing Is Limited Only by Counting Statistics", PLoS ONE, vol. 5, Issue 5 (e10439), May 3, 2010, 1-6.
Fan, Jian-Bing et al., "Highly Parallel Genomic Assay", Nature Reviews, 7, 2006, 632-644.
Fat Secret, , "5 Foods to Never Eat", "www.fatsecret.com" (printed from internet Nov. 1, 2014)., 2 pages.
Fazio, Gennaro. et al., "Identification of RAPD Markers Linked to Fusarium Crown and Root Rot Resistance (Frl) in Tomato", Euphytica 105, 1999, 205-210.
Fiorentino, F. et al., "Development and Clinical Application of a Strategy for Preimplantation Genetic Diagnosis of Single Gene Disorders Combined with HLA Matching", Molecular Human Reproduction (Advance Access publication), 10 (6), 2004, 445-460.
Fiorentino, F et al., "Strategies and Clinical Outcome of 250 Cycles of Preimplantation Genetic Diagnosis for Single Gene Disorders", Human Reproduction, 21, 3, 2006, 670-684.
Fiorentino, Francesco et al., "Short Tandem Repeats Haplotyping of the HLA Region in Preimplantation HLA Matching", European Journal of Human Genetics, 13, 2005, 953-958.
Ford, E. et al., "A method for generating highly multiplexed ChIP-seq libraries", BMC Research Notes, vol. 7, No. 312, May 22, 2014, 1-5.
Forejt, et al., "Segmental trisomy of mouse chromosome 17: introducing an alternative model of Down's syndrome", Genomics, 4(6), 2003, 647-652.
Forshew, et al., "Noninvasive Identification and Monitoring of Cancer Mutations by Targeted Deep Sequencing of Plasma DNA", Noninvasive identification and monitoring of cancer mutations by targeted deep sequencing of plasma DNA. Sci. Transl. Med. 4, 136 30 (2012)., 1-12.
Forshew, T. et al., "Supplementary Materials for Noninvasive Identification and Monitoring of Cancer Mutations by Targeted Deep Sequencing of Plasma DNA", Sci. Transl. Med, vol. 4, May 30, 2012, 20 pgs.
Fredriksson, et al., "Multiplex amplification of all coding sequences within 10 cancer genes by Gene-Collector", Nucleic Acids Research, 2007, vol. 35, No. 7 e47, 1-6.
Freeman, Jennifer L. et al., "Copy Number Variation: New Insights in Genome Diversity", Genome Research, 16, 2006, 949-961.
Frost, Mackenzie S et al., "Differential Effects of Chronic Pulsatile Versus Chronic Constant Maternal Hyperglycemia on Fetal Pancreatic B-Cells", Journal of Pregnancy, 2012,, Article ID 812094, 2012, 8.
Fu, G. K. et al., "Counting individual DNA molecules by the stochastic attachment of diverse labels", PNAS, vol. 108, No. 22, May 31, 2011, 9026-9031.
Fu, G. K. et al., "Digital Encoding of Cellular mRNAs Enabling Precise and Absolute Gene Expression Measurement by Single-Molecule Counting", Analytical Chemistry, vol. 86, Mar. 3, 2014, 2867-2870.

Ganshirt-Ahlert, D. et al., "Ratio of Fetal to Maternal DNA is Less Than 1 in 5000 at different Gestational Ages in Maternal Blood", Clinical Genetics,38, 1990, 38-43.
Ganshirt-Ahlert, D. et al., "Fetal DNA in Uterine Vein Blood", Obstetrics & Gynecology, 80 (4), 1992, 601-603.
Ganshirt-Ahlert, Dorothee et al., "Three Cases of 45,X/46,XYnf Mosaicism", Human Genetics, 76, 1987, 153-156.
Garcia-Murillas, I. et al., "Mutation tracking in circulating tumor DNA predicts relapse in early breast cancer", Science Translational Medicine, vol. 7, No. 302, Aug. 26, 2015, 1-2.
Gardina, P. et al., "Ploidy Status and Copy Number Aberrations in Primary Glioblastomas Defined by Integrated Analysis of Allelic Ratios, Signal Ratios and Loss of Heterozygosity Using 500K SNP Mapping Arrays", BMC Genomics, 9 (489), (doi:10.1186/1471-2164-9-489), 2008, 16 pgs.
Geiss, G. K. et al., "Direct multiplexed measurement of gene expression with color-coded probe pairs", Nature Biotechnology, vol. 26, No. 3, Feb. 17, 2008, 317-325.
Ghanta, Sujana et al., "Non-Invasive Prenatal Detection of Trisomy 21 Using Tandem Single Nucleotide Polymorphisms", PLoS ONE, 5 (10), 2010, 10 pgs.
Gielis, E. M. et al., "Plasma donor-derived cell-free DNA kinetics after kidney transplantation using a single tube multiplex PCR assay", PLOS One, vol. 13, No. 12, e0208207, Dec. 6, 2018, 16 pgs.
Gjertson, David W. et al., "Assessing Probability of Paternity and the Product Rule in DNA Systems", Genetica, 96, 1995, 89-98.
Greenwalt, T. et al., "The Quantification of Fetomaternal Hemorrhage by an Enzyme-Linked Antibody Test with Glutaraldehyde Fixation", Vox Sang, 63, 1992, 268-271.
Grskovic, M. et al., "Validation of a Clinical-Grade Assay to Measure Donor-Derived Cell-Free DNA in Solid Organ Transplant Recipients", The Journal of Molecular Diagnostics, vol. 18, No. 6 + Supplemental Appendix 51, Nov. 2016, 890-902.
Guerra, J. , "Terminal Contributions for Duplex Oligonucleotide Thermodynamic Properties in the Context of Nearest Neighbor Models", Biopolymers, 95(3), (2010), 2011, 194-201.
Guetta, Esther et al., "Analysis of Fetal Blood Cells in the Maternal Circulation: Challenges, Ongoing Efforts, and Potential Solutions", Stem Cells and Development, 13, 2004, 93-99.
Guichoux, et al., "Current Trends in Microsatellite Genotyping", Molecular Ecology Resources, 11, 2011, 591-911.
Gunderson, K. L. et al., "A genome-wide scalable SNP genotyping assay using microarray technology", Nature Genetics, vol. 37, No. 5, May 2005, 549-554.
Hall, M. , "Panorama Non-Invasive Prenatal Screening for Microdeletion Syndromes", Apr. 1, 2014 (Apr. 1, 2014), XP055157224, Retrieved from the Internet: URL:http://www.panoramatest.com/sites/default/files/files/PanoramaMicrodeletionsWhite Paper-2.pdf [retrieved on Dec. 8, 2014].
Han, S-W et al., "Predictive and Prognostic Impact of Epidermal Growth Factor Receptor Mutation in Non-Small-Cell Lung Cancer Patients Treated With Gefitinib", Journal of Clinical Oncology, vol. 23, No. 11, Apr. 10, 2005, 2493-2501.
Handyside, et al., "Isothermal whole genome amplification from single and numbers of cells: a new era for preimplantation genetic diagnosis of inherited disease", Molecular Human Reproduction vol. IO, No. 10 pp. 767-772, 2004.
Hara, Eiji et al., "Subtractive cDNA cloning using oligo(dT)3o-latex and PCR: isolation of cDNA clones specific to undifferentiated human embryonal carcinoma cells", Nucleic Acids Research, 19(25), 1991, 7097-7104.
Hardenbol, P. , "Multiplexed Genotyping With Sequence-Tagged Molecular Inversion Probes", Nature Biotechnology, 21 (6), 2003, 673-678.
Hardenbol, Paul et al., "Highly multiplexed molecular inversion probe genotyping: Over 10,000 targeted SNPs genotyped in a singled tube assay", Genome Research, 15, 2005, 269-275.
Harismendy, O. et al., "Method for Improving Sequence Coverage Uniformity of Targeted Genomic Intervals Amplified by LR-PCR Using Illumina Ga Sequencing-By-Synthesis Technology", Bio Techniques, 46(3), 2009, 229-231.
Harper, J. C. et al., "Recent Advances and Future Developments in PGD", Prenatal Diagnosis, 19, 1999, 1193-1199.

(56) References Cited

OTHER PUBLICATIONS

Harton, G.L. et al., "Preimplantation Genetic Testing for Marfan Syndrome", Molecular Human Reproduction, 2 (9), 1996, 713-715.
Hartwell, L. H. et al., "Chapter 11: The Direct Detection of Genotype Distinguishes Individual Genomes", Genetics: From Genes to Genomes, Second Edition, 2004, 371-414.
Hartwell, L. H. et al., "Chapter 13: Chromosomal Rearrangements and Changes in Chromosome Number Reshape Eukaryotic Genomes", Genetics: From Genes to Genomes, Second Edition, 2004, 441-486.
Hattori, M. et al., "The DNA sequence of human chromosome 21", Nature, vol. 405, May 18, 2000, 311-319.
Hawkins, T. et al., "Whole genome amplification—applications and advances", Current Opinion in Biotechnology, 13, 2002, 65-67.
Hayden, et al., "Multiplex-Ready PCR: A new method for multiplexed SSR and SNP genotyping", BMC Genomics 2008, 9(80), 1-12.
Hellani, A. et al., "Clinical Application of Multiple Displacement Amplification in Preimplantation Genetic Diagnosis", Reproductive BioMedicine Online, 10 (3), 2005, 376-380.
Hellani, Ali et al., "Multiple displacement amplification on single cell and possible PGD applications", Molecular Human Reproduction, 10(11), 2004, 847-852.
Hojsgaard, S. et al., "BIFROST—Block recursive models induced from relevant knowledge, observations, and statistical techniques", Computational Statistics & Data Analysis, 19(2), 1995, 155-175.
Hollas, B. et al., "A stochastic approach to count RN A molecules using DNA sequencing methods", Lecture Notes in Computer Science, vol. 2812, 2003, 55-62.
Holleley, et al., "Multiplex Manager 1.0: a Cross-Platform Computer Program that Plans and Optimizes Multiplex PCR", BioTechniques46:511-517 (Jun. 2009), 511-517.
Hollox, E. et al., "Extensive Normal Copy Number Variation of a β-Defensin Antimicrobial-Gene Cluster", Am. J. Hum. Genet., 73, 2003, 591-600.
Homer, et al., "Resolving Individuals Contributing Trace Amounts of DNA to Highly Complex Mixtures Using High-Density SNP Genotyping Microarrays", PLOS Genetics, 4(8), 2008, 9 pgs.
Hoogendoorn, Bastiaan et al., "Genotyping Single Nucleotide Polymorphisms by Primer Extension and High Performance Liquid Chromatography", Hum Genet, 104, 1999, 89-93.
Hornak, M. et al., "Aneuploidy Detection in Pigs Using Comparative Genomic Hybridization: From the Oocytes to Blastocysts", PLoS ONE, vol. 7, No. 1, Jan. 2012, 6 pages.
Hospital, F. et al., "A General Algorithm to Compute Multilocus Genotype Frequencies Under Various Mating Systems" vol. 12, No. 6, Jan. 1, 1996 (Jan. 1, 1996), pp. 455-462.
Howie, et al., "Fast and accurate genotype imputation in genome-wide association studies through pre-phasing", Nature Genetics, vol. 44, No. 8, Jul. 22, 2012, 955-959.
Hu, Dong Gui et al., "Aneuploidy Detection in Single Cells Using DNA Array-Based Comparative Genomic Hybridization", Molecular Human Reproduction, 10(4), 2004, 283-289.
Hug, H. et al., "Measurement of the number of molecules of a single mRNA species in a complex mRNA preparation", J. Theor. Biol., vol. 221, 2003, 615-624.
Hultin, E. et al., "Competitive enzymatic reaction to control allele-specific extensions", Nucleic Acids Research, vol. 33, No. 5, Mar. 14, 2005, 1-10.
Ido, Yasuo et al., "Hyperglycemia-Induced Apoptosis in Human Umbilical Vein Endothelial Cells: Inhibition by the AMP-Activated Protein Kinase Activation", Diabetes, 51, 2002, 159-167.
Illumina, "Patent Owner Illumina's Preliminary Response to Petition", Oct. 17, 2018, 75 pgs.
Illumina, "Petition for Inter Partes Review of U.S. U.S. Pat. No. 8,682,592", Jun. 13, 2019, 91 pages.
Illumina, "Plaintiff/Counterclaim Defendant Illumina, Inc.'s Amended Patent L.R. 3-3 Preliminary Invalidity Contentions for U.S. Pat. No. 8,682,592", Oct. 30, 2018, 22 pages.
Illumina, "Plaintiff/Counterclaim-Defendant Illumina, Inc.'s Patent L.R. 3-3 Contentions for U.S. Patent Preliminary Invalidity Contentions for U.S. Pat. No. 8,682,592", Oct. 9, 2018, 81 pages.
Illumina Catalog, , "Paired-End Sample Preparation Guide, Illumina Catalog# PE-930-1 001, Part# 1005063 Rev. E", 2011, 1-40.
Illumina, Inc., , "Declaration of David Peters, Ph.D. in Support of Petition for Inter Partes Review of U.S. U.S. Pat. No. 8,682,592", Jun. 13, 2019, 136 pages.
*Illumina, Inc. V. Natera, Inc.*, , "Order Re: Claim Construction", Jan. 30, 2019, 16 pgs.
Imielinski, M. et al., "Mapping the Hallmarks of Lung Adenocarcinoma with Massively Parallel Sequencing", Cell, vol. 150, Sep. 14, 2012, 1107-1120.
Ishii, et al., "Optimization of Annealing Temperature to Reduce Bias Caused by a Primer Mismatch in Multitemplate PCR", Applied and Environmental Microbiology, Aug. 2001, p. 3753-3755.
Jabara, C. B. et al., "Accurate sampling and deep sequencing of the HIV-1 protease gene using a Primer ID", PNAS, vol. 108, No. 50, Dec. 13, 2011, 20166-20171.
Jahr, S. et al., "DNA Fragments in the Blood Plasma of Cancer Patients: Quantitations and Evidence for Their Origin from Apoptotic and Necrotic Cells", Cancer Research, vol. 61, Feb. 15, 2001, 1659-1665.
Jamal-Hanjani, M. et al., "Detection of ubiquitous and heterogeneous mutations in cell-free DNA from patients with early-stage non-small-cell lung cancer", Annals of Oncology, vol. 27, No. 5, Jan. 28, 2016, 862-867.
Jamal-Hanjani, M. et al., "Tracking Genomic Cancer Evolution for Precision Medicine: The Lung TRACERx Study", PLOS Biology, vol. 12, No. 7, Jul. 2014, 1-7.
Jamal-Hanjani, M. et al., "Tracking the Evolution of Non-Small-Cell Lung Cancer", The New England Journal of Medicine, vol. 376, No. 22, Jun. 1, 2017, 2109-2121.
Jarvie, T. , "Next generation sequencing technologies", Drug Discovery Today: Technologies, vol. 2, No. 3, 2005, 255-260.
Jenkins, S. et al., "High-throughput SNP genotyping", Comparative and Functional Genomics, vol. 3, Dec. 5, 2001, 57-66.
Johnson, D.S. et al., "Comprehensive Analysis of Karyotypic Mosaicism Between Trophectoderm and Inner Cell Mass", Molecular Human Reproduction, 16(12), 2010, 944-949.
Johnson D.S, et al., "Preclinical Validation of a Microarray Method for Full Molecular Karyotyping of Blastomeres in a 24-h Protocol", Human Reproduction, 25 (4), 2010, 1066-1075.
Kamat, A. A. et al., "Quantification of total plasma cell-free DNA in ovarian cancer using real-time PCR", Ann N Y Acad Sci., vol. 1075, Sep. 2006, 230-234.
Kaplinski, Lauris et al., "MultiPLX: Automatic Grouping and Evaluation of PCR Primers", Bioinformatics, 21(8), 2005, 1701-1702.
Kazakov, V.I. et al., "Extracellular DNA in the Blood of Pregnant Women", Tsitologia, vol. 37, No. 3, 1995, 1-8.
Kijak, G. et al., "Discrepant Results in the Interpretation of HIV-1 Drug-Resistance Genotypic Data Among Widely Used Algorithms", HIV Medicine, 4, 2003, 72-78.
Kim, H. et al., "Whole-genome and multisector exome sequencing of primary and post-treatment glioblastoma reveals patterns of tumor evolution", Genome Research, vol. 25, No. 3, Feb. 3, 2015, 316-327.
Kinde, I. et al., "Detection and quantification of rare mutations with massively parallel sequencing", PNAS, vol. 108, No. 23, Jun. 7, 2011, 9530-9535.
Kinnings, S. L. et al., "Factors affecting levels of circulating cell-free fetal DNA in maternal plasma and their implications for noninvasive prenatal testing", Prenatal Diagnosis, vol. 35, 2015, 816-822.
Kirkizlar, E. et al., "Detection of Clonal and Subclonal Copy-Number Variants in Cell-Free DNA from Patients with Breast Cancer Using a Massively Multiplexed PCR Methodology", Translational Oncology, vol. 8, No. 5, Oct. 2015, pp. 407-416.
Kivioja, T. et al., "Counting absolute numbers of molecules using unique molecular identifiers", Nature Methods, Advance Online Publication, Nov. 20, 2011, 1-5.

(56) References Cited

OTHER PUBLICATIONS

Konfortov, Bernard A. et al., "An Efficient Method for Multi-Locus Molecular Haplotyping", Nucleic Acids Research, 35(1), e6, 2007, 8 pgs.
Krjutskov, K. et al., "Development of a single tube 640-plex genotyping method for detection of nucleic acid variations on microarrays", Nucleic Acids Research, vol. 36, No. 12, May 23, 2008, 7 pages.
Kuliev, Anver et al., "Thirteen Years' Experience on Preimplantation Diagnosis: Report of the Fifth International Symposium on Preimplantation Genetics", Reproductive BioMedicine Online, 8, 2, 2004, 229-235.
Kunishima, S. et al., "First description of somatic mosaicism in MYH9 disorders", British Journal of Haematology, vol. 128, 2005, 360-365.
Kwok, P. Y. , "High-throughput genotyping assay approaches", Pharmacogenomics, vol. 1, No. 1, 2000, 1-5.
Lambert-Messerlian, G. et al., "Adjustment of Serum Markers in First Trimester Screening", Journal of Medical Screening, 16 (2), 2009, 102-103.
Lander, E. S. et al., "Initial sequencing and analysis of the human genome", Nature, vol. 409, Feb. 15, 2001, 860-921.
Lathi, Ruth B. et al., "Informatics Enhanced SNP Microarray Analysis of 30 Miscarriage Samples Compared to Routine Cytogenetics", PLoS ONE, 7(3), 2012, 5 pgs.
Leary, R. J. et al., "Development of Personalized Tumor Biomarkers Using Massively Parallel Sequencing", Science Translational Medicine, vol. 2, No. 20, Feb. 24, 2010, 1-8.
Leary, Rebecca J et al., "Detection of Chromosomal Alterations in the Circulation of Cancer Patients with Whole-Genome Sequencing", Science Translational Medicine, 4, 162, 2012, 12.
Levsky, J. M. et al., "Fluorescence in situ hybridization: past, present and future", Journal of Cell Science, vol. 116, No. 14, 2003, 2833-2838.
Li, B. , "Highly Multiplexed Amplicon Preparation for Targeted Re-Sequencing of Sample Limited Specimens Using the Ion AmpliSeq Technology and Semiconductor Sequencing", Proceedings of the Annual Meeting of the American Society of Human Genetics [retrieved on Oct. 30, 2012]. Retrieved from the Internet: <URL: http://www.ashg.org/2012meeting/abstracts/fulltext/f120121811.htm>, 2012, 1 pg.
Li, Y. et al., "Non-Invasive Prenatal Diagnosis Using Cell-Free Fetal DNA in Maternal Plasma from PGD Pregnancies", Reproductive BioMedicine Online, 19 (5), 2009, 714-720.
Li, Ying et al., "Size Separation of Circulatory DNA in Maternal Plasma Permits Ready Detection of Fetal DNA Polymorphisms", Clinical Chemistry, 50, 6, 2004, 1002-1011.
Liao, Gary J.W. et al., "Targeted Massively Parallel Sequencing of Maternal Plasma DNA Permits Efficient and Unbiased Detection of Fetal Alleles", Clinical Chemistry, 57 (1), 2011, 92-101.
Liao, J. et al., "An Alternative Linker-Mediated Polymerase Chain Reaction Method Using a Dideoxynucleotide to Reduce Amplification Background", Analytical Biochemistry 253, 137-139 (1997).
Liew, Michael et al., "Genotyping of Single-Nucleotide Polymorphisms", Clinical Chemistry, 50(7), 2004, 1156-1164.
Life Technologies, "Ion AmpliSeq™ Designer provides full flexibility to sequence genes of your choice", Retrieved from the Internet<URL: http://tools.lifetechnologies.com/content/sfs/brochures/IonAmpliSeq_CustomPanels_AppNote_CO1, 2012, 4 pages.
Lindberg, J. et al., "Exome Sequencing of Prostate Cancer Supports the Hypothesis of Independent Tumour Origins", European Urology, vol. 63, 2013, 347-353.
Lindroos, Katarina et al., "Genotyping SNPs by Minisequencing Primer Extension Using Oligonucleotide Microarrays", Methods in Molecular Biology, 212, Single Nucleotide Polymorphisms: Methods and Protocols, P-K Kwok (ed.), Humana Press, Inc., Totowa, NJ, 2003, 149-165.
Lo, et al., "Digital PCR for the Molecular Detection of Fetal Chromosomal Aneuploidy", PNAS, vol. 104, No. 32, Aug. 7, 2007, 13116-13121.
Lo, et al., "Fetal Nucleic Acids in Maternal Blood: the Promises", Clin. Chem. Lab. Med., 50(6), 2012, 995-998.
Lo, et al., "Free Fetal DNA in Maternal Circulation", JAMA, 292(23), (Letters to the Editor), 2004, 2835-2836.
Lo, , "Non-Invasive Prenatal Diagnosis by Massively parallel Sequencing of Maternal Plasma DNA", Open Biol 2: 120086, 2012, 1-5.
Lo, et al., "Prenatal Sex Determination by DNA Amplification from Maternal Peripheral Blood", The Lancet,2, 8676, 1989, 1363-1365.
Lo, et al., "Rapid Clearance of Fetal DNA from Maternal Plasma", Am. J. Hum. Genet., 64, 1999, 218-224.
Lo, et al., "Strategies for the Detection of Autosomal Fetal DNA Sequence from Maternal Peripheral Blood", Annals New York Academy of Sciences,731, 1994, 204-213.
Lo, et al., "Two-way cell traffic between mother and fetus: biologic and clinical implications", Blood, 88(11), Dec. 1, 1996, 4390-4395.
Lo, Y. , "Noninvasive prenatal detection of fetal chromosomal aneuploidies by maternal plasma nucleic acid analysis: a review of the current state of the art", BJOG An International Journal of Obstetrics and Gynaecology, vol. 116, 2009, 152-157.
Lo, Y.M. Dennis , "Fetal Nucleic Acids in Maternal Plasma: Toward the Development of Noninvasive Prenatal Diagnosis of Fetal Chromosomal Aneuploidies", Ann. N.Y. Acad. Sci., 1137, 2008, 140-143.
Lo, Y.M. Dennis et al., "Maternal Plasma DNA Sequencing Reveals the Genome-Wide Genetic and Mutational Profile of the Fetus", Science Translational Medicine 2 (61), 2010, 13.
Lo, Y.M. Dennis et al., "Plasma placental RNA allelic ratio permits noninvasive prenatal chromosomal aneuploidy detection", Nature Medicine, 13 (2), 2007, 218-223.
Lo, Y.M. Dennis et al., "Presence of Fetal DNA in Maternal Plasma and Serum", The Lancet, 350, 1997, 485-487.
Lo, Y.M. Dennis et al., "Quantitative Analysis of Fetal DNA in Maternal Plasma and Serum: Implications for Noninvasive Prenatal Diagnosis", Am. J. Hum. Genet., 62, 1998, 768-775.
Lo, Y-M D. , "Non-invasive prenatal diagnosis using fetal cells in maternal blood", J. Clin. Pathol., vol. 47, 1994, 1060-1065.
Lo, Y-M.D et al., "Detection of Single-Copy Fetal DNA Sequence from Maternal Blood", The Lancet, 335, 1990, 1463-1464.
Lo, Y-M.D et al., "Prenatal Determination of Fetal Rhesus D Status by DNA Amplification of Peripheral Blood of Rhesus-Negative Mothers", Annals New York Academy of Sciences, 731, 1994, 229-236.
Lo, Y-M.D. et al., "Detection of Fetal RhD Sequence from Peripheral Blood of Sensitized RhD-Negative Pregnant Women", British Journal of Haematology, 87, 1994, 658-660.
Lo, Y-M.D. et al., "Prenatal Determination of Fetal RhD Status by Analysis of Peripheral Blood of Rhesus Negative Mothers", The Lancet, 341, 1993, 1147-1148.
Lu, I. et al., "Establishment of a system based on universal multiplex-PCR for screening genetically modified crops", Anal. Bioanal. Chem, vol. 396, Oct. 24, 2009, 2055-2064.
Lui, Y. Y. et al., "Predominant Hematopoietic Origin of Cell-Free Dna in Plasma and Serum after Sex-Mismatched Bone Marrow Transplantation", Clinical Chemistry, vol. 48, vol. 3, 2002, 421-427.
Lun, Fiona M. et al., "Noninvasive Prenatal Diagnosis of Monogenic Diseases by Digital Size Selection and Relative Mutation Dosage on Dna in Maternal Plasma", PNAS, 105(50), 2008, 19920-19925.
Ma, Xiaotu et al., "Rise and fall of subclones from diagnosis to relapse in pediatric B-acute lymphoblastic leukaemia", Nature Communications, vol. 6, Mar. 19, 2015, 1-12.
Magbanua, M. J. et al., "Abstract PD2-01: Personalized serial circulating tumor DNA (ctDNA) analysis in high-risk early stage breast cancer patients to monitor and predict response to neoadjuvant therapy and outcome in the I-SPY 2 TRIAL", Cancer Research, vol. 79, No. 4 Supplement, Feb. 15, 2019.
Mamon, H. et al., "Letters to the Editor: Preferential Amplification of Apoptotic DNA from Plasma: Potential for Enhancing Detection of Minor DNA Alterations in Circulating DNA", Clinical Chemistry, vol. 54, No. 9, 2008, 1582-1584.
Maniatis, T. et al., "In: Molecular Cloning: A Laboratory Manual", Cold Spring Harbor Laboratory, New York, Thirteenth Printing, 1986, 458-459.

(56) References Cited

OTHER PUBLICATIONS

Mansfield, Elaine S , "Diagnosis of Down Syndrome and Other Aneuploidies Using Quantitative Polymerase Chain Reaction and Small Tandem Repeat Polymorphisms", Human Molecular Genetics, 2, 1, 1993, 43-50.

Mardis, E. R. , "The impact of next-generation sequencing technology on genetics", Trends in Genetics, vol. 24, No. 3, Feb. 11, 2008, 133-141.

Margulies, M. et al., "Genome sequencing in microfabricated high-density picolitre reactors", Nature, vol. 437, Sep. 15, 2005, 376-380.

Margulies, M. et al., "Genome sequencing in microfabricated high-density picolitre reactors plus Supplemental Methods", Nature, vol. 437, Sep. 15, 2005, 40 pgs.

Markoulatos, P. et al., "Multiplex Polymerase Chain Reaction: A Practical Approach", Journal of Clinical Laboratory Analysis, vol. 16, 2002, 47-51.

May, Robert M. , "How Many Species Are There on Earth?", Science, 241, Sep. 16, 1988, 1441-1449.

Mcbride, D. et al., "Use of Cancer-Specific Genomic Rearrangements to Quantify Disease Burden in Plasma from Patients with Solid Tumors", Genes, Chromosomes & Cancer, vol. 49, Aug. 19, 2010, 1062-1069.

Mccloskey, M. L. et al., "Encoding PCR Products with Batchstamps and Barcodes", Biochem Genet., vol. 45, Oct. 23, 2007, 761-767.

Mccray, Alexa T. et al., "Aggregating UMLS Semantic Types for Reducing Conceptual Complexity", MEDINFO 2001: Proceedings of the 10th World Congress on Medical Informatics (Studies in Health Technology and Informatics, 84, V. Patel et al. (eds.), IOS Press Amsterdam, 2001, 216-220.

Mcdonald, B. R. et al., "Abstract P4-01-21: Multiplexed targeted digital sequencing of circulating tumor DNA to detect minimal residual disease in early and locally advanced breast cancer", Cancer Research, vol. 79, No. 4 Supplement, Feb. 15, 2019.

Mennuti, M. et al., "Is It Time to Sound an Alarm About False-Positive Cell-Free DNA Testing for Fetal Aneuploidy?", American Journal of Obstetrics, 2013, 5 pgs.

Merriam-Webster, , "Medical Definition of Stimulant", http://www.merriam-webster.com/medical/stimulant, Mar. 14, 2016, 7 pages.

Merriam-Webster, , "Universal Definition", "Merriam-Webster.com (http://www.merriam-webster.com/dictionary/universal, downloaded Jul. 23, 2014)", 3 pages.

Mersy, et al., "Noninvasive Detection of Fetal Trisomy 21: Systematic Review and Report of Quality and Outcomes of Diagnostic Accuracy Studies Performed Between 1997 and 2012", Human Reproduction Update, 19(4), 2013, 318-329.

Mertes, F. et al., "Targeted enrichment of genomic DNA regions for next-generation sequencing", Briefings in Functional Genomics, vol. 10, No. 6, Nov. 26, 2011, 374-386.

Miller, Robert , "Hyperglycemia-Induced Changes in Hepatic Membrane Fatty Acid Composition Correlate with Increased Caspase-3 Activities and Reduced Chick Embryo Viability", Comparative Biochemistry and Physiology, Part B, 141, 2005, 323-330.

Miller, Robert R. , "Homocysteine-Induced Changes in Brain Membrane Composition Correlate with Increased Brain Caspase-3 Activities and Reduced Chick Embryo Viability", Comparative Biochemistry and Physiology Part B, 136, 2003, 521-532.

Miner, B. E. et al., "Molecular barcodes detect redundancy and contamination in hairpin-bisulfite PCR", Nucleic Acids Research, vol. 32, No. 17, Sep. 30, 2004, 1-4.

Minkoff, E. et al., "Stem Cells, Cell Division, and Cancer", Biology Today Third Edition, Chapter 12, 2004, 10 pages.

Morand, et al., "Hesperidin contributes to the vascular protective effects of orange juice: a randomized crossover study in healthy volunteers", Am J Clin Nutr. Jan. 2011;93(1 ):73-80. Epub Nov. 10, 2010.

Munne, S. et al., "Chromosome Abnormalities in Human Embryos", Textbook of Assisted Reproductive Techniques, 2004, pp. 355-377.

Munne, S. et al., "Chromosome abnormalities in human embryos", European Society of Human Reproduction and Embryology: Human Reproduction Update, vol. 4, No. 6, 1998, 842-855.

Munne, S. et al., "Improved implantation after preimplantation genetic diagnosis of aneuploidy", Reproductive BioMedicine Online, vol. 7., No. 1., May 15, 2003, 91-97.

Murtaza, M. et al., "Non-Invasive Analysis of Acquired Resistance to Cancer Therapy by Sequencing of Plasma DNA", Nature (doi:10.1038/nature12065), 2013, 6 pgs.

Muse, Spencer V. , "Examining rates and patterns of nucleotide substitution in plants", Plant Molecular Biology 42: 25-43, 2000.

Myers, Chad L. et al., "Accurate Detection of Aneuploidies in Array CGH and Gene Expression Microarray Data", Bioinformatics, 20(18), 2004, 3533-3543.

Nannya, Yasuhito et al., "A Robust Algorithm for Copy Number Detection Using High-density Oligonucleotide Single Nucleotide Polymorphism Genotyping Arrays", Cancer Res., 65, 14, 2005, 6071-6079.

Narayan, A. et al., "Ultrasensitive measurement of hotspot mutations in tumor DNA in blood using error-suppressed multiplexed deep sequencing", Cancer Research, vol. 72, No. 14, Jul. 15, 2012, 3492-3498.

Natera, Inc., , "Declaration of Sandra L. Haberny", May 16, 2019, 3 pages.

Natera, Inc., , "Defendant Natera, Inc.'s Invalidity Contentions Under Patent L.R. 3-3; Document Production Accompanying Invalidity Contentions Under Patent L.R. 3-4", Aug. 20, 2018, 17 pages.

Natera, Inc., , "Exhibit 8 Ehrich Invalidity Chart", Aug. 20, 2018, 16 pages.

Natera, Inc., , "Exhibits A-H to Haberny Declaration", May 16m 2019, 192 pages.

Natera, Inc., , "Motion to Dismiss", May 16, 2019, 2 pages.

Natera, Inc., , "Natera Inc.'s First Amended Answer, Affirmative Defenses and Counterclaims", Aug. 16, 2018, 28 pages.

Natera, Inc., , "Natera, Inc.'s Supplemental Objections and Response to Plaintiff Illumina, Inc.'s Interrogatory No. 8", Mar. 20, 2019, 29 pages.

Natera, Inc., , "Opening Brief in Support of Motion to Dismiss", May 16, 2019, 26 pages.

Natera, Inc., , "Petitioner Reply Per Board Order of Nov. 2, 2018 (Paper No. 10)", Nov. 9, 2018, 8 pgs.

NCBI, , "dbSNP record for rs1294331", Retrieved from the Internet: <URL: www.ncbi.nlm.nih.gov/snp/?term=rs 1294331 >, 2019, 2 pgs.

NCBI, , "dbSNP record for r51872575", Retrieved from the Internet: <URL: www.ncbi.nlm.nih.gov/snp/?term=rs1872575, 2019, 2 pgs.

NCBI, , "dbSNP record for rs2362450", Retrieved from the Internet: <URL: www.ncbi.nlm.nih.gov/snp/?term=rs2362450>, 2019, 1 pg.

NCBI, , "dbSNP record for rs2384571", Retrieved from the Internet: <URL: www.ncbi.nlm.nih.gov/snp/?term=rs2384571>, 2019, 2 pgs.

NCBI, , "dbSNP record for rs2498982", Retrieved from the Internet: <URL: www.ncbi.nlm.nih.gov/snp/?term=rs2498982>, 2019, 3 pgs.

NCBI, , "dbSNP record for rs3731877", Retrieved from the Internet: <URL: www.ncbi.nlm.nih.gov/snp/?term=rs3731877>, 2019, 2 pgs.

Newman, A. M. et al., "Integrated digital error suppression for improved detection of circulating tumor DNA", Nature Biotechnology, vol. 34, No. 5, May 2016, 547-555.

Ng, S. B. et al., "Individualised multiplexed circulating tumour DNA assays for monitoring of tumour presence in patients after colorectal cancer surgery", Scientific Reports, vol. 7, No. 40737, Jan. 19, 2017, 11 pages.

Nguyen-Dumont, T. , "A high-plex PCR approach for massively parallel sequencing", BioTechniques, vol. 55, No. 2, Aug. 2013, 69-74.

Nicolaides, K. et al., "Noninvasive Prenatal Testing for Fetal Trisomies in a Routinely Screened First-Trimester Population", American Journal of Obstetrics (article in press), 207, 2012, 1.e1-1.e6.

Nicolaides, K.H et al., "Validation of Targeted Sequencing of Single-Nucleotide Polymorphisms for Non-Invasive Prenatal Detection of Aneuploidy of Chromosomes 13, 18, 21, X, and Y", Prenatal Diagnosis, 33, 2013, 575-579.

(56) References Cited

OTHER PUBLICATIONS

Nicolaides, Kypros H. et al., "Prenatal Detection of Fetal Triploidy from Cell-Free DNA Testing in Maternal Blood", Fetal Diagnosis and Therapy, 2013, 1-6.
Nygren, et al., "Quantification of Fetal DNA by Use of Methylation-Based DNA Discrimination", Clinical Chemistry 56:10 1627-1635 (2010).
Ogino, S. et al., "Bayesian Analysis and Risk Assessment in Genetic Counseling and Testing", Journal of Molecular Diagnostics, 6 (1), 2004, 9 pgs.
Ohsawa, M. et al., "Prenatal Diagnosis of Two Pedigrees of Fukuyama Type Congenital Muscular Dystrophy by Polymorphism Analysis", The Health and Welfare Ministry, 1994, 5 pgs.
O'Malley, R. et al., "An adapter ligation-mediated PCR method for high-throughput mapping of T-DNA inserts in the Arabidopsis genome", Nat. Protoc., 2, 2007, 2910-2917.
Orozco A.F., et al., "Placental Release of Distinct DNA-Associated Micro-Particles into Maternal Circulation: Reflective of Gestation Time and Preeclampsia", Placenta,30, 2009, 891-897.
Ozawa, Makiko et al., "Two Families with Fukuyama Congenital Muscular Dystrophy that Underwent in Utero Diagnosis Based on Polymorphism Analysis", Clinical Muscular Dystrophy: Research in Immunology and Genetic Counseling—FY 1994 Research Report, (including text in Japanese), 1994, 8.
Paez, Guillermo J. et al., "Genome coverage and sequence fidelity of Φ29 polymerase-based multiple strand displacement whole genome amplification", Nucleic Acids Research, 32(9), 2004, 1-11.
Page, S. L. et al., "Chromosome Choreography: The Meiotic Ballet", Science, 301, 2003, 785-789.
Palomaki, G. E. et al., "DNA sequencing of maternal plasma to detect Down syndrome: An international clinical validation study", Genetics in Medicine, vol. 13, No. 1, Nov. 2011, 913-920.
Palomaki, Glenn et al., "DNA Sequencing of Maternal Plasma Reliably Identifies Trisomy 18 and Trisomy 13 as Well as Down Syndrome: an International Collaborative Study", Genetics in Medicine, 2012, 10.
Palomaki, Glenn E. et al., "DNA Sequencing of Maternal Plasma to Detect Down Syndrome: An International Clinical Validation Study", Genetics in Medicine (pre-print version), 13, 2011, 8 pgs.
Papadopoulou, E. et al., "Cell-Free DNA and RNA in Plasma as a New Molecular Marker for Prostate Cancer", Oncology Research, vol. 14, 2004, 439-445.
Papageorgiou, Elisavet A. et al., "Fetal-Specific DNA Methylation Ratio Permits Noninvasive Prenatal Diagnosis of Trisomy 21", Nature Medicine (advance online publication),17, 2011, 5 pgs.
Pastinen, T. et al., "Minisequencing: A Specific Tool for DNA Analysis and Diagnostics on Oligonucleotide Arrays", Genome Research, vol. 7, 1997, 606-614.
Pathak, A. et al., "Circulating Cell-Free DNA in Plasma/Serum of Lung Cancer Patients as a Potential Screening and Prognostic Tool", Clinical Chemistry, 52, 2006, 1833-1842.
PCT/US2006/045281, , "International Preliminary Report on Patentability", dated May 27, 2008, 1 pg.
PCT/US2006/045281, , "International Search Report and Written Opinion", dated Sep. 28, 2007, 7 pgs.
PCT/US2008/003547, , "International Search Report", dated Apr. 15, 2009, 5 pgs.
PCT/US2009/034506, , "International Search Report", dated Jul. 8, 2009, 2 pgs.
PCT/US2009/045335, , "International Search Report", dated Jul. 27, 2009, 1 pg.
PCT/US2009/052730, , "International Search Report", dated Sep. 28, 2009, 1 pg.
PCT/US2010/050824, , "International Search Report", dated Nov. 15, 2010, 2 pgs.
PCT/US2011/037018, , "International Search Report", dated Sep. 27, 2011, 2 pgs.
PCT/US2011/061506, , "International Search Report", dated Mar. 16, 2012, 1 pgs.
PCT/US2011/066938, , "International Search Report", dated Jun. 20, 2012, 1 pg.
PCT/US2012066339, , "International Search Report", mailed Mar. 5, 2013, 1 pg.
PCT/US2013/028378, , "International Search Report and Written Opinion", dated May 28, 2013, 11 pgs.
PCT/US2013/57924, , "International Search Report and Written Opinion", dated Feb. 18, 2014, 8 pgs.
PCT/US2014/051926, , "International Search Report and Written Opinion", dated Dec. 9, 2014, 3 pgs.
Pearson, K. , "On the criterion that a given system of deviations from the probable in the case of a correlated system of variables is such that it can be reasonably supposed to have arisen from random sampling", Philosophical Magazine Series 5, vol. 50, Issue 302, 1900, 157-175.
Pena, Sergio D.J et al., "Paternity Testing in the DNA Era", Trends in Genetics, 10, 6, 1994, 204-209.
Pergament, E. et al., "Single-Nucleotide Polymorphism-Based Noninvasive Prenatal Screening in a High-Risk and Low-Risk Cohort", Obstetrics & Gynecology, vol. 124, No. 2, Part 1, Aug. 2014, 210-218 + Appendices.
Perkel, Jeffrey M. , "Overcoming the Challenges of Multiplex PCR", Biocompare Editorial Article, 2012, 1-5.
Perry, George H. et al., "The Fine-Scale and Complex Architecture of Human Copy-Number Variation", The American Journal of Human Genetics,82, 2008, 685-695.
Pertl, B. et al., "Detection of Male and Female Fetal DNA in Maternal Plasma by Multiplex Fluorescent Polymerase Chain Reaction Amplification of Short Tandem Repeats", Hum. Genet., 106, 2000, 45-49.
Peters, D. , "List of Materials Considered by David Peters, Ph.D.", Jun. 13, 2019, 2 pages.
Peters, David P. et al., "Noninvasive Prenatal Diagnosis of a Fetal Microdeletion Syndrome", New England Journal of Medicine, 365(19), 2011, 1847-1848.
Pfaffl, Michael W. , "Relative Expression Software Tool (REST ©) for Group-Wise Comparison and Statistical Analysis of Relative Expression Results in real-Time PCR", Nucleic Acids Research, 30(9), 2002, 10 pgs.
Phillips, C. et al., "Resolving Relationship Tests that Show Ambiguous STR Results Using Autosomal SNPs as Supplementary Markers", Forensic Science International: Genetics 2, 2008, 198-204.
Podder, Mohua et al., "Robust SN P genotyping by multiplex PCR and arrayed primer", BMC Medical Genomics,1(5), 2008, 1-15.
Poirier, K. et al., "Maternal mosaicism for mutations in the ARX gene in a family with X linked mental retardation", Human Genetics, vol. 118, Aug. 3, 2005, 45-48.
Poon, L. L. et al., "Differential DNA Methylation between Fetus and Mother as a Strategy for Detecting Fetal DNA in Maternal Plasma", Clinical Chemistry, vol. 48, No. 1, 2002, 35-41.
Popova, T. et al., "Genome Alteration Print (GAP): a tool to visualize and mine complex cancer genomic profiles obtained by SNP arrays", Genome Biology, vol. 10, R128, Nov. 11, 2009, 1-14.
Porreca, Gregory J et al., "Multiplex Amplification of Large Sets of Human Exons", Nature Methods, 4, (advance online publication), 2007, 6.
Price, T.S. et al., ""SW-ARRAY: A dynamic programming solution for the identification of copy-number changes in genomic DNA using array comparative genome hybridization data",", Nucleic Acids Research, vol. 33, No. 11, Jun. 16, 2005, 3455-3464.
Primdahl, H. et al., "Allelic Imbalances in Human Bladder Cancer: Genome-Wide Detection With High-Density Single-Nucleotide Polymorphism Arrays", Journal of the National Cancer Institute, vol. 94, No. 3, Feb. 6, 2002, 216-223.
Quinn, G. P. et al., "Experimental Design and Data Analysis for Biologists", Graphical Exploration of Data, 2002, 64-67.
Rabinowitz, et al., "Accurate Prediction of HIV-1 Drug Response from the Reverse Transcriptase and Protease Amino Acid Sequences Using Sparse Models Created by Convex Optimization", Bioinformatics, 22, 5, 2006, 541-549.
Rabinowitz, Matthew et al., "Origins and rates of aneuploidy inhuman blastomeres", Fertility and Sterility, vol. 97, No. 2, Feb. 2012, 395-401.

(56) References Cited

OTHER PUBLICATIONS

Rabinowitz, Matthew. et al., "Non-Invasive Prenatal Aneuploidy Testing of Chromosomes 13, 18, 21, X, and Y Using Targeted Sequencing of Polymorphic Loci", The American Society of Human Genetics, meeting poster, 2012, 1 pg.
Rachlin, J. et al., "Computational tradeoffs in multiplex PCR assay design for SNP genotyping", BMC Genomics, vol. 6, No. 102, Jul. 25, 2005, 11 pages.
Ragoussis, J. , "Genotyping Technologies for Genetic Research", Annual Review of Genomics and Human Genetics, vol. 10 (1), Sep. 1, 2009, 117-133.
Rahmann, Sven et al., "Mean and variance of the Gibbs free energy of oligonucleotides in the nearest neighbor model under varying conditions", Bioinformatics, 20(17), 2004, 2928-2933.
Rava, Richard P. et al., "Circulating Fetal Cell-Free DNA Fraction Differ in Autosomal Aneuploidies and Monosomy X", Clinical Chemistry, 60(1), (papers in press), 2013, 8 pgs.
Rechitsky, Svetlana et al., "Preimplantation Genetic Diagnosis with HLA Matching", Reproductive Bio Medicine Online, 9, 2, 2004, 210-221.
Reinert, T. et al., "Analysis of circulating tumour DNA to monitor disease burden following colorectal cancer surgery", Gut, vol. 65, 2016, 625-634.
Renwick, P. et al., "Proof of Principle and First Cases Using Preimplantation Genetic Haplotyping—A Paradigm Shift for Embryo Diagnosis", Reproductive BioMedicine Online, 13 (1), 2006, 110-119.
Ricciotti, Hope , "Eating by Trimester", Online]. Retrieved from Internet:<http://www.youandyourfamily.com/article.php?story=Eating+by+Trimester>, 2014, 3.
Riley, D. E. , "DNA Testing: An Introduction for Non-Scientists An Illustrated Explanation", Scientific Testimony: An Online Journal, http://www.scientific.org/tutorials/articles/riley/riley.html, Apr. 6, 2005, 22 pages.
Riva, F. , "Patient-Specific Circulating Tumor DNA Detection during Neoadjuvant Chemotherapy in Triple-Negative Breast Cancer", Clinical Chemistry, vol. 63, No. 3, 2017, 691-699.
Rogaeva, E. et al., "The Solved and Unsolved Mysteries of the Genetics of Early-Onset Alzheimer's Disease", NeuroMolecular Medicine, vol. 2, 2002, 1-10.
Roper, Stephen M. et al., "Forensic Aspects of DNA-Based Human Identity Testing", Journal of Forensic Nursing, 4, 2008, 150-156.
Roux, K. , "Optimization and Troubleshooting in PCR", PCR Methods Appl. 4, 1995, 185-194.
Rozen, Steve et al., "Primer3 on the WWW for General Users and for Biologis Programmers", Methods in Molecular Biology, 132: Bioinformatics Methods and Protocols, 1999, 365-386.
Russell, L. M. , "X Chromosome Loss and Ageing", Cytogenetic and Genome Res., 116, 2007, 181-185.
Ryan, A. et al., "Informatics-Based, Highly Accurate, Noninvasive Prenatal Paternity Testing", Genetics in Medicine (advance online publication), 2012, 5 pgs.
Rychlik, et al., "Optimization of the annealing temperature for DNA amplification in vitro", Nucleic Acids Research, 18(21), 1990, 6409-6412.
Sahota, A. , "Evaluation of Seven PCR-Based Assays for the Analysis of Microchimerism", Clinical Biochemistry, vol. 31, No. 8., 1998, 641-645.
Saker, A. et al., "Genetic characterisation of circulating fetal cells allows non-invasive prenatal diagnosis of cystic fibrosis", Prenatal Diagnosis, vol. 26, Jul. 11, 2006, 906-916.
Samango-Sprouse, C. et al., "SNP-Based Non-Invasive Prenatal Testing Detects Sex Chromosome Aneuploidies with High Accuracy", Prenatal Diagnosis, 33, 2013, 1-7.
Sander, Chris , "Genetic Medicine and the Future of Health Care", Science, 287(5460), 2000, 1977-1978.
Santalucia, J. et al., "The Thermodynamics of DNA Structural Motifs", Annu. Rev. Biophys. Biomol. Struct., 33, 2004, 415-440.
Santalucia, John J.R et al., "Improved Nearest-Neighbor Parameters for Predicting DNA Duplex Stability", Biochemistry, 35, 1996, 3555-3562.
Sasabe, Yutaka , "Genetic Diagnosis of Gametes and Embryos Resulting from ART", Japanese Journal of Fertility and Sterility, vol. 46, No. 1, 2001, 43-46.
Schmitt, M. W. et al., "Detection of ultra-rare mutations by next-generation sequencing", PNAS, vol. 109, No. 36, Sep. 4, 2012, 14508-14513.
Schoumans, J et al., "Detection of chromosomal imbalances in children with idiopathic mental retardation by array based comparative genomic hybridisation (array-CGH)", JMed Genet, 42, 2005, 699-705.
Schwarzenbach, H. et al., "Cell-free nucleic acids as biomarkers in cancer patients", Nature Reviews: Cancer, vol. 11, Jun. 2011, 426-437.
Sebat, Jonathan et al., "Strong Association of De Novo Copy Number Mutations with Autism", Science, 316, 2007, 445-449.
Sehnert, A. et al., "Optimal Detection of Fetal Chromosomal Abnormalities by Massively Parallel DNA Sequencing of Cell-Free Fetal DNA from Maternal Blood", Clinical Chemistry (papers in press), 57 (7), 2011, 8 pgs.
Sermon, Karen et al., "Preimplantation genetic diagnosis", The Lancet, Lancet Limited. 363(9421), 2000, 1633-1641.
Servin, B et al., "MOM: A Program to Compute Fully Informative Genotype Frequencies in Complex Breeding Schemes", Journal of Heredity, vol. 93, No. 3, Jan. 1, 2002 (Jan. 1, 2002), pp. 227-228.
Sham, P. et al., "DNA Pooling: A Tool for Large-Scale Association Studies", Nature Reviews Genetics, vol. 3, Nov. 2002, 862-871.
Shaw-Smith, et al., "Microarray Based Comparative Genomic Hybridisation (array-CGH) Detects Submicroscopic Chromosomal Deletions and Duplications in Patients with Learning Disability/Mental Retardation and Dysmorphic Features", J. Med. Genet., 41, 2004, 241-248.
Shen, et al., "High-quality DNA sequence capture of 524 disease candidate genes", High-quality DNA sequence capture of 524 disease candidate genes, Proceedings of the National Academy of Sciences, vol. 108, No. 16, Apr. 5, 2011 (Apr. 5, 2011), pp. 6549-6554.
Shen, R. et al., "High-throughput SNP genotyping on universal bead arrays", Mutation Research, vol. 573, Feb. 11, 2005, 70-82.
Shen, Zhiyong , "MPprimer: a program for reliable multiplex PCR primer design", BMC Bioinformatics 2010, 11:143, 1-7.
Sherlock, J et al., "Assessment of Diagnostic Quantitative Fluorescent Multiplex Polymerase Chain Reaction Assays Performed on Single Cells", Annals of Human Genetics,62, 1, 1998, 9-23.
Shi, H. et al., "Melanoma whole-exome sequencing identifies V600E B-RAF amplification-mediated acquired B-RAF inhibitor resistance", Nature Communications, vol. 3, No. 724, Mar. 6, 2012, 8 pages.
Shiroguchi, K. et al., "Digital RNA sequencing minimizes sequence-dependent bias and amplification noise with optimized single-molecule barcodes", PNAS, vol. 109, No. 4, Jan. 24, 2012, 1347-1352.
Sigdel, T. et al., "Plasma Donor-Derived Cell-Free DNA Quantification by massively multiplex PCR Distinguishes Kidney Transplant Acute Rejection", Transplantation, vol. 102, No. 7S, Jul. 2018, S178-S179.
Sigdel, T. K. et al., "Optimizing Detection of Kidney Transplant Injury by Assessment of Donor-Derived Cell-Free DNA via Massively Multiplex PCR", Journal of Clinical Medicine, vol. 8, No. 19, Dec. 23, 2018, 17 pages.
Simpson, J. et al., "Fetal Cells in Maternal Blood: Overview and Historical Perspective", Annals New York Academy of Sciences, 731, 1994, 1-8.
Sint, Daniela et al., "Advances in Multiplex PCR: Balancing Primer Efficiencies and Improving Detection Success", Methods in Ecology and Evolution, 3, 2012, 898-905.
Slater, Howard et al., "High-Resolution Identification of Chromosomal Abnormalities Using Oligonucleotide Arrays Containing 116,204 SNPs", Am. J. Hum. Genet., 77, 5, 2005, 709-726.

(56) References Cited

OTHER PUBLICATIONS

Snijders, Antoine et al., "Assembly of Microarrays for Genome-Wide Measurement of DNA Copy Number", Nature Genetic, 29, 2001, 263-264.
Snyder, T. M. et al., "Universal noninvasive detection of solid organ transplant rejection", PNAS, vol. 108, No. 15, Apr. 12, 2011, 6229-6234.
Sparks, A. et al., "Non-Invasive Prenatal Detection and Selective Analysis of Cell-Free DNA Obtained from Maternal Blood: Evaluation for Trisomy 21 and Trisomy 18", American Journal of Obstetrics & Gynecology 206, 2012, 319.e1-319.e9.
Sparks, Andrew B. et al., "Selective Analysis of Cell-Free DNA in Maternal Blood for Evaluation of Fetal Trisomy", Prenatal Diagnosis, 32, 2012, 1-7.
Spiro, Alexander et al., "A Bead-Based Method for Multiplexed Identification and Quantitation of DNA Sequences Using Flow Cytometry", Applied and Environmental Microbiology, 66, 10, 2000, 4258-4265.
Spits, C et al., "Optimization and Evaluation of Single-Cell Whole Genome Multiple Displacement Amplification", Human Mutation, 27(5), 496-503, 2006.
Srinivasan, et al., "Noninvasive Detection of Fetal Subchromosome Abnormalities via Deep Sequencing of Maternal Plasma", The American Journal of Human Genetics 92, 167-176, Feb. 7, 2013.
Stephens, Mathews. et al., "A Comparison of Bayesian Methods for Haplotype Reconstruction from Population Genotype Data", Am. J. Hum. Genet.,73, 2003, 1162-1169.
Stevens, Robert et al., "Ontology-Based Knowledge Representation for Bioinformatics", Briefings in Bioinformatics, 1, 4, 2000, 398-414.
Steyerberg, E.W et al., "Application of Shrinkage Techniques in Logistic Regression Analysis: A Case Study", Statistica Neerlandica, 55(1), 2001, 76-88.
Strom, C. et al., "Three births after preimplantation genetic diagnosis for cystic fibrosis with sequential first and second polar body analysis", American Journal of Obstetrics and Gynecology, 178 (6), 1998, 1298-1306.
Strom, Charles M. et al., "Neonatal Outcome of Preimplantation Genetic Diagnosis by Polar Body Removal: The First 109 Infants", Pediatrics, 106( 4), 2000, 650-653.
Stroun, Maurice et al., "Prehistory of the Notion of Circulating Nucleic Acids in Plasma/Serum (CNAPS): Birth of a Hypothesis", Ann. N.Y. Acad. Sci., 1075, 2006, 10-20.
Su, S.Y. et al., ""Inferring combined CNV/SNP haplotypes from genotype data"", Bioinformatics, vol. 26, No. 11,1, Jun. 1, 2010, 1437-1445.
Sun, Guihua et al., "SNPs in human miRNA genes affect biogenesis and function", RNA, 15(9), 2009, 1640-1651.
Sweet-Kind Singer, J. A. et al., "Log-penalized linear regression", IEEE International Symposium on Information Theory, 2003. Proceedings, 2003, 286.
Takano, T. et al., "Epidermal Growth Factor Receptor Gene Mutations and Increased Copy Numbers Predict Gefitinib Sensitivity in Patients With Recurrent Non-Small-Cell Lung Cancer", Journal of Clinical Oncology, vol. 23, No. 28, Oct. 1, 2005, 6829-6837.
Takara Biomedicals, , "Competitive PCR Guide", Lit. # L0126, Aug. 1999, 9 pages.
Taliun, D. et al., "Efficient haplotype block recognition of very long and dense genetic sequences", Bmc Bioinformatics, vol. 15 (10), 2014, 1-18.
Tamura, et al., "Sibling Incest and formulation of paternity probability: case report", Legal Medicine, 2000, vol. 2, p. 189-196.
Tang, et al., Multiplex fluorescent PCR for noninvasive prenatal detection of fetal-derived paternally inherited diseases using circulatory fetal DNA in maternal plasma, Eur J Obstet Gynecol Reprod Biol, 2009, v.144, No. 1, p. 35-39.
Tang, N. et al., "Detection of Fetal-Derived Paternally Inherited X-Chromosome Polymorphisms in Maternal Plasma", Clinical Chemistry, 45 (11), 1999, 2033-2035.

Tebbutt, S. J. et al., "Microarray genotyping resource to determine population stratification in genetic association studies of complex disease", BioTechniques, vol. 37, Dec. 2004, 977-985.
Ten Bosch, J. , "Keeping Up With the Next Generation Massively Parallel Sequencing in Clinical Diagnostics", Journal of Molecular Diagnostics, vol. 10, No. 6, 2008, 484-492.
Tewhey, R. et al., "The importance of phase information for human genomics", Nature Reviews Genetics, vol. 12, No. 3, Mar. 1, 2011, 215-223.
The International Hapmap Consort, , "The International HapMap Project", Nature, vol. 426, Dec. 18, 2003, 789-796.
Thermofisher Scientific, , "Ion AmpliSeq Cancer Hotspot Panel v2", Retrieved from the Internet: https://tools.thermofisher.com/content/sfs/brochures/Ion-AmpliSeq-Cancer-Hotspot-Panel-Flyer.pdf, 2015, 2 pages.
Thomas, M.R et al., "The Time of Appearance and Disappearance of Fetal DNA from the Maternal Circulation", Prenatal Diagnosis, 15, 1995, 641-646.
Tiersch, T. R. et al., "Reference Standards for Flow Cytometry and Application in Comparative Studies of Nuclear DNA Content", Cytometry, vol. 10, Mar. 21, 1989, 706-710.
Tong, Yu et al., "Noninvasive Prenatal Detection of Fetal Trisomy 18 by Epigenetic Allelic Ratio Analysis in Maternal Plasma: Theoretical and Empirical Considerations", Clinical Chemistry, 52(12), 2006, 2194-2202.
Tong, Yu K. et al., "Noninvasive Prenatal Detection of Trisomy 21 by Epigenetic-Genetic Chromosome-Dosage Approach", Clinical Chemistry, 56(1), 2010, 90-98.
Tounta, G. et al., "A Multiplex PCR for Non-invasive Fetal RHD Genotyping Using Cell-free Fetal DNA", in vivo, vol. 25, 2011, 411-418.
Troyanskaya, Olga G. et al., "A Bayesian Framework for Combining Heterogeneous Data Sources for Gene Function Prediction (in *Saccharomyces cerevisiae*)", PNAS, 100(14), 2003, 8348-8353.
Tsui, Nancy B.Y et al., "Non-Invasive Prenatal Detection of Fetal Trisomy 18 by RNA-SNP Allelic Ratio Analysis Using Maternal Plasma SERPINB2 mRNA: A Feasibility Study", Prenatal Diagnosis, 29, 2009, 1031-1037.
Tu, J. et al., "Pair-barcode high-throughput sequencing for large-scale multiplexed sample analysis", BMC Genomics, vol. 13, No. 43, Jan. 25, 2012, 1-9.
Turner, E. et al., "Massively Parallel Exon Capture and Library-Free Resequencing Across 16 Genomes", Nature Methods, 6 (5), 2009, 315-316.
Tynan, J. A. et al., "Restriction Enzyme-Mediated Enhanced Detection of Circulating Cell-Free Fetal DNA in Maternal Plasma", The Journal of Molecular Diagnostics, vol. 13, No. 4, Jul. 2011, 382-389.
Tzimagiorgis, G. et al., "Recovering circulating extracellular or cell-free RNA from bodily fluids", Cancer Epidemiology, vol. 35, 2011, 580-589.
Vallone, Peter , "AutoDimer: a Screening Tool for Primer-Dimer and Hairpin Structures", Bio Techniques, 37, 2004, 226-231.
Varley, Katherine Elena et al., "Nested Patch PCR Enables Highly Multiplexed Mutation Discovery in Candidate Genes", Genome Res., 18(11), 2008, 1844-1850.
Verlinsky, Y. et al., "Over a Decade of Experience with Preimplantation Genetic Diagnosis", Fertility and Sterility, 82 (2), 2004, 302-303.
Wagner, Jasenka et al., "Non-Invasive Prenatal Paternity Testing from Maternal Blood", Int. J. Legal Med., 123, 2009, 75-79.
Wang, D. G. et al., "Large-Scale Identification, Mapping, and Genotyping of Single-Nucleotide Polymorphisms in the Human Genome", Science, vol. 280, May 15, 1998, 1077-1082.
Wang, Eric et al., "Gestational Age and Maternal Weight Effects on Fetal Cell-Free DNA in Maternal Plasma", Prenatal Diagnosis, 33, 2013, 662-666.
Wang, Hui-Yun et al., "A genotyping system capable of simultaneously analyzing >1000 single nucleotide polymorphisms in a haploid genome", Genome Res., 15, 2005, 276-283.
Wang, T.L. et al., "Digital karyotyping", PNAS, vol. 99, No. 25, Dec. 10, 2002, 16156-16161.

(56) References Cited

OTHER PUBLICATIONS

Wang, Yuker et al., "Allele quantification using molecular inversion probes (MIP)", Nucleic Acids Research, vol. 33, No. 21, Nov. 28, 2005, 14 pgs.
Wapner, R. et al., "Chromosomal Microarray Versus Karyotyping for Prenatal Diagnosis", The New England Journal of Medicine, 367 (23), 2012, 2175-2184.
Wapner, R. et al., "First-Trimester Screening for Trisomies 21 and 18", The New England Journal of Medicine, vol. 349, No. 15, Oct. 9, 2003, 1405-1413.
Wapner, R. J. et al., "Expanding the scope of noninvasive prenatal testing: detection of fetal microdeletion syndromes", American Journal of Obstetrics & Gynecology, vol. 212, Dec. 17, 2014, 1.e1-1.e9.
Watkins, N. et al., "Thermodynamic contributions of single internal rA •dA, rC • dC, rG • dG and rU • dT mismatches in RNA/DNA duplexes", Nucleic Acids Research, 9 (5)., 2010, 1894-1902.
Weiss, C. A., "Chapter 8: Confidence Intervals for One Population Mean", Introductory Statistics, Sixth Edition, 2002, 340-381.
Wells, D, "Microarray for Analysis and Diagnosis of Human Embryos", 12th International Congress on Prenatal Diagnosis and Therapy, Budapest, Hungary, 2004, 9-17.
Wells, Dagan, "Advances in Preimplantation Genetic Diagnosis", European Journal of Obstetrics and Gynecology and Reproductive Biology, 115S, 2004, S97-S101.
Wells, Dagan, "Detailed Chromosomal and Molecular Genetic Analysis of Single Cells by Whole Genome Amplification and Comparative Genomic Hybridisation", Nucleic Acids Research, 27, 4, 1999, 1214-1218.
Wen, Daxing et al., "Universal Multiples PCR: A Novel Method of Simultaneous Amplification of Multiple DNA Fragments", Plant Methods, 8(32), NULL, 2012, 1-9.
Widlak, P. et al., "Cleavage Preferences of the Apoptotic Endonuclease DFF 40 (Caspase-activated DNase or Nuclease) on Naked DNA and Chromatin Substrates", The Journal of Biological Chemistry, vol. 275, No. 11, Mar. 17, 2000, 8228-8232.
Wikipedia, "Buffy coat", Retrieved from "https://en.wikipedia.orgJw/index.php?title=Buffy_coat&oldid=900992886", Jun. 9, 019, 2 pgs.
Wikipedia, "Maximum a posteriori estimation", https://en.wikipedia.org/w/index.php?title=Maximum_a_posteriori_estimation&oldid=26878808, [retrieved on Aug. 1, 2017], Oct. 30, 2005, 2 pages.
Wikipedia, , "Stimulant", (available at https://en.wikipedia.org/wiki/Stimulant, accessed Mar. 14, 2016), 17 pages.
Wilton, et al., "Birth of a Healthy Infant After Preimplantation Confirmation of Euploidy by Comparative Genomic Hybridization", N. Engl. J. Med., 345(21), 2001, 1537-1541.
Wilton, L., "Preimplantation Genetic Diagnosis and Chromosome Analysis of Blastomeres Using Comparative Genomic Hybridization", Human Reproduction Update, 11 (1), 2005, 33-41.
Wong, K. K. et al., "Allelic imbalance analysis by high-density single nucleotide polymorphic allele (SNP) array with whole genome amplified DNA", Nucleic Acids Research, vol. 32, No. 9, May 17, 2004, 8 pages.
Wright, C. et al., "The use of cell-free fetal nucleic acids in maternal blood for non-invasive prenatal diagnosis", Human Reproduction Update, vol. 15, no. 1, 2009, 139-151.
Wright, C. F. et al., "Cell-free fetal DNA and RNA in maternal blood: implications for safer antenatal testing", BMJ, vol. 39, 18 Jul. 2009, 161-165.
Wu, Y. Y. et al., "Rapid and/or high-throughput genotyping for human red blood cell, platelet and leukocyte antigens, and forensic applications", Clinica Chimica Acta, vol. 363, 2006, 165-176.
Xia, Tianbing et al., "Thermodynamic Parameters for an Expanded Nearest-Neighbor Model for Formation of RNA Duplexes with Watson-Crick Base Pairs", Biochemistry, 37, 1998, 14719-14735.
Xu, N. et al., "A Mutation in the Fibroblast Growth Factor Receptor 1 Gene Causes Fully Penetrant Normosmic Isolated Hypogonadotropic Hypogonadism", The Journal of Clinical Endocrinology & Metabolism, vol. 92, No. 3, 2007, 1155-1158.
Xu, S. et al., "Circulating tumor DNA identified by targeted sequencing in advanced-stage non-small cell lung cancer patients", Cancer Letters, vol. 370, 2016, 324-331.
Yeh, Iwei et al., "Knowledge Acquisition, Consistency Checking and Concurrency Control for Gene Ontology (GO)", Bioinformatics, 19, 2, 2003, 241-248.
You, Frank M. et al., "BatchPrimer3: A high throughput web application for Pcr and sequencing primer design", BMC Bioinformatics, Biomed Central, London, GB, vol. 9, No. 1, May 29, 2008 (May 29, 2008), p. 253,.
Yuan, X. et al., "Probability Theory-based SNP Association Study Method for Identifying Susceptibility Loci and Genetic Disease Models in Human Case-Control Data", IEEE Trans Nanobioscience, vol. 9, No. 4, Dec. 2010, 232-241.
Yung, T. K. et al., "Single-Molecule Detection of Epidermal Growth Factor Receptor Mutations in Plasma by Microfluidics Digital PCR in Non-Small Cell Lung Cancer Patients", Clinical Cancer Research, vol. 15, Mar. 10, 2009, 2076-2084.
Zachariah, R. et al., "Circulating cell-free DNA as a potential biomarker for minimal and mild endometriosis", Reproductive BioMedicine Online, vol. 18, No. 3, Jan. 27, 2009, 4007-411.
Zhang, L. et al., "Whole genome amplification from a single cell: Implications for genetic analysis", Proc. Nat'l. Acad. Sci. USA, vol. 89, Jul. 1992, 5847-5851.
Zhang, Rui et al., "Quantifying RNA allelic ratios by microfluidic multiplex PCR and sequencing", Nature Methods, 11(1), 2014, 51-56.
Zhao, Xiaojun. et al., "An Integrated View of Copy Number and Allelic Alterations in the Cancer Genome Using Single Nucleotide Polymorphism Arrays", Cancer Research,64, 2004, 3060-3071.
Zhong, X. et al., "Risk free simultaneous prenatal identification of fetal Rhesus D status and sex by multiplex real-time PCR using cell free fetal DNA in maternal plasma", Swiss Medical Weekly, vol. 131, Mar. 2001, 70-74.
Zhou, W. et al., "Counting Alleles Reveals a Connection Between Chromosome 18q Loss and Vascular Invasion", Nature Biotechnology, 19, 2001, 78-81.
Zimmermann, et al., "Noninvasive Prenatal Aneuploidy Testing of Chromosomes 13, 18, 21 X, and Y, Using targeted Sequencing of Polymorphic Loci", Prenatal Diagnosis, 32, 2012, 1-9.
Zimmermann, B., "Declaration Under 37 CFR 1.32", filed in U.S. Appl. No. 14/171,587, dated Feb. 3, 2014, 4 pgs.
Zimmermann, B., "Noninvasive prenatal aneuploidy testing of chromosomes 13, 18, 21, X, and Y, using targeted sequencing of polymorphic loci, Supplemental Information", Prenatal Diagnosis, vol. 32, 2012, 7 pages.
Bai, H. et al., "Detection and Clinical Significance of Intratumoral EGFR Mutational Heterogeneity in Chinese Patients with Advanced Non-Small Cell Lung Cancer", PLOS One, vol. 8, No. 2, Feb. 2013, 7 pages.
Diehl, F. et al., "Detection and quantification of mutations in the plasma of patients with colorectal tumors", PNAS, vol. 102, No. 45, Nov. 8, 2005, 16368-16373.
Fouquet, C. et al., "Rapid and Sensitive p53 Alteration Analysis in Biopsies from Lung Cancer Patients Using a Functional Assay and a Universal Oligonudeotide Array: A Prospective Study", Clinical Cancer Research, vol. 10, May 15, 2004, 3479-3489.
Spertini, D. et al., "Screening of Transgenic Plants by Amplification of Unknown Genomic DNA Flanking T-DNA", BioTechniques, vol. 27, Aug. 1999, 308-314.
Wang, W.-P. et al., "Multiplex single nucleotide polymorphism genotyping by adapter ligation-mediated allele-specific amplification", Analytical Biochemistry, vol. 355, May 5, 2006, 240-248.
Gholami, M. et al., "A tailed PCR procedure for cost-effective, two-order multiplex sequencing of candidate genes in polyploid plants", Plant Biotechnology Journal, vol. 10, 2012, 635-645.
Gundry, C. N. et al., "Base-pair neutral homozygotes can be discriminated by calibrated high-resolution melting of small amplicons", Nucleic Acids Research, vol. 36, No. 10, Apr. 29, 2008, 3401-3408.
Wittwer, C. T. et al., "Real-Time Multiplex PCR Assays", Methods, vol. 25, 2001, 430-448.

(56) References Cited

OTHER PUBLICATIONS

He, QZ et al., "A method for improving the accuracy of non-invasive prenatal screening by cell-free foetal DNA size selection", British Journal of Biomedical science, vol. 75, No. 3, Jul. 2018, 133-138.
Sanchez, C. et al., "New insights into structural features and optimal detection of circulating tumor DNA determined by single-strand DNA analysis", Nature Partner Journals, vol. 3, No. 31, Nov. 23, 2018, 12 pgs.
Vallone, P. M. et al., "A multiplex allele-specific primer extension assay for forensically informative SNPs distributed throughout the mitochondrial genome", Int J Legal Medicine, vol. 118, Feb. 4, 2004, 147-157.
Van Den Oever, J. M. et al., "Single Molecule Sequencing of Free DNA from Maternal Plasma for Noninvasive Trisomy 21 Detection", Clinical Chemistry, vol. 58, No. 4, 2012, 699-706.
Zhang, J. et al., "Presence of Donor-and Recipient-derived DNA in Cell-free Urine Samples of Renal Transplantation Recipients: Urinary DNA Chimerism", Clinical Chemistry, vol. 45, No. 10, 1999, 1741-1746.
Faham, M. et al., "Deep-sequencing approach for minimal residual disease detection in acute lymphoblastic leukemia", Blood Journal, vol. 120, No. 26, Dec. 20, 2012, 5173-5180.
Gao, F. et al., "Characterizing Immunoglobulin Repertoire from Whole Blood by a Personal Genome Sequencer", PLOS One, vol. 8, No. 9, Sep. 13, 2013, 8 pgs.
Hou, X. et al., "Analysis of the Repertoire Features of TCR Beta Chain CDR3 in Human by High-Throughput Sequencing", Cellular Physiology and Biochemistry, vol. 39, Jul. 21, 2019, 651-667.
Bashashati, A. et al., "Distinct evolutionary trajectories of primary high-grade serous ovarian cancers revealed through spatial mutational profiling", Journal of Pathology, vol. 231, 2013, 21-34.
Cronn, R. et al., "Multiplex sequencing of plant chloroplast genomes using Solexa sequencing-by-synthesis technology", Nucleic Acids Research, vol. 36, No. 19, Aug. 27, 2008, 11 pgs.
De Jong, M. M. et al., "Genes other than BRCA 1 and BRCA2 involved in breast cancer susceptibility", J. Med. Genet., vol. 39, 2009, 225-242.
Hodgkinson, C. L. et al., "Tumorigenicity and genetic profiling of circulating tumor cells in small-cell lung cancer", Nature Medicine, vol. 20, No. 8, Aug. 2014, 897-905.
Keller, M. C. et al., "Non-Pathological Paternal Isodisomy of Chromosome 2 Detected From a Genome-Wide SNP Scan", American Journal of Medical Genetics, Part A, 2009, 1823-1826.
Kukita, Y. et al., "High-fidelity target sequencing of individual molecules identified using barcode sequences: de nova detection and absolute quantitation of mutations in plasma cell-free DNA from cancer patients", DNA Research, vol. 22, No. 4, Jun. 29, 2015, 269-277.
Li, R. et al., "SNP detection for massively parallel whole-genome resequencing", Genome Research, vol. 19, 2009, 1124-1132.
Pirker, C. et al., "Whole Genome Amplification for CGH Analysis: Linker-Adapter PCR as the Method of Choice for Difficult and Limited Samples", Cytometry Part A, vol. 61A, 2004, 26-34.
Scarpa, A. et al., "Molecular Typing of Lung Adenocarcinoma on Cytological Samples Using a Multigene Next Generation Sequencing Panel", PLOS One, vol. 8, No. 11, Nov. 13, 2013, 6 pgs.
Short, N. J. et al., "Targeted next-generation sequencing of circulating cell-free DNA vs bone marrow in patients with acute myeloid leukemia", Blood Advances, vol. 4, No. 8, Apr. 23, 2020, 1670-1677.
Siebert, P. D. et al., "An improved PCR method for walking in uncloned genomic DNA", Nucleic Acids Research, vol. 23, No. 6, 1995, 1087-1088.
Yamada, T. et al., "PrimerStation: a highly specific multiplex genomic PCR primer design server for the human genome", Nucleic Acids Research, vol. 34, 2006, W665-W669.
Avgidou, K. et al., "Prospective first-trimester screening for trisomy 21 in 30,564 pregnancies", American Journal of Obstetrics and Gynecology, vol. 192, 2005, 1761-1767.

Barski, A. et al., "High-Resolution Profiling of Histone Methylations in the Human Genome", Cell, vol. 129, May 18, 2007, 823-837.
Bauer, M. et al., "A prospective analysis of cell-free fetal DNA concentration in maternal plasma as an indicator for adverse pregnancy outcome", Prenatal Diagnosis, vol. 26, 2006, 831-836.
Baxter, L. L. et al., "Discovery and genetic localization of Down syndrome cerebellar phenotypes using the Ts65Dn mouse", Human Molecular Genetics, vol. 9, No. 2, Jan. 2000, 195-202.
Bennett, S. T. et al., "Toward the $1000 human genome", Pharmacogenomics, vol. 6, No. 4, 2005, 373-382.
Blow, N., "The personal side of genomics", Nature, vol. 449, Oct. 4, 2007, 627-630.
Chiu, R.W.K. et al., "Hypermethylation of RASSF1A in Human and Rhesus Placentas", The American Journal of Pathology, vol. 170, No. 3, Mar. 2007, 941-950.
Falcon, O., "Screening for trisomy 21 by fetal tricuspid regurgitation, nuchal translucency and maternal serum free b-hCG and PAPP-A at 11+ to 13+6 weeks", Ultrasound Obstet Gynecol, vol. 27, 2006, 151-155.
Fan, J.-B. et al., "Highly Parallel SNP Genotyping", Cold Spring Harbor Symposia on Quantitative Biology, vol. LXVIII, Feb. 2003, 69-78.
Gautier, E. et al., "Fetal RhD genotyping by maternal serum analysis: A two-year experience", American Journal of Obstetrics and Gynecology, vol. 192, 2005, 666-669.
Illumina, , "Automated GoldenGate™ Genotyping on the BeadStation 500", Pub. No. 970-2004-002, 2004, 2 pages.
Illumina, , "GoldenGate Assay Workflow: Illumina's GoldenGate assay protocol provides high-quality, high-multiplex genotyping results with a streamlined workflow", Pub. No. 370-2004-006, 2004, 2 pages.
Illumina, , "Illumine Extends BeadArray Technology to Address Wider Range of SNP Genotyping Projects; New Microarray Offerings Enable Genotyping at 384 and 786 Multiplex", https://www.businesswire.com/news/home/20040504006011/en/Illumina-Extends-BeadArray-Technology-to-Address-Wider-Range-of-SNP-Genotyping-Projects-New-Microarray-Offerings-Enable-Genotyping-at-384-and-786-Multiplex, May 4, 2004, 2 pages.
Illumina, , "Illumina® Beadstation 500: A Scalable System That Grows With Your Research Requirements", Pub. No. 970-2005-003, Jul. 1, 2005, 4 pages.
Illumina, , "Illumina Announces Benchtop SNP Genotyping System", Press Release, Nov. 5, 2003, 3 pages.
Illumina, , "Illumina Begins Shipment of BeadStation 500G Benchtop Genotyping System", Press Release, Apr. 15, 2004, 3 pages.
Illumina, , "MiSeq System Information Sheet", 2018, 3 pgs.
Illumina, , "Preparing Samples for Sequencing Genomic DNA", Part # 11251892 Rev. A, 2007, 18 pages.
Illumina, , "Products & Services", support contact sitemap legal privacy +1 858.202.4566 © 2007 Illumina, Inc. All rights reserved. https://we b. archive .o rg/web/20070321 001 025/http ://www. ii lu m ina.co m/pagesn rn. ii mn?ID= 70, Mar. 21, 2007, 3 pages.
Illumina, , "Technology: Solexa Sequencing Technology", https://web.archive.org/web/20070521 081517/http://www.illumina.com/pages. ilmn?I D=203, May 21, 2007, 1 page.
Jett, K. et al., "Clinical and genetic aspects of neurofibromatosis 1", Genetics in Medicine, vol. 12, No. 1, Jan. 2010, 11 pages.
Johnson, D. S. et al., "Genome-Wide Mapping of in Vivo Protein-DNA Interactions", Science, vol. 316, Jun. 8, 2007, 1497-1502.
Kamel, A. M. et al., "A simple strategy for breakpoint fragment determination in chronic myeloid leukemia", Cancer Genetics and Cytogenetics, vol. 122, 2000, 110-115.
Lapaire, O. et al., "Array-CGH analysis of cell-free fetal DNA in 10 mL of amniotic fluid supernatant", Prenatal Diagnosis, vol. 27, May 17, 2007, 616-621.
Lapierre, J.M. et al., "Analysis of uncultured amniocytes by comparative genomic hybridization: a prospective prenatal study", Prenatal Diagnosis, vol. 20, 2000, 123-131.
Lasken, R. S. et al., "Whole genome amplification: abundant supplies of DNA from precious samples or clinical specimens", TRENDS in Biotechnology, vol. 21, No. 12, Dec. 2003, 531-535.

(56) References Cited

OTHER PUBLICATIONS

Li, Y. et al., "Detection of Paternally Inherited Fetal Point Mutations for b-Thalassemia Using Size-Fractionated Cell-Free DNA in Maternal Plasma", JAMA, vol. 293, No. 7, Apr. 13, 2005, 843-849.

Lo, Y.M.D., "Fetal DNA in Maternal Plasma: Biology and Diagnostic Applications", Clinical Chemistry, vol. 46, No. 12, 2000, 1903-1906.

Masuzaki, H. et al., "Detection of cell free placental DNA in maternal plasma: direct evidence from three cases of confined placental mosaicism", J Med Genet, vol. 41, 2004, 289-292.

Nagalla, S. R. et al., "Proteomic Analysis of Maternal Serum in Down Syndrome: Identification of Novel Protein Biomarkers", Journal of Proteome Research, vol. 6, Mar. 21, 2007, 1245-1257.

Oliphant, A. et al., "Bead.Array™ Technology: Enabling an Accurate, Cost-Effective Approach to High-Throughput Genotyping", Bio Techniques, vol. 32, Jun. 2002, S56-S6.

Pask, R. et al., "Investigating the utility of combining 29 whole genome amplification and highly multiplexed single nucleotide polymorphism BeadArray TM genotyping", BMC Biotechnology, vol. 4, No. 15, Jul. 27, 2004, 8 pages.

Patil, N. et al., "Blocks of Limited Haplotype Diversity Revealed by High-Resolution Scanning of Human Chromosome 21", Science, vol. 294, Nov. 23, 2001, 1719-1723.

Paunio, T. et al., "Preimplantation diagnosis by whole-genome amplification, PCR amplification, and solid-phase minisequencing of blastomere DNA", Clinical Chemistry, vol. 42, No. 9, 1996, 1382-1390.

Philip, J. et al., "Late First-Trimester Invasive Prenatal Diagnosis: Results of an International Randomized Trial", American College of Obstetricians and Gynecologists, vol. 103, No. 6, Jun. 2004, 1164-1173.

Robertson, G. et al., "Genome-wide profiles of STAT1 DNA association using chromatin immunoprecipitation and massively parallel sequencing", Nature Methods, vol. 4, No. 8, Aug. 2007, 651-657.

Roman, B. L. et al., "Non-Radioisotopic AFLP Method Using PCR Primers Fluorescently Labeled with CyA 5", BioTechniques, vol. 26, Feb. 1999, 236-238.

Ruano, G. et al., "Haplotype of multiple polymorphisms resolved by enzymatic amplification of single DNA molecules", Proc. Nati. Acad. Sci. USA, vol. 87, Aug. 1990, 6296-6300.

Samura, O. et al., "Diagnosis of Trisomy 21 in Fetal Nucleated Erythrocytes from Maternal Blood by Use of Short Tandem Repeat Sequences", Clinical Chemistry, vol. 47, No. 9, 2001, 1622-1626.

Seppo, A. et al., "Detection of circulating fetal cells utilizing automated microscopy: potential for noninvasive prenatal diagnosis of chromosomal aneuploidies", Prenatal Diagnosis, vol. 28, Jul. 22, 2008, 815-821.

Spencer, K. et al., "Maternal serum levels of dimeric inhibin a in pregnancies affected by trisomy 21 in the first trimester", Prenatal Diagnosis, vol. 21, 2001, 441-444.

Spencer, K. et al., "Maternal serum levels of total activin-A in first-trimester trisomy 21 pregnancies", Prenatal Diagnosis, vol. 21, 2001, 270-273.

Swinkels, D. W. et al., "Effects of Blood-Processing Protocols on Cell-free DNA Quantification in Plasma", Clinical Chemistry, vol. 49, No. 3, 2003, 525-526.

Tsangaris, G. T. et al., "Proteomic analysis of amniotic fluid in pregnancies with Down syndrome", Proteomics, vol. 6, 2006, 4410-4419.

Vogelstein, B. et al., "Digital PCR", Proc. Natl. Acad. Sci. USA, vol. 96, Aug. 1999, 9236-9241.

Binladen, J. et al., "The Use of Coded PCR Primers Enables High-Throughput Sequencing of Multiple Homolog Amplification Products by 454 Parallel Sequencing", PLOS One, Issue 2, Feb. 2007, 9 pages.

Gnirke, A. et al., "Solution hybrid selection with ultra-long oligonucleotides for massively parallel targeted sequencing", Nature Biotechnology, vol. 27, No. 2, Feb. 2009, 182-189.

Tewhey, R. et al., "Microdroplet-based PCR enrichment for large-scale targeted sequencing", Nature Biotechnology, vol. 27, No. 11, Nov. 2009, 1025-1031.

Zhou, W. et al., "Counting alleles to predict recurrence of early-stage colorectal cancers", The Lancet, vol. 359, Jan. 19, 2002, 219-225.

Canick, J. A., et al., "The impact of maternal plasma DNA fetal fraction on next generation sequencing tests for common fetal aneuploidies", Prenatal Diagnosis, 2013, 667-674.

Landegren, U., et al., "Padlock and proximity probes for in situ and array-based analyses: tools for the post-genomic era", Comparative and Functional Genomics, 2003, 525-530.

Matsuzaki, H., et al., "Genotyping over 100,000 SNPs on a pair of oligonucleotide arrays", Nature Methods, Nov. 2004, 109-111.

Nilsson, M., et al., "Padlock Probes: Circularizing Oligonucleotides for Localized DNA Detection", Science, Sep. 10, 1994, 2085-2088.

Parameswaran, P., et al., "A pyrosequencing-tailored nucleotide barcode design unveils opportunities for large-scale sample multiplexing", Nucleic Acids Research, Oct. 11, 2007, 9 pages.

Syvanen, A.C., "Toward genome-wide SNP genotyping", Nature Genetics Supplement, Jun. 2005, S5-510.

Yaron, Y., "The implications of non-invasive prenatal testing failures: a review of an under-discussed phenomenon", Prenatal Diagnosis, 2016, 391-396.

"Abstracts for CNAPS III Circulating Nucleic Acids in Plasma and Serum and Serum Proteomics", Clinical Chemistry, vol. 49, No. 11, 2003, 33 pages.

"Abstracts for CNAPS IV Circulating Nucleic Acids in Plasma/Serum", Fourth International Conference on Circulating Nucleic Acids in Plasma/Serum (CNAPS-IV), 2005, 40 pages.

Ambardar, S. et al., "High Throughput Sequencing: An Overview of Sequencing Chemistry", Indian J. Microbiol., vol. 56, No. 4, 2016, 394-404.

Anker, P. et al., "The Second International Symposium on Circulating Nucleic Acids in Plasma and Serum (CNAPS-2) held in conjunction with the 6th Annual Scientific Symposium of the Hong Kong Cancer Institute", Clinical Chemistry, vol. 47, No. 2, 2001, 361-370.

Bale, J. R. et al., "Reducing Birth Defects: Meeting the Challenge in the Developing World", Institute of Medicine of the National Academies, 2003, 270 pgs.

Chitty, L. S. et al., "Noninvasive Prenatal Screening for Genetic Diseases Using Massively Parallel Sequencing of Maternal Plasma DNA", Cold Spring Harbor Perspectives in Medicine, vol. 5, No. 9, 2015, 20 pages.

Choi, Y. et al., "Comparison of phasing strategies for whole human genomes", PLOS Genetics, Apr. 5, 2018, 26 pages.

Clausen, F. B. et al., "Improvement in fetal DNA extraction from maternal plasma. Evaluation of the NucliSens Magnetic Extraction system and the QIAamp DSP Virus Kit in comparison with the QIAamp DNA Blood Mini Kit", Prenatal Diagnosis, vol. 27, 2007, 6-10.

Di, X. et al., "Dynamic model based algorithms for screening and genotyping", Bioinformatics, vol. 21, No. 9, 2005, 1958-1963.

Ding, C. et al., "MS analysis of single-nucleotide differences in circulating nucleic acids: Application to noninvasive prenatal diagnosis", PNAS, vol. 101, No. 29, Jul. 20, 2004, 10762-10767.

Dressman, D. et al., "Transforming single DNA molecules into fluorescent magnetic particles for detection and enumeration of genetic variations", PNAS, vol. 100, No. 15, Jul. 22, 2003, 8817-8822.

Eltoukhy, H. et al., "Modeling and Base-Calling for DNA Sequencing-By-Synthesis", IEEE, 2006, II-1032-II-1035.

Fortina, P. et al., "DOP-PCR Amplification of Whole Genomic DNA and Microchip-Based Capillary Electrophoresis", Methods in Molecular Biology: Capillary Electrophoresis of Nucleic Acids, vol. II Practical Applications of Capillary Electrophoresis, 2001, 211-219.

Griffiths, A. J. et al., "An Introduction to Genetic Analysis", Sixth Edition, 1996, 5 pages.

Grunenwald, H., "Optimization of Polymerase Chain Reactions", Methods in Biology, vol. 226, 2003, 89-99.

(56) References Cited

OTHER PUBLICATIONS

Hosono, S. et al., "Unbiased Whole-Genome Amplification Directly From Clinical Samples", Genome Research, vol. 13, 2003, 954-964.
Huang, D. J. et al., "Use of an Automated Method Improves the Yield and Quality of Cell-Free Fetal DNA Extracted from Maternal Plasma", Clinical Chemistry, vol. 51, No. 12, 2005, 2419-2420.
Illumina, "History of Sequencing by Synthesis", https://www.illumina.com/science/technology/next-generation-sequencing/illumina-sequencing-history.html, 2020, 3 pages.
Illumina, "Preparing Samples for Sequencing Genomic DNA", (available at http://zazil.ibt.unam.mx/usmb/wpcontent/uploads/2016/05/1003806_Genomic_DNA_Sample_Prep.pdf), Part #1003806 Rev. A, 2007, 20 pages.
Innan, H. et al., "The Pattern of Polymorphism on Human Chromosome 21", Genome Research, vol. 13, 2003, 1158-1168.
Jiang, P. et al., "The Long and Short of Circulating Cell-Free DNA and the Ins and Outs of Molecular Diagnostics", Trends in Genetics, vol. 32, No. 6, Jun. 2016, 360-371.
Kirkness, E. F. et al., "Sequencing of isolated sperm cells for direct haplotyping of a human genome", Genome Research, vol. 23, 2013, 826-832.
Lu, S. et al., "Probing Meiotic Recombination and Aneuploidy of Single Sperm Cells by Whole-Genome Sequencing", Science, vol. 338, Dec. 21, 2012, 1627-1630.
Meyerson, M. et al., "Advances in understanding cancer genomes through second-generation sequencing", Nature Reviews: Genetics, vol. 11, Oct. 2010, 685-696.
Mikkelsen, T. S. et al., "Genome-wide maps of chromatin state in pluripotent and lineage-committed cells", Nature, vol. 448, No. 2, Aug. 2007, 553-562.
Morris, J. K. et al., "Trends in Down's syndrome live births and antenatal diagnoses in England and Wales from 1989 to 2008: analysis of data from the National Down Syndrome Cytogenetic Register", BMJ Online, vol. 339, Oct. 2009, 5 pages.
Nishigaki, K. et al., "Random PCR-Based Genome Sequencing: A Non-Divide-and-Conquer Strategy", DNA Research, vol. 7, 2000, 19-26.
Pont-Kingdon, G. et al., "Rapid Detection of Aneuploidy (Trisomy 21) by Allele Quantification Combined with Melting Curves Analysis of Single-Nucleotide Polymorphism Loci", Clinical Chemistry, vol. 49, No. 7, 2003, 1087-1094.
Quinlan, M. P. , "Amniocentesis: Indications and Risks", American Medical Association Journal of Ethics: Virtual Mentor, vol. 10, No. 5, May 2008, 304-306.
Reeves, R. H. et al., "Too much of a good thing: mechanisms of gene action in Down syndrome", Trends in Genetics, vol. 17, No. 2, Feb. 2, 2001, 83-88.
Rhoads, A. et al., "PacBio Sequencing and Its Applications", Genomics Proteomics Bioinformatics, vol. 13, Nov. 2, 2015, 278-289.
Schubert, "Picking out prenatal DNA", Nature Medicine, vol. 10, No. 785, Aug. 2004, 1 page.
Shendure, J. et al., "Accurate Multiplex Polony Sequencing of an Evolved Bacterial Genome", Science, Nov. 30, 2007, 18-24.
Shendure, J. et al., "Next-generation DNA sequencing", Nature Biotechnology, vol. 26, No. 10, Oct. 2008, 1135-1145.
Shokralla, S. et al., "Next-generation DNA barcoding: using next-generation sequencing to enhance and accelerate DNA barcode capture from single specimens", Molecular Ecology Resources, vol. 14, 2014, 892-901.
Sivertsson, A. et al., "Pyrosequencing as an Alternative to Single-Strand Conformation Polymorphism Analysis for Detection of N-ras Mutations in Human Melanoma Metastases", Clinical Chemistry, vol. 48, No. 12, 2002, 2164-2170.
Stewart, C. M. et al., "Circulating cell-free DNA for non-invasive cancer management", Cancer Genetics, vol. 228-229, 2018, 169-179.
Taback, B. et al., "Quantification of Circulating DNA in the Plasma and Serum of Cancer Patients", Ann. N.Y. Acad. Sci, vol. 1022, 2004, 17-24.

Von Eggeling, F. et al., "Applications of Random PCR", Cellular and Molecular Biology, vol. 41, No. 5, 1995, 653-670.
Wang, J. et al., "Genome-wide Single-Cell Analysis of Recombination Activity and De Novo Mutation Rates in Human Sperm", Cell, vol. 150, Jul. 20, 2012, 402-412.
Wei, C. et al., "Detection and Quantification by Homogeneous PCR of Cell-free Fetal DNA in Maternal Plasma", Clinical Chemistry, vol. 47, No. 2, 2001, 336-338.
Winsor, E. J. et al., "Maternal Cell Contamination in Uncultured Amniotic Fluid", Prenatal Diagnosis, vol. 16, 1996, 49-54.
Wu, T.L. et al., "Cell-free DNA: measurement in various carcinomas and establishment of normal reference range", Clinica Chimica Acta, vol. 321, 2002, 77-87.
Zheng, S. et al., "Whole Genome Amplification Increases the Efficiency and Validity of Buccal Cell Genotyping in Pediatric Populations1", Cancer Epidemiology, Biomarkers & Prevention, vol. 10, Jun. 2001, 697-700.
Zlotogora, J. , "Penetrance and expressivity in the molecular age", Genetics in Medicine, vol. 5, No. 5, 2003, 347-352.
Agbor-Enoh, S. et al., "Donor-derived cell-free DNA predicts allograft failure and mortality after lung transplantation", EBioMedicine, vol. 40, 2019, 541-553.
Kanou, et al., "Cell-free DNA in human ex vivo lung perfusate as a potential biomarker to predict the risk of primary graft dysfunction in lung transplantation", The Journal of Heart and Lung Transplantation, vol. 36, No. 45, 2017, S187.
Marshutina, N. V. et al., "Comparative Clinical and Diagnostic Significance of Some Serological Tumor Associated Markers for Different Histological Types of Lung Cancer", Russian Oncological Journal, vol. 3, 2010, 13-16.
Xu, W. et al., "A Novel Universal Primer-Multiplex-PCR Method with Sequencing Gel Electrophoresis Analysis", PLOS One, vol. 7, No. 1, Jan. 17, 2012, 10 pgs.
Abaan, O. D. et al., "The Exomes of the NCI-60 Panel: A Genomic Resource for Cancer Biology and Systems Pharmacology", Cancer Es., vol. 73, No. 14, Jul. 15, 2013, 4372-4382.
Amicucci, P. et al., "Prenatal Diagnosis of Myotonic Dystrophy Using Fetal DNA Obtained from Maternal Plasma", Clinical Chemistry, vol. 46, No. 2, 2000, 301-302.
Anker, P. et al., "Circulating DNA in Plasma or Serum", Medicina, vol. 60, 2000, 699-702.
Auld, D. S., "Use of Chelating Agents to Inhibit Enzymes", Methods in Enzymology, vol. 158, 1988, 110-114.
Banfi, G. et al., "The role of ethylenediamine tetraacetic acid (EDTA) as in vitro anticoaagulant for diagnostic purposes", Clin. Chem., vol. 45, No. 5, 2007, 565-576.
Barra, G. B. et al., "EDTA-mediated inhibition of DNases protects circulating cell-free DNA from ex vivo degradtion in blood samples", Clinical Biochemistry, vol. 48, 2015, 976-981.
Bergen, A. W. et al., "Effects of DNA mass on multiple displacement whole genome amplification and genotyping performance", BMC Biotechnology, vol. 5, No. 24, Sep. 16, 2005, 11 pgs.
Bischoff, F. Z. et al., "Cell-free fetal DNA in maternal blood: kinetics, source and structure", Human Reproduction Update, vol. 11, No. 1, 2005, 59-67.
Bischoff, F. Z. et al., "Intact fetal cells in maternal plasma: are they really there?", Lancet, vol. 361, 2003, 139-140.
Board, R.E. et al., "Detection of BRAF mutations in the tumour and serum of patients enrolled in the AZD6244 (ARR-142886) advanced melanoma phase II study", British Journal of Cancer, vol. 101, 2009, 1724—1730.
Boudsocq, F. et al., "Sulfolobus solfataricus P2 DNA polymerase IV (Dpo4): an archaell DinB-like DNA polymerase with lesion-bypass properties akin to eukaryotic poln", Nucleic Acids Research, vol. 29, No. 22, 2001, 4607-4616.
Bouma, B. N. et al., "Human Blood Coagulation Factor", The Journal of Biological Chemistry, vol. 252, No. 18, 1977, 6432-6437.
Brinza, D. et al., "2SNP: scalable phasing based on 2-SNP haplotypes", Bioinformatics, vol. 22, No. 3, 2006, 371-373.
Browning, S. R. et al., "Rapid and Accurate Haplotype Phasing and Missing-Data Inference for Whole-Genome Association Studies By Use of Localized Haplotype Clustering", The American Journal of Human Genetics, vol. 81, Nov. 2007, 1084-1097.

(56) References Cited

OTHER PUBLICATIONS

Bryant, A. P., "Terminology of Sugars", Ind. Eng. Chem., vol. 26, No. 2, 1933, 231.
Burkey, B. F. et al., "Hepatic apolipoprotein J. is secreted as a lipoprotein", Journal of Lipid Research, vol. 33, 1992, 1517-1526.
Calin, G. A. et al., "A MicroRNA Signature Associated with Prognosis and Progression in Chronic Lymphocytic Leukemia", N Engl J Med, vol. 353, 2005, 1793-1801.
Cao, Y. et al., "Clinical Evalution of Branched DNA Signal Amplification for Quantifying HIV Type 1 in Human Plasma", AIDS Research and Human Retroviruses, vol. 11, No. 3, 1995, 353-361.
Chen, C. P. et al., "Fetal DNA in maternal plasma: the prenatal detection of a paternally inherited fetal aneuploidy", Prenatal Diagnosis, vol. 20, 2000, 353-357.
Chim, S. S. et al., "Detection and Characterization of Placental MicroRNAs in Maternal Plasma", Clinical Chemistry, vol. 54, No. 3, 2008, 482-490.
Chinnapapagari, S. K. et al., "Treatment of Maternal Blood Samples with Formaldehyde Does Not Alter the Proportion of Circulatory Fetal Nucleic Acids (DNA and mRNA) in Maternal Plasma", Clinical Chemistry, vol. 51, No. 3, 2005, 653-655.
Chung, G. T. et al., "Lack of Dramatic Enrichment of Fetal DNA in Maternal Plasma by Formaldehyde Treatment", Clinical Chemistry, vol. 51, No. 3, 2005, 655-658.
Ciriello, G. et al., "Emerging landscape of oncogenic signatures across human cancers", Nature Genetics, vol. 45, No. 10, Oct. 2013, 1127-1135.
Delaneau, O. et al., "Shape-IT: new rapid and accurate algorith for haplotype interence", BMC Bioinformatics, vol. 9, No. 540, Dec. 16, 2008, 14 pages.
Dias-Santagata, D. et al., "BRAF V600E Mutations Are Common in Pelomorphic Xanthoastrocytoma: Diagnostic and Therapeutic Implication", PLoS One, vol. 6, No. 3, Mar. 2011, 9 pages.
Dickover, R. E. et al., "Optimization of Specimen-Handling Procedures for Accurate Quantitation of Levels of Human Immunodeficiency Virus RNA in Plasma by Reverse Transcriptase PCR", Journal of Clinical Microbiology, vol. 36, No. 4, 1998, 1070-1073.
Dowd, P. et al., "On the mechanism of the anticlotting action of vitamin R quinone", Proc. Natl. Acad. Sci. USA, vol. 92, 1995, 8171-8175.
Downward, J., "Targeting Ras Signalling Pathways in Cancer Therapy", Nature Reviews, vol. 3, Jan. 2003, 11-22.
Erlich, R. L. et al., "Next-generation sequencing for HLA typing of class loci", BMC Genomics, vol. 12, No. 42, 2011, 13 pages.
Eronen, L. et al., "HaploRec: efficient and accurate large-scale reconstruction of haplotypes", BMC Bioinformatics, vol. 7, No. 542, Dec. 22, 2006, 18 pages.
Fackenthal, J. D. et al., "Aberrant RNA splicing and its functional consequences in cancer cells", Disease Models & Mechanisms, vol. 1, 2008, 37-42.
Fortina, P. et al., "Detection of the most common mutations causing beta-thalassemia in Mediterraneans using a multiplex amplification refractory mutation system (MARMS)", Genome Res., vol. 2, 1992, 163-166.
Gu, H. et al., "Diagnostic role of MicroRNA expression profile in the serum of pregnant women with fetuses with neural tube defects", Journal of Neurochemistry, vol. 122, 2012, 641-649.
Hahn, S. et al., "Current applications of single cell PCR", CMLS Cellular and Molecular. Life Sciences, vol. 57, 2000, 96-105.
Howie, B. N. et al., "A Flexible and Accurate Genotype Imputation Method for the Next Generation of Genome-Wide Association Studies", PLoS Genetics, vol. 5, No. 6, Jun. 2009, 15 pages.
Hu, Y. et al., "Detection of Extrahepatic Hepatitis C Virus Replication by a Novel, Highly Sensitive, Single-Tube Nested Polymerase Chain Reaction", Am. J. Clin Pathol., vol. 119, 2003, 95-100.
Huang, J. et al., "Whole genome DNA copy number changes identified by high density oligonucleotide arrays", Human Genomics, vol. 1, No. 4, May 2004, 287-299.

Hung, E.C.W. et al., "Detection of circulating fetal nucleic acids: a review of methods and applications", J. Clin. Pathol., vol. 62, 2009, 308-313.
Ivanov, M. et al., "Non-random fragmentation patterns in circulating cell-free DNA reflect epigenetic regulation", BMC Genomics, vol. 16 (Suppl 13):S1, Jun. 2015, 12 pgs.
Jennings, C. et al., "Investigation of Effects of Acid Citrate Dextrose and EDTA on Ability to Quantitatively Culture Human Immunodeficiency Virus", Journal of Clinical Microbiology, vol. 38, No. 9, 2000, 3522.
Jewesburty, E.C.O., "Reactions after Transfusion of Store Blood", The British Medical Journal, vol. 1, No. 4191, 1941, 664-665.
Johnson, J. B. et al., "Differential mechanisms of complementmediated Neutralization of the closely related paramyxoviruses simian virus 5 and mumps virus", Virology, vol. 376, No. 1, 2008, 112-123.
Johnson, K. L. et al., "Interlaboratory Comparison of Fetal Male DNA Detection from Common Maternal Plasma Samples by Real-Time PC", Clinical Chemistry, vol. 50, No. 3, 2004, 516-521.
Keith, L. et al., "Clinical Experience With the Prevention of Rh-Isoimmunization: A Historical Comparative Analysis", American Journal of Reproductive Immunology, vol. 5, 1984, 84-89.
Kiernan, J. A., "Formaldehyde, formalin, paraformaldehyde and glutaraldehyde: Whaat they are and what they do.", Microscopy Today, vol. 1, 2000, 8-12.
Kimmel, G. et al., "Gerbil: Genotype resolution and block identification using likelihood", PNAS, vol. 102, No. 1, Jan. 4, 2005, 158-162.
Kohler, C. et al., "Levels of plasma circulating cell free nuclear and mitochondrial DNA as potential biomakers for breast tumors", Molecular Cancer, vol. 8, No. 105, Nov. 17, 2009, 9 pages.
Lecomte, T. et al., "Detection of Free-Circulating Tumor-Associated DNA in plasma of Colorectal Cancer Patients and its association with Prognosis", Int. J. Cancer, vol. 100, 2002, 542-548.
Lee, T. et al., "Down synodrome and cell-free fetal DNA in archived maternal serum", AmJ obstet Gynecol, vol. 187, No. 5, 1217-1221, Nov. 2002.
Lee, T.H. et al., "Quantitation of genomic DNA in plasma and serum samples:higher concentrations of genomic DNA found in serum than in plasma", Transfusion, vol. 41, Feb. 2001, 276-282.
Lichtenstein, A. V. et al., "Circulating Nucleic Acids and Apoptosis", Annals New York Academy of Sciences, vol. 945, 1993, 239-249.
Lo, Y.M.D. et al., "Prenatal diagnosis: progress through plasma nucleic acids", Nature Reviews, vol. 8, 2007, 71-77.
Lovmar, L. et al., "Quantitative evaluation by minisequencing and microarrays reveals accurate multiplexed SNP genotyping of whole genome amplified DN", Nucleic Acids Research, vol. 31, No. 21, 2003, 9 pgs.
Mackieqicz, D. et al., "Distribution of Recombination Hotspots in the Human Genome—A Comparison of Computer SImulations with Real Data", PLOS One, vol. 8, No. 6, Jun. 2013, 11 pages.
McDonald, J. P. et al., "Novel thermostable Y-family polymerases: applications for the PCR aamplification of damaged or ancients DNAs", Nucleic Acids Research, vol. 34, No. 4, 2006, 1102-1111.
Murali, R. et al., "Crystal structure of Taq DNA polymerase in complex with anhibitory Fab: The Fab is directed against an intermediate in the helix-coil dynamics of the enzyme", Proc. Natl. Acad. Sci. USA, vol. 95, Oct. 1998, 12562-12567.
Olive, M. et al., "Characterization of the DiFi Rectal Carcinoma Cell Line Derived from a Familial Adenomatous Polyposis Patient", In Vitro Cellular & Developmental Biology, vol. 29A, No. 3, Part 1, Mar. 1993, 239-248.
Olney, R. S. et al., "Chorionic Villus Sampling and Amniocentesis: Recommendations for Prenatal Counseling", MMWR: Recommendations and Reports, 44(RR-9), Jul. 21, 1995, 1-12.
Parker, A. V. et al., "The Effect of Sodium Citrate on the Stimulation of Polymorphonuclear Leukocytes", Investigative Opthalmology & Visual Science, vol. 26, 1985, 1257-1261.
Pelizzari, C. A. et al., "Quantitative analysis of DNA Arraay autoradiographs", Nucleic Acids Research, vol. 28, No. 22, 2000, 4577-4581.

(56) References Cited

OTHER PUBLICATIONS

Qin, Z. S. et al., "Partition-Ligation—Expectation-Maximization Algorithm for Haplotype Inference with Single-Nucleotide Polymorphisms", Am. J. Hum Genet., vol. 71, 2002, 1242-1247.
Quan, P. C. et al., "Studies on the mechanism of NK cell lysis", The Journal of Immunology, vol. 128, 1982, 1786-1791.
Rosado, J. A. et al., "Tyrosine kinases activate store mediated Ca2+ entry in human platelets through the reorganization of the actin cytoskeleton", Biochem. J., vol. 351, 2000, 429-437.
Rosen, D. R. et al., "Mutations in Cu/Zn superoxide dismutase gene are associated with familial amyotrophic lateral sclerosis", Nature, vol. 362, Mar. 4, 1993, 59-62.
Ryan, B. M. et al., "A prospective study of circulating mutant KRAS2 in the serum of patients with colorectal neoplasia: strong prognostic indicator in postperative follow up", Gut, vol. 52, 2003, 101-108.
Sahukhal, G. S. et al., "msaABCR operon positively regulates biofilm development by repressing proteases and autolysis in *Staphlococcus aureus*", FEMS Microbiology Letters, vol. 362, No. 4, 2015, 1-10.
Saito, H. et al., "Prenatal DNA diagnosis of a single-gene disorder from maternal plasma", The Lancet, vol. 356, Sep. 30, 2000, 1170.
Scheet, P. et al., "A Fast and Flexible Statistical Model for Large-Scale Population Genotype Data: Applications to Inferring Missing Genotypes and Haplotypic Phase", The American Journal of Human Genetics, vol. 78, Apr. 2006, 629-644.
Schwarzenbach, H. et al., "Evaluation of cell-free tumour DNA and RNA in patients with breast cancer and benign breast disease", Molecular BioSystems, vol. 7, 2011, 2848-2854.
Shinozaki, M. et al., "Utility of Circulating B-RAF DNA Mutation inn Serum for Monitoring Melanoma Patients receiving Biochemotherapy", Clin Cancer Res, vol. 13, No. 7, Apr. 1, 2007, 2068-2074.
Solomon, M. J. et al., "Formaldehyde-mediated DNA-protein crosslinking: A probe for in vivo chromatin structures", Proc. Natl. Acad. Sci. USA, vol. 82, 1985, 6470-6474.
Stephens, M. et al., "Accounting for Decay of Linkage Disequilibrium in Haplotype Inference and Missing-Data Imputation", Am. J. Hum. Genet., vol. 76, 2005, 449-462.
Su, Z. et al., "A Platform for Rapid Detection of Multiple Oncogneic Mutations With Relevance to Targeted Therapy in Non—Small-Cell Lung Cancer", The Journal of Molecular Diagnostics, vol. 13, No. 1, Jan. 2011, 74-84.
Thavarajah, R. et al., "Chemical and physical basics of routine formaldehyde fixation", Journal of Oral and Maxillofacial Pathology, vol. 16, No. 3, 2012, 400-405.
Tsui, N. B. et al., "Systematic micro-array based identification of placental mRNA in maternal plasma: towards non-invasive prenatal gene expression profiling", J. Med. Genet, vol. 41, 2004, 461-467.
Urbaniak, S. J. et al., "RhD haemolytic disease of the fetus and the newborn", Blood Reviews, vol. 14, 2000, 44-61.
Van Uitert, I. et al.,, "The influence of different membrane components on the electrical stability of bilayer lipid membranes", Biochimica et Biophysica Acta, vol. 1798, 2010, 21-31.
Wang, S. et al., "Potential Clinical Significance of Plasma-Based KRAS Mutation Analysis in Patients with Advanced Non—Small Cell Lung Cancer", Clin Cancer Res. vol. 16, No. 4, Feb. 15, 2010, 1324-1330.
Yamada, T. et al., "Detection of K-ras Gene Mutations in Plasma DNA of Patients with Pancreatic Adenocarcinoma: Correlation with Clinicopathological Features", Clinical Cancer Research, vol. 4, Jun. 1998, 1527-1532.
Couraud, S. et al., "Noninvasive Diagnosis of Actionable Mutations by Deep Sequencing of Circulating Free DNA in lung Cancer from Never-Smokers: A Proof-of-Concept Study from BioCAST/IFCT-1002", Clinical Cancer Research, vol. 20, No. 17, Jul. 10, 2014, 4613-4624.
Couraud, S. et al., "Supplementary Data for Noninvasive Diagnosis of Actionable Mutations by Deep Sequencing of Circulating Free DNA in lung Cancer from Never-Smokers: A Proof-of-Concept Study from BioCAST/IFCT-1002", 2014, 13 pages.
Langmore, J., "Quality Control and Pre-Qualifications of NGS Libraries Made from Clinical Samples", ABRF 2013 Satellite Workshop, Mar. 2, 2013, 35 pages.
Takashima, Y. et al., "Expansion—contraction of photoresponsive artificial muscle regulated by host—guest interactions", Nature Communications, vol. 3, No. 1270, Dec. 11, 2012, 8 pages.
Beck, J. , et al., "Profile of the Circulating DNA in Apparently Healthy Individual", Clinical Chemistry, 2009, 730-738.
Bianchi, D W, et al., "Insights Into Fetal and Neonatal Development Through Analysis of Cell-Free RNA in Body Fluids", Early Human Development, vol. 86, No. 11, Nov. 2010, 747-752.
Blomquist, T M, et al., "Targeted RNA-Sequencing with Competitive Multiplex-PCR Amplicon Libraries", Plos One, vol. 8, Issue 11, Nov. 2013, 14 pages.
Broude, N. E., et al., "High Multiplexity PCR Based on PCR Suprression", DNA Amplification Current Technologies and Applications, 2004, 61-76.
Broude, N E, et al.,"High-Level Multiplex DNA Amplification", Antisense & Nucleic Acid Drug Development, vol. 11, 2001, 327-332.
Broude, N. E., et al., "Multiplex Allele-specific Target Amplification based on PCR Suprression", PNAS, vol. 98, No. 1, Jan. 2, 2001, 206-211.
Campbell, P. J., et al., "Subclonal phylogenetic structures in cancer revealed by ultra-deep sequencing", PNAS, Sep. 2, 2008, 13081-13086.
Castleberry, C. D., et al., "Quantification of Circulating Cell-Free DNA in Pediatric Heart Transplant Recipients", Journal of Heart and Lung Transplantation, Apr. 1, 2011, S139.
Edwards, M. C., et al., "Multiplex PCR: Advantages, Development and Applications", Genome Research, 1994, S65-S75.
Fan, C H, et al., "Detection of Aneuploidy with Digital Polymerase Chain Reaction", Analytical Chemistry, vol. 79, No. 19, Oct. 1, 2007, 7576-7579.
Frohman, M A, et al., "On Beyond Classic RACE (Rapid Amplification of cDNA Ends)", Genome Research, vol. 4, 1994, S40-S58.
Garcia Moreira, V. , et al., "Cell-Free DNA as a Noninvasive Acute Rejection Marker in Renal Transplantation", Clinical Chemistry, 2009, 1958-1966.
Guo, H , et al., "A Specific and Versatile Genome Walking Technique", Gene, vol. 381, 2006, 18-23.
Hyndman, D L, et al., "PCR Primer Design", Methods in Molecular Biology, vol. 226, Second Edition, 2003, 81-88.
Illumina , "Hiseq 2500 Sequencing System", System Specification Sheet: Sequencing, 2015, 4 pgs.
Illumina , "TruSeq™ RNA and DNA library Preparation Kits v2", Data Sheet: Illumina® Sequencing, 2014, 4.
Iskow, R. C. et al., "Natural Mutagenesis of Human Genomes by Endogenous Retrotransposons", Cell, vol. 141, Jun. 25, 2010, 1253-1261.
Junppner, H. , et al., "Functional Properties of the PTH/PTHrP Receptor", Bone, Aug. 1995, 39S-42S.
Kane, M. , et al., "Application of Less Primer Method of Commercial Kits", Forensic Science International: Genetics Supplement Series, vol. 1, Issue 1, 2008, 41-43.
Kivioja, T. , et al., "Counting absolute number of molecules using unique molecular identifiers", Nature Proceedings, Apr. 14, 2011, 18 pgs.
Kivioja, T. , et al., "Counting absolute numbers of molecules using unique molecular identifiers", Nature Methods, Jan. 2012, 72-76.
Konfortov, B A, et al., "A High-Resolution Happy Map of Dictyostelium discodieum Chromosome 6", Genomoe Research, vol. 10, No. 11, Nov. 2000, 1737-1742.
Kopreski, MS , et al., "Detection of mutant K-ras DNA in plasma or serum of patients with colorectal cancer", British Journal of Cancer, 1997, 1293-1299.
Lavrentieva, I , et al., "High Polymorphism Level of Genomic Sequences Flanking Insertion Sites of Human Endogenous Restroviral Long Terminal Repeats", FEBS Letters, vol. 443, No. 3, Jan. 29, 1999, 341-347.

(56) References Cited

OTHER PUBLICATIONS

Lee, J., et al., "Anchored Multiplex PCR Enables Sensitive and Specific Detection of Variants in Circulating Tumor DNA by Next-Generation Sequencing", DOI:https://doi.org/10.16/j.cancergen. 2017.04.049, Cancer Genetics 214-215, 2017, 47.
Metzker, M. L., et al., "Polymerase Chain Reaction", Encyclopedia of Medical Devices and Instrumentation, vol. 5, Second Edition, 2006, 380-387.
Metzker, M. L., et al., "Quantitation of Mixed-Based Populations of HIV-1 Variants by Automated DNA Sequencing with BODIPY* Dye-Labeled Primers", BioTechniques, Sep. 1998, 446-462.
Meyer, M., et al., "Illumina Sequencing Library Preparation for Highly Multiplexed Target Capture and Sequencing", Cold Spring Harbor Protocols, vol. 2010, Issue 6, Jun. 2010, 1-10.
Namlos, H. M., et al., "Noninvasive Detection of ctDNA Reveals Intratumor Heterogeneity and Is Associated with Tumor Burden in Gastrointestinal Stromal Tumor", Molecular Cancer Therapuetics, vol. 17, No. 11, 2018, 2473-2480.
Nawroz, H., et al., "Microsatellite Alterations in Serum DNA of Head and Neck Cancer Patients", Nature Medicine, vool. 2, No. 9, Sep. 1996, 1035-1037.
Ohara, O., et al., "One-sided Polymerase Chain Reaction: The Amplification of cDNA", Proceedings of the National Academy of Sciences, vol. 86, 1989, 5673-5677.
Olivarius, S., et al., "High-Throughput Verification of Transcriptional Starting Sites of Deep-RACE", Bio Techniques, vool. 46, No. 2, Feb. 2009, 130-132.
Perakis, S., et al., "Advances in Circulating Tumor DNA Analysis", Advances in Clinical Chemistry, 2017, 73-153.
Profitt, J., et al., "Isolation And Characterisation of Recombination Events Involving Immunoglobulin Heavy Chain Switch Regions in Multiple Myeloma Using Long Distance Vectorette PCR (ldv-pcr)", Leukemia, vol. 13, No. 7, Jul. 1999, 1100-1107.
Rabinowitz, M., "A System and Method for Integrating, Validating and Applying Genetic and Clinical Data to Enhance Medical Decisions", Nov. 29, 2005, 155 pgs.
Santalucia, Jr., J., "Physical Principles and Visual-OMP Software for Optimal PCR Design", Methods in Molecular Biology, vol. 402, 2007, 3-33.
Schoske, R., et al., "Multiplex PCR Design Strategy used for the Stimultaneous Amplification of 10 Y Chromosome Short Tandem Repeat (STR) Loci", Analytical and Bioanalytical Chemistry, vol. 375, 2003, 333-343.
Shapero, M. H., et al., "MARA: A Novel Approach for Highly Multiplexed Locus-soecufuc SNPR Genotyping Using High-density DNA Oligonucleotide Arrays", Nucleic Acids Research, vol. 32, No. 22, 2004, 1-9.
Tountа, G., et al., "Non-invasive prenatal diagnosis using cell-free fetal nucleic acids in maternal plasma: Progress overview beyond predictive and personalized diagnosis", EPMA Journal, vol. 2, Issue 2, 2011, 163-171.
Treff, N. R., et al., "Single cell Whole Genome Amplification Technique Significantly Impacts the Accuracy and Precision of Microarray based 23 Chromosome Aneuploidy Screening", Poster Presentation Preimplantation Genetic Diagnosis, Sep. 1, 2007, s231.
Troutt, et al., "Ligation-anchored PCR: A SImple Amplification Technique with Single-sided Specificity", Proceedings of the National Academy of Sciences, vol. 89, Oct. 1992, 9823-9825.
Tufan, N L, et al., "Analysis of Cell-Free Fetal DNA from Paternal Plasma and Serum Using a Conventional Multiplex PCR: Factors Influencing Success", The Turkish Journal of Medical Sciences, vol. 35, 2005, 85-92.
Zheng, Z., et al., "Anchored Multiplex PCT for Targeted Next-generation Sequencing", Nature Medicine, vol. 20, No. 12, Dec. 2014, 1479-1486.
Zhong, X Y, et al., "Detection of Fetal Rhesus D And Sex Using Fetal DNA from Maternal Plasma by Multiplex Polymerase Chain Reaction", British Journal of Obstrics and Gynaecology, vol. 107, Jun. 2000, 766-769.
Zimmermann, B., et al., "Digital PCR: a powerful new tool for noninvasive prenatal diagnosis?"Prenatal Dianosis, Nov. 10, 2008, 1087-1093.
Zimmermann, B., et al., "Novel Real-Time Quantitative PCR Test for Trisorny 21", Clinical Chemistry, 2002, 362-363.
Zimmerman, B., et al., "Opptimized Real-Time Quantitative PCR Measurement of Male Fetal DNA in Maternal Plasma", Clinical Chemistry, 2005, 1598-1604.
Zimmermann, B., et al., "Real-Time Quantitative Polymerase Chain Reaction Measurement of Male Fetal DNA in Maternal Plasma", Methods in Molecular Medicine, 2007, 43-49.
Zimmermanm, B., et al., "Use of Real-Time Polymerase Chain Reaction for the Detection of Fetal Aneuploidies", Methods in Molecular Biology, Feb. 2006, 83-100.
Bau, Stephan et al., "Targeted next-generation sequencing by specific capture of multiple genomic loci using low-volume microfluidic DNA arrays", Anal Bional Chem, vol. 393, 2009, 171-175.
Goncalves-Primo, A. et al., "Investigation of Apoptosis-Related Gene Expression Levels in Preimplantation Biopsies as Predictors of Delayed Kidney Graft Function", Transplantation, vol. 97, No. 12, Jun. 27, 2014.
Nakamura, N. et al., "Ex Vivo Liver Perfusion with Arterial Blood from A Pig with Ischemic Liver Failure", Articial Organs, vol. 23, No. 2, 1999, 153-160.
Nui, A. et al., "The Functional Integrity of a Normothermic Perfusion System Using Artifical Blood in Pig Liver", Journal of Surgical Research, vol. 131, 2006, 189-98.
Olerup, O. et al., "HLA-DR typing by PCR amplification with sequence-specific primers (PCR-SSP) in 2 hours; an alternative to serological DR Typing in Clinical Practice including donor-recipient matching in cadaveric transplantation", Tissue Antigens, vol. 39, No. 5, May 1992, 225-235.
Paruzynski, A. et al., "Genome-wide high-throughput integrome analyses by nrLAM-PCR and next generation sequencing", Nature Protocols, vol. 5, No. 8, Jul. 8, 2010, 1379-1395.
Abd-Elsalam, Kamel A., "Bioinformatic Tools and Guideline for PCR Primer Design", African Journal of Biotechnology, vol. 2, 2003, pp. 91-95.
Adalsteinsson, V. A. et al., "Scalable whole-exome sequencing of cell-free DNA reveals high concordance with metastatic tumor", Nature Communications, vol. 18, No. 1324, 2017, 13 pages.
Adinolfi, M. et al., "Rapid Detection of Aneuploidies by Microsatellite and the Quantitative Fluorescent Polymerase Chain Reaction", Prenatal Diagnosis, vol. 17, No. 13, 1997, 1299-1311.
Alizadeh, Mehdi et al., "Quantitative Assessment of Hematopoietic Chimerism after Bone Marrow Transplantation by Real-time Quantitative Polymerase Chain Reaction", Blood, vol. 99, No. 12, Jun. 15, 2002, 4618-4625.
Ansorge, Wilhelm J., "Next-generation DNA Sequencing Techniques", New Biotechnology, vol. 25, No. 4, Feb. 2, 2009, 195-203.
Arandjelovic, M. et al., "Two-Step Multiplex Polymerase Chain Reaction improves the Speed and Accuracy of Genotyping Using DNA from Noninvasive eand Museum Samples", Molecular Ecology Resources, vol. 9, 2009, pp. 28-36.
Avent, Neil D. et al., "Cell-free Fetal DNA int he Maternal Serum And Plasma: Current And Evolving Application", Current Opinion in Obstretrics and Gynecology, vol. 21, No. 2, Apr. 1, 2009, 175-179.
Ayala, et al., "Long-Term Follow-Up of Donor Chimerism Tolerance After Human Liver Transplantation", Liver Transplantation, vol. 15, No. 6,, May 28, 2009, 581-591.
Balavoine, Guillaume, "Identification of Members of Several Homeobox Genes in a Planarian Using a Ligation-Mediated Polymerase Chain Reaction Technique", Nucleic Acids Research, vol. 24, 1996, pp. 1547-1553.
Balduini, et al., "Utility of Biochemical Markers in The Follow-up Heart Transplant Recipients", Transplantation Proceedings, vol. 35, No. 8, Dec. 1, 2003, 3075-3078.
Barbazuk, et al., "SNP Dsicovery via 454 Transcriptome Sequencing", The Plant Journal, vol. 51, Jul. 27, 2007, 910-918.
Bartlett, John M. et al., "PCR Protocols", PCR Protocols, vol. 226, 2003, 519 pages.

(56) References Cited

OTHER PUBLICATIONS

Baxter-Lowe, et al., "Tracking Microchimeric DNA in Plasma To Diagnose and Manage Organ Transplant Rejection", Clinical Chemistry, vol. 52, No. 4, Apr. 1, 2006, 559-561.

Beck, et al., "Next Generation Sequencing of Serum Circulating Nucleic Acids from Patients with Invasive Ductal Breast Cancer Reveals Differences to Healthy and Nonmalignant Controls", Molecular Cancer Research, vol. 8, No. 3, Mar. 1, 2010, 335-342.

Belostotsky, Dmitry A. et al., "Plant Systems Biology", Methods in Molecular Biology, vol. 553, Aug. 25, 2009, 3-408.

Bender, et al., "A Multiplex SNP Typing Approach for the DNA Pyrosequencing Technology", International Congress Services, vol. 1288, Apr. 20, 2006, 73-75.

Benjamini, Y. et al., "Controlling the False Discovery Rate: A Practical and Powerful Approach to Multiple Testing", Journal of the Royal Statistical Society, Series B (Methodological), vol. 57, No. 1, 1995, 289-300.

Bentley, et al., "High-resolution, High-throughput HLA Genotyping by Next-generation Sequencing", Tissue Antigens, vol. 74, No. 5, Nov. 1, 2009, 393-403.

Bordoni, et al., "Evaluation Of Human Gene Variant Detection In Amplicon Pools By The GS-FLX Parallel Pyrosequencer", BMC Genomics, vol. 9, Oct. 8, 2008, 1-8.

Brastianos, P. K. et al., "Genomic Characterization of Brain Metastases Reveals Branched Evolution and Potential Therapeutic Targets", Cancer Discovery, vol. 5, Sep. 26, 2015, 1164-1177.

Brockman, et al., "Quality Scores And SNP Detection In Sequencing-by-synthesis System", Genome Research, vol. 18, No. 5, May 1, 2008, 763-770.

Bustamante-Aragones, Ana et al., "New Strategy for The Prenatal Detection/Exclusion of Paternal Cystic Fibrosis Mutations in Maternal Plasma", Journal of Cystic Fibrosis, vol. 7, Issue 6, Nov. 1, 2008, 505-510.

Butler, et al., "Cardiovascular Magnetic Resonance In The Diagnosis Of Acute Heart Transplant Rejection: A Review", Journal of Cardiovascular Magnetic Resonance, vol. 11, No. 1, Mar. 12, 2009, 1-11.

Chan, Allen K. et al., "Cell-free Nucleic Acids In Plasma, Serum and Urine: A New Tool In Molecular Diagnosis", Annals of Clinical Biochemistry, vol. 40, Issue 2, Mar. 1, 2003, 122-130.

Chavali, Sreenivas et al., "Oligonucleotide Properties Determination And Primer Designing: A Critical Examination of Predictions", Bioinformatics, vol. 21, 2005, pp. 3918-3925.

Chen, Bing-Yuan et al., "PCR Cloning Protocols", PCR Cloning Protocols, PCR Cloning Protocols, vol. 192, 2002, 434 pages.

Church, et al., "Multiplex DNA Sequencing", Science, vol. 240, No. 4849, Apr. 8, 1988, 185-188.

Crespo-Leiro, et al., "Gene Expression Profiling for Monitoring Graft Rejection in Heart Transplant Recipients", Transplantation Proceedings, vol. 31, No. 6, Jul. 1, 2009, 2240-2243.

Cunningham, K.S. et al., "An approach to endomyocardial biopsy interpretation", Journal of Clinical Pathology, vol. 59, No. 2, Mar. 2006, 121-129.

Dahl, et al., "Multigene Amplification and Massively Parallel Sequencing for Cancer Mutation Discovery", Proceedings of the National Academy of Sciences, vol. 104, No. 22, May 29, 2007, 9387-9392.

Dambrin, et al., "A New Rejection Criteria In The Heterotopically Placed Rat Heart By Non-invasive Measurement Of Dp/Dtmax", The Journal of Heart and Lung Transplantation, vol. 18, No. 6, Jun. 18, 1999, 524-531.

Deb, Mahua et al., "Development of a Multiplexed PCR Detection Method for Barley and Cereal Yellow Dwarf Viruses, Wheat Spindle Streak Virus, Wheat Streak Mosaic Virus and Soil-Borne Wheat Mosaic Virus", Journal of Virological Methods, vol. 148, 2008, pp. 17-24.

Delgado, P. O. et al., "Characterization of cell-free circulating DNA in plasma in patients with prostate cancer", Tumor Biol., vol. 34, 983-986, 2013.

Doostzadeh, et al., "High Throughput Automated Allele Frequency Estimation by Pyrosequencing", PLoS ONE, vol.3, No.7, Jul. 16, 2008, 1-4.

Dorit, D. L. , "cDNA Amplification Using One-sided (Anchored) Pcr", Current Protocols in Molecular Biology, vol. 17, 1992, pp. 15.6.1-15.6.10.

Dorit, Robert L. et al., "One-sided Anchored Polymerase Chain Reaction for AMplification and Sequencing of Complementary DNA",Methods in Enzymology, vol. 218., 1993, pp. 36-47.

Efron B. et al., "Bootstrap Methods for Standard Errors, Confidence Intervals, and Other Measures of Statistical Accuracy", Statistical Science, vol. 1, No. 1, 1986, 54-77.

Elnifro, Elfath M. , "Multiplex PCR: Optimization and Application in Diagnostic Virology", Clinical Microbiology Reviews, vol. 13, 2000, pp. 559-570.

Erijman, Ariel et al., "Transfer-PCR (TPCR): A Highway for DNA Cloning and Proteins Engineering", Journal of Structural Biology, vol. 175, 2011, pp. 171-177.

European Comission, , "The 7th International Conference on Circulating Nucleic Acids in Plasma and Serum (CNAPS VII) in Madrid—Spain", The International Conference on Circulating Nucleic Acids in Plasma and Serum, Oct. 24, 2011, 2 pgs.

Fan, H. C. et al., "IN Principle Method for Noninvasive Determination of Fetal Genome", Nat. Prec., 2010, 16 pgs.

Fitzgerald, , "Intravascular Ultrasound Imaging Of Coronary Arteries: Is Three Layers The Norm?", Circulation, vol. 86, No. 1, Jul. 1, 1992, 154-158.

Fournie, et al., "Plasma DNA As A Marker of Cancerous Cell Death. Investigations In Patients Suffering From Lung Cancer and in Nude Mice Bearing Human Tumours", Cancer Letters, vol. 91, No. 2, May 8, 1995, 221-227.

Fredriksson, M et al., "Assessing Hematopoietic Chimerism After Allogeneic Stem Cell Transplantation by Multiplexed SNP Genotyping Using Microarrays and Quantitative Analysis of SNP Alleles", Leukemia, vol. 18, Issue 2, Dec. 4, 2003, 255-266.

Fu, Yao-Wen et al., "Presence of Donor-and-recipientderived Dna Microchimerism In The Cell-free Blood Samples of Renal Transplantation Recipients Associates With The Acceptance of Transplanted Kidneys", Asian Journal of Andrology, vol. 8, No. 4, Jul. 1, 2006, 477-482.

Gadi, V. K. et al., "Soluble Donor DNA Concentrations in Recipient Serum Correlate with pncreas-Kidney Rejection", Clinical Chemistry, vol. 52, No. 3, 2006, 379,382.

Gao, et al., "Relation of Donor Age and Preexisiting Coronary Artery Diseases on Angiography and Intracoronary Ultrasound to Later Development of Accelerated Allograft Artery Disease", The American Journal of Cardiology, vol. 29, No. 3, Mar. 1, 1997, 623-629.

Gao, Ming et al., "Characterization of dull1, a Maize Gene Coding fo-r a Novel Starch Synthase", The Plant Cell, vol. 10, 1998, pp. 399-412.

Geifman-Holtzman, et al., "Prenatal Diagnosis: Update On Invasive Verus Nonvasive Fetal Diagnostic Testing From Maternal Blood", Expert Review of Molecular Diagnostics, vol. 8, Nov. 1, 2008, 727-751.

Gielis, E. M. et al., "Cell-Free DNA: An Upcoming Biomarker in Transplantation", American Journal of Transplantation, vol. 15, 2015, 2541-2551.

Gineikiene, Egle et al., "Single Nucleotide Polymorphism-based System Improves the Applicability of Quantitative PCR for Cherism Monitoring", Journal of Molecular Diagnostics, vol. 11, No. 1, Jan. 1, 2009, 66-74.

Gingeras, et al., "Fifty Years of Molecular (DNA/RNA) Diagnostics", Clinical Chemistry, vol. 51, No. 3, Jan. 13, 2005, 661-671.

Girnita, Diana M. et al., "Disparate Distribution of 16 Candidate Single Nucleotide Polymorphisms AMong Racial and Ethnic Groups of Pediatric Heart Transplant Patients", Transplantation, vol. 82, No. 12, Dec. 27, 2006, 1774-1780.

Go, A. T. et al., "Non-invasive aneuploidy detection using free fetal DNA and RNA maternal plasma: recent progress and future possibilities", Human Reproduction Update, vol. 17, No. 3, 2011, 372-382.

(56) References Cited

OTHER PUBLICATIONS

Gordon, et al., "Disease-Specific Motifs Can be Identified In Circulating Nucleic Acids from Live Elk and Cattle Infected with Transmissible Spongiform Encephalopathies", Nucleic Acids Research, vol. 37. No. 2, Feb. 1, 2009, 550-556.
Gorringe, et al., "Large-scale Genomic Analysis of Ovarian Carinomas", Molecular oncology, vol. 3, No. 2, Apr. 1, 2009, 157-164.
Gouya, et al., "Coronary Artery Stenosis In High-risk Patients: 64-section Ct and Coronary Angiography-Prospective Study and Analysis of Discordance", Radiology, vol. 252, No. 2, Aug. 1, 2009, 377-385.
Gregory, et al., "Comparison of Sxity-Four-Slice Multidetector Computed Tomographic Coronary Sngiography to Coronary Angiography with Intravascular Ultrasound for the Detection of Transplant Vasculopathy", The American Journal of Cardiology, vol. 98, No. 7, Aug. 4, 2006, 877-884.
Gwee, Pai-chung et al., "Simultaneous Genotyping of Seven Single-nucleotide Polymorphisms in the Mdr1 Gene by Single-tube Multiplex Minisequencing", Pai-chung Gwee. et al., "Simultaneous Genotyping of Seven Single-nuclotide Polymorphisms in The Mdr1 Gene by Single-tube Multiplex Minisequencing", Clinical chemistry, Apr. 2003, vol. 49, Issue. 3, pp. 672-676., Apr. 1, 2003, 672-676.
Hahn, et al., "Non-invasive Prenatal Diagnostics Using Next Generation Sequencing: Technical, Legal and Social Challenges", Expert Opinion on Medical Diagnostics, vol. 6, No. 6, Nov. 1, 2012, 517-528.
Hahn, S. et al., "Quantification of Circulating DNA: In the Preparation Lies the Rub", Clinical Chemistry, vol. 47, No. 9, 2001, 1577-1578.
Halford, William P., "The Essential Prerequisites for Quantitative RT-PCR", Natue Biotechnology, vol. 17, 1999, 1 page.
Handley, D. et al., "Noninvasive prenatal chromosomal aneuploidy detection using plasma cell-free nucleic acid", Expert Rev Obstet. Gynecol, vol. 5, No. 5, 2010, 581-590.
Hao, T. B. et al., "Circulating cell-free DNA in serum as a biomarker for diagnosis and prognostic prediction of colorectal cancer", British Journal of Cancer, vol. 111, Aug. 26, 2014, 1482-1489.
Heaton, Paul R. et al., "Heminested PCR Assay for Detection of Six Genotypes of Rabies and Rabies-related Viruses", Journal of Clinical Microbiology, vol. 35, 1997, pp. 2762-2766.
Heidary, M. et al., "The dynamic range of circulating tumor DNA in metastatic breast cancer", Breast Cancer Research, vol. 16, No. 421, 2014, 10 pages.
Henegariu, O. et al., "Multiplex PCR: Critical Parameters and Step-by-Step Protocol", Biotechniques, vol. 23, 1997, pp. 504-511.
Hidestrand, M. et al., "Highly Sensitive Noninvasive Cardiac Transplant Rejection Monitoring Using Targeted Quantification of Donor-Specific Cell-Free Deoxyribonucleic Acid", Journal of the American College of Cardiology, vol. 63, No. 12, 1224-1226, 2014.
Hoberman, Rose et al., "A Probabilistic Approach for SNP Discovery in High-throughput Human Reseqencing Data", Genome Research, vol. 19, Jul. 15, 2009, 1542-1552.
Hochberg, et al., "A Novel Rapid Single Nucleotide Polymorphism (SNP—Based Method for Assessment Of Hematopietic Chimerism After Allogeneic Stem Cell Transplantation", Blood, vol. 101, No. 1, Jan. 1, 2003, 363-369.
Hodges, et al., "Genome-wide In Situ Expon Capture for Selective Resequencing", Nature Genetics, vol. 39, No. 12, Nov. 4, 2007, 1522-1527.
Hoffmann, Steven et al., "Donor Genomics Influence Graft Events: The Effect of Donor Polymorphisms on Acute Rejection and Chronic Allograft Nephropathy", Kidney International, vol. 66, No. 4, Oct. 1, 2004, 1686-1693.
Holt, et al., "Detecting SNPS and Estimating Allele Frequencies in Clonal Bacterial Populations By Sequencing Pooled DNA", Bioinformatics, vol. 25, No. 16, Aug. 15, 2009, 2074-2075.
Horai, et al., "Novel Implantable Device to Detect Cardiac Allograft Rejection", Circulation, vol. 120, No. Suppl 1, Sep. 15, 2009, 185-190.

Hosmillio, Myra D. et al., "Development of Universal SYBR Green Real-time RT-PCR for the Rapid Detection and Quantitation of Bovine and Porcine Toroviruses", Journal of Virological Methods, vol. 168, 2010, pp. 212-217.
Hu, Hao et al., "Mutation Screening in 86 Known X-linked Mental Retardation Genes by Droplet-based Multiplex Pcr and Massive Parallel Sequencing", Hao Hu. et al., "Mutation Screening in 86 Known X-linked Mental Retardation Genes by Droplet-based Multiplex Pcr and Massive Parallel Sequencing", Hugo J, Dec. 2009, vol. 3, pp. 41-49., Dec. 1, 2009, 41-49.
Huang, D. J. et al., "Reliable detection of Trisomy 21 using MALDI-TOF mass spectrometry", Genetics in Medicine, vol. 8, Nov. 2006, 728-734.
Hubacek, et al., "Detection of Donor DNA after Heart Transplantation:; How Far Could it be Affected by Blood Transfusion and Donor Chimerism?", Transplantation Proceedings, vol. 39, Jun. 1, 2007, 1593-1595.
Illumina, , "Genomic Sequencing", Data Sheet: Sequencing, 2010, 38939-38944.
Ingman, et al., "SNP Frequency Estimation Using Massively Parallel Sequencing of Pooled DNA", European Journal of Human Genetics, vol. 17, No. 3, Oct. 15, 2008, 383-386.
Intereqicz, B. et al., "DNA Released from Ischemic and Rejecting Organs as an Indicator of Graft Cellular Damage", Annals of Transplantation, vol. 9, No. 2, May 1, 2004, 42-45.
Jen, J. et al., "An Overview on the Isolation and Analysis of Circulating Tumor DNA in Plasma and Serum", Annals New York Academy of Sciences, 2000, 8-12.
Jung, K. et al., "Cell-free DNA in the blood as solid tu1nor biomarker-A critical appraisal of the literature", Clinica Chimica Acta, vol. 411, 2010, 1611—1624.
Kalendar, Ruslan et al., "Java Web Tools for PCR, in Silico PCR, and Oligonulcotide Assembly and Analysis", Genomics, vol. 98, 2011, pp. 137-144.
Kane, M., "APplication of Less Primer Method to Multiplex PCR", International Congress Series, vol. 1288, 2006, pp. 694-696.
Kapadia, Samir R. et al., "Impact of Intravascular Ultrasound in Understanding Transplant Coronary Artery Disease", Current Opinion in Cardiology, vol. 14, No. 2, Mar. 1, 1999, 1-19.
Karger, et al., "DNA Sequencing by Capillary Electrophoresis", Electrophoresis, vol. 30, Supplement 1, Jun. 1, 2009, 1-11.
Karoui, Noureddine E. et al., "Getting More from Digital SNP Data", Statistics in Medicine, vol. 25, Issue 18, Jan. 5, 2006, 3124-3133.
Kass, et al., "Diagnosis of Graft Coronary Artery Disease", Current Opinion in Cardiology, vol. 22, No. 2, Mar. 1, 2007, 139-145.
Kathiresan, Sekar et al., "Genome-wide Association of Early-onset Myocardial Infarction with Common Single Nucleotide Polymorphisms, Common Copy Number Variants, and Rare Copy Number Variants", Nature Genetics, vol. 41, No. 3, Mar. 1, 2009, 1-23.
Kennedy, S. R. et al., "Detecting ultralow-frequency mutations by Duplex Sequencing", Nature Protocols, vol. 9, No. 11, 2014, 2586-2606.
Kibbe, Warren A., "Oligocalc: An Online Oligonucleotide Properties Calculator", Nucleic Acids Research, vol. 35, 2007, pp. W43-W46.
Kircher, Martin et al., "Improved Base Calling for the Illumina Genome Analyzer Using Machine Learning Strategies", Genome Biology, vol. 10, Issue 8, Article No. R83, Aug. 14, 2009, 83.2-83.9.
Kobashigawa, et al., "Multicenter Intravascular Ultrasound Validation Study Among Heart Transplant Recipients", Journal of the American College of Cardiology, vol. 45, No. 9, May 3, 2005, 1532-1537.
Koboldt, et al., "VarScan: Variant Detection in Massively Parallel Sequencing of Individual and Pooled Samples", Bioinformatics, vol. 25, No. 17, Jun. 19, 2009, 2283-2285.
Koelman, et al., "Donor-derived Soluble HLA Plasma Levels Can Not Be Used To Monitor Graft Rejection In Heart Transplant Recipients", Transplant Immunology, vol. 8, No. 1, Mar. 1, 2000, 57-64.
Koide, K. et al., "Fragmentation of cell-free fetal DNA in plasma and urine of pregnant women", Prenatal Diagnosis, vol. 25, 604-607.

(56) References Cited

OTHER PUBLICATIONS

Koldehoff, Michael et al., "Quantitative analysis of chimerism after allogeneic stem cell transplantation by real-time polymerase chain reaction with single nucleotide polymorphisms, standard tandem repeats, and Y-chromosome-specific sequences", American Journal of Hematology, vol. 81, No. 10, Jul. 12, 2006, 735-746.

Koressaar, Triinu et al., "Enchancements and Modifications of Primer Design Program Primer3", Bioinformatics, vol. 23, 2007, pp. 1289-1291.

Korn, et al., "Integrated Genotype Calling and Association Analysis of SNPS, Common Copy Number Polymorphisms and Rare CNVS", Nature Genetics, vol. 40, No. 10, Oct. 1, 2008, 1253-1260.

Kuhn, H. et al., "Rolling-circle amplification under topological constraints", Nucleic Acids Research, vol. 30, No. 2, 2002, 574-580.

Lambert, et al., "Quantification of Maternal Microchimerism by HLA-Specific Real-time Polymerase Chain Reaction", Arthritis and Rheumatism, vol. 50, No. 3, Mar. 1, 2004, 906-914.

Lardeux, Frederic et al., "Optimization of a Semi-nested Multiplex PCR to Identify Plasmodium Parasites in Wild-Caught ANopheles in Bolivia, and Its Application to Field Epidemiological Studies", Transaction of the Royal Society of Tropical Medicine and Hygiene, vol. 102, 2008, pp. 485-492.

Larsen, J. B. et al., "Single-step Nested Multiplex PCR to Differentiate Between Various Bivalve Larvae", Marine Biology, vol. 146, 2005, pp. 1119-1129.

Lavebrat, et al., "Single Nucleotide Polymorphism (SNP) Allele Frequency Estimation in DNA Pools Using Pyrosequencing", Nature Protocols, vol. 1, No. 6, Jan. 11, 2007, 2573-2582.

Lavebratt, Catharina et al., "Pyrosequencing-based SNP Allele Frequency Estimation in DNA Pools", Human Mutation, vol. 23, Issue 1, Dec. 19, 2003, 92-97.

Leamon, John H. et al., "A massively parallel PicoTiterPlate based platform for discrete picoliter-scale polymerase chain reactions", Eletrophoresis, vol. 24, No. 21, Nov. 1, 2003, 3769-3777.

Levsky, Jeffrey M. et al., "Efficacy of Coronary Ct Angiography: Where We Are, Where We Are Going and Where We Want to Be", Journal Of Cardiovascular Computed Tomography, vol. 3, Supplement 2, Nov. 2, 2009, s99-s108.

Li, et al., "Detection of SNPs in the Plasma of Pregnant Women and in the Urine of Kidney Transplant Recipients by Mass Spectrometry", Annals of the New York Academy of Sciences, vol. 1075, Sep. 5, 2006, 144-147.

Li, et al., "Mapping Short DNA Sequencing Reads and Calling Variants Using Mapping Quality Scores", Genome Research, vol. 18, No. 11,, Aug. 19, 2008, 1851-1858.

Li, et al., "Multiplex Padlock Targeted Sequencing Reveals Human Hypermutable CpG Variations", Genome Research, vol. 19, No. 9, Jun. 12, 2009, 1606-1615.

Li, et al., "SOAP2: An Improved Ultrafast Tool for Short Read Alignment", Bioinformatics, vol. 25, No. 15, Aug. 1, 2009, 1966-1967.

Li, Yang et al., "Detection of Donor-specific DNA Polymorphisms in the Urine of Renal Transplant Recipients", Clinical Chemistry, vol. 49, No. 4, Apr. 1, 2003, 655-658.

Li, Ying et al., "Ready detection of donor-specific single-nucleotide polymorphisms in the urine of renal transplant recipients by matrix-assisted laser desorption/ionization time-of-flight mass spectrometry", Ying Li. et al., "Ready detection of donor-specific single-nucleotide polymorphisms in the urine of renal transplant recipients by matrix-assisted laser desorption/ionization time-of-the-flight mass spectrometry", Clini Chem, Oct. 2005, vol. 51, Issue. 10, pp. 1903-1904, Oct. 1, 2005, 1903-1904

Liljedahl, Ulrika et al., "Detecting Imbalanced Expression Of SNP Alleles by Minisequecing on Microarrays", BMC Biotechnology, vol. 4, Article No. 24, Oct. 22, 2004, 1-10.

Lo, et al., "Next-generation Sequencing Of Plasma/Serum DNA: An Emerging Research and Molecular Diagnostic Tool", Clinical Chemistry, vol. 55, No. 4, Apr. 1, 2009, 607-608.

Lo, et al., "Presence Of Donor-specific Dna In Plasma Of Kidney and Liver-transplant Recipients", Lancet, vol. 351, No. 9112, May 2, 1998, 1329-1330.

Lo, Y M. et al., "Circulating Nucleic Acids in Plasma and Serum: An Overview", Annals of the New York Academy of Sciences, vol. 945, Sep. 1, 2001, 1-7.

Loh, Elwyn , "Anchored PCR: Amplification with Single-sided Specificity", Methods, vol. 2, 1991, pp. 11-19.

Lui, Yanni Y. et al., "Circulating DNA in Plasma and Serum: Biology, Preanalytical Issues And Diagnostics Applications", Clinical Chemistry and Laboratory Medicine, vol. 40, No. 10, Oct. 29, 2002, 962-968.

Lui, Yanni Y. et al., "Origin of Plasma Cell-Free DNA after Solid Organ Transplantation", Clinical Chemistry, vol. 49, No. 3, Mar. 1, 2003, 495-496.

Lun, Fiona M. et al., "Microfluidics Digital PCR Reveals A higher than Expected Fraction of Fetal DNA Maternal Plasma", Clinical Chemistry, vol. 54, No. 10, Aug. 14, 2008, 1664-1672.

Marguiles, M. et al., "Genome Sequencing in Open Microfabricated High Density Picoliter Reactors", Nature, vol. 436, No. 7057, Sep. 15, 2005, 376-380.

Marianes, Alexis E. et al., "Targets of Somatic Hypermutation within Immunoglobulin Light Chain Genes in Zebrafish", Immunology, vol. 132, 2010, pp. 240-255.

Maron, Jill L. et al., "Cell-free Fetal DNA Plasma Extraction and Real-time Polymerase Chain Reaction Quantification", Methods in Molecular Medicine, vol. 132, Aug. 1, 2007, 51-63.

Martinez-Lopez, J. et al., "Real-time PCR Quantification of Haematopoietic Chimerism after Transplantation: A Comparison Between TaqMan and Hybridzation Probes Technologies", International Journal of Laboratory Hematology, vol. 32, Issue 1, Part 1, May 12, 2009, e17-e25.

Martins, et al., "Quantification of Donor-derived DNA in Serum: A New Apporach of Acute Rejection Diagnosis In A Rat Kidney Transplantation Model", Transplantation Proceedings, vol. 37, No. 1,, Jan. 1, 2005, 87-88.

Matsybara, T. et al., "Pantropic Retroviral Vectors Integrate and Express In Cells of the Malaria Mosquito, Anopheles Gambiae", PNAS, vol. 93, 1996, pp. 6181-6185.

Messmer, Trudy O. et al., "Application of Nested, Multiplex PCR to Psittacosis Outbreaks", Journal of Clinical Microbiology, vol. 35, No. 8, 1997, pp. 2043-2046.

Meuzelaar, Linda S. et al., "Megaplex PCR: A Strategy for Multiplex Amplification", Nature Methods, vol. 4, 2007, pp. 835-837.

Milani, et al., "Genotyping Single Nucleotide Polymorphisms by Multiplex Minisequencing Using Tag-arrays", DNA Microarrays for Biomedical Research, vol. 529, Jan. 16, 2009, 215-229.

Miramontes, pedro et al., "DNA Dimer Correlations Reflect in Vivo Conditions and Discriminate Among Nearest-neightbor Base Pair Free Energy Parameter Measures", Physica A, vol. 321, 2003, pp. 577-586.

Mitra, S. et al., "Chapter 4 Classification Techniques", Introduction to Machine Learning and Bioinformatics, First Edition, 2008, 101-127.

Moreau, Valerie et al., "Zip Nucleic Acids: New High Affinity Oligonucleotides as Potent Primers for PCR and Reverse Transcription", Nucleic Acids Research, vol. 37, No. 19, e130, 2009, 14 pages.

Moreira, et al., "Increase In And Clearance of Cell-free Plasma DNA in Hemodialysis Quantified by Real-time PCR", Clinical Chemistry and Laboratory Medicine, vol. 44, No. 12, Dec. 13, 2006, 1410-1415.

Neve, B. et al., "Rapid SNP Allele Frequency Determination in Genomic DNA Pools by Pyrosequencing", BioTechniques, vol. 32, No. 5, May 1, 2002, 1138-1142.

Ng, et al., "Multiplex Sequencing of Paired-end Ditags (MS-PET): A Strategy for the Ultra-high-throughput Analysis of Transcriptomes and Genomes", Nucleic Acids Research, vol. 34, No. 12, Jul. 13, 2006, 1-10.

Nishiwaki, Moire et al., "Genotyping of Human Papillomaviruses by A Novel One-step Typing Method with Multiplex PCR and Clinical Applications", Journal of Clinical Microbiology, vol. 46, 2008, pp. 1161-1168.

(56) References Cited

OTHER PUBLICATIONS

Norton, S. E. et al., "A stabilizing reagent prevents cell-free DNA contamination by cellular DNA in plasma during blood samples storage and shipping as determined by digital PCR", Clin Biochem., vol. 46, No. 15, Oct. 2013, 1561-1565.
O'Connell, G. C. et al., "High Interspecimen Variability in Nucleic Acid Extraction Efficiency Necessitates the Use of Spike-In Control for Accurate qPCR-based Measurement of Plasma Cell-Free DNA Levels", Lab Medicine, vol. 48, 2017, 332-338.
Oeth, et al., "iPLEX™ Assay: Increased Plexing Efficenncy and Flexibility for MassARRAY System Through Single Base Primer Extension with Mass-Modified Terminators", Sequenom Application Note Doc. No. 8876-006, Apr. 28, 2005, 1-12.
Ohira, T. et al., "Tumor volume determines the feasibility of cell-free DNA sequencing for mutation detection in non-small cell lung cancer", Cancer Science, vol. 107, 2016, 1660-1666.
Okou, et al., "Microarray-based Genomic Selection For High-throughput Resequencing", Nature Methods, vol. 4, No. 11, Oct. 14, 2007, 907-909.
Okou, David T. et al., "Combining Microarray-based Genomic Selection (MGS) with the Illumina Genome Analyzer Platform to Sequence Diploid Target Regions", Annals of Human Genetics, vol. 73, No. 5, Aug. 6, 2009, 502-513.
Oliver, Dwight H. et al., "Use of Single Nucleotide Polymorphisms (SNP) and Real-time Polymerase Chain Reaction for Bone Marrow Engraftment Analysis", The Jjournal of Molecular Diagnostics, vol. 2, No. 4, Nov. 1, 2000, 202-208.
Olivier, et al., "The Invader Assay for SNP Genotyping", Mutation Research, vol. 573, No. 1-2, Jun. 3, 2005, 103-110.
Orsouw, et al., "Complexity Reduction of Polymorphic Sequences (Crops): A Novel Approach for Large-scale Polymorphism Discovery In Complex Genomes", PLoS One, vol. 11:e1172, Nov. 14, 2017, 1-10.
Owczarzy, Richard et al., "Melting Temperatures of Nucleic Acids: Discrepancies in Analysis", Biophysical Chemistry, vol. 117, 2005, pp. 207-215.
Palk, P. K. et al., "Next-Generation Sequencing of Stagee IV Squamous Cell Lung Cancers Reveals an Association of P13K Aberrations and Evidence of Clonal Heterogeneity in Patients with Brain Metastases", Cancer Discovery, vol. 5, Apr. 30, 2015, 610-621.
Pakstis, et al., "Candidate SNPs for a Universal Individual Identification Panel", Human Genetics, vol. 121, No. 3-4,, Feb. 27, 2007, 305-317.
Pakstis, et al., "SNPS for Individual Identification", Forensic Science International, vol. 1, May 22, 2008, 479-481.
Palka-Santini, Maria et al., "Large Scale Multiplex PCR Improves Pathogen Detection by DNA Microarrays", BMC Microbiology, vol. 9, No. 1, 2009, 14 pages.
Panjkovich, Alejandro et al., "Comparison of Different Melting Temperature Calculation Methods for Short DNA Sequences", Bioinformatics, vol. 21, 2005, pp. 711-722.
Pfaffl, Michael W. , "Quantification Strategies in Real-time PCR", A-Z of quantitative PCR, 2004, pp. 87-112.
Pinard, et al., "Assessment of Whole Genome Amplification-induced Bias Through High-throughput, Massively Parallel Whole Genome Sequencing", BMC Genomics, vol. 7:216, Aug. 23, 2006, 1-21.
Pourmand, et al., "Multiplex Pyrosequencing", Nucleic Acid Research, vol. 30, No. 7, Apr. 1, 2002, 1-5.
Prabhu, et al., "Overlapping Pools for High-throughput Targeted Resequencing", Genome Research, vol. 19, May 15, 2009, 1254-1261.
Puszyk, William M. et al., "Noninvasive Prenatal Diagnosis o-f Aneuploidy Using Cell-free Nucleic Acids in Maternal Blood: Promises and Unanswered Questions", Prenatal Diagnosis, vol. 28, No. 1, Nov. 16, 2007, 1-6.
Qiagen, , "QIAamp DNA Mini Kit and QIAamp DNA Blood Mini Kit Handbook", QIAamp DNA Mini Kit and QIAamp DNA Blood Mini Kit Handbook, Feb. 2003, ("Qiagen (2003)"), 2003, 68 pages.
Raindance Technologies, et al., "RainDance Technologies Introduces the RDT 1000", RainDance Technologies, Nov. 12, 2008.
Ravipati, Goutham et al., "Comparison of Sensitivity, Specificity, Positive Predictive Value, and Negative Predictive Value of Stress Testing Versus 64-Multislice Coronary Computed Tomography Angiography in Predicting Obstructive Coronary Artery Disease Diangosed by Coronary Angiogr", The American Journal of Cardiology, Coronary Artery Disease. vol. 101, Issue 6, Mar. 15, 2008, 774-775.
Roche Diagnostics, et al., "Versatile Nucleic Acid Purification", MagnaPure Manual, Feb. 3, 2012.
Ross, P. et al., "Quantitative Approach to Single-Nucleotide Polymorphism Analysis Using Maldi-TOF Mass Spectrometry", BioTechniques, vol. 29, Sep. 2000, 629-629.
Rothberg, et al., "The Development and Impact of 454 Sequencing", Nature Biotechnology, vol. 26, No. 10, Oct. 9, 2008, 1117-1124.
Rubio, J. M. et al., "Semi-nested, Multiplex Polymerase Chain Reaction for Detection of Human Malaria Parasites and Evidence of Plasmodium Vivax Infection in Equatorial Guinea", The American Journal of Tropical Medicine and Hygiene, vol. 60, 1999, pp. 183-187.
Ruschendorf, et al., "Alohomora: A Tool for Linkage Analysis using 10k SNP Array Data", Bioinformatics Applications Notes, vol. 21, No. 9, Jan. 12, 2005, 2123-2125.
Sanger, et al., "Nucleotide Sequence of Bacteriophage Lambda DNA", Journal of Molecular Biology, vol. 162, No. 4, Dec. 25, 1982, 729-773.
Schaaf, C. P. et al., "Copy Number and SNP Arrays in Clinical Diagnostics", Annu. Rev. Genomics Hum. Genet., vol. 12, 2011, 25-51.
Schwarzenbach, H. et al., "Detection and Characterization of Circulating Microsatellite-DNA in Blood of Patients with Breast Cancer"Ann. N.Y. Acad. Sci., vol. 1022, 2004, 25-32.
Sharples, et al., "Diagnostic Accuracy of Coronary Angiography and Risk Factors for Post-heart-transplant Cardiac Allograft Vasculopathy", Transplantation, vol. 76, No. 4, Aug. 27, 2003, 679-682.
Shyamala, Venkatakrishna et al., "Genome Walking by Single-Specific-Primer Polymerase Chain Reaction: SPP-PCR", Gene, vol. 84, 1989, pp. 1-8.
Singh, Vinayak K. et al., "PCR Primer Design", Molecular Biology Today, vol. 2, 2001, pp. 27-32.
Smith, et al., "Rapid Whole-genome Mutational Profiling using Next-generation Sequencing Technologies", Genome Research, vol. 18, Sep. 4, 2008, 1638-1642.
Smith, James F. et al., "Cell-free Fetal DNA in Maternal Plasma", Neo Reviews, vol. 9, No. 8, Aug. 1, 2008, e332-e337.
Solexa, , "Application Note: DNA Sequencing", 2006, 1-2.
Sorenson, G. D. et al., "Soluble Normal and Mutated DNA Sequences from Single-Copy Genes in Human Blood", Cancer Epdemiology, Biomarkers & Prevention, vol. 3, Jan./Feb. 1994, 67-71.
Spes, et al., "Diagnostic and Prognostic Value of Serial Dbutamine Stress Echocardiography for Noninvasive Assessment of Cardiac Allograft Vasculopathy: A Comparison with Coronary Angiography and Intravascular Ultrasound", Circulation, vol. 100, No. 5, Aug. 3, 1999, 509-515.
Spindler, K.L. G. et al., "Cell-free DNA in healthy individuals, noncancerous disease and strong prognostic value in colorectal cancer", International Journal of Cancer, vol. 135, 2014, 2984-2991.
Spindler, K.-L. G. et al., "Cell-Free DNA in Metastatic Colorectal Cancer: A Systematic Review and Meta-Analysis", The Oncologist, vol. 22, 2017, 1049-1055.
Stewart, S. et al., "Revision of the 1990 Working Formulation for the Standardization of Nomenclature in the Diagnosis of Heart Rejection", The Journal of Heart and Lung Transplantation, vol. 24, No. 11, Nov. 2005, 1710-1720.
Stiller, et al., "Direct Multiplex Sequencing (DMPS)—A Novel Method for Targeted High-thoroughput Sequencing of Ancient and Highly Degraded DNA", Genome Research, vol. 19, No. 10, Jul. 27, 2009, 1843-1848.
Stolerman, Elliot S. et al., "Haplotype structure of the ENPP1 Gene and Normal Association of the K121Q missense single nucleotide

(56) References Cited

OTHER PUBLICATIONS polymorphism with glycemic traits in the Framingham Heart Study", Diabetes, vol. 57, Issue 7, Jul. 1, 2008, 1971-1977.

Stone, J. P. et al., "Ex Vivo Normothermic Perfusion Induces Donor-Derived Leukocyte Mobilization and Removal Prior to Renal Transplantation", Kidney Int Rep., vol. 1, No. 4, Aug. 6, 2016, 230-239.

Swarup, V. et al., "Circulating (cell-free) nucleic acids—A promising, non-invasive tool for early detection of several human disease", FEBS Letters, vol. 581, 2007, 795-799.

Takalaa, et al., "A High-throughput Method for Quantifying Alleles and Haplotypes of The Malaria Vaccine Candidate Plasmodium Falciparum Merozoite Surface Protein-1 19 kDa", Malaria Journal, vol. 5:31, Apr. 20, 2006, 1-10.

Thompson, J. C. et al., "Detection of Therapeutically Targetable Driver and Resistance Mutations in Lung Cancer Patients by Next-Generation Sequencing of Cell-Free Circulating Tumor DNA", Clin Cancer Res, vol. 22, No. 23, Dec. 1, 2016, 5772-5782.

Thornton, Brenda et al., "Real-time Pcr (qPCR) Primer Design using Free Online Software", Biochemistry and Molecular Biology Education, vol. 39, 2011, pp. 145-154.

Tong, et al., "Diagnostic Developments Involving Cell-free (Circulating) Nucleic Acids", Clinica Chimica Acta, vol. 363, No. (1-2), Aug. 26, 2005, 187-196.

Toshikazu, et al., "Estimaation of Haplotype Frequencies, Linkage-disequilibrium Measures, and Combination of Hapolotype Copies in eahc Pool by Use of Pooled DNA Data", American Journal of Human Genetics, vol. 72, Jan. 1, 2003, 384-398.

Troeger, C. et al., "Approximately Half of the Erythroblasts in Maternal Blood are of Fetal Origin", Molecular Human Reproduction, vol. 5, No. 12, Dec. 1, 1999, 1162-1165.

Tsang, Jason C. et al., "Circulating Nucleic Acids in Plasma/Serum", Pathology, vol. 39, No. 2, Apr. 1, 2007, 197-207.

Tuzcu, et al., "Intravascular Ultrasound Evidence of Angiographically Silent Progression in Coronary Atherosclerosis Predicts Long-term Morbidity and Mortality after Cardiac Transplantation", The American Journal of Cardiology, vol. 45, No. 9, May 3, 2005, 1538-1542.

Umetani, N. et al., "Increased Integrity of Free Circulating DNA in Sera of Patients with Colorectal or Periampullary Cancer: Direct Quantitative PCR for ALU Repeats", Clinical Chemistry, vol. 52, No. 6, 2006, 1062-1069.

Urbanova, M. et al., "Circulating Nucleic Acids as a New Diagnostic Tool", Cellular & Molecular Biology Letters, vol. 15, 2010, 242-259.

Vallone, Peter M. et al., "Demonstration of Rapid Multiplex PCR Amplification Involving 16 Genetic Loci", Forensic Science International: Genetics, vol. 3, 2008, pp. 42-45.

Vanneste, Marion et al., "Functional Genomic Screening Independently Identifies CUL3 as a Mediator of Vemurafenib Resistance via Src-RAC1 Signaling Axis", Frontiers in Oncology, vol. 10, 2020, 16 pages.

Verlaan, et al., "Allele-specific Chromatin Remodeling in the ZPBP22/GSDMB/ORMDL3 Locus Associated with the Risk of Asthma and Autoimmune Disease", The American Journal of Human Genetics, vol. 85, No. 3, Sep. 11, 2009, 377-393.

Verlaan, et al., "Targeted Screening of Cis-Regulatory Variation in Human Haplotypes", Genome Research, vol. 19, No. 1, Jan. 1, 2009, 118-127.

Vlaminck, I. D. et al., "Circulating Cell-Free DNA Enables Noninvasive Diagnosis of Heart Transplant Rejection", Sci Transl Med., vol. 6, No. 241, Jun. 18, 2018, 26 pages.

Voelkerding, et al., "Next-generation Sequencing: From Basic Research to Diagnostics", Clinical Chemistry, vol. 55, No. 4, Apr. 1, 2009, 641-658.

Von Ahsen, Nicolas et al., "Oligonucleotide Melting Temperatures under PCR Conditions: Nearest-Neighbor Corrections for Mg2+, Deoxynucleotide Triphosphate, and Dimethly Sulfoxide Concentrations with Comparison to Alternative Empirical Formulas", Clinical Chemistry, vol. 47, 2001, pp. 1956-1961.

Wartell, Roger M. et al., "Thermal Denaturation of DNA Molecules: A Comparison of Theory with Exeriment", Physics Report, vol. 126, 1985, pp. 67-107.

Wasson, Jon et al., "Assessing Allele Frequencies of Singlr Nucleotide Polymorphisms in DNA Pools by Pyrosequencing Technology", BioTechniques, vol. 32, No. 5, May 1, 2002, 1144-1152.

Watt, Heather L., "Sex Diagnosis of Preimplantation Porcine Embryos through PCR Amplification of The Sry Gene", Sex Diagnosis of Preimplantation Porcine Embryos Through PCR Amplification of the SRY Gene (1998) ("Watt (1998)"), 1998, 151 pages.

Wei, Ting et al., "Novel Approaches to Mitigate Primer Interaction and Eliminate Inhibtors in Multiplex PCR, Demonstrated Using an Assay for Detection of three Strawberry Viruses", Journal of Virological Methods, vol. 151, 2008, pp. 132,139.

Wellnhofer, et al., "Angiographic Assessment of Cardiac Allograft Vasculopathy: Results of a Consensus Conference of the Task Force for Thoracic Organ Transplaantation of the German Cardiac Society", Transplant International, vol. 23, No. 11, Aug. 19, 2010, 1094-1104.

Wiedmann, Ralph T. et al., "SNP Discovery in Swine by Reduced Representation and High Throughput Pyrosequencing", BMC Genetics, vol. 9, Article No. 81, Dec. 4, 2008, 1-7.

Wilkening, Stefan et al., "Determination of Allele Frequency in Pooled DNA: Comparison of Three PCR-based Methods", Bio Techniques, vol. 39, No. 6, May 30, 2005, 853-857.

Wilkinson, Sarah T. et al., "Decreased MHC Class II Expression in Diffuse Large B-Cell Lymphoma does not Correlate with CPG Methylation of Ciita Promoters III and IV", Leuk Lymphoma, vol. 50, 2009, pp. 1875-1878.

Witherspoon, David J. et al., "Mobile Element Scanning (Me-scan) by Targeted High-throughput Sequencing", BMC Genomics, vol. 410, 2010, 15 pages.

Wong, K. H. et al., "Multiplex Illumina Sequencing Using DNA Barcoding", Current Protocols in Molecular Biology, vol. 101, Jan. 2013, 7.11.1-7.11.11.

Wright, Caroline et al., "Cell-free Fetal Nucleic Acids for Noninvasive Prenatal Diagnosis", PHG Foundation, Jan. 1, 2009, 1-64.

Xia, et al., "Simultaneous Quantitative Assessment of Circulating Cell-free Mitochondrial and Nuclear DNA by Multiplex Real-time PCR", Genetics and Molecular Biology, vol. 32, No. 1, Mar. 1, 2009, 20-24.

Xian, et al., "Advances on Circulating Fetal DNA in Maternal Plasma", Chinese Medical Journal, vol. 120, No. 14, Jul. 2, 2007, 1256-1259.

Xie, et al., "CNV-SEQ, A New Method to Detect Copy Number Variation Using Highthroughput Sequencing", BMC Bioinformatics, vol. 10:80, Mar. 6, 2009, 1-9.

Xue, et al., "Optimizing the Yield and Utility of Circulating Cell-free DNA from Plasma and Serum", Clinica Chimica Acta, vol. 404, No. 2, Jun. 27, 2009, 100-104.

Yang, Lin et al., "64-MDCT Coronary Angiography of Patients with Atrial Fibrillation: Influence of Heart Rate on Image Quality and Efficacy In Evalution of Coronary Artery Disease", AJR, vol. 193, No. 3, Sep. 1, 2009, 795-801.

Yijen, et al., "Noninvasive Evalution of Cardiac Allograft Rejection by Cellular and Functional Cardiac Magnetic Resonance", JACC: Cardiovacular Imaging, vol. 2, No. 6, Jun. 1, 2009, 731-741.

Yilmaz, A. et al., "Comparative Evluation of Left and Right Ventricular Endomyocardial Biopsy", Circulation, vol. 122, No. 9, Aug. 31, 2010, 900-909.

Yuanxin, Yan et al., "T-linker-specific Ligation PCR (T-linker Pcr): An Advanced PCR Technique for Chromosome Walking or for Isoolation of Tagged DNA ends", Nucleic Acids Research, vol. 31, No. 12, e68, 2003, 7 pages.

Zhang, et al., "Diagnosis of Acute Rejection by Analysis of Urinary DNA of Donor Origin in Renal Transplant Recipients", Transplantation Proceedings, vol. 33, No. 1-2, Feb. 2001, 380-381.

Zhang, et al., "Use of PCR and PCR-SSP for Detection of Urinary Donor-Origin Dna in Renal Transplant Recipients with Acute Rejection", Chinese Medical Journal, vol. 116, No. 2, Feb. 2003, 191-194.

(56) References Cited

OTHER PUBLICATIONS

Zhang, Kun et al., "Digital RNNA Alleotyping Reveals Tissue-specific and Allele-specific Gene Expression in Human", Nature Methods, vol. 6, No. 8, Jul. 20, 2009, 613-618.

Zhao, et al., "urinary Thromboxane B2 in Cardiac Transplant Patients as a Screening Method of Rejection", Prostaglandins, vol. 54, No. 6, Dec. 1, 1997, 881-889.

Zhong, Xiao Y. et al., "Cell-free DNA in Urine: A Marker for Kidney Graft Rejection, but not for Prenatal Diagnosis ?", Annals of the New York Academy of Sciences, vol. 945, Sep. 1, 2001, 250-257.

Zhou, et al., "Pyrosequencing, A High-throughput Method for Detecting Single Nucleotide Polymorphisms in the Dihydrofolate Reductase and Dihydropteroate Synthetase Genes of Plasmodiym Falciparum", Journal of Clinical Microbiology, vol. 44, No. 11, Nov. 1, 2006, 3900-3910.

Zimmer, et al., "Transplant Coronary Artery Disease", JACC: Cardiovascular Interventions, vol. 3, No. 4, Apr. 1, 2010, 367-377.

\* cited by examiner

| | | | SEQ ID NO: |
|---|---|---|---|
| The sequencing-adaptor sequence is located inside the primer sequence and flanked by target specific sequence on both sides. 10 bases are target-specific at the 3'-end of each primer. Primers were tested successfully in real-time PCR. For sequencing this reduces the number of primer bases that need to be sequenced. | | | |
| rs8130564 | int-tag 1.10 | AACTCACATAGCACACGACGCTCTTCCGATCTTGCAAGCACA | 44611 |
| rs2832093 | int-tag 2.10 | TCCTTCTGTGACACGACGCTCTTCCGATCTCCCTGCTCTT | 44612 |
| rs12011281 | int-tag 3.10 | tcctctctctACACGACGCTCTTCCGATCTCGGCTGTCA | 44613 |
| rs6719561 | int-tag 4.10 | TACATCCTTGAGACACGACGCTCTTCCGATCTGCTGTGCAGT | 44614 |
| rs10187018 | int-tag 5.10 | tttgcttgagctACACGACGCTCTTCCGATCTcggagttc | 44615 |
| rs10460481 | int-tag 6.10 | gtcttatggtggACACGACGCTCTTCCGATCTcaaagccagt | 44616 |
| The sequencing-adaptor sequence is located inside the primer sequence and flanked by target specific sequence on both sides. The internal tag is formed into a hairpin structure by 10 complementary bases on either end. This brings the target-specific ends of the primer into close proximity and hinders unspecific binding to the "internal tag". 10 bases are target specific at the 3'-end of each primer. Primers were tested successfully in real-time PCR. | | | |
| rs8130564 | loop-int-tag 1.10 | AACTCACATAGCtgatcggtACACGACGCTCTTCCGATCTTGCAAGCACA | 44617 |
| rs2832093 | loop-int-tag 2.10 | TCCTTCTGTGtgatcggtACACGACGCTCTTCCGATCTCCCTGCTCTT | 44618 |
| rs12011281 | loop-int-tag 3.10 | tcctctcttgatcggtACACGACGCTCTTCCGATCTCGGCTGTCA | 44625 |
| rs6719561 | loop-int-tag 4.10 | TACATCCTTGAGtgatcggtACACGACGCTCTTCCGATCTGCTGTGCAGT | 44620 |
| rs10187018 | loop-int-tag 5.10 | tttgcttgagcttgatcggtACACGACGCTCTTCCGATCTcggagttc | 44621 |
| rs10460481 | loop-int-tag 6.10 | gtcttatggtggtgatcggtACACGACGCTCTTCCGATCTcaaagccagt | 44622 |

FIG. 12

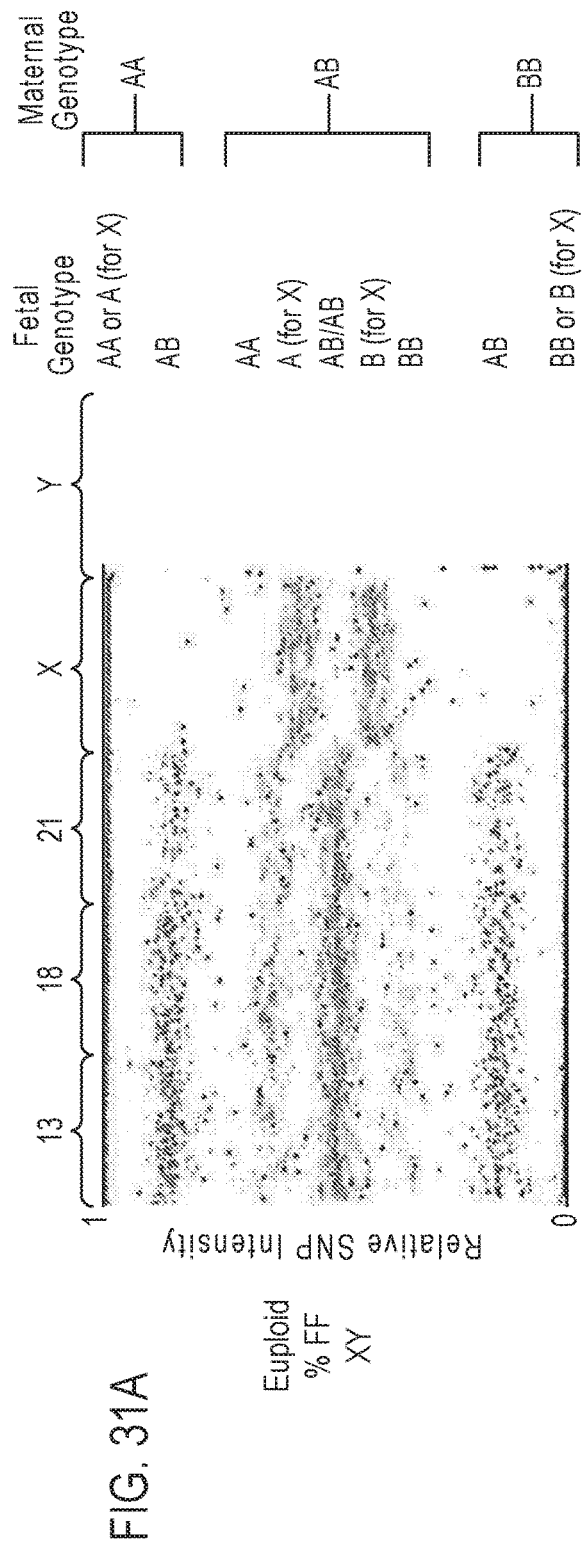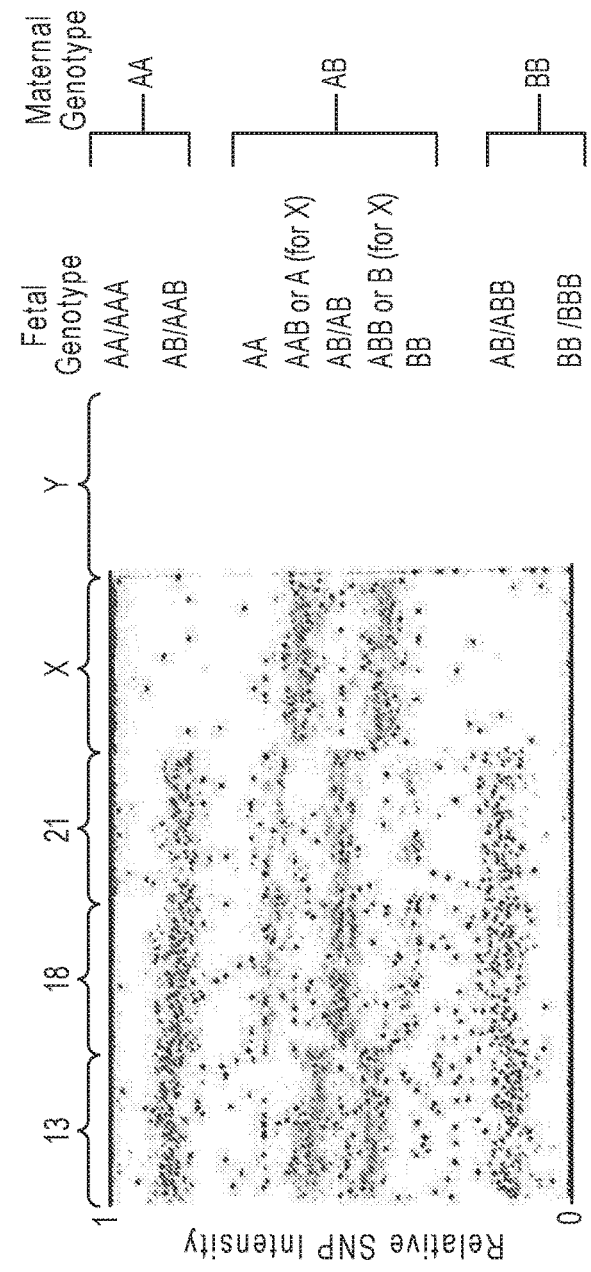

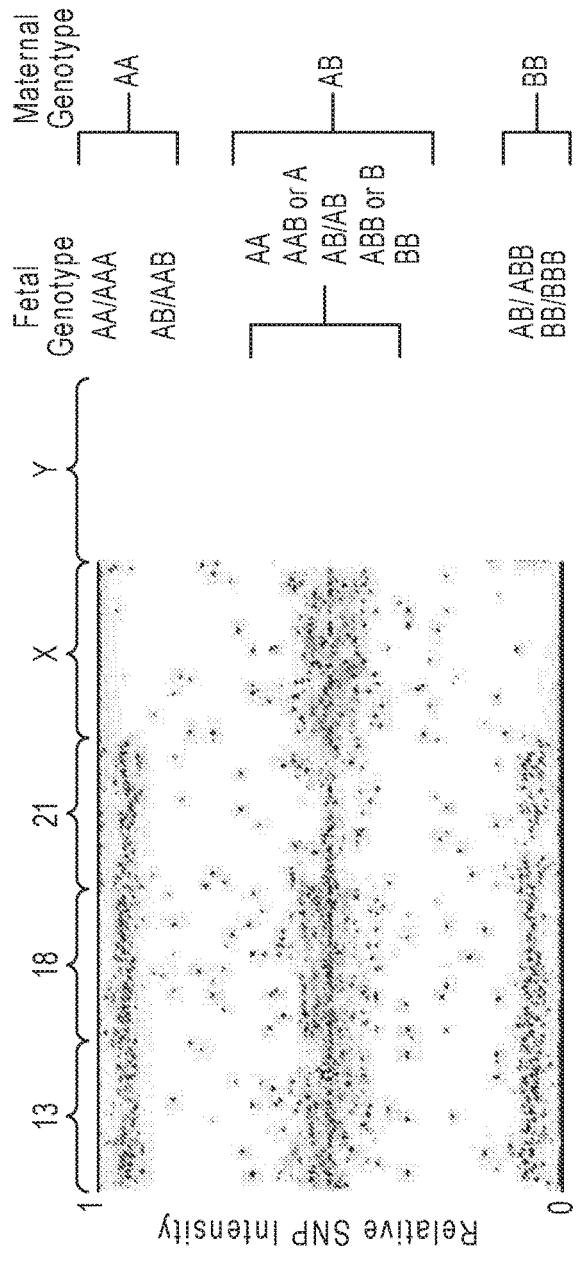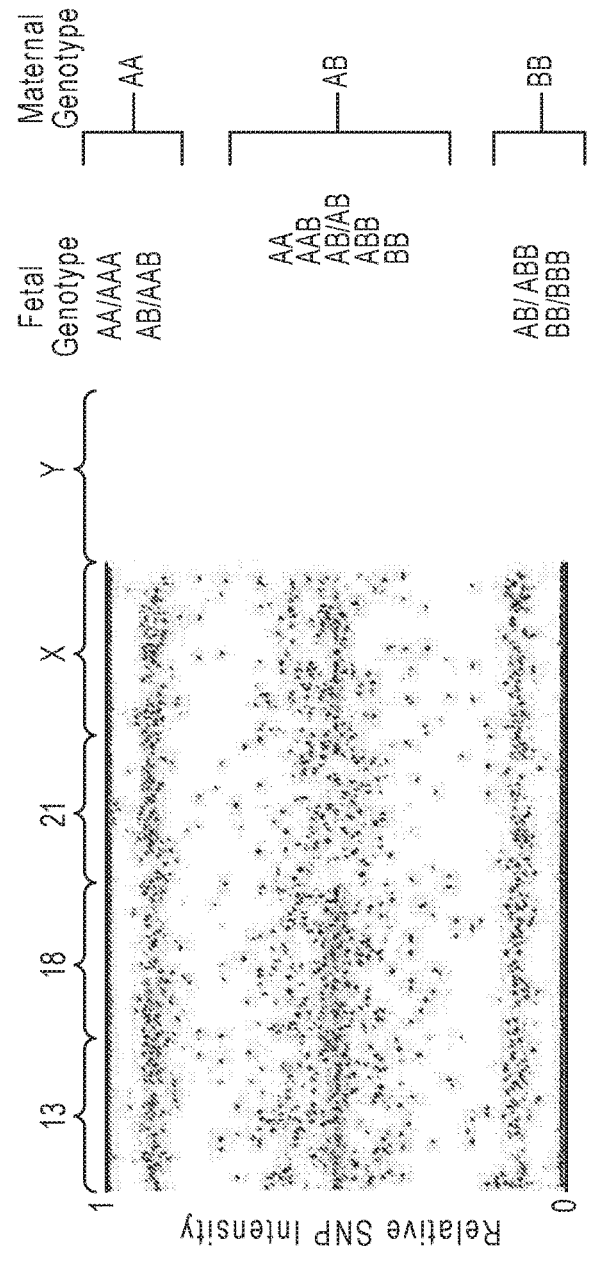

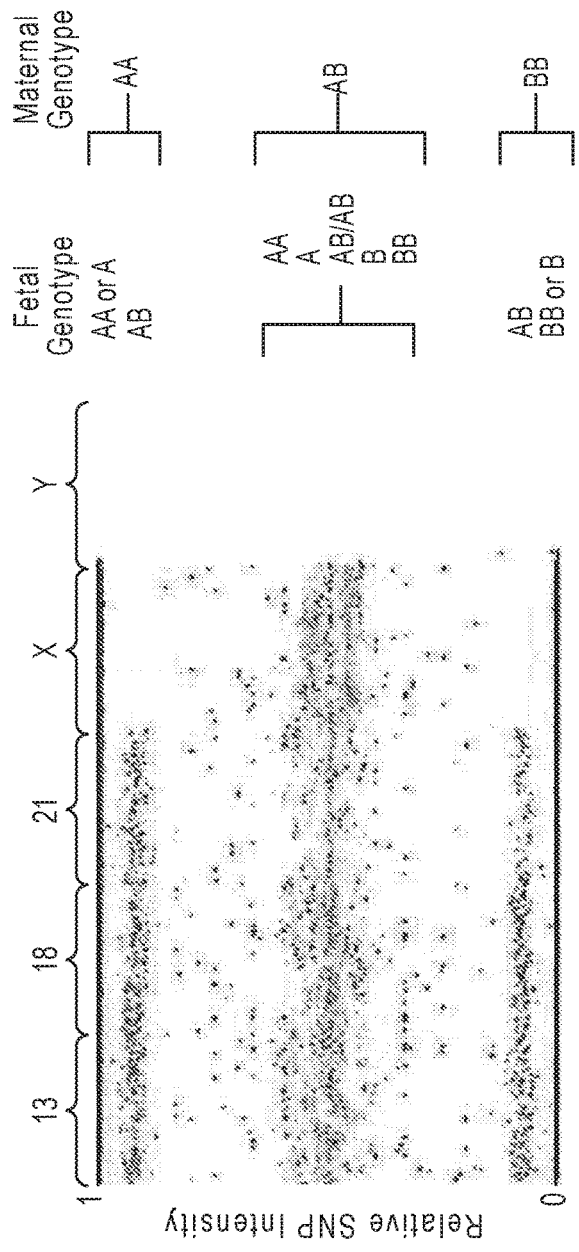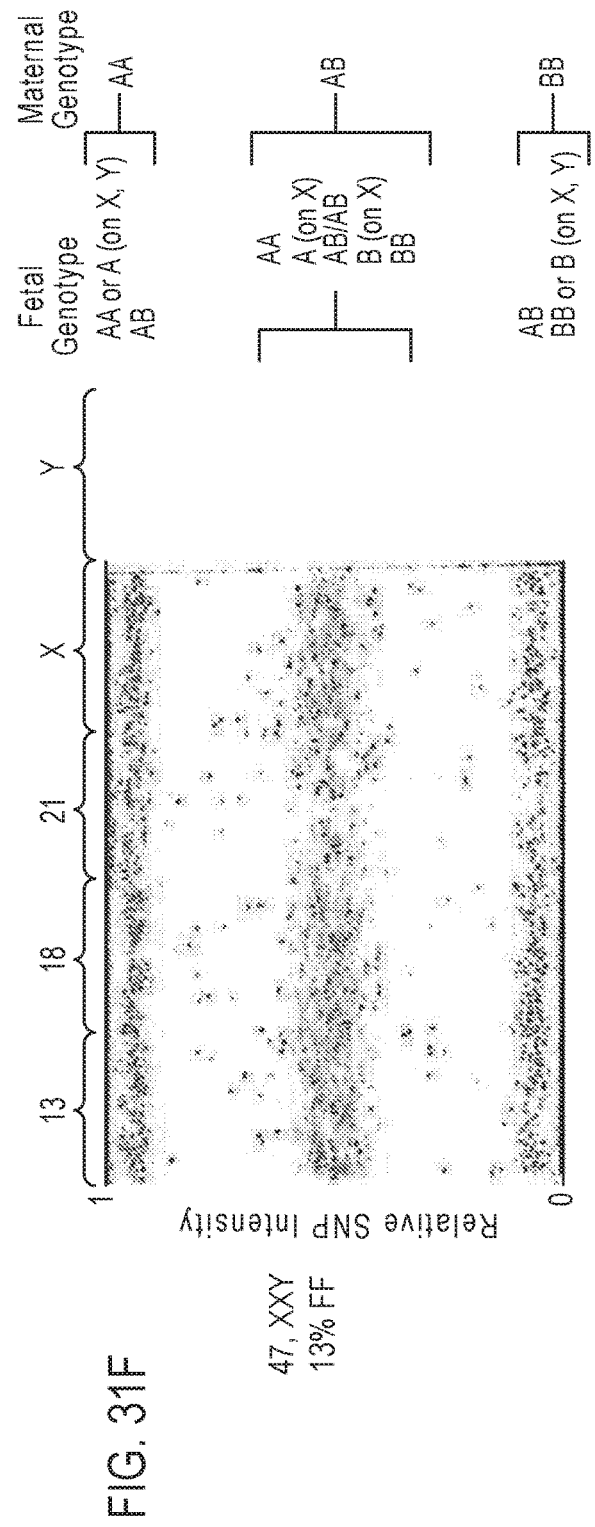
FIG. 31E  45X 15% FF
FIG. 31F  47, XXY 13% FF $\Delta G = \Delta G_1 + \Delta G_2 + ... + \Delta G_x$

5'  A   T   C   G   A   3'

3'  G   A   C   T   T   5'

↓ SHIFT ALIGNMENT BY 1

| Description | MAPPED_READS | TOTAL_READS | %Mapped Reads |
|---|---|---|---|
| gMother | 3,633,900 | 3,647,446 | 100% |
| gMother | 3,567,685 | 3,578,549 | 100% |
| gMother | 3,733,706 | 3,747,692 | 100% |
| gChild | 3,725,554 | 3,737,742 | 100% |
| gChild | 3,816,989 | 3,829,450 | 100% |
| gChild | 3,524,956 | 3,536,569 | 100% |
| 1 mother | 3,467,493 | 7,564,869 | 46% |
| 1 mother | 3,868,210 | 7,107,028 | 54% |
| 1 mother | 4,918,140 | 7,613,240 | 65% |
| 1 child | 361,390 | 6,507,434 | 6% |
| 1 child | 1,885,864 | 6,496,348 | 29% |
| 1 child | 2,789,647 | 6,259,288 | 45% |

FIG. 34

| Description | MAPPED_READS | TOTAL_READS | %Mapped Reads |
|---|---|---|---|
| case 1 blastoceol | 68,123 | 8,470,872 | 1% |
| case 1 cell 1 | 4,340,613 | 8,248,598 | 53% |
| case 1 cell 2 | 5,480,580 | 8,230,870 | 67% |
| case 1 cell 3 | 4,664,577 | 7,846,040 | 59% |
| case 2 blastoceol | 45,794 | 6,302,957 | 1% |
| case 2 cell 1 | 6,988,854 | 8,622,495 | 81% |
| case 2 cell 2 | 7,083,600 | 8,843,495 | 80% |
| case 2 cell 3 | 5,811,364 | 8,256,310 | 70% |

FIG. 36

|  | gDNA | Single Cell |
|---|---|---|
| Count | 75 | 510 |
| Mean | 0.15 % | 0.51 % |
| Median | 0.09 % | 0.33 % |
| Max | 1.03 % | 10 % |
| Standard Deviation | 0.16% | 0.79 % |
| 95$^{th}$ percentile | 0.43 % | 1.22 % |
| 90$^{th}$ percentile | 0.37 % | 0.92 % |

| DOE1 | Mapped READS | TOTAL READS | % Mapped | Dropout Count | Median DOR All | NOR | Error Rate (%) |
|---|---|---|---|---|---|---|---|
| 1xMM | 1,112,007 | 1,262,558 | 80.0% | 436 | 26.25 | 1,043,539 | 0.107% |
| 2xMM | 3,412,593 | 3,615,347 | 94.4% | 105 | 147.75 | 3,206,478 | 0.141% |
| F-A | 449,074 | 635,571 | 70.6% | 1379 | 9.625 | 421,228 | 0.077% |
| F-B | 3,293,944 | 3,519,378 | 93.7% | 105 | 142.5 | 3,106,520 | 0.072% |
| F-D | 4,028,128 | 4,109,448 | 98.0% | 122 | 142.5 | 3,796,213 | 0.064% |
| F-J | 3,676,617 | 3,922,330 | 93.7% | 102 | 159.25 | 3,461,304 | 0.079% |

F-A is : 25 mM Tris pH 7.8, 3 mM MgCl$_2$, 0 mM KCl, 10 mM (NH$_4$)$_2$SO$_4$, 50 U/mL Taq Gold    aka F-A Gold F-B is : 75 mM Tris pH 7.8, 6 mM MgCl$_2$, 0 mM KCl, 40 mM (NH$_4$)$_2$SO$_4$, 150 U/mL Taq Gold    aka F-B Gold F-D is : 25 mM Tris pH 8.2, 3 mM MgCl$_2$, 30 mM KCl, 40 mM (NH$_4$)$_2$SO$_4$, 150 U/mL Taq Gold    aka F-B Qiagen F-J is : 75 mM Tris pH 7.8, 6 mM MgCl$_2$, 0 mM KCl, 40 mM (NH$_4$)$_2$SO$_4$, 150 U/mL Qiagen HS Taq    aka F-B Qiagen

FIG. 45

METHODS FOR SIMULTANEOUS AMPLIFICATION OF TARGET LOCI

CROSS-REFERENCE TO RELATED APPLICATIONS

This application is a continuation of U.S. Utility application Ser. No. 16/777,700, filed Jan. 30, 2020.

U.S. Utility application Ser. No. 16/777,700 is a continuation of U.S. Utility application Ser. No. 16/399,103, filed Apr. 30, 2019.

U.S. Utility application Ser. No. 16/399,103 is a continuation of U.S. Utility application Ser. No. 16/140,298, filed Sep. 24, 2018.

U.S. Utility application Ser. No. 16/140,298 is a continuation of U.S. Utility application Ser. No. 14/918,544, filed Oct. 20, 2015 (now U.S. Pat. No. 10,316,362).

U.S. Utility application Ser. No. 14/918,544, filed Oct. 20, 2015 (now U.S. Pat. No. 10,316,362), is a continuation-in-part application of U.S. Utility application Ser. No. 14/877,925, filed Oct. 7, 2015, now abandoned; a continuation-in-part application of U.S. Utility application Ser. No. 14/692,703, filed Apr. 21, 2015, now U.S. Pat. No. 10,179,937; a continuation-in-part application of U.S. Utility application Ser. No. 14/538,982, now U.S. Pat. No. 9,677,118, filed Nov. 24, 2014; and claims the benefit of and priority to U.S. Provisional Application Ser. No. 62/148,173, filed Apr. 15, 2015; U.S. Provisional Application Ser. No. 62/147,377, filed Apr. 14, 2015; U.S. Provisional Application Ser. No. 62/146,188, filed Apr. 10, 2015; and U.S. Provisional Application Ser. No. 62/066,514, filed Oct. 21, 2014.

U.S. Utility application Ser. No. 14/877,925, filed Oct. 7, 2015, is a continuation-in-part of U.S. Utility application Ser. No. 14/225,356, filed Mar. 25, 2014; is a continuation-in-part of U.S. Utility application Ser. No. 13/780,022, filed Feb. 28, 2013; and is a continuation of U.S. Utility application Ser. No. 13/683,604, filed Nov. 21, 2012.

U.S. Utility application Ser. No. 14/692,703, filed Apr. 21, 2015, now U.S. Pat. No. 10,179,937, claims the benefit of and priority to U.S. Provisional Application Ser. No. 62/148,173, filed Apr. 15, 2015; U.S. Provisional Application Ser. No. 62/147,377, filed Apr. 14, 2015; U.S. Provisional Application Ser. No. 62/146,188, filed Apr. 10, 2015; U.S. Provisional Application Ser. No. 62/066,514, filed Oct. 21, 2014; U.S. Provisional Application Ser. No. 61/994,791, filed May 16, 2014; U.S. Provisional Application Ser. No. 61/987,407, filed May 1, 2014; and U.S. Provisional Application Ser. No. 61/982,245, filed Apr. 21, 2014.

U.S. Utility application Ser. No. 14/538,982, now U.S. Pat. No. 9,677,118, filed Nov. 24, 2014 claims the benefit of and priority to U.S. Provisional Application Ser. No. 62/066,514, filed Oct. 21, 2014; U.S. Provisional Application Ser. No. 61/994,791, filed May 16, 2014; U.S. Provisional Application Ser. No. 61/987,407, filed May 1, 2014; and U.S. Provisional Application Ser. No. 61/982,245, filed Apr. 21, 2014.

U.S. Utility application Ser. No. 14/225,356, filed Mar. 25, 2014 is a continuation of PCT Application PCT/US2012/58578, filed Oct. 3, 2012.

U.S. Utility application Ser. No. 13/780,022, filed Feb. 28, 2013, is a continuation-in-part of U.S. Utility application Ser. No. 13/683,604 filed Nov. 21, 2012; a continuation-in-part of PCT Application No. PCT/US2012/58578, filed Oct. 3, 2012; a continuation-in-part of U.S. Utility application Ser. No. 13/335,043, filed Dec. 22, 2011, now U.S. Pat. No. 10,113,196; a continuation-in-part of U.S. Utility application Ser. No. 13/300,235, filed Nov. 18, 2011, now U.S. Pat. No. 10,017,812; and an continuation-in-part of U.S. Utility application Ser. No. 13/110,685 (now U.S. Pat. No. 8,825,412), filed May 18, 2011, and also claims the benefit of U.S. Provisional Application Ser. No. 61/634,431, filed Feb. 29, 2012.

U.S. Utility application Ser. No. 13/683,604, filed Nov. 21, 2012, is a continuation-in-part of U.S. Utility application Ser. No. 13/300,235 (now U.S. Pat. No. 10,017,812), filed Nov. 18, 2011; is a continuation-in-part of U.S. Utility application Ser. No. 13/110,685 (now U.S. Pat. No. 8,825,412), filed May 18, 2011; and claims the benefit of and priority to U.S. Provisional Application Ser. No. 61/675,020, filed. Jul. 24, 2012.

PCT Application No. PCT/US2012/058578, filed Oct. 3, 2012, is a continuation-in-part of U.S. Utility application Ser. No. 13/300,235 (now U.S. Pat. No. 10,017,812), filed Nov. 18, 2011; and claims the benefit of and priority to U.S. Provisional Application Ser. No. 61/683,331, filed Aug. 15, 2012; and U.S. Provisional Application Ser. No. 61/542,508, filed Oct. 3, 2011.

U.S. Utility application Ser. No. 13/335,043, filed Dec. 22, 2011, is a continuation-in-part of U.S. Utility application Ser. No. 13/300,325 (now U.S. Pat. No. 10,017,812), filed Nov. 18, 2011; a continuation-in-part of U.S. Utility application Ser. No. 13/110,685 (now U.S. Pat. No. 8,825,412), filed May 18, 2011; and claims the benefit of U.S. Provisional Application Ser. No. 61/426,208, filed Dec. 22, 2010.

U.S. Utility application Ser. No. 13/300,235 (now U.S. Pat. No. 10,017,812), filed Nov. 18, 2011 is a continuation-in-part of U.S. Utility application Ser. No. 13/110,685 (now U.S. Pat. No. 8,825,412), filed May 18, 2011; and claims the benefit of U.S. Provisional Application Ser. No. 61/542,508, filed Oct. 3, 2011; and U.S. Provisional Application Ser. No. 61/571,248, filed Jun. 23, 2011.

U.S. Utility application Ser. No. 13/110,685 (now U.S. Pat. No. 8,825,412), filed May 18, 2011, claims the benefit of U.S. Provisional Application Ser. No. 61/516,996, filed Apr. 12, 2011; U.S. Provisional Application Ser. No. 61/448,547, filed Mar. 2, 2011; U.S. Provisional Application Ser. No. 61/462,972, filed Feb. 9, 2011; U.S. Provisional Application Ser. No. 61/398,159, filed Jun. 21, 2010; and U.S. Provisional Application Ser. No. 61/395,850, filed May 18, 2010.

Each of these applications cited above is hereby incorporated by reference in its entirety.

SEQUENCE LISTING

The instant application contains a Sequence Listing which has been submitted electronically in ASCII format and is hereby incorporated by reference in its entirety. Said ASCII copy, created on Mar. 24, 2020, is named N012US30_SL.txt and is 8,725,977 bytes in size.

FIELD OF THE INVENTION

The present invention generally relates to methods and compositions for simultaneously amplifying multiple nucleic acid regions of interest in one reaction volume.

BACKGROUND OF THE INVENTION

To increase assay throughput and allow more efficient use of nucleic acid samples, simultaneous amplification of many target nucleic acids in a sample of interest can be carried out by combining many oligonucleotide primers with the sample and then subjecting the sample to polymerase chain reaction (PCR) conditions in a process known in the art as multiplex PCR. Use of multiplex PCR can significantly simplify experimental procedures and shorten the time required for nucleic acid analysis and detection. However, when multiple pairs are added to the same PCR reaction, non-target amplification products may be generated, such as amplified primer dimers. The risk of generating such products increases as the number of primers increases. These non-target amplicons significantly limit the use of the amplified products for further analysis and/or assays. Thus, improved methods are needed to reduce the formation of non-target amplicons during multiplex PCR.

Improved multiplex PCR methods would be useful for a variety of application, such as Non-Invasive Prenatal Genetic Diagnosis (NPD). In particular, current methods of prenatal diagnosis can alert physicians and parents to abnormalities in growing fetuses. Without prenatal diagnosis, one in 50 babies is born with serious physical or mental handicap, and as many as one in 30 will have some form of congenital malformation. Unfortunately, standard methods have either poor accuracy, or involve an invasive procedure that carries a risk of miscarriage. Methods based on maternal blood hormone levels or ultrasound measurements are non-invasive, however, they also have low accuracies. Methods such as amniocentesis, chorion villus biopsy and fetal blood sampling have high accuracy, but are invasive and carry significant risks. Amniocentesis was performed in approximately 3% of all pregnancies in the US, though its frequency of use has been decreasing over the past decade and a half.

Normal humans have two sets of 23 chromosomes in every healthy, diploid cell, with one copy coming from each parent. Aneuploidy, a condition in a nuclear cell where the cell contains too many and/or too few chromosomes is believed to be responsible for a large percentage of failed implantations, miscarriages, and genetic diseases. Detection of chromosomal abnormalities can identify individuals or embryos with conditions such as Down syndrome, Klinefelter's syndrome, and Turner syndrome, among others, in addition to increasing the chances of a successful pregnancy. Testing for chromosomal abnormalities is especially important as the mother's age: between the ages of 35 and 40 it is estimated that at least 40% of the embryos are abnormal, and above the age of 40, more than half of the embryos are abnormal.

It has recently been discovered that cell-free fetal DNA and intact fetal cells can enter maternal blood circulation. Consequently, analysis of this genetic material can allow early NPD. Improved methods are desired to improve the sensitivity and specificity and reduce the time and cost required for NPD.

SUMMARY OF THE INVENTION

In one aspect, the invention features methods of amplifying target loci in a nucleic acid sample. In some embodiments, the method involves (i) contacting the nucleic acid sample with a library of test primers (such as non-immobilized primers) that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture; and (ii) subjecting the reaction mixture to primer extension reaction conditions to produce amplified products that include target amplicons. In some embodiments, the method also includes determining the presence or absence of at least one target amplicon (such as at least 50, 60, 70, 80, 90, 95, 96, 97, 98, 99, or 99.5% of the target amplicons). In some embodiments, the method also includes determining the sequence of at least one target amplicon (such as at least 50, 60, 70, 80, 90, 95, 96, 97, 98, 99, or 99.5% of the target amplicons). In some embodiments, the method involves multiplex PCR and sequencing (such as high throughput sequencing). In some embodiments, the method includes selecting the test primers from a library of candidate primers by removing one or more of the candidate primers based at least in part on the likelihood of dimer formation between candidate primers (such as ΔG values, undesirability scores, or interaction scores) prior to contacting the nucleic acid sample with the library of test primers.

In some embodiments, the method involves (i) contacting a sample comprising target human loci with a library of at least 50 (such as at least 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-immobilized, non-identical primers that simultaneously hybridize to at least 50 (such as at least 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-identical target human loci to produce a reaction mixture; wherein the primers do not include molecular inversion probes (MIPs); (ii) subjecting the reaction mixture to primer extension reaction conditions to produce amplified products comprising target amplicons; wherein the annealing temperature for the reaction conditions is greater than a melting temperature (such as the empirically measured or calculated $T_m$) of at least 50 (such as at least 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) of the non-identical primers and/or the length of the annealing step of the reaction conditions is greater than 5 minutes (such as at least 8, 10, 15, 20, 30, 45, 60, 75, 90, 120, 150, or 180 minutes; and wherein at least 50 (such as at least 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-identical target human loci are simultaneously amplified; and (iii) detecting the amplified products such as by sequencing the amplified products or hybridizing the amplified products to an array. In some embodiments, the method includes empirically measuring or calculating (such as calculating with a computer) the melting temperature of at least 25, 50, 80, 90, 92, 94, 96, 98, 99, or 100% of the primers in the library and selecting an annealing temperature that satisfies any of these embodiments for PCR amplification of target loci.

In some embodiments, the method involves (i) contacting a sample comprising target human loci with a library of at least 2 (such as at least 5, 10, 25 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-immobilized, non-identical primers that simultaneously hybridize to at least 2 (such as at least 5, 10, 25 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-identical target human loci to produce a reaction mixture; wherein the primers do not include molecular inversion probes (MIPs); (ii) subjecting the reaction mixture to primer extension reaction conditions to produce amplified products comprising target amplicons; wherein at least 2 (such as at least 5, 10, 25 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-identical target human loci are simultaneously amplified; and (iii) detecting the amplified products such as by sequencing the amplified products or hybridizing the amplified products to an array. In various embodiments, (i) the annealing temperature is at least 1, 2, 3, 4, 5, 6, 7, 8, 9, 10, 11, 12, 13, or 15° C. greater than the melting temperature (such as the empirically measured or calculated $T_m$) of at least 2, 5, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers; (ii) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of at least 2, 5, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers; (iii) the annealing temperature is at least 1, 2, 3, 4, 5, 6, 7, 8, 9, 10, 11, 12, 13, or 15° C. greater than the highest melting temperature (such as the empirically measured or calculated $T_m$) of the primers; (iv) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the highest melting temperature (such as the empirically measured or calculated $T_m$) of the primers; (v) the annealing temperature is at least 1, 2, 3, 4, 5, 6, 7, 8, 9, 10, 11, 12, 13, or 15° C. greater than the average melting temperature (such as the empirically measured or calculated $T_m$) of at least 2, 5, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers; or (vi) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature (such as the empirically measured or calculated $T_m$) of at least 2, 5, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In various embodiments, (i) the length of the annealing step (per PCR cycle) is greater than 1, 3, 5, 8, 10, 15, 20, 30, 45, 60, 75, 90, 120, 150, or 180 minutes or (ii) the length of the annealing step (per PCR cycle) is between 5 and 180 minutes, such as 5 to 60, 10 to 60, 5 to 30, or 10 to 30 minutes, inclusive. In various embodiments, any of the embodiments for annealing temperature are combined with any of the embodiments for annealing time. In various embodiments, the annealing temperature is at least 3° C. greater than the melting temperature of at least 50 of the non-identical primers, the annealing temperature is at least 3° C. greater than the highest melting temperature of the primers, the annealing temperature is at least 8° C. greater than the highest melting temperature of the primers, the annealing temperature is at least 3° C. greater than the average melting temperature of the primers, the annealing temperature is at least 8° C. greater than the average melting temperature of the primers, the range of melting temperature of the primers is between 1 to 5° C., inclusive, the range of melting temperatures of the primers is less than 5° C., or any combination thereof. In some embodiments, the method includes empirically measuring or calculating (such as calculating with a computer) the melting temperature of at least 25, 50, 80, 90, 92, 94, 96, 98, 99, or 100% of the primers in the library and selecting an annealing temperature that satisfies any of these embodiments for PCR amplification of target loci. In some embodiments, a crowding agent, such as PEG or glycerol is included in the reaction mixture.

In various embodiments of any of the aspects of the invention, the method includes non-specifically amplifying nucleic acids in a sample comprising target human loci; contacting the amplified nucleic acids with a library of non-identical primers (such as non-immobilized primers) that simultaneously hybridize to at least 1,000 non-identical target human loci to produce a reaction mixture; wherein the primers do not include molecular inversion probes (MIPs); subjecting the reaction mixture to primer extension reaction conditions to produce amplified products comprising target amplicons; wherein at least 1,000 non-identical target human loci are simultaneously amplified; and sequencing the amplified products. In some embodiments, the non-specific amplification comprises universal polymerase chain reaction (PCR), whole genome application, ligation-mediated PCR, degenerate oligonucleotide primer PCR, or multiple displacement amplification. In some embodiments, the method includes contacting a sample comprising target human loci with a library of non-identical primers (such as non-immobilized primers) that simultaneously hybridize to at least 1,000 non-identical target human loci to produce a reaction mixture; wherein the primers do not include molecular inversion probes (MIPs); subjecting the reaction mixture to primer extension reaction conditions to produce amplified products comprising target amplicons; wherein the annealing temperature for the reaction conditions is greater than the melting temperature of at least 1,000 of the non-identical primers; and wherein at least 1,000 non-identical target human loci are simultaneously amplified; and sequencing the amplified products. In some embodiments, the method includes contacting a sample comprising target human loci with a library of non-identical primers (such as non-immobilized primers) that simultaneously hybridize to at least 1,000 non-identical target human loci to produce a reaction mixture in which the concentration of each primer is less than 20 nM; wherein the primers do not include molecular inversion probes (MIPs); subjecting the reaction mixture to primer extension reaction conditions to produce amplified products comprising target amplicons; wherein the length of the annealing step of the reaction conditions is greater than 10 minutes; and wherein at least 1,000 non-identical target human loci are simultaneously amplified; and sequencing the amplified products. In some embodiments, the method includes contacting a sample comprising target human loci with a library of non-identical primers (such as non-immobilized primers) that simultaneously hybridize to at least 1,000 non-identical target human loci to produce a reaction mixture; wherein the guanine-cytosine (GC) content of the primers is between 30% and 80%, inclusive; wherein the range of melting temperatures of the primers is less than 5° C.; wherein the length of the primers is between 15 to 75 nucleotides, inclusive; and wherein the primers do not include molecular inversion probes (MIPs); subjecting the reaction mixture to primer extension reaction conditions to produce amplified products comprising target amplicons; wherein at least 1,000 non-identical target human loci are simultaneously amplified; and sequencing the amplified products. In some embodiments, the method does not comprise using a microarray. In some embodiments, the library includes a least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers. In some embodiments, at least 25; 50; 75; 100; 300; 500; 750;

1,000; 2,000; 5,000; 7,500; 10,000; 15,000; 19,000; 20,000; 25,000; 27,000; 28,000; 30,000; 40,000; 50,000; 75,000; or 100,000 different target loci are amplified.

In various embodiments of any of the aspects of the invention, the ΔG values for each possible combination of two primers in the library are all equal to or greater than −5 kcal/mol. In some embodiments, the method simultaneously PCR-amplifying at least 1,000 non-identical target human loci in the sample using at least 1,000 non-identical primer pairs (such as non-immobilized primer pairs) to produce a first set of amplified products; wherein each primer pair includes a forward primer and a reverse primer that hybridize to the same target human locus. In some embodiments, the method also includes simultaneously PCR-amplifying at least 1,000 non-identical target human loci in the first set of amplified products using at least 1,000 non-identical primer pairs (such as non-immobilized primer pairs) to produce a second set of amplified products; wherein each primer pair includes a forward primer and a reverse primer that hybridize to the same target human locus. In some embodiments, the primer pairs used in the first and second round of PCR are the same. In some embodiments, the primer pairs used in the first and second round of PCR are different. In some embodiments, the forward primers used in the first and second round of PCR are the same, and the reverse primers used in the first and second round of PCR are different. In some embodiments, the forward primers used in the first and second round of PCR are different, and the reverse primers used in the first and second round of PCR are the same. In some embodiments, the method simultaneously PCR-amplifying at least 1,000 non-identical target human loci in the sample using at least 1,000 non-identical primer pairs (such as non-immobilized primer pairs) to produce a first set of amplified products; wherein each primer pair includes an outer forward primer and an outer reverse primer that hybridize to the same target human locus; and simultaneously PCR-amplifying at least 1,000 non-identical target human loci in the first set of amplified products using a universal reverse primer and at least 1,000 non-identical inner forward primers to produce a second set of amplified products; wherein each inner forward primer hybridizes to a region downstream from the corresponding outer forward primer. In some embodiments, the method includes simultaneously PCR-amplifying at least 1,000 non-identical target human loci in the sample using at least 1,000 non-identical primer pairs to produce a first set of amplified products; wherein each primer pair includes an outer forward primer and an outer reverse primer that hybridize to the same target human locus; and simultaneously PCR-amplifying at least 1,000 non-identical target human loci in the first set of amplified products using a universal forward primer and at least 1,000 non-identical inner reverse primers to produce a second set of amplified products; wherein each inner reverse primer hybridizes to a region upstream from the corresponding outer reverse primer. In some embodiments, the method includes simultaneously PCR-amplifying at least 1,000 non-identical target human loci in the sample using at least 1,000 non-identical forward primers and a universal reverse primer to produce a first set of amplified products; and simultaneously PCR-amplifying at least 1,000 non-identical target human loci in the first set of amplified products using a universal forward primer and at least 1,000 non-identical reverse primers to produce a second set of amplified products. In some embodiments, the method includes simultaneously PCR-amplifying at least 1,000 non-identical target human loci in the sample using at least 1,000 non-identical reverse primers and a universal forward primer to produce a first set of amplified products; and simultaneously PCR-amplifying at least 1,000 non-identical target human loci in the first set of amplified products using a universal reverse primer and at least 1,000 non-identical forward primers to produce a second set of amplified products. In some embodiments, at least 96% of the primer molecules are extended to form amplified products. In some embodiments, the annealing temperature is at least 1, 2, 3, 4, 5, 6, 7, 8, 9, 10, 11, 12, 13, or 15° C. greater than the melting temperature of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the annealing temperature is at least 1, 2, 3, 4, 5, 6, 7, 8, 9, 10, 11, 12, 13, or 15° C. greater than the highest melting temperature of the non-identical primers. In some embodiments, the annealing temperature is at least 1, 2, 3, 4, 5, 6, 7, 8, 9, 10, 11, 12, 13, or 15° C. greater than the average melting temperature of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the range of melting temperature of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers is between 1 to 5° C., inclusive. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers have 2, 1, or 0 guanines or cytosines in the last 5 bases at the 3' end of the primers. In some embodiments, the sample comprises maternal DNA from the pregnant mother of a fetus and fetal DNA, and wherein the method comprises determining the presence or absence of a fetal chromosome abnormality from the sequencing data. In some embodiments, the sample is from an individual suspected of having cancer or an above normal risk for cancer; and wherein one or more of the target human loci comprises a polymorphism or other mutation associated with an above normal risk for cancer or associated with cancer.

In various embodiments of any of the aspects of the invention, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, or 99.5% of the amplified products are target amplicons. In some embodiments, at least 50, 60, 70, 80, 90, 95, 96, 97, 98, 99, or 99.5% of the target loci are amplified. In some embodiments, at least 50, 60, 70, 80, 90, 95, 96, 97, 98, 99, or 99.5% of the target loci are amplified at least 5, 10, 20, 40, 50, 60, 80, 100, 120, 150, 200, 300, or 400-fold. In various embodiments, less than 60, 50, 40, 30, 20, 10, 5, 4, 3, 2, 1, 0.5, 0.25, 0.1, or 0.05% of the amplified products are primer dimers. In some embodiments, the library of test primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 test primer pairs, wherein each pair of primers includes a forward test primer and a reverse test primer that hybridize to the same target locus. In some embodiments, the library of test primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 individual test primers that hybridize to different target loci, wherein the individual primers are not part of primer pairs.

In various embodiments of any of the aspects of the invention, the concentration of each test primer is less than 100, 75, 50, 25, 10, 5, 2, 1, 0.5, 0.1, or 0.05 nM. In various embodiments, the guanine-cytosine (GC) content of the test primers is between 30 to 80%, such as between 20 to 70%, 40 to 70%, or 50 to 60%, inclusive. In some embodiments, the range of GC content (e.g., the maximum GC content minus minimum GC content, such as 80%-60%=a range of 20%) of the test primers is less than 30, 20, 10, or 5%. In some embodiments, there are at least 2 (such as 3, 4, or 5) guanines or cytosines in the last 5 bases at the 3' end of the primers. In some embodiments, a maximum of 2 (such as 2, 1, or 0) of the bases in the last 5 bases at the 3' end of the primers are guanines or cytosines. In some embodiments, there are at least 1 (such as 2 or 3) guanines or cytosines in the last 3 bases at the 3' end of the primers. In some embodiments, the melting temperature ($T_m$) of the test primers is between 40 to 80° C., such as 50 to 70° C., 55 to 65° C., 54 to 60.5° C., or 57 to 60.5° C., inclusive. In some embodiments, the range of melting temperatures of the test primers is less than 20, 15, 10, 5, 3, or 1° C. In some embodiments, the length of the test primers is between 15 to 100 nucleotides, such as between 15 to 75 nucleotides, 15 to 40 nucleotides, 17 to 35 nucleotides, 18 to 30 nucleotides, or 20 to 65 nucleotides, inclusive. In some embodiments, the test primers include a tag that is not target specific, such as a tag that forms an internal loop structure. In some embodiments, the tag is between two DNA binding regions. In various embodiments, the test primers include a 5' region that is specific for a target locus, an internal region that is not specific for the target locus and forms a loop structure, and a 3' region that is specific for the target locus. In various embodiments, the length of the 3' region is at least 7 nucleotides. In some embodiments, the length of the 3' region is between 7 and 20 nucleotides, such as between 7 to 15 nucleotides, or 7 to 10 nucleotides, inclusive. In various embodiments, the test primers include a 5' region that is not specific for a target locus (such as a tag or a universal primer binding site) followed by a region that is specific for a target locus, an internal region that is not specific for the target locus and forms a loop structure, and a 3' region that is specific for the target locus. In some embodiments, the range of the length of the test primers is less than 50, 40, 30, 20, 10, or 5 nucleotides. In some embodiments, the length of the target amplicons is between 50 and 100 nucleotides, such as between 60 and 80 nucleotides, or 60 to 75 nucleotides, inclusive. In some embodiments, the length of the target amplicons is at least 100; 200; 300; 400; 500; 600; 700; 800; 900; 1,000; 1,200; 1,500; 2,000; or 3,000 nucleotides. In some embodiments, the length of the target amplicons is between 100 and 1,500 nucleotides, such as between 100 to 1,000; 100 to 500, 500 to 750, or 750 to 1,000 nucleotides, inclusive. In some embodiments, the range of the length of the target amplicons is less than 50, 25, 15, 10, or 5 nucleotides. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 or all of the target amplicons have a length that falls within the range of the average length of the amplicons ±5% of the average length, average length ±20%, average length ±20%, average length ±30%, or average length ±50%.

In various embodiments of any of the aspects of the invention, the primer extension reaction conditions are polymerase chain reaction conditions (PCR). In various embodiments, the length of the annealing step is greater than 3, 5, 8, 10, 15, 20, 30, 45, 60, 75, 90, 120, 150, or 180 minutes. In various embodiments, the length of the extension step is greater than 0.2, 0.5, 1, 3, 5, 8, 10, or 15 minutes.

In various embodiments of any of the aspects of the invention, the test primers are used to simultaneously amplify at least 300 different target loci in a sample that includes maternal DNA from the pregnant mother of a fetus and fetal DNA to determine the presence or absence of a fetal chromosome abnormality. In various embodiments, the method includes ligating a universal primer binding site to the DNA molecules in the sample; amplifying the ligated DNA molecules using at least 300 specific primers and a universal primer to produce a first set of amplified products; and amplifying the first set of amplified products using at least 300 pairs of specific primers to produce a second set of amplified products.

In various embodiments of any of the aspects of the invention, the test primers are used to simultaneously amplify e.g. at least 100 (e.g., at least 300 or 1,000) different target loci in sample includes DNA from an alleged father of a fetus and to simultaneously amplify the target loci in a sample that includes maternal DNA from the pregnant mother of the fetus and fetal DNA to establish whether the alleged father is the biological father of the fetus.

In various embodiments of any of the aspects of the invention, the test primers are used to simultaneously amplify e.g. at least 100 (e.g., at least 300 or 1,000) different target loci in one cell or multiple cells from an embryo to determine the presence or absence of a chromosome abnormality. In various embodiments, cells from a set of two or more embryos are analyzed, and one embryo is selected for in vitro fertilization.

In various embodiments of any of the aspects of the invention, the test primers are used to simultaneously amplify e.g. at least 100 (e.g., at least 300 or 1,000) different target loci in a forensic nucleic acid sample. In various embodiments, the length of the annealing step is greater than 3, 5, 8, 10, 15, 20, 30, 45, 60, 75, 90, 120, 150, or 180 minutes In various embodiments of any of the aspects of the invention, the method involves using the test primers to simultaneously amplify e.g. at least 100 (e.g., at least 300 or 1,000) different target loci in a control nucleic acid sample to produce a first set of target amplicons and to simultaneously amplify the target loci in a test nucleic acid sample to produce a second set of target amplicons; and comparing the first and second sets of target amplicons to determine whether a target locus is present in one sample but absent in the other, or whether a target locus is present at different levels in the control sample and the test sample. In various embodiments, the test sample is from an individual suspected of having a disease or phenotype of interest (such as cancer), or an increased risk (such as an above normal level of risk) for a disease or phenotype of interest; and wherein one or more of the target loci include a sequence (e.g., a polymorphism or other mutation) associated with an increased risk (such as an above normal level of risk) for the disease or phenotype of interest, or associated with the disease or phenotype of interest. In various embodiments, the method involves using the test primers to simultaneously amplify e.g. at least 100 (e.g., at least 300 or 1,000) different target loci in a control sample that includes RNA to produce a first set of target amplicons and to simultaneously amplify the target loci in a test sample that includes RNA to produce a second set of target amplicons; and comparing the first and second sets of target amplicons to determine the presence or absence of a difference in the RNA expression levels between the control sample and the test sample. In various embodiments, the RNA is mRNA. In various embodiments, the test sample is from an individual suspected of having a disease or phenotype of interest (such as cancer) or an increased risk for the disease or phenotype of interest (such as cancer); and wherein one or more of the target loci includes a sequence (e.g., a polymorphism or other mutation) associated with an increased risk for the disease or phenotype of interest or associated with the disease or phenotype of interest. In some embodiments, the test sample is from an individual diagnosed with a disease or phenotype of interest (such as cancer); and wherein a difference in the RNA expression level between the control sample and test sample indicates a target locus includes a sequence (e.g., a polymorphism or other mutation) associated with an increased or decreased risk for the disease or phenotype of interest.

In some embodiments of any of the aspects of the invention, the test primers are selected from a library of candidate primers based on one or more parameters, such as the selection of primers using any of the methods of the invention. In some embodiments, the test primers are selected from a library of candidate primers based at least in part on the ability of the candidate primers to form primer dimers.

In one aspect, the invention features methods of selecting test primers from a library of candidate primers. In various embodiments, the selection involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing the candidate primer with the highest score (such as an undesirability score) from the library of candidate primers; and (iii) if the candidate primer removed in step (ii) is a member of a primer pair, then removing the other member of the primer pair from the library of candidate primers; and (iv) optionally repeating steps (ii) and (iii), thereby selecting a library of test primers. In some embodiments, the selection method is performed until the score (such as the undesirability score) for the candidate primer combinations remaining in the library are all equal to or below a minimum threshold. In some embodiments, the selection method is performed until the number of candidate primers remaining in the library is reduced to a desired number. In various embodiments, a score (such as an undesirability score) is calculated for at least 80, 90, 95, 98, 99, or 99.5% of the possible combinations of candidate primers in the library. In various embodiments, the candidate primers remaining in the library are capable of simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In various embodiments, the method also includes (v) contacting a nucleic acid sample that includes target loci with the candidate primers remaining in the library to produce a reaction mixture; and (vi) subjecting the reaction mixture to primer extension reaction conditions to produce amplified products that includes target amplicons.

In one aspect, the invention features methods of selecting test primers from a library of candidate primers. In various embodiments, the selection of test primers are selected from a library of candidate primers involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing from the library of candidate primers the candidate primer that is part of the greatest number of combinations of two candidate primers with a score (such as an undesirability score) above a first minimum threshold; (iii) if the candidate primer removed in step (ii) is a member of a primer pair, then removing the other member of the primer pair from the library of candidate primers; and (iv) optionally repeating steps (ii) and (iii), thereby selecting a library of test primers. In some embodiments, the selection method is performed until the score (such as the undesirability score) for the candidate primer combinations remaining in the library are all equal to or below the first minimum threshold. In some embodiments, the selection method is performed until the number of candidate primers remaining in the library is reduced to a desired number. In various embodiments, a score (such as an undesirability score) is calculated for at least 80, 90, 95, 98, 99, or 99.5% of the possible combinations of candidate primers in the library. In various embodiments, the candidate primers remaining in the library are capable of simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In various embodiments, the method also includes (v) contacting a nucleic acid sample that includes target loci with the candidate primers remaining in the library to produce a reaction mixture; and (vi) subjecting the reaction mixture to primer extension reaction conditions to produce amplified products that includes target amplicons.

In various embodiments of any of the aspects of the invention, the selection method involves further reducing the number of candidate primers remaining in the library by decreasing the first minimum threshold used in step (ii) to a lower second minimum threshold and optionally repeating steps (ii) and (iii). In some embodiments, the selection method involves increasing the first minimum threshold used in step (ii) to a higher second minimum threshold and optionally repeating steps (ii) and (iii). In some embodiments, the selection method is performed until the score (such as the undesirability score) for the candidate primer combinations remaining in the library are all equal to or below the second minimum threshold, or until the number of candidate primers remaining in the library is reduced to a desired number.

In various embodiments of any of the aspects of the invention, the method involves, prior to step (i), identifying or selecting primers that hybridize to the target loci. In some embodiments, multiple primers (or primer pairs) hybridize to the same target locus, and the selection method is used to select a one primer (or one primer pair) for this target locus based on one or more parameters. In various embodiments, the method involves, prior to step (ii), removing a primer pair from the library that produces a target amplicon that overlaps with a target amplicon produced by another primer pair. In various embodiments, a candidate primer is selected out of a group of two or more candidate primers with equal scores (such as undesirability scores) for removal from the library of candidate primers based on one or more other parameters. In some embodiments, the candidate primers remaining in the library are used as a library of test primers in any of the methods of the invention. In some embodiments, the resulting library of test primers includes any of the primer libraries of the invention.

In various embodiments of any of the aspects of the invention, the selection method selects candidate primers and divides them into different pools (e.g., 2, 3, 4, 5, 6, or more different pools). Each pool can be used to simultaneously amplify a large number of target loci (or a subset of target loci) in a single reaction volume. In some embodiments, a graph coloring algorithm is used to divide candidate primers into different pools. If desired, this method can be used to minimize the number of different pools needed to amplify most or all of the target loci.

In some embodiments, most or all of the target loci (such as at least 70, 80, 90, 92, 94, 96, 98, 99, or 100% of the target loci) are amplified by at least 2, 3, 4, 5, 6, or more different pools. In some embodiments, most or all of the bases in the target loci (such as at least 70, 80, 90, 92, 94, 96, 98, 99, or 100% of the bases in the target loci) are amplified by at least 2, 3, 4, 5, 6, or more different pools. In some embodiments, most or all of the bases in the target loci (such as at least 70, 80, 90, 92, 94, 96, 98, 99, or 100% of the bases in the target loci) are amplified by at least 2, 3, 4, 5, 6, or more different primers or primer pairs in different pools. For example, a particular base in a target locus may be amplified by at least 2, 3, 4, 5, 6, or more different primers or primer pairs; wherein each different primer or primer pair is in a different pool. Using different primers or primer pairs to amplify each base allows multiple independent measurements of the base to be made, thereby increasing the accuracy of the method. Dividing the different primers or primer pairs that amplify the same base into different pools prevents interference due to overlapping amplicons being formed by different primers or primer pairs.

In one aspect, the invention features methods of selecting test primers from a library of candidate primers to form 2 or more different primer pools. In various embodiments, the selection involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing the candidate primer with the highest score (such as an undesirability score) from the library of candidate primers; and (iii) if the candidate primer removed in step (ii) is a member of a primer pair, then removing the other member of the primer pair from the library of candidate primers; and (iv) optionally repeating steps (ii) and (iii), thereby selecting a first pool. In some embodiments, the selection method is performed until the score (such as the undesirability score) for the candidate primer combinations remaining in the library are all equal to or below a minimum threshold for the first pool. In some embodiments, the selection method is performed until the number of candidate primers remaining in the library is reduced to a desired number for the first pool. In some embodiments, after the first pool is selected those primers are removed from further consideration and steps of the method (such as steps (ii) and (iii)) are repeated with the remaining primers to select a second pool. If desired, this method may be repeated to select the desired number of primer pools. In various embodiments, a score (such as an undesirability score) is calculated for at least 80, 90, 95, 98, 99, or 99.5% of the possible combinations of candidate primers in the library. In some embodiments, the score is based at least in part on the current coverage of the bases in the target locus (such as the number of other primer pools that have a primer or primer pair that amplifies a particular base in the target locus). In various embodiments, one or more of the pools are each capable of simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In various embodiments, the method also includes separately contacting a nucleic acid sample that includes target loci with two or more of the pools to produce separate reaction mixtures; and (vi) subjecting the reaction mixtures to primer extension reaction conditions to produce amplified products that includes target amplicons.

In one aspect, the invention features methods of selecting test primers from a library of candidate primers to form 2 or more different primer pools. In various embodiments, the selection of test primers are selected from a library of candidate primers involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing from the library of candidate primers the candidate primer that is part of the greatest number of combinations of two candidate primers with a score (such as an undesirability score) above a first minimum threshold; (iii) if the candidate primer removed in step (ii) is a member of a primer pair, then removing the other member of the primer pair from the library of candidate primers; and (iv) optionally repeating steps (ii) and (iii), thereby selecting a first pool. In some embodiments, the selection method is performed until the score (such as the undesirability score) for the candidate primer combinations remaining in the library are all equal to or below the first minimum threshold for the first pool. In some embodiments, the selection method is performed until the number of candidate primers remaining in the library is reduced to a desired number for the first pool. In various embodiments, the selection method involves further reducing the number of candidate primers remaining in the library by decreasing the first minimum threshold used in step (ii) to a lower second minimum threshold and optionally repeating steps (ii) and (iii). In some embodiments, the selection method involves increasing the first minimum threshold used in step (ii) to a higher second minimum threshold and optionally repeating steps (ii) and (iii). In some embodiments, the selection method is performed until the score (such as the undesirability score) for the candidate primer combinations remaining in the library are all equal to or below the second minimum threshold, or until the number of candidate primers remaining in the library is reduced to a desired number for the first pool. In some embodiments, after the first pool is selected those primers are removed from further consideration and steps of the method (such as steps (ii) and (iii)) are repeated with the remaining primers to select a second pool. If desired, this method may be repeated to select the desired number of primer pools. In various embodiments, a score (such as an undesirability score) is calculated for at least 80, 90, 95, 98, 99, or 99.5% of the possible combinations of candidate primers in the library. In some embodiments, the score is based at least in part on the current coverage of the bases in the target locus (such as the number of other primer pools that have a primer or primer pair that amplifies a particular base in the target locus). In various embodiments, one or more of the pools are each capable of simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In various embodiments, the method also includes separately contacting a nucleic acid sample that includes target loci with two or more of the pools to produce separate reaction mixtures; and (vi) subjecting the reaction mixtures to primer extension reaction conditions to produce amplified products that includes target amplicons.

In some embodiments, at least 70, 80, 85, 90, 95, or 100% of the nucleotides in a region of interest (such as an exon) are included in at least 1, 2, 3, or 4 different amplicons (i.e., amplicons with non-identical sequences that are formed by different primers or primer pairs). In some embodiments, at least 70, 80, 85, 90, 95, or 100% of the nucleotides in at least 70, 80, 85, 90, 95, or 100% of the regions of interest are amplified by at least 1, 2, 3, or 4 different amplicons. In some embodiments in which 2-fold coverage is desired, the primers are divided into at least two different pools such the amplicons in each pool do not overlap with each other (which would cause interference during amplification).

In various embodiments of any of the aspects of the invention, the score (such as the undesirability score) are based at least in part on one or more parameters selected from the group consisting of heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon.

In various embodiments of any of the aspects of the invention, the score (such as the undesirability score) are based at least in part on one or more parameters selected from the group consisting of heterozygosity rate of the target locus, specificity of the candidate primer for the target locus; size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the test primers are used to simultaneously amplify e.g. at least 100 (e.g., at least 300 or 1,000) different target loci in a sample that includes maternal DNA from the pregnant mother of a fetus and fetal DNA to determine the presence or absence of a fetal chromosome abnormality. In various embodiments, the method includes ligating a universal primer binding site to the DNA molecules in the sample; amplifying the ligated DNA molecules using e.g. at least 100 (e.g., at least 300 or 1,000) specific primers and a universal primer to produce a first set of amplified products; and amplifying the first set of amplified products using e.g. at least 100 (e.g., at least 300 or 1,000) pairs of specific primers to produce a second set of amplified products. In various embodiments, at least 500; 750; 1,000; 2,000; 5,000; 7,500; 10,000; 15,000; 19,000; 20,000; 25,000; 27,000; 28,000; 30,000; 40,000; 50,000; 75,000; or 100,000 different primer pairs are used. In various embodiments, at least 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the score (such as the undesirability score) are based at least in part on one or more parameters selected from the group consisting of heterozygosity rate of the target locus, specificity of the candidate primer for the target locus; size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the test primers are used to simultaneously amplify e.g. at least 100 (e.g., at least 300 or 1,000) different target loci in sample includes DNA from an alleged father of a fetus and to simultaneously amplify the target loci in a sample that includes maternal DNA from the pregnant mother of a fetus and fetal DNA to establish whether the alleged father is the biological father of the fetus. In various embodiments, at least 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the score (such as the undesirability score) are based at least in part on one or more parameters selected from the group consisting of heterozygosity rate of the target locus, specificity of the candidate primer for the target locus; size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the test primers are used to simultaneously amplify e.g. at least 100 (e.g., at least 300 or 1,000) different target loci in one cell or multiple cells from an embryo to determine the presence or absence of a chromosome abnormality. In various embodiments, cells from a set of two or more embryos are analyzed, and one embryo is selected for in vitro fertilization. In various embodiments, at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the scores (such as the undesirability scores) are based at least in part on one or more parameters selected from the group consisting of heterozygosity rate of the target locus, specificity of the candidate primer for the target locus; size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the test primers are used to simultaneously amplify e.g. at least 100 (e.g., at least 300 or 1,000) different target loci in a forensic nucleic acid sample. In various embodiments, the length of the annealing step is greater than 3, 5, 8, 10, 15, 20, 30, 45, 60, 75, 90, 120, 150, or 180 minutes. In various embodiments, at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the scores (such as the undesirability scores) are based at least in part on one or more parameters selected from the group consisting of heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the method involves using the test primers to simultaneously amplify e.g. at least 100 (e.g., at least 300 or 1,000) different target loci in a control nucleic acid sample to produce a first set of target amplicons and to simultaneously amplify the target loci in a test nucleic acid sample to produce a second set of target amplicons; and comparing the first and second sets of target amplicons to determine whether a target locus is present in one sample but absent in the other, or whether a target locus is present at different levels in the control sample and the test sample. In various embodiments, the test sample is from an individual suspected of having a disease or phenotype of interest, or an increased risk for a disease or phenotype of interest; and wherein one or more of the target loci include a sequence (e.g., a polymorphism) at the target locus associated with an increased risk for the disease or phenotype of interest, or associated with the disease or phenotype of interest. In various embodiments, at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the scores (such as the undesirability scores) are based at least in part on one or more parameters selected from the group consisting of heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the method involves using the test primers to simultaneously amplify e.g. at least 100 (e.g., at least 300 or 1,000); different target loci in a control sample that includes RNA to produce a first set of target amplicons and to simultaneously amplify the target loci in a test sample that includes RNA to produce a second set of target amplicons; and comparing the first and second sets of target amplicons to determine the presence or absence of a difference in the RNA expression levels between the control sample and the test sample. In various embodiments, the RNA is mRNA. In various embodiments, the test sample is from an individual suspected of having a disease or phenotype of interest (such as cancer) or an increased risk for the disease or phenotype of interest (such as cancer); and wherein one or more of the target loci includes a sequence (e.g., a polymorphism or other mutation) associated with an increased risk for the disease or phenotype of interest or associated with the disease or phenotype of interest. In some embodiments, the test sample is from an individual diagnosed with a disease or phenotype of interest (such as cancer); and wherein a difference in the RNA expression level between the control sample and test sample indicates a target locus includes a sequence (e.g., a polymorphism or other mutation) associated with an increased or decreased risk for the disease or phenotype of interest. In various embodiments, at least 300; 500; 750; 1,000; 2000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In one aspect, the invention features libraries of primers (such as non-immobilized primers). In some embodiments, the primers are selected from a library of candidate primers using any of the methods of the invention. In some embodiments, the library includes primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In some embodiments, the library includes primers that simultaneously amplify at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In some embodiments, the library includes primers that simultaneously amplify at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci such that less than 60, 40, 30, 20, 10, 5, 4, 3, 2, 1, 0.5, 0.25, 0.1, or 0.05% of the amplified products are primer dimers. In some embodiments, the library includes primers that simultaneously amplify at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci such that at least 50, 60, 70, 80, 90, 95, 96, 97, 98, 99, or 99.5% of the amplified products are target amplicons. In some embodiments, the library includes primers that simultaneously amplify target loci such that at least 50, 60, 70, 80, 90, 95, 96, 97, 98, 99, or 99.5% of the target loci out of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 primer pairs, wherein each pair of primers includes a forward test primer and a reverse test primer where each pair of test primers hybridize to a target locus. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 individual primers that each hybridize to a different target locus, wherein the individual primers are not part of primer pairs. In some embodiments, the primers in the library are not immobilized (such as not immobilized to a solid support) or not part of a microarray. In some embodiments, the primers are dissolved in solution (such as dissolved in the liquid phase). In some embodiments, the library of primers consists essentially of, or consists of primers.

In some embodiments, $\Delta G$ values for each possible combination of two primers (each possible primer dimer) in a library are all equal to or greater than −20, −18, −16, −14, −12, −10, −9, −8, −7, −6, −5, −4, −3, −2, or −1 kcal/mol. In some embodiments, $\Delta G$ values for at least 80, 85, 90, 92, 94, 96, 98, 99, or 100% of the primers in the library for possible combinations of that primer with other primers in the library are all equal to or greater than −20, −18, −16, −14, −12, −10, −9, −8, −7, −6, −5, −4, −3, −2, or −1 kcal/mol.

In various embodiments of any of the aspects of the invention, the concentration of each primer is less than 100, 75, 50, 25, 10, 5, 2, 1, 0.5, 0.1, or 0.05 nM. In various embodiments, the GC content of the primers is between 30 to 80%, such as between 40 to 70%, 20 to 70%, or 50 to 60%, inclusive. In some embodiments, the range of GC content of the primers is less than 30, 20, 10, or 5%. In some embodiments, there are at least 2 (such as 3, 4, or 5) guanines or cytosines in the last 5 bases at the 3' end of the primers. In some embodiments, there are at least 1 (such as 2 or 3) guanines or cytosines in the last 3 bases at the 3' end of the primers. In some embodiments, a maximum of 2 (such as 2, 1, or 0) bases in the last 5 bases at the 3' end of the primers are guanines or cytosines. In some embodiments, the melting temperature of the primers is between 40 to 80° C., such as 50 to 70° C., 55 to 65° C., 54 to 60.5° C., or 57 to 60.5° C., inclusive. In some embodiments, the range of melting temperature of the primers is less than 15, 10, 5, 3, or 1° C. In some embodiments, the length of the primers is between 15 to 100 nucleotides, such as between 15 to 75 nucleotides, 15 to 40 nucleotides, 17 to 35 nucleotides, 18 to 30 nucleotides, or 20 to 65 nucleotides, inclusive. In some embodiments, the primers include a tag that is not target specific, such as a tag that forms an internal loop structure. In some embodiments, the tag is between two DNA binding regions. In various embodiments, the primers include a 5' region that is specific for a target locus, an internal region that is not specific for the target locus and forms a loop structure, and a 3' region that is specific for the target locus. In various embodiments, the length of the 3' region is at least 7 nucleotides. In some embodiments, the length of the 3' region is between 7 and 20 nucleotides, such as between 7 to 15 nucleotides, or 7 to 10 nucleotides, inclusive. In various embodiments, the primers include a 5' region that is not specific for a target locus (such as another tag or a universal primer binding site) followed by a region that is specific for a target locus, an internal region that is not specific for the target locus and forms a loop structure, and a 3' region that is specific for the target locus. In some embodiments, the range of the length of the primers is less than 50, 40, 30, 20, 10, or 5 nucleotides. In some embodiments, the length of the target amplicons is between 50 and 100 nucleotides, such as between 60 and 80 nucleotides, or 60 to 75 nucleotides, inclusive. In some embodiments, the range of the length of the target amplicons is less than 50, 25, 15, 10, or 5 nucleotides. In some embodiments, the target loci are on two or more different chromosomes, such as two or more of chromosomes 13, 18, 21, X and Y. In some embodiments, the target loci are target human loci. In some embodiments, the target loci includes a sequence (e.g., a polymorphism or other mutation) associated with an increased risk for the disease or phenotype of interest (such as cancer), or associated with the disease or phenotype of interest (such as cancer). In some embodiments, the polymorphism or mutation is a driver mutation that has a causative role in the disease or phenotype of interest (such as cancer). In some embodiments, the polymorphism or mutation is not a causative mutation. For example, in some cancers, multiple mutations accumulate but some of them are not causative mutations. Polymorphisms or mutations (such as those that are present at a higher frequency in subjects with a disease or phenotype of interest such as cancer than subjects without the disease or phenotype of interest such as cancer) that are not causative can still be useful for diagnosing the disease or phenotype. In some embodiments, the polymorphisms or mutation is present at a higher frequency in subjects with a disease or disorder (such as cancer) than subjects (such as healthy or normal subjects) without the disease or disorder (such as cancer). In some embodiments, the polymorphisms or mutation is indicative of cancer, such as a causative mutation. In some embodiments, the polymorphism(s) or mutation(s) are directly detected. In some embodiments, the polymorphism (s) or mutation(s) are indirectly detected by detection of one or more sequences (e.g., a polymorphic locus such as a SNP) that are linked to the polymorphism or mutation).

In one aspect, the invention provides a composition that includes any of the primer libraries of the invention (such as non-immobilized primers). In some embodiments, the composition includes one or more free nucleotides (such as deoxynucleotides, ATP, CTP, GTP, TTP, UTP, dATP, dCTP, dGTP, dTTP, dUTP an activated nucleotide or deoxynucleotide, or a non-naturally occurring nucleotide or deoxynucleotide). In some embodiments, the composition includes at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with a polynucleotide sequence of a human nucleic acid and at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with a polynucleotide sequence that is not found in a human (such as a universal primer, a primer that comprises a region or consists entirely of random nucleotides, or a primer with a region such as a tag or barcode of one or more nucleotides that are not found in a human or are not found in nature as part of the polynucleotide sequence of the primer). In some embodiments, the composition includes at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with the polynucleotide sequence of a human nucleic acid and one or more non-human or non-naturally occurring enzymes (e.g., ligase or polymerase from a species other than a human, such as a bacterial or non-naturally-occurring ligase or polymerase). In some embodiments, the composition includes at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with the polynucleotide sequence of a human nucleic acid and a buffer or additive that is non-naturally-occurring or is not found in a human. In some embodiments, the composition comprises, consists essentially of, or consists of one or more of the following: primer(s), amplicon(s) free nucleotide(s), non-human or non-naturally occurring enzyme(s), buffer(s), additive(s), or any combination thereof. In some embodiments, the composition comprises, consists essentially of, or consists of primers and one or more non-human or non-naturally occurring enzymes. Exemplary non-naturally occurring enzymes contain at least one sequence difference compared to naturally occurring (wild-type) enzymes.

In one aspect, the invention provides a composition comprising at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) in solution in one reaction volume. In some embodiments, the amplicons are produced from the simultaneous PCR amplification of at least 100 different target loci (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical target loci) using at least 100 different primers or primer pairs (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs) in one reaction volume. In some embodiments, (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments, the length of the target amplicons is between 50 and 100 nucleotides, such as between 60 and 80 nucleotides, or 60 and 75 nucleotides, inclusive. In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, the composition includes at least 1,000 different amplicons in solution in one reaction volume. In some embodiments, the amplicons are produced from the simultaneous PCR amplification of at least 1,000 different target human loci using at least 1,000 different primers in one reaction volume; wherein (i) less than 20% of the amplicons are primer dimers, and (ii) at least 80% of the amplicons comprise one of the target human loci and are between 50 and 100 nucleotides in length, inclusive. In some embodiments, the composition consists essentially of, or consists of one or more of the following: amplicons, primers (such as any of the primers disclosed herein), free nucleotide(s), non-human or non-naturally occurring enzyme(s), buffer(s), or any combination thereof. In some embodiments, at least one amplicon or primer has a non-human or non-naturally occurring sequence, nucleotide, or linkage between nucleotides.

In one aspect, the invention provides a composition comprising at least 100 different primers or primer pairs (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs) and at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) in solution in one reaction volume. In some embodiments, the amplicons are produced from the simultaneous PCR amplification of at least 100 different target loci (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical target loci) using the primers or primer pairs in one reaction volume. In some embodiments, (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments, the length of the target amplicons is between 50 and 100 nucleotides, such as between 60 and 80 nucleotides, or 60 and 75 nucleotides, inclusive. In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, the composition comprising at least 1,000 different primers and at least 1,000 different amplicons in solution in one reaction volume. In some embodiments, the amplicons are produced from the simultaneous PCR amplification of at least 1,000 different target human loci with the primers in one reaction volume; wherein (i) less than 20% of the amplicons are primer dimers, and (ii) at least 80% of the amplicons comprise one of the target loci and are between 50 and 100 nucleotides in length, inclusive. In some embodiments, the composition consists essentially of, or consists of one or more of the following: amplicons, primers (such as any of the primers disclosed herein), free nucleotide(s), non-human or non-naturally occurring enzyme(s), buffer(s), or any combination thereof. In some embodiments, at least one amplicon or primer has a non-human or non-naturally occurring sequence, nucleotide, or linkage between nucleotides.

In one aspect, the invention provides kits that include any of the primer libraries or compositions of the invention for amplifying target loci in a nucleic acid sample. In some embodiments, the kits consists essentially of, or consists of primers, primers and instructions for using the primers, a composition of the invention, or a composition of the invention and instructions for using the composition. In some embodiments, the kit includes instructions for using the library to amplify the target loci.

In one aspect, the invention provides an apparatus, device, or composition that includes any of the primer libraries or compositions of the invention. In some embodiments, the apparatus, device, or composition includes a physical structure (such as one or more reaction vessels, reaction chambers, or wells) that contains the primer library or composition of the invention (for example, the primers may be dissolved in a solution that is in the physical structure). In some embodiments, the physical structure is a non-naturally occurring physical structure or a physical structure that does not naturally contain a primer library or composition of the invention (such as a physical structure that is not found in nature with nucleic acids in it).

In one aspect, the invention features methods for determining a ploidy status of chromosome in a gestating fetus. In some embodiments, the method involves contacting a nucleic acid sample with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci to produce a reaction mixture; wherein the nucleic acid sample includes maternal DNA from the mother of the fetus and fetal DNA from the fetus. In some embodiments, the reaction mixture is subjected to primer extension reaction conditions to produce amplified products; the amplified products are measured with a high throughput sequencer to produce sequencing data; allele counts at the polymorphic loci are calculated on a computer based on the sequencing data; a plurality of ploidy hypotheses each pertaining to a different possible ploidy state of the chromosome are created on a computer; a joint distribution model for the expected allele counts at the polymorphic loci on the chromosome is built on a computer for each ploidy hypothesis; a relative probability of each of the ploidy hypotheses is determined on a computer using the joint distribution model and the allele counts; and the ploidy state of the fetus is called by selecting the ploidy state corresponding to the hypothesis with the greatest probability.

In one aspect, the invention features methods for determining a ploidy status of a chromosome in a gestating fetus. In an embodiment a method for determining a ploidy status of a chromosome in a gestating fetus includes obtaining a first sample of DNA that comprises maternal DNA from the mother of the fetus and fetal DNA from the fetus, preparing the first sample by isolating the DNA so as to obtain a prepared sample, measuring the DNA in the prepared sample at a plurality of polymorphic loci on the chromosome, calculating, on a computer, allele counts at the plurality of polymorphic loci from the DNA measurements made on the prepared sample, creating, on a computer, a plurality of ploidy hypotheses each pertaining to a different possible ploidy state of the chromosome, building, on a computer, a joint distribution model for the expected allele counts at the plurality of polymorphic loci on the chromosome for each ploidy hypothesis, determining, on a computer, a relative probability of each of the ploidy hypotheses using the joint distribution model and the allele counts measured on the prepared sample, and calling the ploidy state of the fetus by selecting the ploidy state corresponding to the hypothesis with the greatest probability.

In one aspect, the invention features methods of testing for an abnormal distribution of a chromosome in a sample that includes a mixture of maternal and fetal DNA. In some embodiments, the method involves (i) contacting the sample with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture; wherein the target loci are from a plurality of different chromosomes; and wherein the plurality of different chromosomes include at least one first chromosome suspected of having an abnormal distribution in the sample and at least one second chromosome presumed to be normally distributed in the sample; (ii) subjecting the reaction mixture to primer extension reaction conditions to produce amplified products; (iii) sequencing the amplified products to obtain a plurality of sequence tags aligning to the target loci; wherein the sequence tags are of sufficient length to be assigned to a specific target locus; (iv) assigning on a computer the plurality of sequence tags to their corresponding target loci; (v) determining on a computer a number of sequence tags aligning to the target loci of the first chromosome and a number of sequence tags aligning to the target loci of the second chromosome; and (vi) comparing on a computer the numbers from step (v) to determine the presence or absence of an abnormal distribution of the first chromosome.

In one aspect, the invention provides methods for detecting the presence or absence of a fetal aneuploidy. In some embodiments, the method involves (i) contacting a sample that includes a mixture of maternal and fetal DNA with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different non-polymorphic target loci to produce a reaction mixture; wherein the target loci are from a plurality of different chromosomes; (ii) subjecting the reaction mixture to primer extension reaction conditions to produce amplified products that includes target amplicons; (iii) quantifying on a computer a relative frequency of the target amplicons from the first and second chromosomes of interest; (iv) comparing on a computer the relative frequency of the target amplicons from the first and second chromosomes of interest; and (v) identifying the presence or absence of an aneuploidy based on the compared relative frequencies of the first and second chromosome of interest. In some embodiments, the first chromosome is a chromosome suspected of being euploid. In some embodiments, the second chromosome is a chromosome suspected of being aneuploidy.

In one aspect, a method is disclosed for determining presence or absence of fetal aneuploidy in a maternal tissue sample comprising fetal and maternal genomic DNA, the method including (a) obtaining a mixture of fetal and maternal genomic DNA from said maternal tissue sample, (b) conducting massively parallel DNA sequencing of DNA fragments randomly selected from the mixture of fetal and maternal genomic DNA of step (a) to determine the sequence of said DNA fragments, (c) identifying chromosomes to which the sequences obtained in step (b) belong, (d) using the data of step (c) to determine an amount of at least one first chromosome in said mixture of maternal and fetal genomic DNA, wherein said at least one first chromosome is presumed to be euploid in the fetus, (e) using the data of step (c) to determine an amount of a second chromosome in said mixture of maternal and fetal genomic DNA, wherein said second chromosome is suspected to be aneuploid in the fetus, (f) calculating the fraction of fetal DNA in the mixture of fetal and maternal DNA, (g) calculating an expected distribution of the amount of the second target chromosome if the second target chromosome is euploid, using the number in step (d), (h) calculating an expected distribution of the amount of the second target chromosome if the second target chromosome is aneuploid, using the first number is step (d) and the calculated fraction of fetal DNA in the mixture of fetal and maternal DNA in step (f), and (i) using a maximum likelihood or maximum a posteriori approach to determine whether the amount of the second chromosome as determined in step (e) is more likely to be part of the distribution calculated in step (g) or the distribution calculated in step (h); thereby indicating the presence or absence of a fetal aneuploidy.

In various embodiments of any of the aspects of the invention, the target loci include one or more SNPs in the homologous non-recombining region of chromosome X and/or chromosome Y. In some embodiments, the method includes determining the relative amount of chromosome X and chromosome Y. In some embodiments, the method includes determining the number of copies of chromosome X and/or chromosome Y.

In some embodiments, the method also includes obtaining genotypic data from one or both parents of the fetus. In some embodiments, obtaining genotypic data from one or both parents of the fetus includes preparing the DNA from the parents where the preparing comprises preferentially enriching the DNA at the plurality of polymorphic loci to give prepared parental DNA, optionally amplifying the prepared parental DNA, and measuring the parental DNA in the prepared sample at the plurality of polymorphic loci.

In various embodiments of any of the aspects of the invention, building a joint distribution model for the expected allele count probabilities of the plurality of polymorphic loci on the chromosome is done using the obtained genetic data from the one or both parents. In some embodiments, the sample (e.g., the first sample) has been isolated from maternal plasma and where the obtaining genotypic data from the mother is done by estimating the maternal genotypic data from the DNA measurements made on the prepared sample.

In one aspect, a diagnostic box is disclosed for helping to determine a ploidy status of a chromosome in a gestating fetus where the diagnostic box is capable of executing the preparing and measuring steps of any of the methods of the invention.

In various embodiments of any of the aspects of the invention, the allele counts are probabilistic rather than binary. In some embodiments, measurements of the DNA in the prepared sample at the plurality of polymorphic loci are also used to determine whether or not the fetus has inherited one or a plurality of disease linked haplotypes.

In various embodiments of any of the aspects of the invention, building a joint distribution model for allele count probabilities is done by using data about the probability of chromosomes crossing over at different locations in a chromosome to model dependence between polymorphic alleles on the chromosome. In some embodiments, building a joint distribution model for allele counts and the step of determining the relative probability of each hypothesis are done using a method that does not require the use of a reference chromosome.

In various embodiments of any of the aspects of the invention, determining the relative probability of each hypothesis makes use of an estimated fraction of fetal DNA in the prepared sample. In some embodiments, the DNA measurements from the prepared sample used in calculating allele count probabilities and determining the relative probability of each hypothesis comprise primary genetic data. In some embodiments, selecting the ploidy state corresponding to the hypothesis with the greatest probability is carried out using maximum likelihood estimates or maximum a posteriori estimates.

In various embodiments of any of the aspects of the invention, calling the ploidy state of the fetus also includes combining the relative probabilities of each of the ploidy hypotheses determined using the joint distribution model and the allele count probabilities with relative probabilities of each of the ploidy hypotheses that are calculated using statistical techniques taken from a group consisting of a read count analysis, comparing heterozygosity rates, a statistic that is only available when parental genetic information is used, the probability of normalized genotype signals for certain parent contexts, a statistic that is calculated using an estimated fetal fraction of the sample (e.g., the first sample) or the prepared sample, and combinations thereof.

In various embodiments of any of the aspects of the invention, a confidence estimate is calculated for the called ploidy state. In some embodiments, the method also includes taking a clinical action based on the called ploidy state of the fetus, wherein the clinical action is selected from one of terminating the pregnancy or maintaining the pregnancy.

In various embodiments of any of the aspects of the invention, the method may be performed for fetuses at between 4 and 5 weeks gestation; between 5 and 6 weeks gestation; between 6 and 7 weeks gestation; between 7 and 8 weeks gestation; between 8 and 9 weeks gestation; between 9 and 10 weeks gestation; between 10 and 12 weeks gestation; between 12 and 14 weeks gestation; between 14 and 20 weeks gestation; between 20 and 40 weeks gestation; in the first trimester; in the second trimester; in the third trimester; or combinations thereof.

In various embodiments of any of the aspects of the invention, a report displaying a determined ploidy status of a chromosome in a gestating fetus generated using the method. In some embodiments, a kit is disclosed for determining a ploidy status of a target chromosome in a gestating fetus designed to be used with any of the methods of the invention, the kit including a plurality of inner forward primers and optionally the plurality of inner reverse primers, where each of the primers is designed to hybridize to the region of DNA immediately upstream and/or downstream from one of the polymorphic sites on the target chromosome, and optionally additional chromosomes, where the region of hybridization is separated from the polymorphic site by a small number of bases, where the small number is selected from the group consisting of 1, 2, 3, 4, 5, 6 to 10, 11 to 15, 16 to 20, 21 to 25, 26 to 30, 31 to 60, and combinations thereof.

In one aspect, the invention features methods for establishing whether an alleged father is the biological father of a fetus that is gestating in a pregnant mother. In some embodiments the method involves, (i) simultaneously amplifying a plurality of polymorphic loci that includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci on genetic material from the alleged father to produce a first set of amplified products; (ii) simultaneously amplifying the corresponding plurality of polymorphic loci on a mixed sample of DNA originating from a blood sample from the pregnant mother to produce a second set of amplified products; wherein the mixed sample of DNA includes fetal DNA and maternal DNA; (iii) determining on a computer the probability that the alleged father is the biological father of the fetus using genotypic measurements based on the first and second sets of amplified products; and (iv) establishing whether the alleged father is the biological father of the fetus using the determined probability that the alleged father is the biological father of the fetus. In various embodiments, the method further includes simultaneously amplifying the corresponding plurality of polymorphic loci on genetic material from the mother to produce a third set of amplified products; wherein the probability that the alleged father is the biological father of the fetus is determined using genotypic measurements based on the first, second, and third sets of amplified products.

In one aspect, the invention provides methods of estimating relative likelihoods that each embryo from a set of embryos will develop as desired. In some embodiments, the method involves contacting a sample from each embryo with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture for each embryo, wherein the samples are each derived from one or more cells from an embryo. In some embodiments, each reaction mixture is subjected to primer extension reaction conditions to produce amplified products. In some embodiments, the method includes determining on a computer one or more characteristics of at least one cell from each embryo based on the amplified products; and estimating on a computer the relative likelihoods that each embryo will develop as desired, based on the one or more characteristics of the at least one cell for each embryo.

In one aspect, the invention features methods of measuring the amount of two or more target loci in a nucleic acid sample. In some embodiments, the method involves (i) using PCR to amplify a nucleic acid sample that includes a first standard locus, a second standard locus, a first target locus, and a second target locus to form amplified products; wherein the first standard locus and the first target locus have the same number of nucleotides but have a sequence that differs at one or more nucleotides; and wherein the second standard locus and the second target locus have the same number of nucleotides but have a sequence that differs at one or more nucleotides; (ii) sequencing the amplified products to determine a standard ratio that compares the relative amount of the amplified first standard locus compared to the amplified second standard locus; wherein the standard ratio indicates the difference in PCR efficiency for the amplification of the first standard locus and the second standard locus; (iii) determining a target ratio that compares the relative amount of the amplified first target locus compared to the amplified second target locus; and (iv) adjusting the target ratio from step (iii) based on the standard ratio from step (ii) to determine the relative amount of the first target locus and the second target locus in the sample. In various embodiments, the method involves determining the absolute amount of the first target locus and the second target locus in the sample. In various embodiments, the method further includes determining the presence or absence of a target locus (e.g, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci) in the sample. In various embodiments, the method involves using any of the primer libraries of the invention. In various embodiments, the method involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci.

In one aspect, the invention features methods of quantitatively measuring a plurality of genetic targets in a sample for analysis. In some embodiments, the method includes (i) mixing genetic material derived from the sample for analysis with a plurality of target specific amplification reagents, and a plurality of standard sequences corresponding to the target specific amplification reagent targets; (ii) amplifying target regions of the genetic material and the standard sequences to produce target amplicons and standard sequence amplicons; and (iii) measuring the quantity of target amplicons and standard sequence amplicons produced. In some embodiments, the genetic material is present in a genetic library. In some embodiments, the genetic targets are polymorphic loci (such as SNPs). In some embodiments, the measuring of quantity is achieved by counting sequences. In some embodiments, the method further includes determining the estimated copy number of at least one chromosome in a sample from which the genetic library was derived, wherein the determination involves comparing the number of sequence reads of a target amplicon with the number of sequence reads of a standard amplicon. In some embodiments, the standard sequences and the genetic library include universal priming sites cable of being primed by the same primer. In some embodiments, the mixing step includes at least 10; 100, 500; 1,000; 2,000; 5,000; 7,500; 10,000; 15,000; 19,000; 20,000; 25,000; 27,000; 28,000; 30,000; 40,000; 50,000; 75,000; or 100,000 different target specific amplification reagents and at least 10; 100, 500; 1,000; 2,000; 5,000; 7,500; 10,000; 15,000; 19,000; 20,000; 25,000; 27,000; 28,000; 30,000; 40,000; 50,000; 75,000; or 100,000 standard sequences. In various embodiments, the method involves using any of the primer libraries of the invention. In various embodiments, the method involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target regions. In some embodiments, the relative amounts of each of the standard sequences are known. In some embodiments, the relative amounts of each of the sequences is has been calibrated with respect to a reference genome. In some embodiments, the sample for analysis includes a mixture of fetal and maternal genomes. In some embodiments, the sample for analysis is derived from the blood of a pregnant woman or derived from blood plasma. In some embodiments, the reference genome has at least one aneuploidy, such as an aneuploidy at chromosome 13, 18, 21, X, or Y. In some embodiments, the reference genome is diploid.

In one aspect, the invention features a mixture that includes a plurality of genetic standard sequences, wherein the relative amount of each genetic standard sequence in the mixture has been determined by calibration to a reference genome. In various embodiments, the mixture includes at least 10; 100, 500; 1,000; 2,000; 5,000; 7,500; 10,000; 15,000; 19,000; 20,000; 25,000; 27,000; 28,000; 30,000; 40,000; 50,000; 75,000; or 100,000 genetic standard sequences. In various embodiments, the genetic standard sequences include a first universal priming site, a second universal priming site, a first target specific priming site, a second target specific priming site, and a marker sequence located between the first and second target specific priming sites, wherein the first target specific site and the second target specific priming site are located between the first and second universal priming sites. In various embodiments, the calibration involves using any of the primer libraries of the invention. In various embodiments, the calibration involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target regions. In some embodiments, the reference genome has at least one aneuploidy, such as an aneuploidy at chromosome 13, 18, 21, X, or Y. In some embodiments, the reference genome is diploid.

In one aspect, the invention features methods of producing a set of calibrated genetic standard sequences. In some embodiments, the method includes (i) forming an amplification reaction mixture that includes a genetic library prepared from a reference genome, a plurality of target-specific amplification primer reagent sets, and a plurality of genetic standard sequences corresponding to the target specific amplification reagent sets, (ii) amplifying the genetic library and the genetic standard sequences to produce amplicons from the target sequences and amplicons from the genetic standard sequences, (iii) measuring the quantity of the amplicons from the target sequences and amplicons from the genetic standard sequences, and (iv) determining the relative amount of each of genetic standard sequences with respect to each other, whereby the plurality of genetic standard sequences is calibrated. In various embodiments, at least 10; 100, 500; 1,000; 2,000; 5,000; 7,500; 10,000; 15,000; 19,000; 20,000; 25,000; 27,000; 28,000; 30,000; 40,000; 50,000; 75,000; or 100,000 genetic standard sequences are used. In various embodiments, the method involves using any of the primer libraries of the invention. In various embodiments, the method involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different sequences. In some embodiments, the reference genome has at least one aneuploidy, such as an aneuploidy at chromosome 13, 18, 21, X, or Y. In some embodiments, the reference genome is diploid.

In one aspect, the invention provides a set of genetic standard sequences that have been calibrated according to any of the methods of the invention. In one aspect, the invention provides a set of genetic standard sequences that may be calibrated either before, during or after the method is performed.

In one aspect, the invention features methods of measuring the number of copies of a gene of interest having at least one allele that has a deletion. In some embodiments, the method includes (i) mixing genetic material derived from a sample for analysis with an amplification reagent specific for the gene of interest and not capable of significantly amplifying the deletion comprising allele of the gene of interest, a standard sequence corresponding to gene of interest, an amplification reagent specific for a reference sequence, and a standard sequence corresponding to the reference sequence; (ii) amplifying the gene sequence of interest, the standard sequence corresponding to the gene of interest, the reference sequence, and the standard sequence corresponding to the reference sequence to produce gene of interest amplicons, reference sequence amplicons, and standard sequence amplicons; and (iii) measuring the quantity of target amplicons and standard sequence amplicons produced. In some embodiments, the measuring of quantity is achieved by counting sequence reads. In some embodiments, the method further includes determining the estimated copy number of at least one chromosome in the sample from which the genetic library was derived, wherein the determination involves comparing the number of sequences of target amplicons with the number of sequences of a standard amplicons. In some embodiments, the standard sequences and the genetic library include universal priming sites capable of being primed by the same primer. In some embodiments, the relative amounts of each of the sequences have been calibrated with respect to reference genome. In various embodiments, at least 10; 100, 500; 1,000; 2,000; 5,000; 7,500; 10,000; 15,000; 19,000; 20,000; 25,000; 27,000; 28,000; 30,000; 40,000; 50,000; 75,000; or 100,000 genetic standard sequences are used. In various embodiments, the method involves using any of the primer libraries of the invention. In various embodiments, the method involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target regions. In some embodiments, the reference genome is diploid. In some embodiments, the sample for analysis is derived from blood.

In some embodiments of any of the aspects of the invention, preferentially enriching the DNA in the sample (e.g., the first sample) at the target loci (e.g., the plurality of polymorphic loci) includes obtaining a plurality of pre-circularized probes where each probe targets one of the loci (e.g., polymorphic loci), where the 3' and 5' end of the probes are preferably designed to hybridize to a region of DNA that is separated from the polymorphic site of the locus by a small number of bases, where the small number is 1, 2, 3, 4, 5, 6, 7, 8, 9, 10, 11, 12, 13, 14, 15, 16, 17, 18, 19, 20, 21 to 25, 26 to 30, 31 to 60, or a combination thereof, hybridizing the pre-circularized probes to DNA from the sample (e.g., the first sample), filling the gap between the hybridized probe ends using DNA polymerase, circularizing the pre-circularized probe, and amplifying the circularized probe.

In some embodiments of any of the aspects of the invention, the preferentially enriching the DNA at the target loci (e.g., the plurality of polymorphic loci) includes obtaining a plurality of ligation-mediated PCR probes where each PCR probe targets one of the target loci (e.g., the polymorphic loci), and where the upstream and downstream PCR probes are designed to hybridize to a region of DNA on one strand of DNA that is preferably separated from the polymorphic site of the locus by a small number of bases, where the small number is 1, 2, 3, 4, 5, 6, 7, 8, 9, 10, 11, 12, 13, 14, 15, 16, 17, 18, 19, 20, 21 to 25, 26 to 30, 31 to 60, or a combination thereof, hybridizing the ligation-mediated PCR probes to the DNA from the sample (e.g., the first sample), filling the gap between the ligation-mediated PCR probe ends using DNA polymerase, ligating the ligation-mediated PCR probes, and amplifying the ligated ligation-mediated PCR probes.

In some embodiments of various aspects of the invention, preferentially enriching the DNA at the target loci (e.g., plurality of polymorphic loci) includes obtaining a plurality of hybrid capture probes that target the loci (e.g., the polymorphic loci), hybridizing the hybrid capture probes to the DNA in the sample (e.g., the first sample) and physically removing some or all of the unhybridized DNA from the sample (e.g., the first sample) of DNA.

In some embodiments of any of the aspects of the invention, the hybrid capture probes are designed to hybridize to a region that is flanking but not overlapping the polymorphic site. In some embodiments, the hybrid capture probes are designed to hybridize to a region that is flanking but not overlapping the polymorphic site, and where the length of the flanking capture probe may be selected from the group consisting of less than about 120 bases, less than about 110 bases, less than about 100 bases, less than about 90 bases, less than about 80 bases, less than about 70 bases, less than about 60 bases, less than about 50 bases, less than about 40 bases, less than about 30 bases, and less than about 25 bases. In some embodiments, the hybrid capture probes are designed to hybridize to a region that overlaps the polymorphic site, and where the plurality of hybrid capture probes comprise at least two hybrid capture probes for each polymorphic loci, and where each hybrid capture probe is designed to be complementary to a different allele at that polymorphic locus.

In some embodiments of any of the aspects of the invention, preferentially enriching the DNA a plurality of polymorphic loci includes obtaining a plurality of inner forward primers where each primer targets one of the polymorphic loci, and where the 3' end of the inner forward primers are designed to hybridize to a region of DNA upstream from the polymorphic site, and separated from the polymorphic site by a small number of bases, where the small number is selected from the group consisting of 1, 2, 3, 4, 5, 6 to 10, 11 to 15, 16 to 20, 21 to 25, 26 to 30, or 31 to 60 base pairs, optionally obtaining a plurality of inner reverse primers where each primer targets one of the polymorphic loci, and where the 3' end of the inner reverse primers are designed to hybridize to a region of DNA upstream from the polymorphic site, and separated from the polymorphic site by a small number of bases, where the small number is selected from the group consisting of 1, 2, 3, 4, 5, 6 to 10, 11 to 15, 16 to 20, 21 to 25, 26 to 30, or 31 to 60 base pairs, hybridizing the inner primers to the DNA, and amplifying the DNA using the polymerase chain reaction to form amplicons.

In some embodiments of any of the aspects of the invention, the method also includes obtaining a plurality of outer forward primers where each primer targets one of the target (e.g., polymorphic loci), and where the outer forward primers are designed to hybridize to the region of DNA upstream from the inner forward primer, optionally obtaining a plurality of outer reverse primers where each primer targets one of the target loci (e.g., polymorphic loci), and where the outer reverse primers are designed to hybridize to the region of DNA immediately downstream from the inner reverse primer, hybridizing the first primers to the DNA, and amplifying the DNA using the polymerase chain reaction.

In some embodiments of any of the aspects of the invention, the method also includes obtaining a plurality of outer reverse primers where each primer targets one of the polymorphic loci, and where the outer reverse primers are designed to hybridize to the region of DNA immediately downstream from the inner reverse primer, optionally obtaining a plurality of outer forward primers where each primer targets one of the target loci (e.g., the polymorphic loci), and where the outer forward primers are designed to hybridize to the region of DNA upstream from the inner forward primer, hybridizing the first primers to the DNA, and amplifying the DNA using the polymerase chain reaction.

In some embodiments of any of the aspects of the invention, preparing the sample (e.g., the first sample) further includes appending universal adapters to the DNA in the sample (e.g., the first sample) and amplifying the DNA in the sample (e.g., the first sample) using the polymerase chain reaction. In some embodiments, at least a fraction of the amplicons that are amplified are less than 100 bp, less than 90 bp, less than 80 bp, less than 70 bp, less than 65 bp, less than 60 bp, less than 55 bp, less than 50 bp, or less than 45 bp, and where the fraction is 10%, 20%, 30%, 40%, 50%, 60%, 70%, 80%, 90%, or 99%.

In some embodiments of any of the aspects of the invention, amplifying the DNA is done in one or a plurality of individual reaction volumes, and where each individual reaction volume contains more than 100 different forward and reverse primer pairs, more than 200 different forward and reverse primer pairs, more than 500 different forward and reverse primer pairs, more than 1,000 different forward and reverse primer pairs, more than 2,000 different forward and reverse primer pairs, more than 5,000 different forward and reverse primer pairs, more than 10,000 different forward and reverse primer pairs, more than 20,000 different forward and reverse primer pairs, more than 50,000 different forward and reverse primer pairs, or more than 100,000 different forward and reverse primer pairs. In various embodiments of any of the aspects of the invention, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primer pairs are used.

In some embodiments of any of the aspects of the invention, preparing the sample (e.g., the first sample) further comprises dividing the sample (e.g., the first sample) into a plurality of portions, and where the DNA in each portion is preferentially enriched at a subset of the target loci (e.g., plurality of polymorphic loci). In some embodiments, the inner primers are selected by identifying primer pairs likely to form undesired primer duplexes and removing from the plurality of primers at least one of the pair of primers identified as being likely to form undesired primer duplexes. In some embodiments, the inner primers contain a region that is designed to hybridize either upstream or downstream of the targeted locus (e.g., the polymorphic locus), and optionally contain a universal priming sequence designed to allow PCR amplification. In some embodiments, at least some of the primers additionally contain a random region that differs for each individual primer molecule. In some embodiments, at least some of the primers additionally contain a molecular barcode.

In some embodiments of any of the aspects of the invention, preferential enrichment results in average degree of allelic bias between the prepared sample and the sample (e.g., the first sample) of a factor selected from the group consisting of no more than a factor of 2, no more than a factor of 1.5, no more than a factor of 1.2, no more than a factor of 1.1, no more than a factor of 1.05, no more than a factor of 1.02, no more than a factor of 1.01, no more than a factor of 1.005, no more than a factor of 1.002, no more than a factor of 1.001 and no more than a factor of 1.0001. In some embodiments, the plurality of polymorphic loci are SNPs. In some embodiments, measuring the DNA in the prepared sample is done by sequencing.

In some embodiments, the nucleic acids in the sample are non-specifically amplified prior to amplification of the target loci (such as specific amplification of the target loci with a primer library of the invention). In some embodiments, the non-specific amplification includes whole genome application (WGA), such as ligation-mediated PCR (LM-PCR), degenerate oligonucleotide primer PCR (DOP-PCR), or multiple displacement amplification (MDA). In some embodiments, the non-specific amplification includes universal PCR, such as adaptor-mediated universal PCR.

In some embodiments of any of the aspects of the invention, the target loci are present on the same nucleic acid of interest (e.g, the same chromosome or the same region of a chromosome). In some embodiments, at least some of the target loci are present on different nucleic acids of interest (e.g, different chromosomes). In some embodiments, the nucleic acid sample includes fragmented or digested nucleic acids. In some embodiments, the nucleic acid sample includes DNA, such as genomic DNA, cDNA, cell-free DNA (cfDNA), cell-free mitochondrial DNA (cf mDNA), cell-free DNA that originated from nuclear DNA (cf nDNA), cellular DNA, or mitochondrial DNA. In some embodiments, nucleic acid sample includes RNA, such as cfRNA, cellular RNA, cytoplasmic RNA, coding cytoplasmic RNA, non-coding cytoplasmic RNA, mRNA, miRNA, mitochondrial RNA, rRNA, or tRNA. In some embodiments, the nucleic acid sample includes DNA from a single cell, 2 cells, 3 cells, 4 cells, 5 cells, 6 cells, 7 cells, 8 cells, 9 cell, 10 cells, or more than 10 cells. In some embodiments, the nucleic acid sample is a blood or plasma sample that is substantially free of cells. In some embodiments, the nucleic acid sample includes or is derived from blood, plasma, saliva, semen, sperm, cell culture supernatant, mucus secretion, dental plaque, gastrointestinal tract tissue, stool, urine, hair, bone, body fluids, tears, tissue, skin, fingernails, blastomeres, embryos, amniotic fluid, chorionic villus samples, bile, lymph, cervical mucus, or a forensic sample. In some embodiments, the target loci are segments of human nucleic acids. In some embodiments, the target loci are segments of human nucleic acids found in the human genome. In some embodiments, the target loci comprise or consist of single nucleotide polymorphisms (SNPs). In some embodiments, the primers are DNA molecules.

In some embodiments of any of the aspects of the invention, the DNA in the sample (e.g., the first sample) originates from maternal plasma. In some embodiments, preparing the sample (e.g., the first sample) further comprises amplifying the DNA. In some embodiments, preparing the sample (e.g., the first sample) further comprises preferentially enriching the DNA in the sample (e.g., the first sample) at the target loci (e.g., a plurality of polymorphic loci).

In various embodiments, the primer extension reaction or the polymerase chain reaction includes the addition of one or more nucleotides by a polymerase. In some embodiments, greater than or equal to 5, 10, 20, 30, 40, 50, or 60 cycles of PCR are performed. In some embodiments, the amplification of loci is performed using a polymerase (e.g., a DNA polymerase, RNA polymerase, or reverse transcriptase) with low 5'→ 3' exonuclease and/or low strand displacement activity. In some embodiments, a DNA polymerase is used produce DNA amplicons using DNA as a template. In some embodiments, a RNA polymerase is used produce RNA amplicons using DNA as a template. In some embodiments, a reverse transcriptase is used produce cDNA amplicons using RNA as a template.

In various embodiments, the primer extension reaction or the polymerase chain reaction does not include ligation-mediated PCR. In various embodiments, the primer extension reaction or the polymerase chain reaction does not include the joining of two primers by a ligase. In various embodiments, the primers do not include Linked Inverted Probes (LIPs), which can also be called pre-circularized probes, pre-circularizing probes, circularizing probes, Padlock Probes, or Molecular Inversion Probes (MIPs). In some embodiments, the primers are not loopable primers. In some embodiments, the primers do not form a loop structure, for example, the primers do not comprise a 3' target specific portion, a stem (comprising a first loop forming region and a second loop forming region), and a loop portion. In various embodiments, the primer library, composition, kit, or method does not include an array (such as a microarray) or do no use an array (such as a microarray). In some embodiments, multiplex PCR and/or sequencing is performed without use of an array (such as a microarray). In some embodiments, the primer library, composition, kit, or method comprises a microarray. In some embodiments, the primers or the target loci do not comprise an STR allele (for example, the target loci may be non-polymorphic loci or the loci may comprise a polymorphism other than an STR allele). In some embodiments, some or all of the target loci comprise an STR allele.

It is understood that all of the aspects and embodiments of the invention described herein include "comprising," "consisting," and "consisting essentially of" aspects and embodiments. It is understood that aspects and embodiments of the invention described herein include combinations of any two or more of the aspects or embodiments of the invention.

Definitions

Single Nucleotide Polymorphism (SNP) refers to a single nucleotide that may differ between the genomes of two members of the same species. The usage of the term should not imply any limit on the frequency with which each variant occurs.

Sequence refers to a DNA sequence or a genetic sequence. It may refer to the primary, physical structure of the DNA molecule or strand in an individual. It may refer to the sequence of nucleotides found in that DNA molecule, or the complementary strand to the DNA molecule. It may refer to the information contained in the DNA molecule as its representation in silico.

Locus refers to a particular region of interest on the DNA (or corresponding RNA) of an individual, which may refer to a SNP, the site of a possible insertion or deletion, or the site of some other relevant genetic variation. Disease-linked SNPs may also refer to disease-linked loci.

Polymorphic Allele, also "Polymorphic Locus," refers to an allele or locus where the genotype varies between individuals within a given species. Some examples of polymorphic alleles include single nucleotide polymorphisms, short tandem repeats, deletions, duplications, and inversions.

Polymorphic Site refers to the specific nucleotides found in a polymorphic region that vary between individuals.

Allele refers to the alternative form or version of a gene that occupies a particular locus. Genetic Data also "Genotypic Data" refers to the data describing aspects of the genome of one or more individuals. It may refer to one or a set of loci, partial or entire sequences, partial or entire chromosomes, or the entire genome. It may refer to the identity of one or a plurality of nucleotides; it may refer to a set of sequential nucleotides, or nucleotides from different locations in the genome, or a combination thereof. Genotypic data is typically in silico, however, it is also possible to consider physical nucleotides in a sequence as chemically encoded genetic data. Genotypic Data may be said to be "on," "of," "at," "from" or "on" the individual(s). Genotypic Data may refer to output measurements from a genotyping platform where those measurements are made on genetic material.

Genetic Material also "Genetic Sample" refers to physical matter, such as tissue or blood, from one or more individuals comprising DNA or RNA Noisy Genetic Data refers to genetic data with any of the following: allele dropouts, uncertain base pair measurements, incorrect base pair measurements, missing base pair measurements, uncertain measurements of insertions or deletions, uncertain measurements of chromosome segment copy numbers, spurious signals, missing measurements, other errors, or combinations thereof.

Confidence refers to the statistical likelihood that the called SNP, allele, set of alleles, ploidy call, or determined number of chromosome segment copies correctly represents the real genetic state of the individual.

Ploidy Calling, also "Chromosome Copy Number Calling," or "Copy Number Calling" (CNC), may refer to the act of determining the quantity and/or chromosomal identity of one or more chromosomes present in a cell.

Aneuploidy refers to the state where the wrong number of chromosomes (e.g., the wrong number of full chromosomes or the wrong number of chromosome segments, such as the presence of deletions or duplications of a chromosome segment) is present in a cell. In the case of a somatic human cell it may refer to the case where a cell does not contain 22 pairs of autosomal chromosomes and one pair of sex chromosomes. In the case of a human gamete, it may refer to the case where a cell does not contain one of each of the 23 chromosomes. In the case of a single chromosome type, it may refer to the case where more or less than two homologous but non-identical chromosome copies are present, or where there are two chromosome copies present that originate from the same parent. In some embodiments, the deletion of a chromosome segment is a microdeletion.

Ploidy State refers to the quantity and/or chromosomal identity of one or more chromosomes types in a cell.

Chromosome may refer to a single chromosome copy, meaning a single molecule of DNA of which there are 46 in a normal somatic cell; an example is 'the maternally derived chromosome 18'. Chromosome may also refer to a chromosome type, of which there are 23 in a normal human somatic cell; an example is 'chromosome 18'.

Chromosomal Identity may refer to the referent chromosome number, i.e. the chromosome type. Normal humans have 22 types of numbered autosomal chromosome types, and two types of sex chromosomes. It may also refer to the parental origin of the chromosome. It may also refer to a specific chromosome inherited from the parent. It may also refer to other identifying features of a chromosome.

The State of the Genetic Material or simply "Genetic State" may refer to the identity of a set of SNPs on the DNA, to the phased haplotypes of the genetic material, and to the sequence of the DNA, including insertions, deletions, repeats and mutations. It may also refer to the ploidy state of one or more chromosomes, chromosomal segments, or set of chromosomal segments.

Allelic Data refers to a set of genotypic data concerning a set of one or more alleles. It may refer to the phased, haplotypic data. It may refer to SNP identities, and it may refer to the sequence data of the DNA, including insertions, deletions, repeats and mutations. It may include the parental origin of each allele.

Allelic State refers to the actual state of the genes in a set of one or more alleles. It may refer to the actual state of the genes described by the allelic data.

Allelic Ratio or allele ratio, refers to the ratio between the amount of each allele at a locus that is present in a sample or in an individual. When the sample was measured by sequencing, the allelic ratio may refer to the ratio of sequence reads that map to each allele at the locus. When the sample was measured by an intensity based measurement method, the allele ratio may refer to the ratio of the amounts of each allele present at that locus as estimated by the measurement method.

Allele Count refers to the number of sequences that map to a particular locus, and if that locus is polymorphic, it refers to the number of sequences that map to each of the alleles. If each allele is counted in a binary fashion, then the allele count will be whole number. If the alleles are counted probabilistically, then the allele count can be a fractional number.

Allele Count Probability refers to the number of sequences that are likely to map to a particular locus or a set of alleles at a polymorphic locus, combined with the probability of the mapping. Note that allele counts are equivalent to allele count probabilities where the probability of the mapping for each counted sequence is binary (zero or one). In some embodiments, the allele count probabilities may be binary. In some embodiments, the allele count probabilities may be set to be equal to the DNA measurements.

Allelic Distribution, or 'allele count distribution' refers to the relative amount of each allele that is present for each locus in a set of loci. An allelic distribution can refer to an individual, to a sample, or to a set of measurements made on a sample. In the context of sequencing, the allelic distribution refers to the number or probable number of reads that map to a particular allele for each allele in a set of polymorphic loci. The allele measurements may be treated probabilistically, that is, the likelihood that a given allele is present for a give sequence read is a fraction between 0 and 1, or they may be treated in a binary fashion, that is, any given read is considered to be exactly zero or one copies of a particular allele.

Allelic Distribution Pattern refers to a set of different allele distributions for different parental contexts. Certain allelic distribution patterns may be indicative of certain ploidy states.

Allelic Bias refers to the degree to which the measured ratio of alleles at a heterozygous locus is different to the ratio that was present in the original sample, such as a sample of DNA. The degree of allelic bias at a particular locus is equal to the observed allelic ratio at that locus, as measured, divided by the ratio of alleles in the original DNA or RNA sample at that locus. Allelic bias may be defined to be greater than one, such that if the calculation of the degree of allelic bias returns a value, x, that is less than 1, then the degree of allelic bias may be restated as 1/x. Allelic bias maybe due to amplification bias, purification bias, or some other phenomenon that affects different alleles differently.

Allelic imbalance for aneuploidy determinations, such as CNV determinations, refers to the difference between the frequencies of the alleles for a locus. It is an estimate of the difference in the copy numbers of the homologs. Allelic imbalance can arise from the complete loss of an allele or from an increase in copy number of one allele relative to the other. Allelic imbalances can be detected by measuring the proportion of one allele relative to the other in fluids or cells from individuals that are constitutionally heterozygous at a given locus. (Mei et al, Genome Res, 10:1126-37 (2000)). For dimorphic SNPs that have alleles arbitrarily designated 'A' and 'B', the allele ratio of the A allele is $n_A/(n_A+n_B)$, where $n_A$ and $n_B$ are the number of sequencing reads for alleles A and B, respectively. Allelic imbalance is the difference between the allele ratios of A and B for loci that are heterozygous in the germline. This definition is analogous to that for SNVs, where the proportion of abnormal DNA is typically measured using mutant allele frequency, or $n_m/(n_m+n_r)$, where $n_m$ and $n_r$ are the number of sequencing reads for the mutant allele and the reference allele, respectively. Accordingly, the proportion of abnormal DNA for a CNV can be measured by the average allelic imbalance (AAI), defined as $|(H1-H2)|/(H1+H2)$, where Hi is the average number of copies of homolog i in the sample and $Hi/(H1+H2)$ is the fractional abundance, or homolog ratio, of homolog i. The maximum homolog ratio is the homolog ratio of the more abundant homolog.

Primer, also "PCR probe" refers to a single DNA molecule (a DNA oligomer) or a collection of DNA molecules (DNA oligomers) where the DNA molecules are identical, or nearly so, and where the primer contains a region that is designed to hybridize to a targeted locus (e.g., a targeted polymorphic locus or a nonpolymorphic locus), and may contain a priming sequence designed to allow PCR amplification. A primer may also contain a molecular barcode. A primer may contain a random region that differs for each individual molecule. The terms "test primer" and "candidate primer" are not meant to be limiting and may refer to any of the primers disclosed herein.

Library of primers refers to a population of two or more primers. In various embodiments, the library includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers. In various embodiments, the library includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primer pairs, wherein each pair of primers includes a forward test primer and a reverse test primer where each pair of test primers hybridize to a target locus. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different individual primers that each hybridize to a different target locus, wherein the individual primers are not part of primer pairs. In some embodiments, the library has both (i) primer pairs and (ii) individual primers (such as universal primers) that are not part of primer pairs.

Different primers refers to non-identical primers.
Different pools refers to non-identical pools.
Different target loci refers to non-identical target loci.
Different amplicons refers to non-identical amplicons.
Hybrid Capture Probe refers to any nucleic acid sequence, possibly modified, that is generated by various methods such as PCR or direct synthesis and intended to be complementary to one strand of a specific target DNA sequence in a sample. The exogenous hybrid capture probes may be added to a prepared sample and hybridized through a denature-reannealing process to form duplexes of exogenous-endogenous fragments. These duplexes may then be physically separated from the sample by various means.

Sequence Read refers to data representing a sequence of nucleotide bases that were measured using a clonal sequencing method. Clonal sequencing may produce sequence data representing single, or clones, or clusters of one original DNA molecule. A sequence read may also have associated quality score at each base position of the sequence indicating the probability that nucleotide has been called correctly.

Mapping a sequence read is the process of determining a sequence read's location of origin in the genome sequence of a particular organism. The location of origin of sequence reads is based on similarity of nucleotide sequence of the read and the genome sequence.

Matched Copy Error, also "Matching Chromosome Aneuploidy" (MCA), refers to a state of aneuploidy where one cell contains two identical or nearly identical chromosomes. This type of aneuploidy may arise during the formation of the gametes in meiosis, and may be referred to as a meiotic non-disjunction error. This type of error may arise in mitosis. Matching trisomy may refer to the case where three copies of a given chromosome are present in an individual and two of the copies are identical.

Unmatched Copy Error, also "Unique Chromosome Aneuploidy" (UCA), refers to a state of aneuploidy where one cell contains two chromosomes that are from the same parent, and that may be homologous but not identical. This type of aneuploidy may arise during meiosis, and may be referred to as a meiotic error. Unmatching trisomy may refer to the case where three copies of a given chromosome are present in an individual and two of the copies are from the same parent, and are homologous, but are not identical. Note that unmatching trisomy may refer to the case where two homologous chromosomes from one parent are present, and where some segments of the chromosomes are identical while other segments are merely homologous.

Homologous Chromosomes refers to chromosome copies that contain the same set of genes that normally pair up during meiosis.

Identical Chromosomes refers to chromosome copies that contain the same set of genes, and for each gene they have the same set of alleles that are identical, or nearly identical.

Allele Drop Out (ADO) refers to the situation where at least one of the base pairs in a set of base pairs from homologous chromosomes at a given allele is not detected.

Locus Drop Out (LDO) refers to the situation where both base pairs in a set of base pairs from homologous chromosomes at a given allele are not detected.

Homozygous refers to having similar alleles as corresponding chromosomal loci.

Heterozygous refers to having dissimilar alleles as corresponding chromosomal loci.

Heterozygosity Rate refers to the rate of individuals in the population having heterozygous alleles at a given locus. The heterozygosity rate may also refer to the expected or measured ratio of alleles, at a given locus in an individual, or a sample of DNA.

Highly Informative Single Nucleotide Polymorphism (HISNP) refers to a SNP where the fetus has an allele that is not present in the mother's genotype.

Chromosomal Region refers to a segment of a chromosome, or a full chromosome.

Segment of a Chromosome refers to a section of a chromosome that can range in size from one base pair to the entire chromosome.

Chromosome refers to either a full chromosome, or a segment or section of a chromosome.

Copies refers to the number of copies of a chromosome segment. It may refer to identical copies, or to non-identical, homologous copies of a chromosome segment wherein the different copies of the chromosome segment contain a substantially similar set of loci, and where one or more of the alleles are different. Note that in some cases of aneuploidy, such as the M2 copy error, it is possible to have some copies of the given chromosome segment that are identical as well as some copies of the same chromosome segment that are not identical.

Haplotype refers to a combination of alleles at multiple loci that are typically inherited together on the same chromosome. Haplotype may refer to as few as two loci or to an entire chromosome depending on the number of recombination events that have occurred between a given set of loci. Haplotype can also refer to a set of single nucleotide polymorphisms (SNPs) on a single chromatid that are statistically associated.

Haplotypic Data, also "Phased Data" or "Ordered Genetic Data," refers to data from a single chromosome in a diploid or polyploid genome, i.e., either the segregated maternal or paternal copy of a chromosome in a diploid genome.

Phasing refers to the act of determining the haplotypic genetic data of an individual given unordered, diploid (or polyploidy) genetic data. It may refer to the act of determining which of two genes at an allele, for a set of alleles found on one chromosome, are associated with each of the two homologous chromosomes in an individual.

Phased Data refers to genetic data where one or more haplotypes have been determined.

Hypothesis refers to a possible ploidy state at a given set of chromosomes, or a set of possible allelic states at a given set of loci. The set of possibilities may comprise one or more elements.

Copy Number Hypothesis, also "Ploidy State Hypothesis," refers to a hypothesis concerning the number of copies of a chromosome in an individual. It may also refer to a hypothesis concerning the identity of each of the chromosomes, including the parent of origin of each chromosome, and which of the parent's two chromosomes are present in the individual. It may also refer to a hypothesis concerning which chromosomes, or chromosome segments, if any, from a related individual correspond genetically to a given chromosome from an individual.

Target Individual refers to the individual whose genetic state is being determined. In some embodiments, only a limited amount of DNA is available from the target individual. In some embodiments, the target individual is a fetus. In some embodiments, there may be more than one target individual. In some embodiments, each fetus that originated from a pair of parents may be considered to be target individuals. In some embodiments, the genetic data that is being determined is one or a set of allele calls. In some embodiments, the genetic data that is being determined is a ploidy call.

Related Individual refers to any individual who is genetically related to, and thus shares haplotype blocks with, the target individual. In one context, the related individual may be a genetic parent of the target individual, or any genetic material derived from a parent, such as a sperm, a polar body, an embryo, a fetus, or a child. It may also refer to a sibling, parent or a grandparent.

Sibling refers to any individual whose genetic parents are the same as the individual in question. In some embodiments, it may refer to a born child, an embryo, or a fetus, or one or more cells originating from a born child, an embryo, or a fetus. A sibling may also refer to a haploid individual that originates from one of the parents, such as a sperm, a polar body, or any other set of haplotypic genetic matter. An individual may be considered to be a sibling of itself.

Fetal refers to "of the fetus," or "of the region of the placenta that is genetically similar to the fetus". In a pregnant woman, some portion of the placenta is genetically similar to the fetus, and the free floating fetal DNA found in maternal blood may have originated from the portion of the placenta with a genotype that matches the fetus. Note that the genetic information in half of the chromosomes in a fetus is inherited from the mother of the fetus. In some embodiments, the DNA from these maternally inherited chromosomes that came from a fetal cell is considered to be "of fetal origin," not "of maternal origin."

DNA of Fetal Origin refers to DNA that was originally part of a cell whose genotype was essentially equivalent to that of the fetus.

DNA of Maternal Origin refers to DNA that was originally part of a cell whose genotype was essentially equivalent to that of the mother.

Child may refer to an embryo, a blastomere, or a fetus. Note that in the presently disclosed embodiments, the concepts described apply equally well to individuals who are a born child, a fetus, an embryo or a set of cells therefrom. The use of the term child may simply be meant to connote that the individual referred to as the child is the genetic offspring of the parents.

Parent refers to the genetic mother or father of an individual. An individual typically has two parents, a mother and a father, though this may not necessarily be the case such as in genetic or chromosomal chimerism. A parent may be considered to be an individual.

Parental Context refers to the genetic state of a given SNP, on each of the two relevant chromosomes for one or both of the two parents of the target.

Develop As Desired, also "Develop Normally," refers to a viable embryo implanting in a uterus and resulting in a pregnancy, and/or to a pregnancy continuing and resulting in a live birth, and/or to a born child being free of chromosomal abnormalities, and/or to a born child being free of other undesired genetic conditions such as disease-linked genes. The term "develop as desired" is meant to encompass anything that may be desired by parents or healthcare facilitators. In some cases, "develop as desired" may refer to an unviable or viable embryo that is useful for medical research or other purposes.

Insertion into a Uterus refers to the process of transferring an embryo into the uterine cavity in the context of in vitro fertilization.

Maternal Plasma refers to the plasma portion of the blood from a female who is pregnant.

Clinical Decision refers to any decision to take or not take an action that has an outcome that affects the health or survival of an individual. In the context of prenatal diagnosis, a clinical decision may refer to a decision to abort or not abort a fetus. A clinical decision may also refer to a decision to conduct further testing, to take actions to mitigate an undesirable phenotype, or to take actions to prepare for the birth of a child with abnormalities.

Diagnostic Box refers to one or a combination of machines designed to perform one or a plurality of aspects of the methods disclosed herein. In an embodiment, the diagnostic box may be placed at a point of patient care. In an embodiment, the diagnostic box may perform targeted amplification followed by sequencing. In an embodiment the diagnostic box may function alone or with the help of a technician.

Informatics Based Method refers to a method that relies heavily on statistics to make sense of a large amount of data. In the context of prenatal diagnosis, it refers to a method designed to determine the ploidy state at one or more chromosomes or the allelic state at one or more alleles by statistically inferring the most likely state, rather than by directly physically measuring the state, given a large amount of genetic data, for example from a molecular array or sequencing. In an embodiment of the present disclosure, the informatics based technique may be one disclosed in this patent. In an embodiment of the present disclosure it may be PARENTAL SUPPORT™.

Primary Genetic Data refers to the analog intensity signals that are output by a genotyping platform. In the context of SNP arrays, primary genetic data refers to the intensity signals before any genotype calling has been done. In the context of sequencing, primary genetic data refers to the analog measurements, analogous to the chromatogram, that comes off the sequencer before the identity of any base pairs have been determined, and before the sequence has been mapped to the genome.

Secondary Genetic Data refers to processed genetic data that are output by a genotyping platform. In the context of a SNP array, the secondary genetic data refers to the allele calls made by software associated with the SNP array reader, wherein the software has made a call whether a given allele is present or not present in the sample. In the context of sequencing, the secondary genetic data refers to the base pair identities of the sequences have been determined, and possibly also where the sequences have been mapped to the genome.

Non-Invasive Prenatal Diagnosis (NPD), or also "Non-Invasive Prenatal Screening" (NPS), refers to a method of determining the genetic state of a fetus that is gestating in a mother using genetic material found in the mother's blood, where the genetic material is obtained by drawing the mother's intravenous blood.

Preferential Enrichment of DNA that corresponds to a locus, or preferential enrichment of DNA at a locus, refers to any method that results in the percentage of molecules of DNA in a post-enrichment DNA mixture that correspond to the locus being higher than the percentage of molecules of DNA in the pre-enrichment DNA mixture that correspond to the locus. The method may involve selective amplification of DNA molecules that correspond to a locus. The method may involve removing DNA molecules that do not correspond to the locus. The method may involve a combination of methods. The degree of enrichment is defined as the percentage of molecules of DNA in the post-enrichment mixture that correspond to the locus divided by the percentage of molecules of DNA in the pre-enrichment mixture that correspond to the locus. Preferential enrichment may be carried out at a plurality of loci. In some embodiments of the present disclosure, the degree of enrichment is greater than 20. In some embodiments of the present disclosure, the degree of enrichment is greater than 200. In some embodiments of the present disclosure, the degree of enrichment is greater than 2,000. When preferential enrichment is carried out at a plurality of loci, the degree of enrichment may refer to the average degree of enrichment of all of the loci in the set of loci.

Amplification refers to a method that increases the number of copies of a molecule, such as a molecule of DNA.

Selective Amplification may refer to a method that increases the number of copies of a particular molecule of DNA, or molecules of DNA that correspond to a particular region of DNA. It may also refer to a method that increases the number of copies of a particular targeted molecule of DNA, or targeted region of DNA more than it increases non-targeted molecules or regions of DNA. Selective amplification may be a method of preferential enrichment.

Universal Priming Sequence refers to a DNA sequence that may be appended to a population of target DNA molecules, for example by ligation, PCR, or ligation mediated PCR. Once added to the population of target molecules, primers specific to the universal priming sequences can be used to amplify the target population using a single pair of amplification primers. Universal priming sequences are typically not related to the target sequences.

Universal Adapters, or 'ligation adaptors' or 'library tags' are DNA molecules containing a universal priming sequence that can be covalently linked to the 5-prime and 3-prime end of a population of target double stranded DNA molecules. The addition of the adapters provides universal priming sequences to the 5-prime and 3-prime end of the target population from which PCR amplification can take place, amplifying all molecules from the target population, using a single pair of amplification primers.

Targeting refers to a method used to selectively amplify or otherwise preferentially enrich those molecules of DNA that correspond to a set of loci, in a mixture of DNA.

Joint Distribution Model refers to a model that defines the probability of events defined in terms of multiple random variables, given a plurality of random variables defined on the same probability space, where the probabilities of the variable are linked. In some embodiments, the degenerate case where the probabilities of the variables are not linked may be used.

Percent identity in reference to nucleic acid sequences refers to the degree of sequence identity between nucleic acid sequences.

BRIEF DESCRIPTION OF THE DRAWINGS

The presently disclosed embodiments will be further explained with reference to the attached drawings, wherein like structures are referred to by like numerals throughout the several views. The drawings shown are not necessarily to scale, with emphasis instead generally being placed upon illustrating the principles of the presently disclosed embodiments.

FIG. 12: An example of some primers with internal tags. FIG. 12 discloses nucleotide sequences as SEQ ID NOS: 44,611, 44,612, 44,613, 44,614, 44,615, 44,616, 44,617, 44,618, 44,625, 44,620, 44,621, and 44,622, respectively, in order of appearance.

FIG. 30, 0% FF plot: Generated plots when two chromosomes are present and the fetal cfDNA fraction is 0%. This plot is from a non-pregnant woman, and thus represents the pattern when the genotype is entirely maternal. Allele clusters are thus centered around 1 (AA alleles), 0.5 (AB alleles), and 0 (BB alleles). FIG. 30, 12% FF plot: Generated plot when two chromosomes are present and the fetal fraction is 12%. The contribution of fetal alleles to the fraction of A allele reads shifts the position of some allele spots up or down along the y-axis, such that the bands are centered around 1 (AA|AA alleles), 0.94 (AA|AB alleles), 0.56 (AB|AA alleles), 0.50 (AB|AB alleles), 0.44 (AB|BB alleles), 0.06 (BB|AB alleles), and 0 (BB|BB alleles). FIG. 30, 26% FF Plot. Generated plot when two chromosomes are present and the fetal fraction is 26%. The pattern, including two filled circles and two filled square peripheral bands and a trio of central open triangle bands, is readily apparent. Bands are centered around 1 (AA|AA alleles), 0.87 (AA|AB alleles), 0.63 (AB|AA alleles), 0.50 (AB|AB alleles), 0.37 (AB|BB alleles), 0.13 (BB|AB alleles), and 0 (BB|BB alleles). FIG. 30D: Generated plot when one chromosome is present and the fetal fraction is 26%. The hallmark pattern of one external filled circle and one external filled square peripheral band as well as two central open triangle bands indicated maternally-inherited monosomy. Because the fetus only contributes a single allele (A or B) to the allele reads, the internal peripheral filled circles and filled square bands are not present, and the center trio of bands condenses into two bands. Bands that are centered around 1 (AA|A alleles), 0.57 (AB|A alleles), 0.43 (AB|B alleles), and 0 (BB|B alleles). FIG. 30E: Generated plot when three chromosomes are present and the fetal fraction is 27%. This pattern of two filled circles and filled square peripheral bands as well as two central open triangle bands indicates maternally-inherited meiotic trisomy. Bands are centered around 1 (AA|AAA alleles), 0.88 (AA|AAB alleles), 0.56 (AB|AAB alleles), 0.44 (AB|ABB alleles), 0.12 (BB|ABB alleles), and 0 (BB|BBB alleles). FIG. 30F: Generated plot when three chromosomes are present and the fetal fraction is 14%. This pattern of three filled circles and three filled square peripheral bands, as well as two central open triangle bands, indicates paternally-inherited meiotic trisomy. Bands are centered around 1 (AA|AAA alleles), 0.93 (AA|AAB alleles), 0.87 (AA|ABB alleles), 0.60 (AB|AAA alleles), 0.53 (AB|AAB alleles), 0.47 (AB|ABB alleles), 0.40 (AB|BBB alleles), 0.13 (BB|AAB alleles), 0.07 (BB|ABB alleles), and 0 (BB|BBB alleles). FIG. 30G: Generated plot when three chromosomes are present and the fetal fraction is 35%. This pattern of two filled circles and two filled square peripheral bands and four central open triangle bands indicates maternally-inherited mitotic trisomy. Bands are centered around 1 (AA|AAA alleles), 0.85 (AA|AAB alleles), 0.72 (AB|AAA alleles), 0.57 (AB|AAB alleles), 0.43 (AB|ABB alleles), 0.28 (AB|BBB alleles), 0.15 (BB|ABB alleles), and 0 (BB|BBB alleles). FIG. 30H: Generated plot when three chromosomes are present and the fetal fraction is 25%. This pattern of two filled circles and two filled square peripheral bands as well as four central open triangle bands indicates paternally-inherited mitotic trisomy. This pattern can be distinguished from that of maternally-inherited mitotic trisomy (as in FIG. 30G) by the position of the internal peripheral bands. Specifically, bands are centered around 1 (AA|AAA alleles), 0.78 (AA|ABB alleles), 0.67 (AB|AAA alleles), 0.56 (AB|AAB alleles), 0.44 (AB|ABB alleles), 0.33 (AB|BBB alleles), 0.22 (BB|AAB alleles), and 0 (BB|BBB alleles).

FIGS. 31A-31G: Graphical representations of (FIG. 31A) euploid, (FIG. 31B) T13, (FIG. 31C) T18, (FIG. 31D) T21, (FIG. 31E) 45,X, (FIG. 31F) 47,XXY, and (FIG. 31G) 47,XYY, test samples as indicated. Each chromosome is indicated at the top of the plot, fetal and maternal genotypes are indicated to the right of the plots, the x-axis represents the linear position of the SNPs along each chromosome, and the y-axis indicates the number of A allele reads as a fraction of the total reads. Note the altered cluster positioning based on fetal fraction, as described herein. Each spot represents a single SNP locus. Fetal and maternal genotypes are indicated to the right of the plot, and chromosome identities are indicated at the top of the plots.

FIGS. 33A-33F: Illustrations of the calculation of an interaction score between primers in a primer library. FIG. 33A shows the first two bases (dinucleotide) of a primer that align to the other primer for calculation of ΔG. Iterate over the remainder of the primer that aligns with the other primer by sliding the bases being observing one base to the right. Continue until ΔG has been calculated for all pairs of bases that align (FIG. 33B). Shift the alignment of the two primers (FIGS. 33C and 33D). Determine ΔG for the new alignment (FIGS. 33E and 33F).

FIG. 34: Table of the percentage of reads that map to target loci for genomic DNA samples and for samples of a single cell from a cell line for both mother and child samples.

FIG. 36: Table of the percentage of reads that map to target loci for blastocoel fluid and for a single blastocyst cell.

FIG. 45 is a table of data (such as percent mapped reads and error rate) from multiplex PCR with various buffers.

Figure 1:
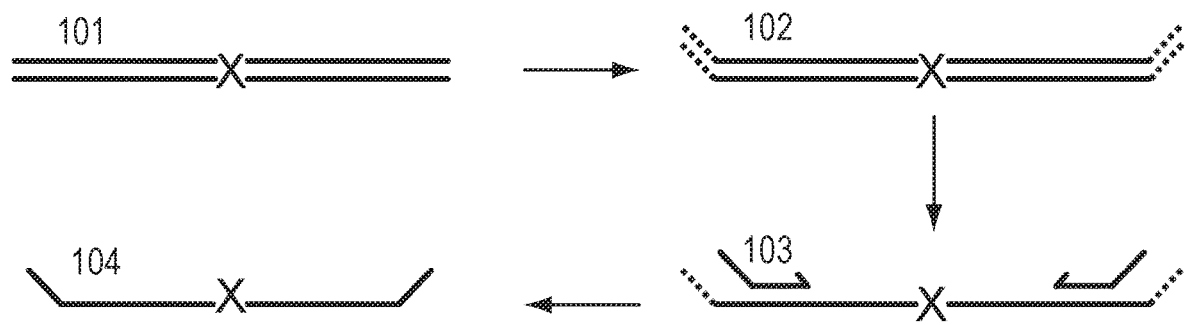
FIG. 1: Graphical representation of direct multiplexed mini-PCR method.

While the above-identified drawings set forth presently disclosed embodiments, other embodiments are also contemplated, as noted in the discussion. This disclosure presents illustrative embodiments by way of representation and not limitation. Numerous other modifications and embodiments can be devised by those skilled in the art which fall within the scope and spirit of the principles of the presently disclosed embodiments.

DETAILED DESCRIPTION

The present invention is based in part on the surprising discovery that often only a relatively small number of primers in a library of primers are responsible for a substantial amount of the amplified primer dimers that form during multiplex PCR reactions. Methods have been developed to select the most undesirable primers for removal from a library of candidate primers. By reducing the amount of primer dimers to a negligible amount (~0.1% of the PCR products), these methods allow the resulting primer libraries to simultaneously amplify a large number of target loci in a single multiplex PCR reaction. Because the primers hybridize to the target loci and amplify them rather than hybridizing to other primers and forming amplified primer dimers, the number of different target loci that can be amplified is increased. It was also discovered that using lower primer concentrations and much longer annealing times than normal increases the likelihood that the primers hybridize to the target loci instead of hybridizing to each other and forming primer dimers (see, e.g., U.S. Ser. No. 13/683,604, filed Nov. 21, 2012, which is hereby incorporated by reference in its entirety). The methods can also be used to amplify a large number of target loci even if the primers have a relatively large range of melting temperatures (in contrast to other methods that require primers to have very similar melting temperatures to successfully amplify multiple loci simultaneously due to the need for the primers to be functional under the same reaction conditions). Additionally, it was discovered that the annealing temperature can optionally be higher than the melting temperatures of the primers (in contrast to other methods that use an annealing temperature below the melting temperatures of the primers). A higher annealing temperature improves the specificity of the PCR amplification and reduces or prevents amplification of non-target loci.

During the PCR amplification and sequencing of 19,488 target loci in a genomic sample, 99.4-99.7% of the sequencing reads mapped to the genome, of those, 99.99% of the mapped to target loci. For plasma samples with 10 million sequencing reads, typically at least 19,350 of the 19,488 target loci (99.3%) were amplified and sequenced. This primer library has even been used to amplify the nucleic acids in a single cell (FIGS. 34-37).

During the PCR amplification and sequencing of ~28,000 target loci in a genomic sample, 99% of the sequencing reads mapped to target loci. This primer library has also been used to amplify nucleic acids in a single cell.

Being able to simultaneously amplify such a large number of target loci at once greatly decreases the amount of time and the amount of DNA required to analyze thousands of target loci. For example, DNA from a single cell is sufficient to simultaneously analyze thousands of target loci, which is important for applications in which the amount of DNA is low, such as genetic testing of a single cell from an embryo prior to in vitro fertilization or genetic testing of a forensic sample with little DNA. In addition, being able to analyze the target loci in one reaction volume (such as in one chamber, well, or vessel) rather than splitting the sample into multiple different reactions reduces variability that can occur between reactions. In addition, methods have been developed to use reference standards to correct for amplification bias that may occur between different target loci. For example, differences in amplification efficiency between target loci due to factors such as GC content may cause differing amounts of PCR products to be produced for target loci that are actually present in the same amount. The use of reference standards similar to the target loci allows the detection of such amplification bias so that it can be corrected for during the quantitation of the target loci.

During sequencing of PCR products, artifacts such as primer dimers are detected and thus inhibit the detection of target amplicons. Because of this limitation, microarrays with hybridization probes are often used for detection since microarrays are less sensitive to interference from primer dimers (for example, microarrays can be used as a target specific detection that uses probes to hybridize to target amplicons but does not have probes to hybridize to undesired primer dimers). The high level of multiplexing with minimal non-target amplicons that has now been achieved allows PCR followed by sequencing to be used as an alternative to microarrays. For example, the present multiplex PCR methods can be used with a non-target specific method of detection, such as sequencing that detects all amplified products (including both target amplicons and primer dimers, if any). The small amount of primer dimers that are produced allows detection of target amplicons by methods that detect all amplicons. Thus, in some embodiments, the method includes multiplex PCR followed by sequencing without use of an array. In other embodiments, the method includes multiplex PCR followed by an array for detection of the amplified products.

The multiplex-PCR methods of the invention can be in a variety of applications, such as genotyping, detection of chromosomal abnormalities (such as a fetal chromosome aneuploidy), gene mutation and polymorphism (such as single nucleotide polymorphisms, SNPs) analysis, gene deletion analysis, determination of paternity, analysis of genetic differences among populations, forensic analysis, measuring predisposition to disease, quantitative analysis of mRNA, and detection and identification of infectious agents (such as bacteria, parasite, and viruses). The multiplex PCR methods can also be used for non-invasive prenatal testing, such as paternity testing or the detection of fetal chromosome abnormalities.

Exemplary Primer Design Methods

Highly multiplexed PCR can often result in the production of a very high proportion of product DNA that results from unproductive side reactions such as primer dimer formation. In an embodiment, the particular primers that are most likely to cause unproductive side reactions may be removed from the primer library to give a primer library that will result in a greater proportion of amplified DNA that maps to the genome. The step of removing problematic primers, that is, those primers that are particularly likely to firm dimers has unexpectedly enabled extremely high PCR multiplexing levels for subsequent analysis by sequencing. In systems such as sequencing, where performance significantly degrades by primer dimers and/or other mischief products, greater than 10, greater than 50, and greater than 100 times higher multiplexing than other described multiplexing has been achieved. Note this is opposed to probe based detection methods, e.g. microarrays, TAQMAN, PCR etc. where an excess of primer dimers will not affect the outcome appreciably. Also note that the general belief in the art is that multiplexing PCR for sequencing is limited to about 100 assays in the same well. Fluidigm and Rain Dance offer platforms to perform 48 or 1000s of PCR assays in parallel reactions for one sample.

There are a number of ways to choose primers for a library where the amount of non-mapping primer dimer or other primer mischief products are minimized. Empirical data indicate that a small number of 'bad' primers are responsible for a large amount of non-mapping primer dimer side reactions. Removing these 'bad' primers can increase the percent of sequence reads that map to targeted loci. One way to identify the 'bad' primers is to look at the sequencing data of DNA that was amplified by targeted amplification; those primer dimers that are seen with greatest frequency can be removed to give a primer library that is significantly less likely to result in side product DNA that does not map to the genome. There are also publicly available programs that can calculate the binding energy of various primer combinations, and removing those with the highest binding energy will also give a primer library that is significantly less likely to result in side product DNA that does not map to the genome.

In some embodiments for selecting primers, an initial library of candidate primers is created by designing one or more primers or primer pairs to candidate target loci. A set of candidate target loci (such as SNPs) can selected based on publically available information about desired parameters for the target loci, such as frequency of the SNPs within a target population or the heterozygosity rate of the SNPs. In one embodiment, the PCR primers may be designed using the Primer3 program (the worldwide web at primer3.sourceforge.net; libprimer3 release 2.2.3, which is hereby incorporated by reference in its entirety). If desired, the primers can be designed to anneal within a particular annealing temperature range, have a particular range of GC contents, have a particular size range, produce target amplicons in a particular size range, and/or have other parameter characteristics. Starting with multiple primers or primer pairs per candidate target locus increases the likelihood that a primer or prime pair will remain in the library for most or all of the target loci. In one embodiment, the selection criteria may require that at least one primer pair per target locus remains in the library. That way, most or all of the target loci will be amplified when using the final primer library. This is desirable for applications such as screening for deletions or duplications at a large number of locations in the genome or screening for a large number of sequences (such as polymorphisms or other mutations) associated with a disease or an increased risk for a disease. If a primer pair from the library would produces a target amplicon that overlaps with a target amplicon produced by another primer pair, one of the primer pairs may be removed from the library to prevent interference.

In some embodiments, a score such as an "undesirability score" (higher score representing least desirability) is calculated (such as calculation on a computer) for most or all of the possible combinations of two primers from a library of candidate primers. In various embodiments, a score (such as an undesirability score) is calculated for at least 80, 90, 95, 98, 99, or 99.5% of the possible combinations of candidate primers in the library. Each score (such as an undesirability score) is based at least in part on the likelihood of dimer formation between the two candidate primers. If desired, the score (such as the undesirability score) may also be based on one or more other parameters selected from the group consisting of heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, size of the target amplicon, number of SNPs within the candidate primer, location of SNPs within the candidate primer, distance from an end of the amplicon to the target bases within the amplicon, and the number of target loci in an amplicon. In some embodiments, the lower the number of SNPs with the candidate primer (such as 2, 1 or 0 SNPs) the better. In some embodiments, there are no SNPs in the candidate primer. In some embodiments, SNPs (if any) are preferably not in the last 5 nucleotides in the 3' end of the candidate primer. In some embodiments, the target bases (the bases of interest in a target locus) are preferably near an end (the 3' or 5' end) of the amplicon; this may improve the quality of sequencing data (since bases near the end of an amplicon are sequenced more accurately), and/or allow shorter sequencing reads to be performed. In some embodiments, a single amplicon includes 2 or more target loci (such as 2 or more nearby SNPs or variants). In some embodiments, the specificity of the candidate primer for the target locus includes the likelihood that the candidate primer will mis-prime by binding and amplifying a locus other than the target locus it was designed to amplify. In some embodiments, one or more or all the candidate primers that mis-prime are removed from the library. In some embodiments to increase the number of candidate primers to choose from, candidate primers that may mis-prime are not removed from the library. In some embodiments, the optimal melting temperature for selection of the candidate primers is 57° C. In some embodiments, the optimal size for selection of the candidate primers is a length of 24 nucleotides. In some embodiments, the optimal GC content for selection of the candidate primers is 50%. If multiple factors are considered, the score (such as the undesirability score) may be calculated based on a weighted average of the various parameters. The parameters may be assigned different weights based on their importance for the particular application that the primers will be used for. An exemplary score (such as an undesirability score) for a primer is shown below in which the parameters are weighted by various factors.

score=(1)(total number of targets−number of targets covered)+(100)(number of SNPs in GC clamp)+(10)(number of SNPs in primer binding site)+(10)(number of similar primer pair designs)+(0.1)(distance of target base from amplicon end)+(0.1)(amplicon length)+(100)(interaction score)

where interaction score=max (−1*ΔG value) as described herein

Another exemplary score for a primer is shown below.

score=(100)(number of SNPs in GC clamp)+(10)(number of SNPs in primer binding site)+(0.1)(distance of target base from amplicon end)+(0.1)(amplicon length)+(100)(interaction score)

where interaction score=max (−1*ΔG value) as described herein

In some embodiments, the score for a primer pair is the worse score out of the scores for the two primers in the pair. An exemplary score (such as an undesirability score or the score in Example 20) for a pairs of designs (in which each design is one primer pair so that a pair of designs includes two primer pairs with a total of 4 primers) is shown below.

score=(10000000)(amplicon overlap)+(100)(distance between designs)+(1)(total number of targets−number of targets covered)+(100)(number of SNPs in GC clamp)+(10)(number of SNPs in primer binding site)+(10)(number of similar primer pair designs)+(0.1)(distance of target base from amplicon end)+(0.1)(amplicon length)+(100)(interaction score)

where interaction score=max (−1*ΔG value) as described herein;

where amplicon overlap=overlap between the two amplicons formed by a pair of designs In some embodiments, the score for a pair of designs is the worse score out of the scores for the four primers in the pair of designs.

In some embodiments, the primer with the highest score (such as the undesirability score) or any score representing least desirability is removed from the library. If the removed primer is a member of a primer pair that hybridizes to one target locus, then the other member of the primer pair may be removed from the library. The process of removing primers may be repeated as desired. In some embodiments, the selection method is performed until the score (such as the undesirability score) for the candidate primer combinations remaining in the library are all equal to or below a minimum threshold (such as any threshold for which the primers remaining in the library all have at least that level of desirability). In some embodiments, the selection method is performed until the number of candidate primers remaining in the library is reduced to a desired number.

In various embodiments, after the score (such as the undesirability score) are calculated, the candidate primer that is part of the greatest number of combinations of two candidate primers with a score (such as an undesirability score) above a first minimum threshold (such as any threshold for which the primers remaining in the library all have at least that level of desirability) is removed from the library. This step ignores interactions equal to or below the first minimum threshold since these interactions are less significant. If the removed primer is a member of a primer pair that hybridizes to one target locus, then the other member of the primer pair may be removed from the library. The process of removing primers may be repeated as desired. In some embodiments, the selection method is performed until the score (such as the undesirability score) for the candidate primer combinations remaining in the library are all equal to or below the first minimum threshold. If the number of candidate primers remaining in the library is higher than desired, the number of primers may be reduced by decreasing the first minimum threshold to a lower second minimum threshold (such as any threshold with a stricter cutoff than the first minimum threshold so that some of the least desirable primers are removed from the library) and repeating the process of removing primers. If the number of candidate primers remaining in the library is lower than desired, the method can be continued by increasing the first minimum threshold to a higher second minimum threshold (such as any threshold with a less strict cutoff than the first minimum threshold) and repeating the process of removing primers using the original candidate primer library, thereby allowing more of the candidate primers to remain in the library. In some embodiments, the selection method is performed until the score (such as the undesirability score) for the candidate primer combinations remaining in the library are all equal to or below the second minimum threshold, or until the number of candidate primers remaining in the library is reduced to a desired number.

If desired, primer pairs that produce a target amplicon that overlaps with a target amplicon produced by another primer pair can be divided into separate amplification reactions. Multiple PCR amplification reactions may be desirable for applications in which it is desirable to analyze all of the candidate target loci (instead of omitting candidate target loci from the analysis due to overlapping target amplicons).

In various embodiments of any of the aspects of the invention, the selection method selects candidate primers and divides them into different pools (e.g., 2, 3, 4, 5, 6, or more different pools). Each pool can be used to simultaneously amplify a large number of target loci (or a subset of target loci) in a single reaction volume. In some embodiments, a graph coloring algorithm is used to divide candidate primers into different pools. If desired, this method can be used to minimize the number of different pools needed to amplify most or all of the target loci.

In some embodiments, most or all of the target loci (such as at least 70, 80, 90, 92, 94, 96, 98, 99, or 100% of the target loci) are amplified by at least 2, 3, 4, 5, 6, or more different pools. In some embodiments, most or all of the bases in the target loci (such as at least 70, 80, 90, 92, 94, 96, 98, 99, or 100% of the bases in the target loci) are amplified by at least 2, 3, 4, 5, 6, or more different pools. In some embodiments, most or all of the bases in the target loci (such as at least 70, 80, 90, 92, 94, 96, 98, 99, or 100% of the bases in the target loci) are amplified by at least 2, 3, 4, 5, 6, or more different primers or primer pairs in different pools. For example, a particular base in a target locus may be amplified by at least 2, 3, 4, 5, 6, or more different primers or primer pairs; wherein each different primer or primer pair is in a different pool. Using different primers or primer pairs to amplify each base allows multiple independent measurements of the base to be made, thereby increasing the accuracy of the method. Dividing the different primers or primer pairs that amplify the same base into different pools prevents interference due to overlapping amplicons being formed by different primers or primer pairs.

In one aspect, the invention features methods of selecting test primers from a library of candidate primers to form 2 or more different primer pools. In various embodiments, the selection involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing the candidate primer with the highest or worst score (such as an undesirability score) from the library of candidate primers; and (iii) if the candidate primer removed in step (ii) is a member of a primer pair, then removing the other member of the primer pair from the library of candidate primers; and (iv) optionally repeating steps (ii) and (iii), thereby selecting a first pool. In some embodiments, the selection method is performed until the score (such as the undesirability score) for the candidate primer combinations remaining in the library are all equal to or below a minimum threshold for the first pool. In some embodiments, the selection method is performed until the number of candidate primers remaining in the library is reduced to a desired number for the first pool. In some embodiments, after the first pool is selected those primers are removed from further consideration and steps of the method (such as steps (ii) and (iii)) are repeated with the remaining primers to select a second pool. If desired, this method may be repeated to select the desired number of primer pools. In some embodiments, the score is based at least in part on the current coverage of the bases in the target locus (such as the number of other primer pools that have a primer or primer pair that amplifies a particular base in the target locus).

In one aspect, the invention features methods of selecting test primers from a library of candidate primers to form 2 or more different primer pools. In various embodiments, the selection of test primers are selected from a library of candidate primers involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing from the library of candidate primers the candidate primer that is part of the greatest number of combinations of two candidate primers with a score (such as an undesirability score) above a first minimum threshold; (iii) if the candidate primer removed in step (ii) is a member of a primer pair, then removing the other member of the primer pair from the library of candidate primers; and (iv) optionally repeating steps (ii) and (iii), thereby selecting a first pool. In some embodiments, the selection method is performed until the score (such as the undesirability score) for the candidate primer combinations remaining in the library are all equal to or below the first minimum threshold for the first pool. In some embodiments, the selection method is performed until the number of candidate primers remaining in the library is reduced to a desired number for the first pool. In various embodiments, the selection method involves further reducing the number of candidate primers remaining in the library by decreasing the first minimum threshold used in step (ii) to a lower second minimum threshold and optionally repeating steps (ii) and (iii). In some embodiments, the selection method involves increasing the first minimum threshold used in step (ii) to a higher second minimum threshold and optionally repeating steps (ii) and (iii). In some embodiments, the selection method is performed until the score (such as the undesirability score) for the candidate primer combinations remaining in the library are all equal to or below the second minimum threshold, or until the number of candidate primers remaining in the library is reduced to a desired number for the first pool. In some embodiments, after the first pool is selected those primers are removed from further consideration and steps of the method (such as steps (ii) and (iii)) are repeated with the remaining primers to select a second pool. If desired, this method may be repeated to select the desired number of primer pools. In some embodiments, the score is based at least in part on the current coverage of the bases in the target locus (such as the number of other primer pools that have a primer or primer pair that amplifies a particular base in the target locus).

As discussed above, in some embodiments, a library is formed by starting with a library of candidate primers and removing primers until the primers remaining in the library have the desired characteristics for use as a final primer library.

In other embodiments, candidate primers are added to a library (such as a library starting with no primers) to form a library with the desired characteristics. In some embodiments, the candidate primer or primer pair with the most desirable score (such as the lowest undesirability score) is added to a library (such as a library starting with no primers). The process of adding candidate primers may be repeated as desired. In some embodiments, the selection method is performed until the score (such as the undesirability score) for the candidate primers that have not been added to the library are all above a minimum threshold (such that all the candidate primers that have not been chosen for the library all have worse scores than the threshold). In some embodiments, the selection method is performed until the number of candidate primers that have been added to the library reaches a desired number. The library of selected primers can then be used in any of the methods of the invention.

In some embodiments, most (such as at least 50, 60, 70, 80, 90, 95, 96, 97, 98, 99, or 99.5%) or all of the possible sets of two primer pairs (two primer pairs with a total of 4 primers) are considered for inclusion in a library. In some embodiments, the set of two different candidate primer pair with the most desirable score (such as the lowest undesirability score) is added to a first pool (such as a first pool starting with no primers). In some embodiments, the set of two different candidate primer pairs with the next most desirable score is added to the first pool if it is connected to at most two sets of two different candidate primer pairs in the first pool. By "connected" for purposes of this step is meant that a single candidate primer pair in one set of two different candidate primer pairs is the same as a single candidate primer pair in another set of two different candidate primer pairs. If the set of two different candidate primer pairs is connected to more than two sets, it may be added to a different pool than the first pool. The process of set of two different candidate primer pair to pool(s) may be repeated as desired for the next set of two different candidate primer pairs with the next most desirable score. In some embodiments, the selection method is performed until the score (such as the undesirability score) for the candidate primers that have not been added to the pool(s) are all above a minimum threshold (such that all the candidate primers that have not been chosen for the pool(s) all have worse scores than the threshold). In some embodiments, the selection method is performed until the number of candidate primers that have been added to the pool(s) reaches a desired number. In some embodiments, the method involves storing designs in N number of doubly linked list data structures with the design pairs. N represents the current number of different primer pools. Initially, N=1, since there is only one primer pool. In some embodiments, a second pool is only created if necessary to include the desired target loci or the desired level of coverage of target loci. The library of selected primers can then be used in any of the methods of the invention.

In some embodiments, the minimum threshold, the first minimum threshold, or the second minimum threshold is an interaction score equal to or about 20, 18, 16, 14, 12, 10, 9, 8, 7, 6, 5, 4, 3, 2, or 1 kcal/mol. In some embodiments, the interaction score is calculated as followed as described further herein:

Interaction score=max(−1*$\Delta G$ value); or interaction_score=max(−delta$G$_2,0.8*(−delta$G$_1))

where delta$G$_2=Gibbs energy (energy required to break the dimer) for a dimer that is extensible by PCR on both ends, i.e., the 3' end of each primer anneals to the other primer; and delta$G$_1=Gibbs energy for a dimer that is extensible by PCR on at least one end.

These selection methods minimize the number of candidate primers that have to be removed from the library to achieve the desired reduction in primer dimers. By removing a smaller number of candidate primers from the library, more (or all) of the target loci can be amplified using the resulting primer library.

Multiplexing large numbers of primers imposes considerable constraint on the assays that can be included. Assays that unintentionally interact result in spurious amplification products. The size constraints of miniPCR may result in further constraints. In an embodiment, it is possible to begin with a very large number of potential SNP targets (between about 500 to greater than 1 million) and attempt to design primers to amplify each SNP. Where primers can be designed it is possible to attempt to identify primer pairs likely to form spurious products by evaluating the likelihood of spurious primer duplex formation between all possible pairs of primers using published thermodynamic parameters for DNA duplex formation. Primer interactions may be ranked by a scoring function related to the interaction and primers with the worst interaction scores are eliminated until the number of primers desired is met. In cases where SNPs likely to be heterozygous are most useful, it is possible to also rank the list of assays and select the most heterozygous compatible assays. Experiments have validated that primers with high interaction scores are most likely to form primer dimers. At high multiplexing it is not possible to eliminate all spurious interactions, but it is essential to remove the primers or pairs of primers with the highest interaction scores in silico as they can dominate an entire reaction, greatly limiting amplification from intended targets. We have performed this procedure to create multiplex primer sets of up to and in some cases more than 10,000 primers. The improvement due to this procedure is substantial, enabling amplification of more than 80%, more than 90%, more than 95%, more than 98%, and even more than 99% on target products as determined by sequencing of all PCR products, as compared to 10% from a reaction in which the worst primers were not removed. When combined with a partial semi-nested approach as previously described, more than 90%, and even more than 95% of amplicons may map to the targeted sequences.

Note that there are other methods for determining which PCR probes are likely to form dimers. In an embodiment, analysis of a pool of DNA that has been amplified using a non-optimized set of primers may be sufficient to determine problematic primers. For example, analysis may be done using sequencing, and those dimers which are present in the greatest number are determined to be those most likely to form dimers, and may be removed.

This method has a number of potential application, for example to SNP genotyping, heterozygosity rate determination, copy number measurement, and other targeted sequencing applications. In an embodiment, the method of primer design may be used in combination with the mini-PCR method described elsewhere in this document. In some embodiments, the primer design method may be used as part of a massive multiplexed PCR method.

The use of tags on the primers may reduce amplification and sequencing of primer dimer products. In some embodiments, the primer contains an internal region that forms a loop structure with a tag. In particular embodiments, the primers include a 5' region that is specific for a target locus, an internal region that is not specific for the target locus and forms a loop structure, and a 3' region that is specific for the target locus. In some embodiments, the loop region may lie between two binding regions where the two binding regions are designed to bind to contiguous or neighboring regions of template DNA. In various embodiments, the length of the 3' region is at least 7 nucleotides. In some embodiments, the length of the 3' region is between 7 and 20 nucleotides, such as between 7 to 15 nucleotides, or 7 to 10 nucleotides, inclusive. In various embodiments, the primers include a 5' region that is not specific for a target locus (such as a tag or a universal primer binding site) followed by a region that is specific for a target locus, an internal region that is not specific for the target locus and forms a loop structure, and a 3' region that is specific for the target locus. Tag-primers can be used to shorten necessary target-specific sequences to below 20, below 15, below 12, and even below 10 base pairs. This can be serendipitous with standard primer design when the target sequence is fragmented within the primer binding site or, or it can be designed into the primer design. Advantages of this method include: it increases the number of assays that can be designed for a certain maximal amplicon length, and it shortens the "non-informative" sequencing of primer sequence. It may also be used in combination with internal tagging (see elsewhere in this document).

In an embodiment, the relative amount of nonproductive products in the multiplexed targeted PCR amplification can be reduced by raising the annealing temperature. In cases where one is amplifying libraries with the same tag as the target specific primers, the annealing temperature can be increased in comparison to the genomic DNA as the tags will contribute to the primer binding. In some embodiments we are using considerably lower primer concentrations than previously reported along with using longer annealing times than reported elsewhere. In some embodiments the annealing times may be longer than 3 minutes, longer than 5 minutes, longer than 8 minutes, longer than 10 minutes, longer than 15 minutes, longer than 20 minutes, longer than 30 minutes, longer than 60 minutes, longer than 120 minutes, longer than 240 minutes, longer than 480 minutes, and even longer than 960 minutes. In an embodiment, longer annealing times are used than in previous reports, allowing lower primer concentrations. In various embodiments, longer than normal extension times are used, such as greater than 3, 5, 8, 10, or 15 minutes. In some embodiments, the primer concentrations are as low as 50 nM, 20 nM, 10 nM, 5 nM, 1 nM, and lower than 1 uM. This surprisingly results in robust performance for highly multiplexed reactions, for example 1,000-plex reactions, 2,000-plex reactions, 5,000-plex reactions, 10,000-plex reactions, 20,000-plex reactions, 50,000-plex reactions, and even 100,000-plex reactions. In an embodiment, the amplification uses one, two, three, four or five cycles run with long annealing times, followed by PCR cycles with more usual annealing times with tagged primers.

To select target locations, one may start with a pool of candidate primer pair designs and create a thermodynamic model of potentially adverse interactions between primer pairs, and then use the model to eliminate designs that are incompatible with other the designs in the pool.

In an embodiment, the invention features a method of decreasing the number of target loci (such as loci that may contain a polymorphism or mutation associated with a disease or disorder or an increased risk for a disease or disorder such as cancer) that need to be detected for a diagnosis and/or increasing the disease load that is detected (e.g., increasing the number of polymorphisms or mutations that are detected). In some embodiments, the method includes ranking (such as ranking from highest to lowest) loci by frequency or reoccurrence of a polymorphism or mutation (such as a single nucleotide variation, insertion, or deletion, or any of the other variations described herein) in each locus among subjects with the disease or disorder such as cancer. In some embodiments, PCR primers are designed to some or all of the loci. During selection of PCR primers for a library of primers, primers to loci that have a higher frequency or reoccurrence (higher ranking loci) are favored over those with a lower frequency or reoccurrence (lower ranking loci). In some embodiments, this parameter is included as one of the parameters in the calculation of the scores (such as the undesirability scores) described herein. If desired, primers (such as primers to high ranking loci) that are incompatible with other designs in the library can be included in a different PCR library/pool. In some embodiments, multiple libraries/pools (such as 2, 3, 4, 5 or more) are used in separate PCR reactions to enable amplification of all (or a majority) of the loci represented by all the libraries/pools. In some embodiment, this method is continued until sufficient primers are included in one or more libraries/pools such that the primers, in aggregate, enable the desired disease load to be captured for the disease or disorder (e.g., such as by detection of at least 80, 85, 90, 95, or 99% of the disease load).

In some embodiments, the library of candidate primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers or different primer pairs. In some embodiments, only a relatively small number of candidate primers need to be removed from the library to achieve the desired reduction in primer dimers. In some embodiments, less than 30, 20, 15, 10, 5, or 2% of the candidate primers are removed from the library prior to use of the resulting library for multiplex PCR amplification of target loci. In some embodiments, a relatively large number of candidate primers are removed from the library to achieve the desired characteristics for the resulting library. In some embodiments, at least 20, 30, 40, 50, 60, 70, 80, or 90% of the candidate primers are removed from the library prior to use of the resulting library for multiplex PCR amplification of target loci. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers or different primer pairs remain in the library (after removal of some candidate primers from the library).

After the selection process, the primers remaining in the library may be used in any of the methods of the invention. Exemplary Methods for Determining Interaction Scores Exemplary methods of determining a ΔG value (such as the change in Gibbs free energy for primer dimer formation) or an interaction score that indicates the likelihood of dimer formation between candidate primers are described below. In some embodiments, a thermodynamic Nearest-Neighbors approach is used to calculate the likelihood of dimer formation between any two primers (see, e.g., Rahmann and Grafe (2004), "Mean and variance of the Gibbs free energy of oligonucleotides in the nearest neighbor model under varying conditions" Bioinformatics 20, 2928-2933; Allawi, H. T. & SantaLucia, J., Jr. (1998), "Thermodynamics of Internal C-T Mismatches in DNA", *Nucleic Acids Res.* 26, 2694-2701; Peyret, N., Seneviratne, P. A., Allawi, H. T. & SantaLucia, J., Jr. (1999), "Nearest-Neighbor Thermodynamics and NMR of DNA Sequences with Internal A-A, C-C, G-G, and T-T Mismatches", *Biochemistry* 38, 3468-3477; Allawi, H. T. & SantaLucia, J., Jr. (1998), "Nearest-Neighbor Thermodynamics of Internal A-C Mismatches in DNA: Sequence Dependence and pH Effects", *Biochemistry* 37, 9435-9444; Allawi, H. T. & SantaLucia, J., Jr. (1998), "Nearest Neighbor Thermodynamic Parameters for Internal G-A Mismatches in DNA", *Biochemistry* 37, 2170-2179; and Allawi, H. T. & SantaLucia, J., Jr. (1997), "Thermodynamics and NMR of Internal G-T Mismatches in DNA", *Biochemistry* 36, 10581-10594; MultiPLX 2.1 (Kaplinski L, Andreson R, Puurand T, Remm M. MultiPLX: automatic grouping and evaluation of PCR primers. Bioinformatics. 2005 Apr. 15; 21(8):1701-2, which are each hereby incorporated by reference in its entirety).

In some embodiments, the following steps are performed.

Step 1

Figure 33A:
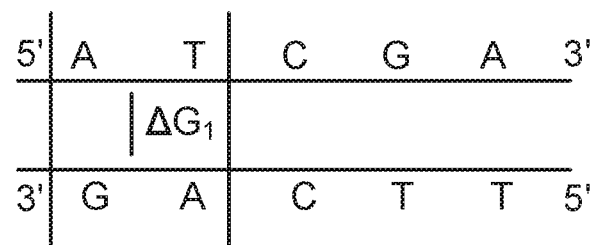

For each primer in a set of candidate primers, compare to every other candidate primer in the following way. Implement an ungapped thermodynamic alignment between the two primers, matching the 5' end of the first primer to the 3' end of the second primer. Taking the first two bases (dinucleotide) that align to the other primer and vice versa, determine the ΔH and ΔS values for the dinucleotide in one primer hybridizing to the dinucleotide in the other primer (see the "AT" hybridizing to "GA" in FIG. 33A). ΔH and ΔS values for various combinations of dinucleotides are known and can be determined, for example, using a thermodynamic look up table (such as the Unified NN model parameters according to Allawi and SantaLucia (1997) "Thermodynamics and NMR of internal G-T mismatches in DNA". *Biochemistry*, 36: 10581-10594, which is hereby incorporated by reference in its entirety). Use the ΔH and ΔS values to calculate ΔG for that interaction as follows or as described in any known equation for this.

$$\Delta G=(1000.0*\Delta H-(\text{temperature}*(\Delta S+0.368*(\text{numPhosphates}/2)*\log(\text{saltConcentration}))))/1000.0$$

Figure 33B:
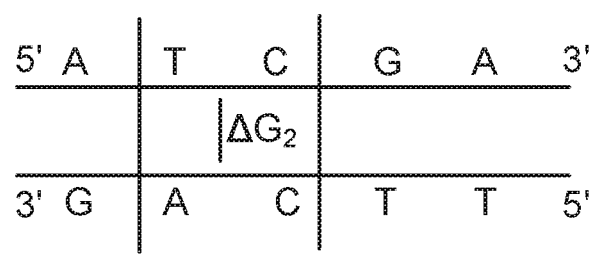

In some embodiments, one or more of the following conditions are assumed for this calculation: temperature: of 60.0° C., primer concentration of 100 nM, or salt concentration of 100 mM. In some embodiments, other conditions are assumed for this calculation, such as the conditions that will be used for multiplex PCR with the pool. Iterate over the remainder of the primer that aligns with the other primer by sliding the bases being observing one base to the right. Continue until ΔG has been calculated for all dinucleotides that align (FIG. 33B). The ΔG for that alignment of the primer pair is the sum of the ΔG values for the various dinucleotides.

Step 2

Shift the alignment of the two primers (FIGS. 33C and 33D).

Step 3

Figure 33E:
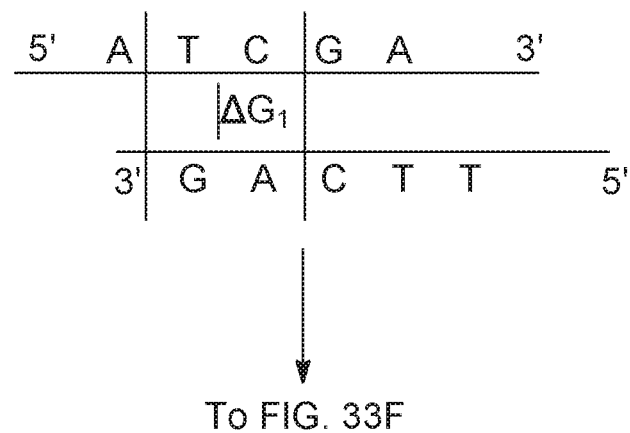
Figure 33F:
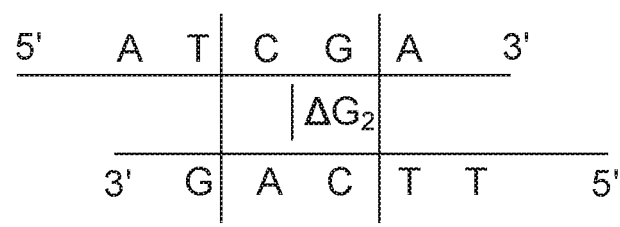

Repeat step 1 again for the new alignment (FIGS. 33E and 33F).

Step 4

After aligning all possible alignments between the two primers, determine the final ΔG value and the interaction score.

In some embodiments, the ΔG value for a combination of primers is the lowest ΔG value (the lowest numerical value, which is indicative of the greatest likelihood of primer dimer formation) out of the ΔG values for all possible alignments between the two primers. For example, if one alignment has a ΔG value of −12 kcal/mol and another alignment has a ΔG value of −2 kcal/mol then −12 kcal/mol (worse value) is used as the ΔG value for that combination of primers.

For algorithms such as the one in Example 16 in which it is easiest to rank primers based on assigning the worse combination of primers (those with the greatest likelihood of dimer formation) the highest interaction score, then the interaction score can be calculated as follows.

$$\text{Interaction score}=\max(-1*\Delta G\text{ value})$$

For example, if one alignment has a ΔG value of −12 kcal/mol and another alignment has a ΔG value of −2 kcal/mol, then 12 kcal/mol is used as the interaction score. In this case, the interaction score with the largest numerical positive number indicates the least desirable combination of primers due to the greatest likelihood of primer dimer formation.

In some embodiments, the interaction score is calculated as follows (this score weights the ΔG values depending on the number of ends that a dimer can be extended by PCR).

$$\text{interaction\_score}=\max(-\text{delta}G\_2,0.8*(-\text{delta}G\_1))$$

where deltaG_2=Gibbs energy (energy required to break the dimer) for a dimer that is extensible by PCR on both ends, i.e., the 3' end of each primer anneals to the other primer; and deltaG_1=Gibbs energy for a dimer that is extensible by PCR on at least one end.

In some embodiments, deltaG_2 is determined by performing steps 1-4 above for all the alignments in which a dimer is extensible by PCR on both ends. The deltaG_2 value is the lowest ΔG value (the lowest numerical value, which is indicative of the greatest likelihood of primer dimer formation) for all the alignments in which a dimer is extensible by PCR on both ends.

In some embodiments, deltaG_1 is determined by performing steps 1-4 above for all the alignments in which a dimer is extensible by PCR on at least one end (such as by PCR on one end or by PCR on both ends). The deltaG_1 value is the lowest ΔG value (the lowest numerical value, which is indicative of the greatest likelihood of primer dimer formation) for all the alignments in which a dimer is extensible by PCR on at least one end.

In some embodiments, possible loop structures or gaps in alignment between primers are also considered.

In some embodiments, ΔG values from step 4 for each possible combination of two primers (each possible primer dimer) in a library are all equal to or greater than −20, −18, −16, −14, −12, −10, −9, −8, −7, −6, −5, −4, −3, −2, or −1 kcal/mol. In some embodiments, ΔG values from step 4 for at least 80, 85, 90, 92, 94, 96, 98, 99, or 100% of the primers in the library for possible combinations of that primer with other primers in the library are all equal to or greater than −20, −18, −16, −14, −12, −10, −9, −8, −7, −6, −5, −4, −3, −2, or −1 kcal/mol. In some embodiments, possible combinations of two primers in a library that have positive ΔG values are ignored since these values are indicative of no likelihood to for primer dimers. In some embodiments for the possible combination of two primers in a library that have negative ΔG values, the ΔG values are between −20 and 0 kcal/mol, such as between −15 and 0 kcal/mol, −10 and 0 kcal/mol, −8 and 0 kcal/mol, −7 and 0 kcal/mol, −6 and 0 kcal/mol, −5.5 and 0 kcal/mol, −5 and 0 kcal/mol, −4.5 and 0 kcal/mol, −4 and 0 kcal/mol, −3.5 and 0 kcal/mol, −3 and 0 kcal/mol, −2.5 and 0 kcal/mol, −2 and 0 kcal/mol, or −1.5 and 0 kcal/mol, inclusive.

In some embodiments, the interaction scores from step 4 for each possible combination of two primers in a library are all equal to or less than 20, 18, 16, 14, 12, 10, 9, 8, 7, 6, 5, 4, 3, 2, or 1 kcal/mol. In some embodiments, the interaction scores from step 4 for at least 80, 85, 90, 92, 94, 96, 98, 99, or 100% of the primers in the library for possible combinations of that primer with other primers in the library are all equal to or less than 20, 18, 16, 14, 12, 10, 9, 8, 7, 6, 5, 4, 3, 2, or 1 kcal/mol. In some embodiments, possible combination of two primers in a library that have negative interaction scores are ignored since these values are indicative of no likelihood to for primer dimers. In some embodiments for the possible combination of two primers in a library that have positive interaction scores, the interaction scores are between 20 and 0 kcal/mol, such as between 15 and 0 kcal/mol, 10 and 0 kcal/mol, 8 and 0 kcal/mol, 7 and 0 kcal/mol, 6 and 0 kcal/mol, 5.5 and 0 kcal/mol, 5 and 0 kcal/mol, 4.5 and 0 kcal/mol, 4 and 0 kcal/mol, 3.5 and 0 kcal/mol, 3 and 0 kcal/mol, 2.5 and 0 kcal/mol, 2 and 0 kcal/mol, or 1.5 and 0 kcal/mol, inclusive.

In some embodiments, the score (such as the undesirability score) for candidate primers is based at least in part on the ΔG value or the interaction score that indicates the likelihood of dimer formation between candidate primers as calculated using any of these methods.

Exemplary Primer Libraries

In one aspect, the invention features libraries of primers, such as primers selected from a library of candidate primers using any of the methods of the invention. In some embodiments, the library includes primers that simultaneously hybridize (or are capable of simultaneously hybridizing) to or that simultaneously amplify (or are capable of simultaneously amplifying) at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci in one reaction volume. In various embodiments, the library includes primers that simultaneously amplify (or are capable of simultaneously amplifying) between 1,000 to 2,000; 2,000 to 5,000; 5,000 to 7,500; 7,500 to 10,000; 10,000 to 20,000; 20,000 to 25,000; 25,000 to 30,000; 30,000 to 40,000; 40,000 to 50,000; 50,000 to 75,000; or 75,000 to 100,000 different target loci in one reaction volume, inclusive. In various embodiments, the library includes primers that simultaneously amplify (or are capable of simultaneously amplifying) between 1,000 to 100,000 different target loci in one reaction volume, such as between 1,000 to 50,000; 1,000 to 30,000; 1,000 to 20,000; 1,000 to 10,000; 2,000 to 30,000; 2,000 to 20,000; 2,000 to 10,000; 5,000 to 30,000; 5,000 to 20,000; or 5,000 to 10,000 different target loci, inclusive. In some embodiments, the library includes primers that simultaneously amplify (or are capable of simultaneously amplifying) the target loci in one reaction volume such that less than 60, 40, 30, 20, 10, 5, 4, 3, 2, 1, 0.5, 0.25, 0.1, or 0.5% of the amplified products are primer dimers. The various embodiments, the amount of amplified products that are primer dimers is between 0.5 to 60%, such as between 0.1 to 40%, 0.1 to 20%, 0.25 to 20%, 0.25 to 10%, 0.5 to 20%, 0.5 to 10%, 1 to 20%, or 1 to 10%, inclusive. In some embodiments, the primers simultaneously amplify (or are capable of simultaneously amplifying) the target loci in one reaction volume such that at least 50, 60, 70, 80, 90, 95, 96, 97, 98, 99, or 99.5% of the amplified products are target amplicons. In various embodiments, the amount of amplified products that are target amplicons is between 50 to 99.5%, such as between 60 to 99%, 70 to 98%, 80 to 98%, 90 to 99.5%, or 95 to 99.5%, inclusive. In some embodiments, the primers simultaneously amplify (or are capable of simultaneously amplifying) the target loci in one reaction volume such that at least 50, 60, 70, 80, 90, 95, 96, 97, 98, 99, or 99.5% of the target loci are amplified. In various embodiments, the amount target loci that are amplified is between 50 to 99.5%, such as between 60 to 99%, 70 to 98%, 80 to 99%, 90 to 99.5%, 95 to 99.9%, or 98 to 99.99% inclusive. In some embodiments, at least 50, 60, 70, 80, 90, 95, 96, 97, 98, 99, or 99.5% of the target loci are amplified at least 5, 10, 20, 40, 50, 60, 80, 100, 120, 150, 200, 300, or 400-fold. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 primer pairs, wherein each pair of primers includes a forward test primer and a reverse test primer where each pair of test primers hybridize to a target locus. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 individual primers that each hybridize to a different target locus, wherein the individual primers are not part of primer pairs.

In some embodiments, the library includes primers (such as at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers or different primer pairs) that simultaneously amplify (or are capable of simultaneously amplifying) the target loci (such as at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci) in one reaction volume such that one or more of the following: (i) less than 60, 40, 30, 20, 10, 5, 4, 3, 2, 1, 0.5, 0.25, 0.1, or 0.5% of the amplified products are primer dimers, (ii) at least 50, 60, 70, 80, 90, 95, 96, 97, 98, 99, or 99.5% of the amplified products are target amplicons, (iii) at least 50, 60, 70, 80, 90, 95, 96, 97, 98, 99, or 99.5% of the target loci are amplified, (iv) at least 50, 60, 70, 80, 90, 95, 96, 97, 98, 99, or 99.5% of the target loci are amplified at least 5, 10, 20, 40, 50, 60, 80, 100, 120, 150, 200, 300, or 400-fold, (v) at least 60, 70, 80, 90, 95, 96, 97, 98, 99, 99.5, or 100% of the amplified products map to the human genome, or (vi) any combination thereof.

In some embodiments, the library includes at least 1,000 different primers or different primer pairs (such as at least 2,000; 5,000; 7,500; 10,000; 15,000; 19,000; 20,000; 25,000; 27,000; 28,000; 30,000; 40,000; 50,000; 75,000; or 100,000 different primers or different primer pairs) that simultaneously amplify (or are capable of simultaneously amplifying) at least 1,000 different target loci (such as at least 2,000; 5,000; 7,500; 10,000; 15,000; 19,000; 20,000; 25,000; 27,000; 28,000; 30,000; 40,000; 50,000; 75,000; or 100,000 different target loci) in one reaction volume such that one or more of the following: (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments for the amplification of nucleic acids (such as DNA or RNA) from a single cell (such as a fetal or embryonic cell), the library includes at least 1,000 different primers or different primer pairs (such as at least 2,000; 5,000; 7,500; 10,000; 15,000; 19,000; 20,000; 25,000; 27,000; 28,000; 30,000; 40,000; 50,000; 75,000; or 100,000 different primers or different primer pairs) that simultaneously amplify (or are capable of simultaneously amplifying) at least 1,000 different target loci (such as at least 2,000; 5,000; 7,500; 10,000; 15,000; 19,000; 20,000; 25,000; 27,000; 28,000; 30,000; 40,000; 50,000; 75,000; or 100,000 different target loci) in one reaction volume such that one or more of the following: (i) less than 60% of the amplified products are primer dimers and at least 10% of the amplified products are target amplicons, (ii) less than 40% of the amplified products are primer dimers and at least 10% of the amplified products are target amplicons, (iii) less than 20% of the amplified products are primer dimers and at least 10% of the amplified products are target amplicons, (iv) less than 10% of the amplified products are primer dimers and at least 10% of the amplified products are target amplicons, (v) less than 5% of the amplified products are primer dimers and at least 15% of the amplified products are target amplicons; (vi) less than 60% of the amplified products are primer dimers and at least 20% of the amplified products are target amplicons, (vii) less than 40% of the amplified products are primer dimers and at least 20% of the amplified products are target amplicons, (viii) less than 20% of the amplified products are primer dimers and at least 20% of the amplified products are target amplicons, (ix) less than 10% of the amplified products are primer dimers and at least 20% of the amplified products are target amplicons, (x) less than 5% of the amplified products are primer dimers and at least 20% of the amplified products are target amplicons; (xi) less than 60% of the amplified products are primer dimers and at least 40% of the amplified products are target amplicons, (xii) less than 40% of the amplified products are primer dimers and at least 40% of the amplified products are target amplicons, (xiii) less than 20% of the amplified products are primer dimers and at least 40% of the amplified products are target amplicons, (xiv) less than 10% of the amplified products are primer dimers and at least 40% of the amplified products are target amplicons, (xv) less than 5% of the amplified products are primer dimers and at least 45% of the amplified products are target amplicons; (xvi) less than 40% of the amplified products are primer dimers and at least 60% of the amplified products are target amplicons, (xvii) less than 20% of the amplified products are primer dimers and at least 80% of the amplified products are target amplicons, (xviii) less than 10% of the amplified products are primer dimers and at least 90% of the amplified products are target amplicons, or (xviiii) less than 5% of the amplified products are primer dimers and at least 95% of the amplified products are target amplicons. In some embodiments, at least 50, 60, 70, 80, 90, 95, 96, 97, 98, 99, or 99.5% of the target loci are amplified at least 5, 10, 20, 40, 50, 60, 80, 100, 120, 150, 200, 300, or 400-fold. In some embodiments, one or more of these embodiments (e.g., percent of primer dimers, target amplicons, or amplified target loci) is achieved after greater than or equal to 5, 10, 20, 30, 40, 50, or 60 cycles of PCR are performed. In some embodiments for a library that amplifies human target loci, at least 60, 70, 80, 90, 95, 96, 97, 98, 99, 99.5, or 100% of the amplified products map to the human genome.

In various embodiments, the concentration of each primer is less than 100, 75, 50, 25, 20, 10, 5, 2, 1, 0.5, 0.1, or 0.05 nM, or less than 500, 100, 10, or 1 uM. In various embodiments, the concentration of each primer is between 1 uM to 100 nM, such as between 1 uM to 1 nM, 1 to 75 nM, 1 to 20 nM, 1 to 10 nM, 2 to 50 nM or 5 to 50 nM, inclusive. In some embodiments, the concentration of one or more universal primers is between 0.2 to 3 µM, such as between 0.5 and 2.5 µM, 0.5 to 1 µM, or 1 to 2.5 µM per primer, inclusive, and the concentration of each primer except the universal primer(s) is between 1 uM to 100 nM, such as between 1 uM to 1 nM, 1 to 75 nM, 1 to 20 nM, 1 to 10 nM, 2 to 50 nM or 5 to 50 nM, inclusive. In various embodiments, the GC content of the primers is between 30 to 80%, such as between 20 to 70%, 40 to 70%, or 50 to 60%, inclusive. In some embodiments, the range of GC content of the primers is less than 30, 20, 10, or 5%. In some embodiments, the range of GC content of the primers is between 5 to 30%, such as 5 to 20% or 5 to 10%, inclusive. In some embodiments, there is a high GC content in the 3' end of the primers. In some embodiments, there are at least 2 (such as 3, 4, or 5) guanines or cytosines in the last 5 bases at the 3' end of the primers. In some embodiments, there are at least 1 (such as 2 or 3) guanines or cytosines in the last 3 bases at the 3' end of the primers. In some embodiments, a maximum of 2 (such as 2, 1, or 0) bases in the last 5 bases at the 3' end of the primers are guanines or cytosines. In some embodiments, a maximum of 1 (such as 1 or 0) base in the last 5 bases at the 3' end of the primers is a guanine or cytosine. In some embodiments, the maximum length of a homopolymer (the same base in a row) in the primers is 12, 10, 8, 6, 5, 4, 3, or 2 consecutive nucleotides. In some embodiments, the melting temperature ($T_m$) of the test primers is between 40 to 80° C., such as 50 to 70° C., 55 to 65° C., 54 to 60.5° C., or 57 to 60.5° C., inclusive. In some embodiments, the $T_m$ is calculated using the Primer3 program (libprimer3 release 2.2.3) using the built-in SantaLucia parameters (the World Wide Web at primer3.sourceforge.net). In some embodiments, the range of melting temperature of the primers is less than 15, 10, 5, 3, or 1° C. In some embodiments, the range of melting temperature of the primers is between 1 to 15° C., such as between 1 to 10° C., 1 to 5° C., or 1 to 3° C., inclusive. In some embodiments, the range of melting temperatures of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the primers is between 1 to 15° C., such as between 1 to 10° C., 1 to 5° C., 1 to 3° C., 2 to 5° C., 3 to 10° C., or 3 to 5° C., inclusive. In some embodiments, the length of the primers is between 15 to 100 nucleotides, such as between 15 to 75 nucleotides, 15 to 40 nucleotides, 17 to 35 nucleotides, 18 to 30 nucleotides, 20 to 65 nucleotides, inclusive. In some embodiments, the range of the length of the primers is less than 50, 40, 30, 20, 10, or 5 nucleotides. In some embodiments, the range of the length of the primers is between 5 to 50 nucleotides, such as 5 to 40 nucleotides, 5 to 20 nucleotides, or 5 to 10 nucleotides, inclusive. In some embodiments, the length of the target amplicons is between 50 and 100 nucleotides, such as between 60 and 80 nucleotides, or 60 to 75 nucleotides, inclusive. In some embodiments, the length of the target amplicons is between 30 and 400 nucleotides, such as between 30 and 200 nucleotides, or 100 and 400 nucleotides, inclusive. In some embodiments, the length of the target amplicons is at least 100; 200; 300; 400; 500; 600; 700; 800; 900; 1,000; 1,200; 1,500; 2,000; or 3,000 nucleotides. In some embodiments, the length of the target amplicons is between 100 and 1,500 nucleotides, such as between 100 to 1,000; 100 to 500, 500 to 750, or 750 to 1,000 nucleotides, inclusive. Longer amplicons may be desirable, e.g., for applications in which is it desirable to screen for multiple potential mutations in one amplicon, such as carrier screening. In some embodiments, one round of PCR is performed to produce relatively long amplicons (such as at least 250 or 500 nucleotides in length) and then a second round of PCR is performed to produce shorter amplicons (to amplify regions within the amplicons amplified in the first round of PCR, such as regions of less than 200 or 100 nucleotides in length). In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 or all of the target amplicons have a length that falls within the range of the average length of the amplicons ±5% of the average length, average length ±20%, average length ±20%, or average length ±30%, or average length ±50%.

In some embodiments, library includes at least at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers that each includes a target specific sequence, such as a sequence that binds a target locus but does not substantially bind to other nucleic acids (such as non-target loci) in a sample, e.g., a biological sample, which naturally includes other nucleic acids. In some embodiments, each primer binds and amplifies a target locus by at least 2, 4, 6, 8, 10, 20, 50-fold or more than one or more (or all) other nucleic acids (such as non-target loci) in a sample. In some embodiments, the library includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target specific primers (e.g., primers that are specific for a target locus). In some embodiments, part or all of the polynucleotide sequence is a non-random sequence for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers in the library. In some embodiments, library also includes a universal primer, a random primer, and a primer with a non-naturally occurring polynucleotide sequence, or a primer with a polynucleotide sequence not naturally found in a human in some embodiments, the universal or random primer has a non-naturally occurring polynucleotide sequence or a polynucleotide sequence not naturally found in a human.

In some embodiments, the composition includes at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with a polynucleotide sequence of a human nucleic acid and at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with a polynucleotide sequence that is not found in a human (such as a universal primer, a primer that comprises a region or consists entirely of random nucleotides, or a primer with a region such as a tag or barcode of one or more nucleotides that are not found in a human or are not found in nature as part of the polynucleotide sequence of the primer). In some embodiments, at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) includes a region of one or more nucleotides that is not naturally part of the primer sequence (such as a region added to the 5' end of the target specific sequence in the primer or an internal region added between the 5' and 3' ends of the primer). In some embodiments, the primer is free of the nucleic acids (such as genes) which, in the naturally-occurring genome of the organism from which the nucleic acid of the invention is derived, flank the gene. In some embodiments, the primer has been separated from one or more components that naturally accompany the corresponding sequence in nature (such as in the genome of a human). Typically, each primer is at least 90, 95, 98, 99, 99.9, or 100%, by weight, free from the molecules (such as proteins, nucleic acids, and naturally-occurring organic molecules) that naturally accompany the corresponding sequence in nature (such as in the genome of a human). Purity can be assayed by any appropriate method, e.g., by electrophoresis or HPLC analysis.

In some embodiments, the primers in the library are not immobilized (such as not immobilized to a solid support) or not part of a microarray. In some embodiments, the primers are dissolved in solution (such as dissolved in the liquid phase). In some embodiments, the library comprises a microarray. In some embodiments, the amplified products are detected using an array, such as an array with probes to one or more chromosomes of interest (e.g., chromosome 13, 18, 21, X, Y, or any combination thereof).

In some embodiments, at least one of the primers (such as at least 20, 40, 80, 90, 95, 98, 99, 99.5, or 100% of the primers) in a library are nucleic acid analogs that have a lower likelihood of primer dimerization compared to the naturally-occurring nucleic acids (see, e.g., U.S. Pat. Nos. 7,414,118 and 6,001,611; which are each hereby incorporated by reference in its entirety). Exemplary nucleic acid analogs have a modified pyrimidine nucleobase, or a purine or pyrimidine base that contains an exocyclic amine.

In some embodiments, the primer library includes a small number of primers (such as less than 5, 2, 1, or 0.5% of the primers in the library) that do not have one or more of the properties described herein. In various embodiments, at least 80, 90, 95, 96, 97, 98, 99, 99.5, or 100% of the primers in the library have one or more of the following properties: (i) $\Delta G$ values for possible combinations of that primer with other primers in the library are all equal to or greater than $-20, -18, -16, -14, -12, -10, -9, -8, -7, -6, -5, -4, -3, -2$, or $-1$ kcal/mol; (ii) $\Delta G$ values for the possible combination of that primer with other primers in the library that have negative $\Delta G$ are between $-20$ and $0$ kcal/mol, such as between $-15$ and $0$ kcal/mol, $-10$ and $0$ kcal/mol, $-8$ and $0$ kcal/mol, $-7$ and $0$ kcal/mol, $-6$ and $0$ kcal/mol, $-5.5$ and $0$ kcal/mol, $-5$ and $0$ kcal/mol, $-4.5$ and $0$ kcal/mol, $-4$ and $0$ kcal/mol, $-3.5$ and $0$ kcal/mol, $-3$ and $0$ kcal/mol, $-2.5$ and $0$ kcal/mol, $-2$ and $0$ kcal/mol, or $-1.5$ and $0$ kcal/mol, inclusive; (iii) the GC content is between 30 to 80%, such as between 20 to 70%, 40 to 70%, or 50 to 60%, inclusive; (iv) the range of GC content is less than 30, 20, 10, or 5% or the range of GC content of the primers is between 5 to 30%, such as 5 to 20%, or 5 to 10%, inclusive; (v) a maximum of 2 (such as 2, 1, or 0) bases in the last 5 bases at the 3' end of the primers are guanines or cytosines; (vi) the melting temperature ($T_m$) of the primers is between 40 to 80° C., such as 50 to 70° C., 55 to 65° C., 54 to 60.5° C., or 57 to 60.5° C., inclusive; (vii) the range of melting temperature of the primers is less than 15, 10, 5, 3, or 1° C.; (viii) the range of melting temperature of the primers is between 1 to 15° C., such as between 1 to 10° C., 1 to 5° C., 1 to 3° C., 2 to 5° C., 3 to 10° C., or 3 to 5° C., inclusive; (ix) the length of the primers is between 15 to 100 nucleotides, such as between 15 to 75 nucleotides, 15 to 40 nucleotides, 17 to 35 nucleotides, 18 to 30 nucleotides, or 20 to 65 nucleotides, inclusive; (x) the range of the length of the primers is less than 50, 40, 30, 20, 10, or 5 nucleotides; (xi) the range of the length of the primers is between 5 to 50 nucleotides, such as 5 to 40 nucleotides, 5 to 20 nucleotides, or 5 to 10 nucleotides, (xii) the length of the target amplicons is between 50 and 100 nucleotides, such as between 60 and 80 nucleotides, or 60 to 75 nucleotides; (xiii) the length of the target amplicons is between 30 and 400 nucleotides, such as between 30 and 200 nucleotides, or 100 and 400 nucleotides; (xiv) the range of the length of the target amplicons is less than 50, 25, 15, 10, or 5 nucleotides; (xv) the range of the length of the target amplicons is between 5 to 50 nucleotides, such as 5 to 25 nucleotides, 5 to 15 nucleotides, or 5 to 10 nucleotides; (xvi) the maximum length of a homopolymer in the primers is 12, 10, 8, 6, 5, 4, 3, or 2 consecutive nucleotides; (xvii) the concentration of each primer is less than 100, 75, 50, 25, 20, 10, 5, 2, 1, 0.5, 0.1, or 0.05 nM, or less than 500, 100, 10, or 1 uM; (xviii) the concentration of each primer is between 1 uM to 100 nM, such as between 1 uM to 1 nM, 1 to 75 nM, 1 to 20 nM, 1 to 10 nM, 2 to 50 nM, or 5 to 50 nM, inclusive; (xix) at least 80, 90, 92, 94, 96, 98, 99, or 100% of the molecules of that primer are extended to form amplified products; (xx) SNPs (if any) are not in the last 5 nucleotides in the 3' end of the candidate primer; (xxi) the target bases (the bases of interest in a target locus) are near an end (the 3' or 5' end) of the amplicon; (xxii) the region of hybridization is separated from the polymorphic site by a small number of bases, where the small number is selected from the group consisting of 1, 2, 3, 4, 5, 6 to 10, 11 to 15, 16 to 20, 21 to 25, 26 to 30, and 31 to 60; (xxiii) the length of the annealing step is greater than 1, 3, 5, 8, 10, 15, 20, 30, 45, 60, 75, 90, 120, 150, or 180 minutes, (xxiv) the length of the annealing step (per PCR cycle) is between 5 and 180 minutes, such as 5 to 60, 10 to 60, 5 to 30, or 10 to 30 minutes, inclusive, (xxv) the length of the annealing step is greater than 5 minutes (such greater than 10, or 15 minutes), and the concentration of each primer is less than 20 nM, (xxvi) the length of the annealing step is greater than 5 minutes (such greater than 10, or 15 minutes), and the concentration of each primer is between 1 to 20 nM, or 1 to 10 nM, inclusive; (xxvii) the length of the annealing step is greater than 20 minutes (such as greater than 30, 45, 60, or 90 minutes), and the concentration of each primer is less than 1 nM; (xxviii) the annealing temperature is at least 1, 2, 3, 4, 5, 6, 7, 8, 9, 10, 11, 12, 13, or 15° C. greater than the melting temperature (such as the empirically measured or calculated $T_m$) of the primers; (xxix) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of the primers; (xxx) the annealing temperature is at least 1, 2, 3, 4, 5, 6, 7, 8, 9, 10, 11, 12, 13, or 15° C. greater than the highest melting temperature of the primers; (xxxi) the annealing temperature is at least 1, 2, 3, 4, 5, 6, 7, 8, 9, 10, 11, 12, 13, or 15° C. greater than the average melting temperature of the primers, (xxxii) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature of the primers; and (xxviii) any combination thereof. In various embodiments, at least 80, 90, 95, 96, 97, 98, 99, 99.5, or 100% of the primers in the library have one or more of the following properties: (i) ΔG values for possible combinations of that primer with other primers in the library are all equal to or greater than −20, −18, −16, −14, −12, −10, −9, −8, −7, −6, −5, −4, −3, −2, or −1 kcal/mol; (ii) ΔG values for the possible combination of that primer with other primers in the library that have negative ΔG are between −20 and 0 kcal/mol, such as between −15 and 0 kcal/mol, −10 and 0 kcal/mol, −8 and 0 kcal/mol, −7 and 0 kcal/mol, −6 and 0 kcal/mol, −5.5 and 0 kcal/mol, −5 and 0 kcal/mol, −4.5 and 0 kcal/mol, −4 and 0 kcal/mol, −3.5 and 0 kcal/mol, −3 and 0 kcal/mol, −2.5 and 0 kcal/mol, −2 and 0 kcal/mol, or −1.5 and 0 kcal/mol, inclusive; (iii) the melting temperature ($T_m$) of the primers is between 40 to 80° C., such as 50 to 70° C., 55 to 65° C., 54 to 60.5° C., or 57 to 60.5° C., inclusive; (iv) the range of melting temperature of the primers is less than 15, 10, 5, 3, or 1° C.; (v) the range of melting temperature of the primers is between 1 to 15° C., such as between 1 to 10° C., 1 to 5° C., 1 to 3° C., 2 to 5° C., 3 to 10° C., or 3 to 5° C., inclusive; (vi) the length of the target amplicons is between 50 and 100 nucleotides, such as between 60 and 80 nucleotides, or 60 to 75 nucleotides; (vii) the length of the target amplicons is between 30 and 400 nucleotides, such as between 30 and 200 nucleotides, or 100 and 400 nucleotides; (viii) the range of the length of the target amplicons is less than 50, 25, 15, 10, or 5 nucleotides; (ix) the range of the length of the target amplicons is between 5 to 50 nucleotides, such as 5 to 25 nucleotides, 5 to 15 nucleotides, or 5 to 10 nucleotides; (x) the concentration of each primer is less than 100, 75, 50, 25, 20, 10, 5, 2, 1, 0.5, 0.1, or 0.05 nM, or less than 500, 100, 10, or 1 uM; (xi) the concentration of each primer is between 1 uM to 100 nM, such as between 1 uM to 1 nM, 1 to 75 nM, 1 to 20 nM, 1 to 10 nM, 2 to 50 nM, or 5 to 50 nM, inclusive; (xii) the annealing temperature is at least 1, 2, 3, 4, 5, 6, 7, 8, 9, 10, 11, 12, 13, or 15° C. greater than the melting temperature (such as the empirically measured or calculated $T_m$) of the primers; (xiii) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of the primers; (xiv) the annealing temperature is at least 1, 2, 3, 4, 5, 6, 7, 8, 9, 10, 11, 12, 13, or 15° C. greater than the highest melting temperature of the primers; (xv) the annealing temperature is at least 1, 2, 3, 4, 5, 6, 7, 8, 9, 10, 11, 12, 13, or 15° C. greater than the average melting temperature of the primers, (xvi) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature of the primers; and (xvii) any combination thereof.

In various embodiments, at least 80, 90, 95, 96, 97, 98, 99, 99.5, or 100% of the primers in the library have one or more of the following properties: (i) ΔG values for possible combinations of that primer with other primers in the library are all equal to or greater than −10 kcal/mol, (ii) the range of melting temperature of the primers is between 1 to 15° C., (iii) the length of the target amplicons is between 50 and 100 nucleotides, (iv) the concentration of each primer is less than 20 nM, (v) the length of the annealing step is greater than 5 minutes (such as greater than 10 minutes), (vi) the length of the annealing step is greater than 5 minutes (such greater than 10 minutes), and the concentration of each primer is less than 20 nM, and (vii) any combination thereof. In various embodiments, at least 80, 90, 95, 96, 97, 98, 99, 99.5, or 100% of the primers in the library have the following properties: (i) ΔG values for possible combinations of that primer with other primers in the library are all equal to or greater than −10 kcal/mol and (ii) the range of melting temperature of the primers is between 1 to 15° C. In various embodiments, at least 80, 90, 95, 96, 97, 98, 99, 99.5, or 100% of the primers in the library have the following properties: (i) the length of the target amplicons is between 50 and 100 nucleotides, and (ii) the concentration of each primer is less than 20 nM. In various embodiments, at least 80, 90, 95, 96, 97, 98, 99, 99.5, or 100% of the primers in the library have the following properties: (i) the length of the target amplicons is between 50 and 100 nucleotides and (ii) the length of the annealing step is greater than 5 minutes (such as greater than 10 minutes). In various embodiments, at least 80, 90, 95, 96, 97, 98, 99, 99.5, or 100% of the primers in the library have the following properties: (i) the length of the target amplicons is between 50 and 100 nucleotides, (ii) the length of the annealing step is greater than 5 minutes (such greater than 10 minutes), and (iii) the concentration of each primer is less than 20 nM, and (vii) any combination thereof.

In various embodiments, at least 80, 90, 95, 96, 97, 98, 99, 99.5, or 100% of the primers in the library have one or more of the following properties: (i) the annealing temperature is at least 5° C. (such as at least 6, 8, or 10° C.) greater than the melting temperature (such as the empirically measured or calculated $T_m$) of the primers; (ii) the annealing temperature is between 5 and 15° C., inclusive greater than the melting temperature of the primers; (iii) the annealing temperature is at least 5° C. (such as at least 6, 8, or 10° C.) greater than the highest melting temperature of the primers; (iv) the annealing temperature is at least 5° C. (such as at least 6, 8, or 10° C.) greater than the average melting temperature of the primers, (v) the annealing temperature is between 4 and 15° C. inclusive greater than the average melting temperature of the primers; and (vi) any combination thereof. In various embodiments, at least 80, 90, 95, 96, 97, 98, 99, 99.5, or 100% of the primers in the library have one or more of the following properties: (i) the annealing temperature is at least 5° C. (such as at least 6, 8, or 10° C.) greater than the melting temperature (such as the empirically measured or calculated $T_m$) of the primers and the length of the annealing step is greater than 5 minutes (such greater than 10 minutes); (ii) the annealing temperature is between 5 and 15° C., inclusive greater than the melting temperature of the primers and the length of the annealing step is greater than 5 minutes (such greater than 10 minutes); (iii) the annealing temperature is at least 5° C. (such as at least 6, 8, or 10° C.) greater than the highest melting temperature of the primers and the length of the annealing step is greater than 5 minutes (such greater than 10 minutes); (iv) the annealing temperature is at least 5° C. (such as at least 6, 8, or 10° C.) greater than the average melting temperature of the primers and the length of the annealing step is greater than 5 minutes (such greater than 10 minutes), (v) the annealing tempera-ture is between 4 and 15° C. inclusive greater than the average melting temperature of the primers and the length of the annealing step is greater than 5 minutes (such greater than 10 minutes); and (vii) any combination thereof. In some embodiments, the guanine-cytosine (GC) content of the primers is between 30% and 80%, inclusive; the range of melting temperatures of the primers is less than 5° C.; and the length of the primers is between 15 to 75 nucleotides, inclusive;

In some embodiments, some (such as at least 80, 90, or 95%) or all of the adaptors or primers include one or more linkages between adjacent nucleotides other than a naturally-occurring phosphodiester linkage. Examples of such linkages include phosphoramide, phosphorothioate, and phosphorodithioate linkages. In some embodiments, some (such as at least 80, 90, or 95%) or all of the adaptors or primers include a thiophosphate (such as a monothiophosphate) between the last 3' nucleotide and the second to last 3' nucleotide. In some embodiments, some (such as at least 80, 90, or 95%) or all of the adaptors or primers include a thiophosphate (such as a monothiophosphate) between the last 2, 3, 4, or 5 nucleotides at the 3' end. In some embodiments, some (such as at least 80, 90, or 95%) or all of the adaptors or primers include a thiophosphate (such as a monothiophosphate) between at least 1, 2, 3, 4, or 5 nucleotides out of the last 10 nucleotides at the 3' end. In some embodiments, such primers are less likely to be cleaved or degraded, such primers may be desirable if a polymerase with proof-reading ability is used (to reduce or prevent the polymerase from removing nucleotides from the primers). In some embodiments, any of the embodiments involving primers with at least one linkage other than a naturally-occurring phosphodiester linkage are used with a polymerase having proof-reader activity. In some embodiments, the primers do not contain an enzyme cleavage site (such as a protease cleavage site). In some embodiments, equal to or greater than 1, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 primers in the library are non-naturally occurring nucleic acids (such nucleic acids with one or more linkages between adjacent nucleotides other than a naturally-occurring phosphodiester linkage).

In some embodiments, the primers have any combination of two or more of the aspects or embodiments disclosed herein.

These primer libraries can be used in any of the methods of the invention.

Exemplary Primers

The primer design methods of the invention have been used to generate several exemplary primer libraries to human target loci. For example, the primer design methods of the invention were used to generate primer libraries. Each of these libraries is composed of three primers per target locus for 1,200; 2,686; or 10,984 different target loci, respectively. The methods of the invention can also be used to generate libraries to non-human target loci.

For an experiment using the 2,686-plex library for multiplex PCR followed by sequencing, the percent of the amplified products that were primer dimers was 11.13%, the median depth of read per target that was amplified was 799.5× coverage, the percent of amplified products that were target amplicons out of the amplified products that were not primer dimers was 93.15% (this is the percent of on target reads when reads for amplified primer dimers are ignored); the number of target loci that were not amplified (failed assay count) was 246; the percent of target loci that were not amplified (failed assay percentage) was 9.16%; the percent of target loci that were amplified was 90.84%; and the total number of reads was 2,522,742. For this primer library, the ΔG values for each possible combination of two primers (each possible primer dimer) in the library are all equal to or greater than −3.86 kcal/mol. This −3.86 kcal/mol value was used as a threshold value to select candidate primers that all had a value equal to or greater than (more desirable than) this value from an initial library of candidate primers.

For an experiment using the 10,984-plex library for multiplex PCR followed by sequencing, the percent of the amplified products that were primer dimers was 5.50%, the median depth of read per target that was amplified was 1,286.5× coverage, the percent of amplified products that were target amplicons out of the amplified products that were not primer dimers was 60.16% (this is the percent of on target reads when reads for amplified primer dimers were ignored); the number of target loci that were not amplified (failed assay count) was 3,712; the percent of target loci that were not amplified (failed assay percentage) was 33.79%; the percent of target loci that were amplified was 66.21%; and the total number of reads was 25,372,858.

For an experiment using the 1,200-plex library for multiplex PCR of a sample of only a single cell followed by sequencing, the percent of the amplified products that were primer dimers was 24.13%. This library has primers to human target loci on chromosome 1, chromosome 21, and the X chromosome. For chromosomes 1 and 21, the median depth of read per target that was amplified was 436× coverage; the percent of target loci that were not amplified (failed assay percentage) was 32.69%; and the percent of target loci that were amplified was 67.31%. The total number of reads was 808,106.

The primer design methods of the invention were also used to generate a library for ~11,000 different target loci (such as amplifying 10,732 different target human loci using 10,732 different primer pairs). For an experiment using this library for multiplex PCR followed by sequencing, the percent of the amplified products that were primer dimers was 14.75%, the median depth of read per target that was amplified was 72.27× coverage, the percent of the amplified products that were target amplicons was 84.32%; the number of target loci that were not amplified (failed assay count) was 118; the percent of target loci that were not amplified (failed assay percentage) was 1.10%; the percent of target loci that were amplified was 98.9%; and the total number of reads was 6,345,782. For this primer library, the ΔG values for each possible combination of two primers (each possible primer dimer) in the library are all equal to or greater than −4.28 kcal/mol. This −4.28 kcal/mol value was used as a threshold value to select candidate primer that all had a value equal to or greater than (more desirable than) this value from an initial library of candidate primers. For the initial candidate primers that were used to select primers for this library, the following interaction cost histogram shows the number of candidate primers for each of the following ranges of ΔG values. This illustrates how the values for the candidate primers compares to the −4.28 kcal/mol threshold value for the final library.

0 to −0.497 kcal/mol: 88357
−0.497 to −0.993 kcal/mol: 30529
−0.993 to −1.49 kcal/mol: 7862
−1.49 to −1.99 kcal/mol: 2639
−1.99 to −2.48 kcal/mol: 1086
−2.48 to −2.98 kcal/mol: 393
−2.98 to −3.48 kcal/mol: 148
−3.48 to −3.97 kcal/mol: 58
−3.97 to −4.47 kcal/mol: 18
−4.47 to −4.97 kcal/mol: 4
−4.97 to −5.46 kcal/mol: 3
−5.46 to −5.96 kcal/mol: 0
−5.96 to −6.46 kcal/mol: 2
−6.46 to −6.95 kcal/mol: 3

The primer design methods of the invention were also used to generate a library for ~14,000 different target loci (such as amplify 13,392 different target human loci with 13,392 different primer pairs). For an experiment using this library for multiplex PCR followed by sequencing, the percent of the amplified products that were primer dimers was 0.56%, the median depth of read per target that was amplified was 69.09× coverage, the percent of the amplified products that were target amplicons was 99.42%; the number of target loci that were not amplified (failed assay count) was 44; the percent of target loci that were not amplified (failed assay percentage) was 0.33%; the percent of target loci that were amplified was 99.67%; and the total number of reads was 7,772,454.

Figure 35:
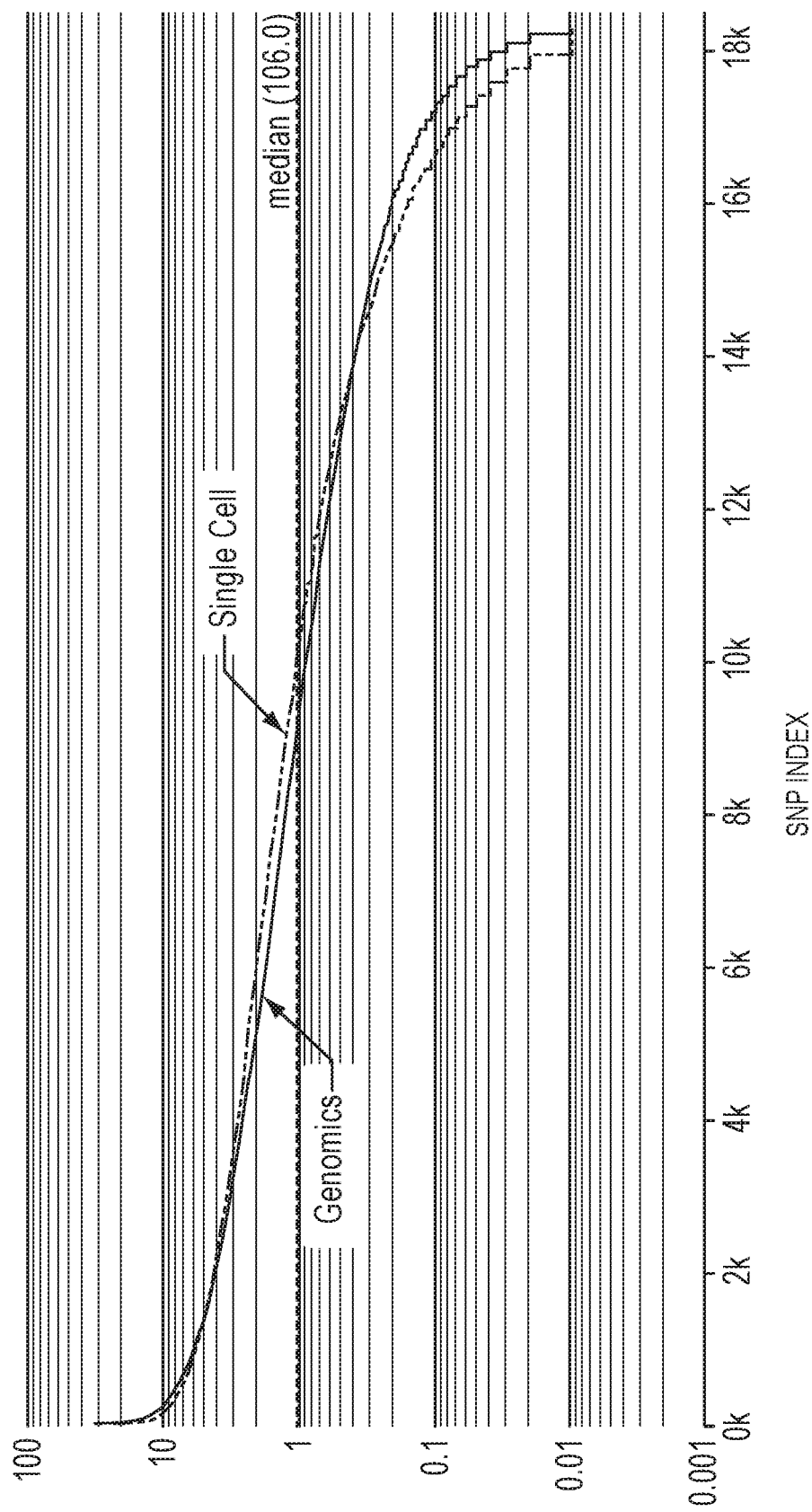
FIG. 35: Overlay of depth of read for a genomic and a single cell sample for different SNPs.
Figure 37:
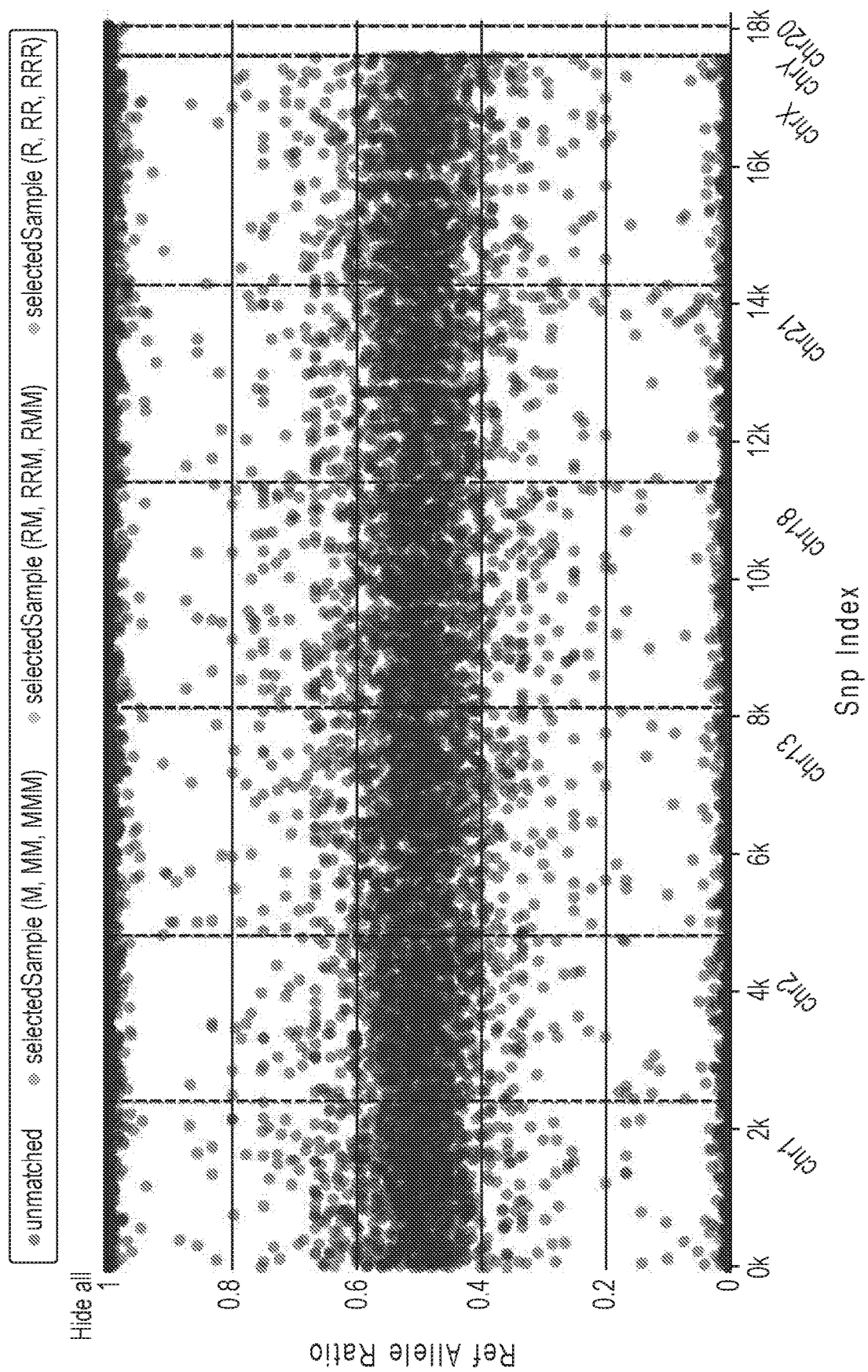
FIG. 37. Graph of reference counts (counts of one allele, such as the "A" allele) divided by total counts for that locus for a single blastocyst cell.

The primer design methods of the invention were also used to generate a library composed of three primers per target locus for 19,488 different target loci. Examples 15, 18, and 19 describe the use of this library. During the PCR amplification and sequencing of a genomic sample, 99.4-99.7% of the sequencing reads mapped to the genome, of those, 99.99% of the reads mapped to target loci. For plasma samples with 10 million sequencing reads, typically at least 19,350 of the 19,488 target loci (99.3%) were amplified and sequenced. For another experiment, the percent of the amplified products that were primer dimers was 1.62%, the median depth of read per target that was amplified was 30× coverage; the percent of the amplified products that were target amplicons was 98.15%; the number of target loci that were not amplified (failed assay count) was 736; the percent of target loci that were not amplified (failed assay percentage) was 0.56%; the percent of target loci that were amplified was 99.44%; and the total number of reads was 6,476,975. For this 19,488-plex library, FIG. 34 is a table of the percentage of reads that map to target loci for genomic DNA samples and for samples of a single cell from a cell line for both mother and child samples using this primer library. There was variability in the single cell data which may have resulted from some dead cells being selected, which may have had most of the DNA leaked out. FIG. 35 is an overlay of depth of read for genomic and a single cell sample for different SNPs. FIG. 36 is a table of the percentage of reads that map to target loci for blastoceol fluid and for a single blastocyst cell. The blastoceol fluid produced no mapped reads, possibly due to no DNA being detected. For a single blastocyst, 50-80% of the reads mapped to target loci. FIG. 37 is a graph of reference counts (counts of one allele, such as the "A" allele) divided by total counts for that locus for a single blastocyst cell. For this primer library, the ΔG values for each possible combination of two primers (each possible primer dimer) in the library are all equal to or greater than −3.86 kcal/mol. This −3.86 kcal/mol value was used as a threshold value to select candidate primer that all had a value equal to or greater than (more desirable than) this value from an initial library of candidate primers.

The primer design methods of the invention were used to generate a library for ~28,000 different target loci (such as amplifying 27,744 different loci with 27,744 different primer pairs). For multiplex PCR and sequencing of genomic DNA samples, 99% of the sequencing reads mapped to target loci. The number of different target human loci that were amplified was 23,776.

For an experiment using this library, the percent of the amplified products that were primer dimers was 0.63%, the median depth of read per target that was amplified was 20× coverage, the percent of the amplified products that were target amplicons was 99.33%; the number of target loci that were not amplified (failed assay count) was 3,968; the percent of target loci that were not amplified (failed assay percentage) was 14.29%; the percent of target loci that were amplified was 85.71%; and the total number of reads was 4,456,636. For a single cell from a cell line, between 2 and 8% of the reads mapped to target loci.

The primer design methods of the invention were used to generate a library for ~9,600 different target loci. As described in Example 10, 7.6 million (97%) of reads mapped to the genome, and 6.3 million (80%) of the reads mapped to the targeted SNPs. The average depth of read was 751, and the median depth of read was 396. As described in Example 9, another experiment produced 3.7 million reads mapping to the genome (94%), and of those, 2.9 million reads (74%) mapped to targeted SNPs with an average depth of read of 344 and a median depth of read of 255.

The primer design methods of the invention were used to generate a library for ~2,400 different target loci. As described in Example 12, when four portions were each amplified with ~2,400 primers, 4.5 million reads mapped to targeted SNPs, the average depth of read was 535 and the median depth of read was 412.

If desired, any of the results may be improved by increasing the number of cells or the amount of nucleic acid template used for the analysis or by optimizing the conditions. For example, if results from single cell samples are not as good as desired for a particular application, a sample with more cells or more nucleic acids may be used instead (such as to decrease the percentage of primer dimers, increase the percentage of target amplicons, or increase the percentage of target loci that are amplified). Samples with more nucleic acids have more template molecules for the primers to bind (instead of primers binding each other and forming primer dimers).

These primer libraries or primer pools can be used in any of the PCR methods of the invention. In some embodiments, primers from any of the primer pools are used in combination with a universal primer to amplify the target loci. In some embodiments, multiple rounds of PCR are performed in which each round of PCR uses primers from one of the primer pools and a universal primer. In some embodiments, primers from two of the primer pools are used to amplify the target loci. In some embodiments, multiple rounds of PCR are performed. In some embodiments, primers from pools C and B are used for the first round of PCR and then primers from pools A and C are used for the second of PCR. In some embodiments, primers from pools C and B are used for the first round of PCR and then primers from pools A and B are used for the second of PCR.

In some embodiments, a region that is not specific for a target locus (such as a tag, bar code, or universal binding site) is added to one or more primers of the invention. In various embodiments, the nonspecific region is added to the 5' end of the primer, to the 3' end of the primer, or to an internal region of the primer. In some embodiments, the primers are fragments (such as fragments of at least 10, 20, 30, 40, 50 or more contiguous nucleotides that are less than full-length).

In some embodiments, the invention provides a library of primers that includes at least 10; 20; 50; 75; 100; 300; 500; 750; 1,000; 2,000; 5,000; 7,500; 10,000; 15,000; 20,000; 25,000; 30,000; 40,000; or 50,000 different primers. In some embodiments, the invention provides a library of primers that includes at least 10; 20; 50; 75; 100; 300; 500; 750; 1,000; 2,000; 5,000; 7,500; 10,000; 15,000; 20,000; 25,000; 30,000; 40,000; or 50,000 different primers.

Percent identity in reference to nucleic acid sequences refers to the degree of sequence identity between nucleic acid sequences. Percent identity can be determined in various ways that are within the skill in the art, for instance, using publicly available computer software with the default parameters such as Smith Waterman Alignment (Smith and Waterman J. Mol. Biol. 147:195-7, 1981); "BestFit" (Smith and Waterman, Advances in Applied Mathematics, 482-489, 1981); Basic Local Alignment Search Tool (BLAST, Altschul, S. F., W. Gish, et al., J. Mol. Biol. 215: 403-410, 1990; available through the U.S. government's National Center for Biotechnology Information web site at the world wide web at ncbi.nlm.nih.gov), BLAST-2, BLAST-N, WU-BLAST, WU-BLAST-2, ENTREZ (available through the National Center for Biotechnology Information), CLUSTALW, CLUSTAL Omega, or Megalign (DNASTAR, Inc. Madison, Wis.) software. In addition, those skilled in the art can determine appropriate parameters for measuring alignment, including any algorithms needed to achieve maximal alignment over the length of the sequences being compared. In general, the length of comparison will generally be at least 20, 30, 40, 45, 50, or more nucleotides.

In some embodiments, percent identity is calculated by determining the number of matched positions in aligned nucleic acid sequences, dividing the number of matched positions by the total number of aligned nucleotides, and multiplying by 100. A matched position refers to a position in which identical nucleotides occur at the same position in aligned nucleic acid sequences. The percent identity over a particular length is determined by counting the number of matched positions over that length and dividing that number by the length followed by multiplying the resulting value by 100. For example, if (i) a 500-nucleotide nucleic acid target sequence is compared to a subject nucleic acid sequence, (ii) an alignment program presents 200 nucleotides from the target sequence aligned with a region of the subject sequence where the first and last nucleotides of that 200-nucleotide region are matches, and (iii) the number of matches over those 200 aligned nucleotides is 180, then the 500-nucleotide nucleic acid target sequence contains a length of 200 and a sequence identity over that length of 90% (i.e., 180, 200×100=90).

Hybridization conditions resulting in a particular degree of stringency will vary depending upon the nature of the hybridization method and the composition and length of the hybridizing nucleic acid sequences. Generally, the temperature of hybridization and the ionic strength (such as the $Na^+$ concentration) of the hybridization buffer will determine the stringency of hybridization. Calculations regarding hybridization conditions for attaining particular degrees of stringency are discussed in Sambrook et al., (1989) Molecular Cloning, second edition, Cold Spring Harbor Laboratory, Plainview, N.Y. (chapters 9 and 11); Nucleic Acid Hybridization, A Practical Approach, Ed. Hames, B. D. and Higgins, S. J., IRL Press, 1985; Ausubel et al. Current Protocols in Molecular Biology, Wiley, New York 1994; and U.S. Pat. No. 8,357,488, filed May 16, 2008. In some embodiments, very high stringency hybridization conditions includes an overnight incubation at 42° C. in a solution comprising 50% formamide, 5×SSC (750 mM NaCl, 75 mM trisodium citrate), 50 mM sodium phosphate (pH 7.6), 5×Denhardt's solution, 10% dextran sulfate, and 20 μg/ml denatured, sheared salmon sperm DNA, followed by washing the filters in 0.1×SSC at about 65° C. The following is an exemplary set of hybridization conditions and is not limiting:

Very High Stringency (Detects Sequences that Share at Least 90% Identity)
  Hybridization: 5×SSC at 65° C. for 16 hours
  Wash twice: 2×SSC at room temperature for 15 minutes each
  Wash twice: 0.5×SSC at 65° C. for 20 minutes each High Stringency (Detects Sequences that Share at Least 80% Identity)
  Hybridization: 5×-6×SSC at 65° C.-70° C. for 16-20 hours
  Wash twice: 2×SSC at room temperature for 5-20 minutes each
  Wash twice: 1×SSC at 55° C.-70° C. for 30 minutes each Low Stringency (Detects Sequences that Share at Least 50% Identity)
  Hybridization: 6×SSC at room temperature to 55° C. for 16-20 hours
  Wash at least twice: 2×-3×SSC at room temperature to 55° C. for 20-30 minutes each These primers can be used in any of the primer libraries or methods of the invention.

Exemplary Primer Libraries for Detection of Recombination

In some embodiments, primers in the primer library are designed to determine whether or not recombination occurred at one or more known recombination hotspots (such as crossovers between homologous human chromosomes). Knowing what crossovers occurred between chromosomes allows more accurate phased genetic data to be determined for an individual. Recombination hotspots are local regions of chromosomes in which recombination events tend to be concentrated. Often they are flanked by "coldspots," regions of lower than average frequency of recombination. Recombination hotspots tend to share a similar morphology and are approximately 1 to 2 kb in length. The hotspot distribution is positively correlated with GC content and repetitive element distribution. A partially degenerated 13-mer motif CCNCCNTNNCCNC plays a role in some hotspot activity. It has been shown that the zinc finger protein called PRDM9 binds to this motif and initiates recombination at its location. The average distance between the centers of recombination hot spots is reported to be ~80 kb. In some embodiments, the distance between the centers of recombination hot spots ranges between ~3 kb to ~100 kb. Public databases include a large number of known human recombination hotspots, such as the HUMHOT and International HapMap Project databases (see, for example, Nishant et al., "HUMHOT: a database of human meiotic recombination hot spots," Nucleic Acids Research, 34: D25-D28, 2006, Database issue; Mackiewicz et al., "Distribution of Recombination Hotspots in the Human Genome—A Comparison of Computer Simulations with Real Data" PLoS ONE 8(6): e65272, doi:10.1371/journal.pone.0065272; and the world wide web at hapmap.ncbi.nlm.nih.gov/downloads/index.html.en, which are each hereby incorporated by reference in its entirety).

In some embodiments, primers in the primer library are clustered at or near recombination hotspots (such as known human recombination hotspots). In some embodiments, the corresponding amplicons are used to determine the sequence within or near a recombination hotspot to determine whether or not recombination occurred at that particular hotspot (such as whether the sequence of the amplicon is the sequence expected if a recombination had occurred or the sequence expected if a recombination had not occurred). In some embodiments, primers are designed to amplify part or all of a recombination hotspot (and optionally sequence flanking a recombination hotspot). In some embodiments, long read sequencing (such as sequencing using the Moleculo Technology developed by Illumina to sequence up to ~10 kb) or paired end sequencing is used to sequence part or all of a recombination hotspot. Knowledge of whether or not a recombination event occurred can be used to determine which haplotype blocks flank the hotspot. If desired, the presence of particular haplotype blocks can be confirmed using primers specific to regions within the haplotype blocks. In some embodiments, it is assumed there are no crossovers between known recombination hotspots. In some embodiments, primers in the primer library are clustered at or near the ends of chromosomes. For example, such primers can be used to determine whether or not a particular arm or section at the end of a chromosome is present. In some embodiments, primers in the primer library are clustered at or near recombination hotspots and at or near the ends of chromosomes.

In some embodiments, the primer library includes one or more primers (such as at least 5; 10; 50; 100; 200; 500; 750; 1,000; 2,000; 5,000; 7,500; 10,000; 20,000; 25,000; 30,000; 40,000; or 50,000 different primers or different primer pairs) that are specific for a recombination hotspot (such as a known human recombination hotspot) and/or are specific for a region near a recombination hotspot (such as within 10, 8, 5, 3, 2, 1, or 0.5 kb of the 5' or 3' end of a recombination hotspot). In some embodiments, at least 1, 5, 10, 20, 40, 60, 80, 100, or 150 different primer (or primer pairs) are specific for the same recombination hotspot, or are specific for the same recombination hotspot or a region near the recombination hotspot. In some embodiments, at least 1, 5, 10, 20, 40, 60, 80, 100, or 150 different primer (or primer pairs) are specific for a region between recombination hotspots (such as a region unlikely to have undergone recombination); these primers can be used to confirm the presence of haplotype blocks (such as those that would be expected depending on whether or not recombination has occurred). In some embodiments, at least 10, 20, 30, 40, 50, 60, 70, 80, or 90% of the primers in the primer library are specific for a recombination hotspot and/or are specific for a region near a recombination hotspot (such as within 10, 8, 5, 3, 2, 1, or 0.5 kb of the 5' or 3' end of the recombination hotspot). In some embodiments, the primer library is used to determine whether or not recombination has occurred at greater than or equal to 5; 10; 50; 100; 200; 500; 750; 1,000; 2,000; 5,000; 7,500; 10,000; 20,000; 25,000; 30,000; 40,000; or 50,000 different recombination hotspots (such as known human recombination hotspots). In some embodiments, the regions targeted by primers to a recombination hotspot or nearby region are approximately evenly spread out along that portion of the genome. In some embodiments, at least 1, 5, 10, 20, 40, 60, 80, 100, or 150 different primer (or primer pairs) are specific for the a region at or near the end of a chromosome (such as a region within 20, 10, 5, 1, 0.5, 0.1, 0.01, or 0.001 mb from the end of a chromosome). In some embodiments, at least 10, 20, 30, 40, 50, 60, 70, 80, or 90% of the primers in the primer library are specific for the a region at or near the end of a chromosome (such as a region within 20, 10, 5, 1, 0.5, 0.1, 0.01, or 0.001 mb from the end of a chromosome). In some embodiments, at least 1, 5, 10, 20, 40, 60, 80, 100, or 150 different primer (or primer pairs) are specific for a region within a potential microdeletion in a chromosome. In some embodiments, at least 10, 20, 30, 40, 50, 60, 70, 80, or 90% of the primers in the primer library are specific for a region within a potential microdeletion in a chromosome. In some embodiments, at least 10, 20, 30, 40, 50, 60, 70, 80, or 90% of the primers in the primer library are specific for a recombination hotspot, a region near a recombination hotspot, a region at or near the end of a chromosome, or a region within a potential microdeletion in a chromosome. In some embodiments, the primers have one or more of the properties described herein. Other embodiments are disclosed in U.S. Ser. No. 61/987,407, filed May 1, 2014 and 62/066,514, filed Oct. 21, 2014.

Exemplary Kits

In one aspect, the invention features a kit, such as a kit for amplifying target loci in a nucleic acid sample for detecting deletions and/or duplications of chromosome segments or entire chromosomes using any of the methods described herein). In some embodiments, the kit can include any of the primer libraries of the invention. In an embodiment, the kit comprises a plurality of inner forward primers and optionally a plurality of inner reverse primers, and optionally outer forward primers and outer reverse primers, where each of the primers is designed to hybridize to the region of DNA immediately upstream and/or downstream from one of the target sites (e.g., polymorphic sites) on the target chromosome(s) or chromosome segment(s), and optionally additional chromosomes or chromosome segments. In some embodiments, the kit includes instructions for using the primer library to amplify the target loci, such as for detecting one or more deletions and/or duplications of one or more chromosome segments or entire chromosomes using any of the methods described herein.

In certain embodiments, kits of the invention provide primer pairs for detecting chromosomal aneuploidy and CNV determination, such as primer pairs for massively multiplex reactions for detecting chromosomal aneuploidy such as CNV (CoNVERGe) (Copy Number Variant Events Revealed Genotypically) and/or SNVs. In these embodiments, the kits can include between at least 100, 200, 250, 300, 500, 1000, 2000, 2500, 3000, 5000, 10,000, 20,000, 25,000, 28,000, 50,000, or 75,000 and at most 200, 250, 300, 500, 1000, 2000, 2500, 3000, 5000, 10,000, 20,000, 25,000, 28,000, 50,000, 75,000, or 100,000 primer pairs that are shipped together. The primer pairs can be contained in a single vessel, such as a single tube or box, or multiple tubes or boxes. In certain embodiments, the primer pairs are pre-qualified by a commercial provider and sold together, and in other embodiments, a customer selects custom gene targets and/or primers and a commercial provider makes and ships the primer pool to the customer neither in one tube or a plurality of tubes. In certain exemplary embodiments, the kits include primers for detecting both CNVs and SNVs, especially CNVs and SNVs known to be correlated to at least one type of cancer.

Kits for circulating DNA detection according to some embodiments of the present invention, include standards and/or controls for circulating DNA detection. For example, in certain embodiments, the standards and/or controls are sold and optionally shipped and packaged together with primers used to perform the amplification reactions provided herein, such as primers for performing CoNVERGe. In certain embodiments, the controls include polynucleotides such as DNA, including isolated genomic DNA that exhibits one or more chromosomal aneuploidies such as CNV and/or includes one or more SNVs. In certain embodiments, the standards and/or controls are called PlasmArt standards and include polynucleotides having sequence identity to regions of the genome known to exhibit CNV, especially in certain inherited diseases, and in certain disease states such as cancer, as well as a size distribution that reflects that of cfDNA fragments naturally found in plasma. Exemplary methods for making PlasmArt standards are provided in the examples herein. In general, genomic DNA from a source known to include a chromosomal aneuploidy is isolated, fragmented, purified and size selected.

Accordingly, artificial cfDNA polynucleotide standards and/or controls can be made by spiking isolated polynucleotide samples prepared as summarized above, into DNA samples known not to exhibit a chromosomal aneuploidy and/or SNVs, at concentrations similar to those observed for cfDNA in vivo, such as between, for example, 0.01% and 20%, 0.1 and 15%, or 0.4 and 10% of DNA in that fluid. These standards/controls can be used as controls for assay design, characterization, development, and/or validation, and as quality control standards during testing, such as cancer testing performed in a CLIA lab and/or as standards included in research use only or diagnostic test kits.

Exemplary Amplicons

In one aspect, the invention provides a composition comprising at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) in solution in one reaction volume. In some embodiments, the amplicons are produced from the simultaneous PCR amplification of at least 100 different target loci (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical target loci) using at least 100 different primers or primer pairs (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs) in one reaction volume. In some embodiments, (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments, the length of the target amplicons is between 50 and 100 nucleotides, such as between 60 and 80 nucleotides, or 60 to 75 nucleotides, inclusive. In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, the composition includes at least 1,000 different amplicons in solution in one reaction volume; wherein the amplicons are produced from the simultaneous PCR amplification of at least 1,000 different target human loci using at least 1,000 different primers in one reaction volume; wherein (i) less than 20% of the amplicons are primer dimers, and (ii) at least 80% of the amplicons comprise one of the target human loci and are between 50 and 100 nucleotides in length, inclusive. In some embodiments, the composition consists essentially of, or consists of one or more of the following: amplicons, primers (such as any of the primers disclosed herein), free nucleotide(s), non-human or non-naturally occurring enzyme(s), buffer (s), or any combination thereof.

In some embodiments, a large percentage or substantially all of the primers used for the multiplex PCR method are consumed during the PCR reaction or are removed from the reaction volume after the PCR amplification. In some embodiments, at least 80, 90, 92, 94, 96, 98, 99, or 100% of the primer molecules are extended to form amplified products. In some embodiments, for at least 80, 90, 92, 94, 96, 98, 99, or 100% of target loci, at least 80, 90, 92, 94, 96, 98, 99, or 100% of the primer molecules to that target loci are extended to form amplified products. In some embodiments, multiple cycles are performed until all or substantially all of the primers are consumed. If desired, a higher percentage of the primers can be consumed by decreasing the initial primer concentration and/or increasing the number of PCR cycles that are performed. In some embodiments, at least 80, 90, 95, 96, 97, 98, 99, or 100% of the nucleic acids in the composition are amplicons (instead of unextended dimers).

In one aspect, the invention provides a composition comprising at least 100 different primers or primer pairs (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs) and at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) in solution in one reaction volume. In some embodiments, the amplicons are produced from the simultaneous PCR amplification of at least 100 different target loci (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical target loci) using the primers or primer pairs in one reaction volume. In some embodiments, (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments, the length of the target amplicons is between 50 and 100 nucleotides, such as between 60 and 80 nucleotides, or 60 to 75 nucleotides, inclusive. In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, the composition comprising at least 1,000 different primers and at least 1,000 different amplicons in solution in one reaction volume; wherein the amplicons are produced from the simultaneous PCR amplification of at least 1,000 different target human loci with the primers in one reaction volume; wherein (i) less than 20% of the amplicons are primer dimers, and (ii) at least 80% of the amplicons comprise one of the target loci and are between 50 and 100 nucleotides in length, inclusive. In some embodiments, the composition consists essentially of, or consists of one or more of the following: amplicons, primers (such as any of the primers disclosed herein), free nucleotide(s), non-human or non-naturally occurring enzyme(s), buffer(s), or any combination thereof.

In some embodiments, the amplification of different target loci is substantially uniform. In some embodiments, target loci (such as nonpolymorphic target loci or polymorphic target loci that are amplified regardless of what allele is present at the polymorphic site) that were present in the same amount (or substantially the same amount) in the initial unamplified sample are also present in substantially the same amount in the PCR-amplified products. In some embodiments, for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different targets, the target loci that is amplified the most out of these targets (which can be all of the targets or a subset of the targets for a library) is amplified less than 2,000; 1,500; 1,000; 500, 400, 300, 200, 100%, 50, 20, 10, 5, or 2% more than the target loci that is amplified the least out of these targets. In some embodiments, for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target amplicons, the target amplicon in greatest abundance out of these target amplicons (which can be all of the target amplicons or a subset of the target amplicons produced by a library) is present in an amount that is less than 2,000; 1,500; 1,000; 500, 400, 300, 200, 100%, 50, 20, 10, 5, or 2% more than the target amplicon in least abundance out of these target amplicons. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target amplicons are present in an amount that is at least 5, 10, 15, 20, 40, 50, 60, 70, 80, or 90% of the amount of the target amplicon in greatest abundance. In some embodiments, for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different amplicons that are produced by multiplex PCR and then sequenced, at least 80, 90, 95, 96, 97, 98, 99, or 99.5% of the target amplicons produce a number of sequencing reads within 20, 30, 50, or 80% above or below the mean number of sequences for target amplicons. If desired, the uniformity can be increased by using primers with more similar primer lengths, target amplicon lengths, GC contents, melting temperatures, or any combination thereof. In some embodiments, the uniformity can be increased by using TMAC in the reaction volume during amplification. In some embodiments, having most or all the primers consumed in the PCR reaction increases the uniformity of amplification.

If desired, the uniformity in DOR can be measured using standard methods such as depth of read slope (DOR slope), normalized median depth of read (nmDOR), or breadth of read (BOR). DOR slope represents the slope of the line in the linear portion of a list of loci sorted in descending DOR order. Closer to zero is better, as it represents a flat line. In some embodiments, the uniformity in DOR can be measured using the Percent of reads in the $90^{th}$-$95^{th}$ Percentile. For this measurement, the loci are sorted in descending DOR order. In the ideal DOR distribution, the $90^{th}$-$95^{th}$ percentile should contain 5% of reads. The reads of all loci between the $90^{th}$ Percentile and $95^{th}$ percentile are counted and divided by the total reads for all loci. In one experiment, the DOR slope versus percent of reads in the $90^{th}$-$95^{th}$ percentile for all samples had an $R^2$=0.81.

In some embodiments, the magnitude of the DOR slope is less than 0.005, 0.001, 0.0005, 0.0001, 0.00005, 0.00001, 0.000005, or 0.000001. In some embodiments, the magnitude of the DOR slope is between 0 and 0.005, such as 0.000001 to 0.005, such as between 0.000005 to 0.00001, 0.00001 to 0.00005, 0.00005 to 0.0001, 0.0001 to 0.0005, 0.0005 to 0.001, or 0.001 to 0.005, inclusive. In some embodiments, the percent of reads in the $90^{th}$-$95^{th}$ percentile is between 0.2 and 9%, such as between 1 to 8%, 2 to 7%, 0.2 to 1.0%, 1 to 2%, 2 to 3%, 2 to 4%, 3 to 4%, 4 to 5%, 5 to 6%, or 6 to 8%, or 7 to 9& inclusive. In some embodiments, the invention features a composition comprising at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) with the magnitude of the DOR slope in any of these ranges or with a percent of reads in the $90^{th}$-$95^{th}$ percentile in any of these ranges. In some embodiments, the amplification method produces at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) with the magnitude of the DOR slope in any of these ranges or with a percent of reads in the $90^{th}$-$95^{th}$ percentile in any of these ranges.

Exemplary Multiplex PCR Methods

In one aspect, the invention features methods of amplifying target loci in a nucleic acid sample that involve (i) contacting the nucleic acid sample with a library of primers that simultaneously hybridize to least 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture; and (ii) subjecting the reaction mixture to primer extension reaction conditions (such as PCR conditions) to produce amplified products that include target amplicons. In some embodiments, the method also includes determining the presence or absence of at least one target amplicon (such as at least 50, 60, 70, 80, 90, 95, 96, 97, 98, 99, or 99.5% of the target amplicons). In some embodiments, the method also includes determining the sequence of at least one target amplicon (such as at least 50, 60, 70, 80, 90, 95, 96, 97, 98, 99, or 99.5% of the target amplicons). In some embodiments, at least 50, 60, 70, 80, 90, 95, 96, 97, 98, 99, or 99.5% of the target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold. In various embodiments, less than 60, 50, 40, 30, 20, 10, 5, 4, 3, 2, 1, 0.5, 0.25, 0.1, or 0.05% of the amplified products are primer dimers. In some embodiments, the method involves multiplex PCR and sequencing (such as high throughput sequencing).

In various embodiments, long annealing times and/or low primer concentrations are used. In various embodiments, the length of the annealing step is greater than 3, 5, 8, 10, 15, 20, 30, 45, 60, 75, 90, 120, 150, or 180 minutes. In various embodiments, the length of the annealing step (per PCR cycle) is between 5 and 180 minutes, such as 5 to 60, 10 to 60, 5 to 30, or 10 to 30 minutes, inclusive. In various embodiments, the length of the annealing step is greater than 5 minutes (such greater than 10, or 15 minutes), and the concentration of each primer is less than 20 nM. In various embodiments, the length of the annealing step is greater than 5 minutes (such greater than 10, or 15 minutes), and the concentration of each primer is between 1 to 20 nM, or 1 to 10 nM, inclusive. In various embodiments, the length of the annealing step is greater than 20 minutes (such as greater than 30, 45, 60, or 90 minutes), and the concentration of each primer is less than 1 nM.

At high level of multiplexing, the solution may become viscous due to the large amount of primers in solution. If the solution is too viscous, one can reduce the primer concentration to an amount that is still sufficient for the primers to bind the template DNA. In various embodiments, less than 60,000 different primers are used and the concentration of each primer is less than 20 nM, such as less than 10 nM or between 1 and 10 nM, inclusive. In various embodiments, more than 60,000 different primers (such as between 60,000 and 120,000 different primers) are used and the concentration of each primer is less than 10 nM, such as less than 5 nM or between 1 and 10 nM, inclusive.

It was discovered that the annealing temperature can optionally be higher than the melting temperatures of some or all of the primers (in contrast to other methods that use an annealing temperature below the melting temperatures of the primers) (Example 25). The melting temperature ($T_m$) is the temperature at which one-half (50%) of a DNA duplex of an oligonucleotide (such as a primer) and its perfect complement dissociates and becomes single strand DNA. The annealing temperature ($T_A$) is the temperature one runs the PCR protocol at. For prior methods, it is usually 5 C below the lowest $T_m$ of the primers used, thus close to all possible duplexes are formed (such that essentially all the primer molecules bind the template nucleic acid). While this is highly efficient, at lower temperatures there are more unspecific reactions bound to occur. One consequence of having too low a $T_A$ is that primers may anneal to sequences other than the true target, as internal single-base mismatches or partial annealing may be tolerated. In some embodiments of the present inventions, the $T_A$ is higher than ($T_m$), where at a given moment only a small fraction of the targets have a primer annealed (such as only ~1-5%). If these get extended, they are removed from the equilibrium of annealing and dissociating primers and target (as extension increases $T_m$ quickly to above 70 C), and a new ~1-5% of targets has primers. Thus, by giving the reaction long time for annealing, one can get ~100% of the targets copied per cycle. Thus, the most stable molecule pairs (those with perfect DNA pairing between the primer and the template DNA) are preferentially extended to produce the correct target amplicons. For example, the same experiment was performed with 57° C. as the annealing temperature and with 63° C. as the annealing temperature with primers that had a melting temperature below 63° C. When the annealing temperature was 57° C., the percent of mapped reads for the amplified PCR products was as low as 50% (with ~50% of the amplified products being primer-dimer). When the annealing temperature was 63° C., the percentage of amplified products that were primer dimer dropped to ~2%.

In various embodiments, the annealing temperature is at least 1, 2, 3, 4, 5, 6, 7, 8, 9, 10, 11, 12, 13, or 15° C. greater than the melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the annealing temperature is at least 1, 2, 3, 4, 5, 6, 7, 8, 9, 10, 11, 12, 13, or 15° C. greater than the melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers, and the length of the annealing step (per PCR cycle) is greater than 1, 3, 5, 8, 10, 15, 20, 30, 45, 60, 75, 90, 120, 150, or 180 minutes.

In various embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In various embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers, and the length of the annealing step (per PCR cycle) is between 5 and 180 minutes, such as 5 to 60, 10 to 60, 5 to 30, or 10 to 30 minutes, inclusive.

In some embodiments, the annealing temperature is at least 1, 2, 3, 4, 5, 6, 7, 8, 9, 10, 11, 12, 13, or 15° C. greater than the highest melting temperature (such as the empirically measured or calculated $T_m$) of the primers. In some embodiments, the annealing temperature is at least 1, 2, 3, 4, 5, 6, 7, 8, 9, 10, 11, 12, 13, or 15° C. greater than the highest melting temperature (such as the empirically measured or calculated $T_m$) of the primers, and the length of the annealing step (per PCR cycle) is greater than 1, 3, 5, 8, 10, 15, 20, 30, 45, 60, 75, 90, 120, 150, or 180 minutes In some embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the highest melting temperature (such as the empirically measured or calculated $T_m$) of the primers. In some embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the highest melting temperature (such as the empirically measured or calculated $T_m$) of the primers, and the length of the annealing step (per PCR cycle) is between 5 and 180 minutes, such as 5 to 60, 10 to 60, 5 to 30, or 10 to 30 minutes, inclusive.

In some embodiments, the annealing temperature is at least 1, 2, 3, 4, 5, 6, 7, 8, 9, 10, 11, 12, 13, or 15° C. greater than the average melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the annealing temperature is at least 1, 2, 3, 4, 5, 6, 7, 8, 9, 10, 11, 12, 13, or 15° C. greater than the average melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers, and the length of the annealing step (per PCR cycle) is greater than 1, 3, 5, 8, 10, 15, 20, 30, 45, 60, 75, 90, 120, 150, or 180 minutes.

In some embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers, and the length of the annealing step (per PCR cycle) is between 5 and 180 minutes, such as 5 to 60, 10 to 60, 5 to 30, or 10 to 30 minutes, inclusive.

In some embodiments, the annealing temperature is between 50 to 70° C., such as between 55 to 60, 60 to 65, or 65 to 70° C., inclusive. In some embodiments, the annealing temperature is between 50 to 70° C., such as between 55 to 60, 60 to 65, or 65 to 70° C., inclusive, and either (i) the length of the annealing step (per PCR cycle) is greater than 3, 5, 8, 10, 15, 20, 30, 45, 60, 75, 90, 120, 150, or 180 minutes or (ii) the length of the annealing step (per PCR cycle) is between 5 and 180 minutes, such as 5 to 60, 10 to 60, 5 to 30, or 10 to 30 minutes, inclusive.

In some embodiments, one or more of the following conditions are used for empirical measurement of $T_m$ or are assumed for calculation of $T_m$: temperature: of 60.0° C., primer concentration of 100 nM, and/or salt concentration of 100 mM. In some embodiments, other conditions are used, such as the conditions that will be used for multiplex PCR with the library. In some embodiments, 100 mM KCl, 50 mM $(NH_4)_2SO_4$, 3 mM $MgCl_2$, 7.5 nM of each primer, and 50 mM TMAC, at pH 8.1 is used. In some embodiments, the $T_m$ is calculated using the Primer3 program (libprimer3 release 2.2.3) using the built-in SantaLucia parameters (the world wide web at primer3.sourceforge.net, which is hereby incorporated by reference in its entirety). For example, the $T_m$ values may be calculated using the method in Example 25. In some embodiments, the calculated melting temperature for a primer is the temperature at which half of the primers molecules are expected to be annealed. As discussed above, even at a temperature higher than the calculated melting temperature, a percentage of primers will be annealed, and therefore PCR extension is possible. In some embodiments, the empirically measured Tm (the actual Tm) is determined by using a thermostatted cell in a UV spectrophotometer. In some embodiments, temperature is plotted vs. absorbance, generating an S-shaped curve with two plateaus. The absorbance reading halfway between the plateaus corresponds to Tm.

In some embodiments, the absorbance at 260 nm is measured as a function of temperature on an ultrospec 2100 pr UV/visible spectrophotometer (Amershambiosciences) (see, e.g., Takiya et al., "An empirical approach for thermal stability (Tm) prediction of PNA/DNA duplexes," Nucleic Acids Symp Ser (Oxf); (48):131-2, 2004, which is hereby incorporated by reference in its entirety). In some embodiments, absorbance at 260 nm is measured by decreasing the temperature in steps of 2° C. per minute from 95 to 20° C. In some embodiments, a primer and its perfect complement (such as 2 uM of each paired oligomer) are mixed and then annealing is performed by heating the sample to 95° C., keeping it there for 5 minutes, followed by cooling to room temperature during 30 minutes, and keeping the samples at 95° C. for at least 60 minutes. In some embodiments, melting temperature is determined by analyzing the data using SWIFT Tm software. In some embodiments of any of the methods of the invention, the method includes empirically measuring or calculating (such as calculating with a computer) the melting temperature for at least 50, 80, 90, 92, 94, 96, 98, 99, or 100% of the primers in the library either before or after the primers are used for PCR amplification of target loci.

In some embodiments, the library comprises a microarray. In some embodiments, the library does not comprise a microarray.

In some embodiments, most or all of the primers are extended to form amplified products. Having all the primers consumed in the PCR reaction increases the uniformity of amplification of the different target loci since the same or similar number of primer molecules are converted to target amplicons for each target loci. In some embodiment, at least 80, 90, 92, 94, 96, 98, 99, or 100% of the primer molecules are extended to form amplified products. In some embodiments, for at least 80, 90, 92, 94, 96, 98, 99, or 100% of target loci, at least 80, 90, 92, 94, 96, 98, 99, or 100% of the primer molecules to that target loci are extended to form amplified products. In some embodiments, multiple cycles are performed until this percentage of the primers are consumed. In some embodiments, multiple cycles are performed until all or substantially all of the primers are consumed. If desired, a higher percentage of the primers can be consumed by decreasing the initial primer concentration and/or increasing the number of PCR cycles that are performed.

In some embodiments, the PCR methods may be performed with microliter reaction volumes, for which it can be harder to achieve specific PCR amplification (due to the lower local concentration of the template nucleic acids) compared to nanoliter or picoliter reaction volumes used in microfluidics applications. In some embodiments, the reaction volume is between 1 and 60 uL, such as between 5 and 50 uL, 10 and 50 uL, 10 and 20 uL, 20 and 30 uL, 30 and 40 uL, or 40 to 50 uL, inclusive.

In an embodiment, a method disclosed herein uses highly efficient highly multiplexed targeted PCR to amplify DNA followed by high throughput sequencing to determine the allele frequencies at each target locus. The ability to multiplex more than about 50 or 100 PCR primers in one reaction volume in a way that most of the resulting sequence reads map to targeted loci is novel and non-obvious. One technique that allows highly multiplexed targeted PCR to perform in a highly efficient manner involves designing primers that are unlikely to hybridize with one another. The PCR probes, typically referred to as primers, are selected by creating a thermodynamic model of potentially adverse interactions between at least 300; at least 500; at least 750; at least 1,000; at least 2,000; at least 5,000; at least 7,500; at least 10,000; at least 20,000; at least 25,000; at least 30,000; at least 40,000; at least 50,000; at least 75,000; or at least 100,000 potential primer pairs, or unintended interactions between primers and sample DNA, and then using the model to eliminate designs that are incompatible with other the designs in the pool. Another technique that allows highly multiplexed targeted PCR to perform in a highly efficient manner is using a partial or full nesting approach to the targeted PCR. Using one or a combination of these approaches allows multiplexing of at least 300, at least 800, at least 1,200, at least 4,000 or at least 10,000 primers in a single pool with the resulting amplified DNA comprising a majority of DNA molecules that, when sequenced, will map to targeted loci. Using one or a combination of these approaches allows multiplexing of a large number of primers in a single pool with the resulting amplified DNA comprising greater than 50%, greater than 60%, greater than 67%, greater than 80%, greater than 90%, greater than 95%, greater than 96%, greater than 97%, greater than 98%, greater than 99%, or greater than 99.5% DNA molecules that map to targeted loci.

In some embodiments the detection of the target genetic material may be done in a multiplexed fashion. The number of genetic target sequences that may be run in parallel can range from one to ten, ten to one hundred, one hundred to one thousand, one thousand to ten thousand, ten thousand to one hundred thousand, one hundred thousand to one million, or one million to ten million. Prior attempts to multiplex more than 100 primers per pool have resulted in significant problems with unwanted side reactions such as primer-dimer formation.

Targeted PCR

In some embodiments, PCR can be used to target specific locations of the genome. In plasma samples, the original DNA is highly fragmented (typically less than 500 bp, with an average length less than 200 bp). In PCR, both forward and reverse primers anneal to the same fragment to enable amplification. Therefore, if the fragments are short, the PCR assays must amplify relatively short regions as well. Like MIPS, if the polymorphic positions are too close the polymerase binding site, it could result in biases in the amplification from different alleles. Currently, PCR primers that target polymorphic regions, such as those containing SNPs, are typically designed such that the 3' end of the primer will hybridize to the base immediately adjacent to the polymorphic base or bases. In an embodiment of the present disclosure, the 3' ends of both the forward and reverse PCR primers are designed to hybridize to bases that are one or a few positions away from the variant positions (polymorphic sites) of the targeted allele. The number of bases between the polymorphic site (SNP or otherwise) and the base to which the 3' end of the primer is designed to hybridize may be one base, it may be two bases, it may be three bases, it may be four bases, it may be five bases, it may be six bases, it may be seven to ten bases, it may be eleven to fifteen bases, or it may be sixteen to twenty bases. The forward and reverse primers may be designed to hybridize a different number of bases away from the polymorphic site.

PCR assay can be generated in large numbers, however, the interactions between different PCR assays makes it difficult to multiplex them beyond about one hundred assays. Various complex molecular approaches can be used to increase the level of multiplexing, but it may still be limited to fewer than 100, perhaps 200, or possibly 500 assays per reaction. Samples with large quantities of DNA can be split among multiple sub-reactions and then recombined before sequencing. For samples where either the overall sample or some subpopulation of DNA molecules is limited, splitting the sample would introduce statistical noise. In an embodiment, a small or limited quantity of DNA may refer to an amount below 10 pg, between 10 and 100 pg, between 100 pg and 1 ng, between 1 and 10 ng, or between 10 and 100 ng. Note that while this method is particularly useful on small amounts of DNA where other methods that involve splitting into multiple pools can cause significant problems related to introduced stochastic noise, this method still provides the benefit of minimizing bias when it is run on samples of any quantity of DNA. In these situations a universal pre-amplification step may be used to increase the overall sample quantity. Ideally, this pre-amplification step should not appreciably alter the allelic distributions.

In an embodiment, a method of the present disclosure can generate PCR products that are specific to a large number of targeted loci, specifically 1,000 to 5,000 loci, 5,000 to 10,000 loci or more than 10,000 loci, for genotyping by sequencing or some other genotyping method, from limited samples such as single cells or DNA from body fluids. Currently, performing multiplex PCR reactions of more than 5 to 10 targets presents a major challenge and is often hindered by primer side products, such as primer dimers, and other artifacts. When detecting target sequences using microarrays with hybridization probes, primer dimers and other artifacts may be ignored, as these are not detected. However, when using sequencing as a method of detection, the vast majority of the sequencing reads would sequence such artifacts and not the desired target sequences in a sample. Methods described in the prior art used to multiplex more than 50 or 100 reactions in one reaction volume followed by sequencing will typically result in more than 20%, and often more than 50%, in many cases more than 80% and in some cases more than 90% off-target sequence reads.

In general, to perform targeted sequencing of multiple (n) targets of a sample (greater than 50, greater than 100, greater than 500, or greater than 1,000), one can split the sample into a number of parallel reactions that amplify one individual target. This has been performed in PCR multiwell plates or can be done in commercial platforms such as the FLUIDIGM ACCESS ARRAY (48 reactions per sample in microfluidic chips) or DROPLET PCR by RAIN DANCE TECHNOLOGY (100s to a few thousands of targets). Unfortunately, these split-and-pool methods are problematic for samples with a limited amount of DNA, as there is often not enough copies of the genome to ensure that there is one copy of each region of the genome in each well. This is an especially severe problem when polymorphic loci are targeted, and the relative proportions of the alleles at the polymorphic loci are needed, as the stochastic noise introduced by the splitting and pooling will cause very poorly accurate measurements of the proportions of the alleles that were present in the original sample of DNA. Described here is a method to effectively and efficiently amplify many PCR reactions that is applicable to cases where only a limited amount of DNA is available. In an embodiment, the method may be applied for analysis of single cells, body fluids, mixtures of DNA such as the free floating DNA found in maternal plasma, biopsies, environmental and/or forensic samples.

In an embodiment, the targeted sequencing may involve one, a plurality, or all of the following steps. a) Generate and amplify a library with adaptor sequences on both ends of DNA fragments. b) Divide into multiple reactions after library amplification. c) Generate and optionally amplify a library with adaptor sequences on both ends of DNA fragments. d) Perform 1000- to 10,000-plex amplification of selected targets using one target specific "Forward" primer per target and one tag specific primer. e) Perform a second amplification from this product using "Reverse" target specific primers and one (or more) primer specific to a universal tag that was introduced as part of the target specific forward primers in the first round. f) Perform a 1000-plex preamplification of selected target for a limited number of cycles. g) Divide the product into multiple aliquots and amplify subpools of targets in individual reactions (for example, 50 to 500-plex, though this can be used all the way down to singleplex. h) Pool products of parallel subpools reactions. i) During these amplifications primers may carry sequencing compatible tags (partial or full length) such that the products can be sequenced.

Highly Multiplexed PCR

Disclosed herein are methods that permit the targeted amplification of over a hundred to tens of thousands of target sequences (e.g., SNP loci) from a nucleic acid sample such as genomic DNA obtained from plasma. The amplified sample may be relatively free of primer dimer products and have low allelic bias at target loci. If during or after amplification the products are appended with sequencing compatible adaptors, analysis of these products can be performed by sequencing.

Performing a highly multiplexed PCR amplification using methods known in the art results in the generation of primer dimer products that are in excess of the desired amplification products and not suitable for sequencing. These can be reduced empirically by eliminating primers that form these products, or by performing in silico selection of primers. However, the larger the number of assays, the more difficult this problem becomes.

One solution is to split the 5000-plex reaction into several lower-plexed amplifications, e.g. one hundred 50-plex or fifty 100-plex reactions, or to use microfluidics or even to split the sample into individual PCR reactions. However, if the sample DNA is limited, such as in non-invasive prenatal diagnostics from pregnancy plasma, dividing the sample between multiple reactions should be avoided as this will result in bottlenecking.

Described herein are methods to first globally amplify the plasma DNA of a sample and then divide the sample up into multiple multiplexed target enrichment reactions with more moderate numbers of target sequences per reaction. In an embodiment, a method of the present disclosure can be used for preferentially enriching a DNA mixture at a plurality of loci, the method comprising one or more of the following steps: generating and amplifying a library from a mixture of DNA where the molecules in the library have adaptor sequences ligated on both ends of the DNA fragments, dividing the amplified library into multiple reactions, performing a first round of multiplex amplification of selected targets using one target specific "forward" primer per target and one or a plurality of adaptor specific universal "reverse" primers. In an embodiment, a method of the present disclosure further includes performing a second amplification using "reverse" target specific primers and one or a plurality of primers specific to a universal tag that was introduced as part of the target specific forward primers in the first round. In an embodiment, the method may involve a fully nested, hemi-nested, semi-nested, one sided fully nested, one sided hemi-nested, or one sided semi-nested PCR approach. In an embodiment, a method of the present disclosure is used for preferentially enriching a DNA mixture at a plurality of loci, the method comprising performing a multiplex preamplification of selected targets for a limited number of cycles, dividing the product into multiple aliquots and amplifying subpools of targets in individual reactions, and pooling products of parallel subpools reactions. Note that this approach could be used to perform targeted amplification in a manner that would result in low levels of allelic bias for 50-500 loci, for 500 to 5,000 loci, for 5,000 to 50,000 loci, or even for 50,000 to 500,000 loci. In an embodiment, the primers carry partial or full length sequencing compatible tags.

The workflow may entail (1) extracting DNA such as plasma DNA, (2) preparing fragment library with universal adaptors on both ends of fragments, (3) amplifying the library using universal primers specific to the adaptors, (4) dividing the amplified sample "library" into multiple aliquots, (5) performing multiplex (e.g. about 100-plex, 1,000, or 10,000-plex with one target specific primer per target and a tag-specific primer) amplifications on aliquots, (6) pooling aliquots of one sample, (7) barcoding the sample, (8) mixing the samples and adjusting the concentration, (9) sequencing the sample. The workflow may comprise multiple sub-steps that contain one of the listed steps (e.g. step (2) of preparing the library step could entail three enzymatic steps (blunt ending, dA tailing and adaptor ligation) and three purification steps). Steps of the workflow may be combined, divided up or performed in different order (e.g. bar coding and pooling of samples).

It is important to note that the amplification of a library can be performed in such a way that it is biased to amplify short fragments more efficiently. In this manner it is possible to preferentially amplify shorter sequences, e.g. mononucleosomal DNA fragments as the cell free fetal DNA (of placental origin) found in the circulation of pregnant women. Note that PCR assays can have the tags, for example sequencing tags, (usually a truncated form of 15-25 bases). After multiplexing, PCR multiplexes of a sample are pooled and then the tags are completed (including bar coding) by a tag-specific PCR (could also be done by ligation). Also, the full sequencing tags can be added in the same reaction as the multiplexing. In the first cycles targets may be amplified with the target specific primers, subsequently the tag-specific primers take over to complete the SQ-adaptor sequence. The PCR primers may carry no tags. The sequencing tags may be appended to the amplification products by ligation.

In an embodiment, highly multiplex PCR followed by evaluation of amplified material by clonal sequencing may be used for various applications such as the detection of fetal aneuploidy. Whereas traditional multiplex PCRs evaluate up to fifty loci simultaneously, the approach described herein may be used to enable simultaneous evaluation of more than 50 loci simultaneously, more than 100 loci simultaneously, more than 500 loci simultaneously, more than 1,000 loci simultaneously, more than 5,000 loci simultaneously, more than 10,000 loci simultaneously, more than 50,000 loci simultaneously, and more than 100,000 loci simultaneously. Experiments have shown that up to, including and more than 10,000 distinct loci can be evaluated simultaneously, in a single reaction, with sufficiently good efficiency and specificity to make non-invasive prenatal aneuploidy diagnoses and/or copy number calls with high accuracy. Assays may be combined in a single reaction with the entirety of a sample such as a cfDNA sample isolated from maternal plasma, a fraction thereof, or a further processed derivative of the cfDNA sample. The sample (e.g., cfDNA or derivative) may also be split into multiple parallel multiplex reactions. The optimum sample splitting and multiplex is determined by trading off various performance specifications. Due to the limited amount of material, splitting the sample into multiple fractions can introduce sampling noise, handling time, and increase the possibility of error. Conversely, higher multiplexing can result in greater amounts of spurious amplification and greater inequalities in amplification both of which can reduce test performance.

Two crucial related considerations in the application of the methods described herein are the limited amount of original sample (e.g., plasma) and the number of original molecules in that material from which allele frequency or other measurements are obtained. If the number of original molecules falls below a certain level, random sampling noise becomes significant, and can affect the accuracy of the test. Typically, data of sufficient quality for making non-invasive prenatal aneuploidy diagnoses can be obtained if measurements are made on a sample comprising the equivalent of 500-1000 original molecules per target locus. There are a number of ways of increasing the number of distinct measurements, for example increasing the sample volume. Each manipulation applied to the sample also potentially results in losses of material. It is essential to characterize losses incurred by various manipulations and avoid, or as necessary improve yield of certain manipulations to avoid losses that could degrade performance of the test.

In an embodiment, it is possible to mitigate potential losses in subsequent steps by amplifying all or a fraction of the original sample (e.g., cfDNA sample). Various methods are available to amplify all of the genetic material in a sample, increasing the amount available for downstream procedures. In an embodiment, ligation mediated PCR (LM-PCR) DNA fragments are amplified by PCR after ligation of either one distinct adaptors, two distinct adapters, or many distinct adaptors. In an embodiment, multiple displacement amplification (MDA) phi-29 polymerase is used to amplify all DNA isothermally. In DOP-PCR and variations, random priming is used to amplify the original material DNA. Each method has certain characteristics such as uniformity of amplification across all represented regions of the genome, efficiency of capture and amplification of original DNA, and amplification performance as a function of the length of the fragment.

In an embodiment LM-PCR may be used with a single heteroduplexed adaptor having a 3-prime tyrosine. The heteroduplexed adaptor enables the use of a single adaptor molecule that may be converted to two distinct sequences on 5-prime and 3-prime ends of the original DNA fragment during the first round of PCR. In an embodiment, it is possible to fractionate the amplified library by size separations, or products such as AMPURE, TASS or other similar methods. Prior to ligation, sample DNA may be blunt ended, and then a single adenosine base is added to the 3-prime end. Prior to ligation the DNA may be cleaved using a restriction enzyme or some other cleavage method. During ligation the 3-prime adenosine of the sample fragments and the complementary 3-prime tyrosine overhang of adaptor can enhance ligation efficiency. The extension step of the PCR amplification may be limited from a time standpoint to reduce amplification from fragments longer than about 200 bp, about 300 bp, about 400 bp, about 500 bp or about 1,000 bp. Since longer DNA found in the maternal plasma is nearly exclusively maternal, this may result in the enrichment of fetal DNA by 10-50% and improvement of test performance. A number of reactions were run using conditions as specified by commercially available kits; the resulted in successful ligation of fewer than 10% of sample DNA molecules. A series of optimizations of the reaction conditions for this improved ligation to approximately 70%.

Mini-PCR

The following Mini-PCR method is desirable for samples containing short nucleic acids, digested nucleic acids, or fragmented nucleic acids, such as cfDNA. Traditional PCR assay design results in significant losses of distinct fetal molecules, but losses can be greatly reduced by designing very short PCR assays, termed mini-PCR assays. Fetal cfDNA in maternal serum is highly fragmented and the fragment sizes are distributed in approximately a Gaussian fashion with a mean of 160 bp, a standard deviation of 15 bp, a minimum size of about 100 bp, and a maximum size of about 220 bp. The distribution of fragment start and end positions with respect to the targeted polymorphisms, while not necessarily random, vary widely among individual targets and among all targets collectively and the polymorphic site of one particular target locus may occupy any position from the start to the end among the various fragments originating from that locus. Note that the term mini-PCR may equally well refer to normal PCR with no additional restrictions or limitations.

During PCR, amplification will only occur from template DNA fragments comprising both forward and reverse primer sites. Because fetal cfDNA fragments are short, the likelihood of both primer sites being present the likelihood of a fetal fragment of length L comprising both the forward and reverse primers sites is ratio of the length of the amplicon to the length of the fragment. Under ideal conditions, assays in which the amplicon is 45, 50, 55, 60, 65, or 70 bp will successfully amplify from 72%, 69%, 66%, 63%, 59%, or 56%, respectively, of available template fragment molecules. The amplicon length is the distance between the 5-prime ends of the forward and reverse priming sites. Amplicon length that is shorter than typically used by those known in the art may result in more efficient measurements of the desired polymorphic loci by only requiring short sequence reads. In an embodiment, a substantial fraction of the amplicons should be less than 100 bp, less than 90 bp, less than 80 bp, less than 70 bp, less than 65 bp, less than 60 bp, less than 55 bp, less than 50 bp, or less than 45 bp.

Note that in methods known in the prior art, short assays such as those described herein are usually avoided because they are not required and they impose considerable constraint on primer design by limiting primer length, annealing characteristics, and the distance between the forward and reverse primer.

Also note that there is the potential for biased amplification if the 3-prime end of the either primer is within roughly 1-6 bases of the polymorphic site. This single base difference at the site of initial polymerase binding can result in preferential amplification of one allele, which can alter observed allele frequencies and degrade performance. All of these constraints make it very challenging to identify primers that will amplify a particular locus successfully and furthermore, to design large sets of primers that are compatible in the same multiplex reaction. In an embodiment, the 3' end of the inner forward and reverse primers are designed to hybridize to a region of DNA upstream from the polymorphic site, and separated from the polymorphic site by a small number of bases. Ideally, the number of bases may be between 6 and 10 bases, but may equally well be between 4 and 15 bases, between three and 20 bases, between two and 30 bases, or between 1 and 60 bases, and achieve substantially the same end.

Multiplex PCR may involve a single round of PCR in which all targets are amplified or it may involve one round of PCR followed by one or more rounds of nested PCR or some variant of nested PCR. Nested PCR consists of a subsequent round or rounds of PCR amplification using one or more new primers that bind internally, by at least one base pair, to the primers used in a previous round. Nested PCR reduces the number of spurious amplification targets by amplifying, in subsequent reactions, only those amplification products from the previous one that have the correct internal sequence. Reducing spurious amplification targets improves the number of useful measurements that can be obtained, especially in sequencing. Nested PCR typically entails designing primers completely internal to the previous primer binding sites, necessarily increasing the minimum DNA segment size required for amplification. For samples such as maternal plasma cfDNA, in which the DNA is highly fragmented, the larger assay size reduces the number of distinct cfDNA molecules from which a measurement can be obtained. In an embodiment, to offset this effect, one may use a partial nesting approach where one or both of the second round primers overlap the first binding sites extending internally some number of bases to achieve additional specificity while minimally increasing in the total assay size.

In an embodiment, a multiplex pool of PCR assays are designed to amplify potentially heterozygous SNP or other polymorphic or non-polymorphic loci on one or more chromosomes and these assays are used in a single reaction to amplify DNA. The number of PCR assays may be between 50 and 200 PCR assays, between 200 and 1,000 PCR assays, between 1,000 and 5,000 PCR assays, or between 5,000 and 20,000 PCR assays (50 to 200-plex, 200 to 1,000-plex, 1,000 to 5,000-plex, 5,000 to 20,000-plex, more than 20,000-plex respectively). In an embodiment, a multiplex pool of about 10,000 PCR assays (10,000-plex) are designed to amplify potentially heterozygous SNP loci on chromosomes X, Y, 13, 18, and 21 and 1 or 2 and these assays are used in a single reaction to amplify cfDNA obtained from a material plasma sample, chorion villus samples, amniocentesis samples, single or a small number of cells, other bodily fluids or tissues, cancers, or other genetic matter. The SNP frequencies of each locus may be determined by clonal or some other method of sequencing of the amplicons. Statistical analysis of the allele frequency distributions or ratios of all assays may be used to determine if the sample contains a trisomy of one or more of the chromosomes included in the test. In another embodiment the original cfDNA samples is split into two samples and parallel 5,000-plex assays are performed. In another embodiment the original cfDNA samples is split into n samples and parallel (10,000/n)-plex assays are performed where n is between 2 and 12, or between 12 and 24, or between 24 and 48, or between 48 and 96. Data is collected and analyzed in a similar manner to that already described. Note that this method is equally well applicable to detecting translocations, deletions, duplications, and other chromosomal abnormalities.

In an embodiment, tails with no homology to the target genome may also be added to the 3-prime or 5-prime end of any of the primers. These tails facilitate subsequent manipulations, procedures, or measurements. In an embodiment, the tail sequence can be the same for the forward and reverse target specific primers. In an embodiment, different tails may be used for the forward and reverse target specific primers. In an embodiment, a plurality of different tails may be used for different loci or sets of loci. Certain tails may be shared among all loci or among subsets of loci. For example, using forward and reverse tails corresponding to forward and reverse sequences required by any of the current sequencing platforms can enable direct sequencing following amplification. In an embodiment, the tails can be used as common priming sites among all amplified targets that can be used to add other useful sequences. In some embodiments, the inner primers may contain a region that is designed to hybridize either upstream or downstream of the targeted locus (e.g., a polymorphic locus). In some embodiments, the primers may contain a molecular barcode. In some embodiments, the primer may contain a universal priming sequence designed to allow PCR amplification.

In an embodiment, a 10,000-plex PCR assay pool is created such that forward and reverse primers have tails corresponding to the required forward and reverse sequences required by a high throughput sequencing instrument such as the HISEQ, GAIIX, or MYSEQ available from ILLUMINA. In addition, included 5-prime to the sequencing tails is an additional sequence that can be used as a priming site in a subsequent PCR to add nucleotide barcode sequences to the amplicons, enabling multiplex sequencing of multiple samples in a single lane of the high throughput sequencing instrument.

In an embodiment, a 10,000-plex PCR assay pool is created such that reverse primers have tails corresponding to the required reverse sequences required by a high throughput sequencing instrument. After amplification with the first 10,000-plex assay, a subsequent PCR amplification may be performed using a another 10,000-plex pool having partly nested forward primers (e.g. 6-bases nested) for all targets and a reverse primer corresponding to the reverse sequencing tail included in the first round. This subsequent round of partly nested amplification with just one target specific primer and a universal primer limits the required size of the assay, reducing sampling noise, but greatly reduces the number of spurious amplicons. The sequencing tags can be added to appended ligation adaptors and/or as part of PCR probes, such that the tag is part of the final amplicon.

Fetal fraction affects performance of the test. There are a number of ways to enrich the fetal fraction of the DNA found in maternal plasma. Fetal fraction can be increased by the previously described LM-PCR method already discussed as well as by a targeted removal of long maternal fragments. In an embodiment, prior to multiplex PCR amplification of the target loci, an additional multiplex PCR reaction may be carried out to selectively remove long and largely maternal fragments corresponding to the loci targeted in the subsequent multiplex PCR. Additional primers are designed to anneal a site a greater distance from the polymorphism than is expected to be present among cell free fetal DNA fragments. These primers may be used in a one cycle multiplex PCR reaction prior to multiplex PCR of the target polymorphic loci. These distal primers are tagged with a molecule or moiety that can allow selective recognition of the tagged pieces of DNA. In an embodiment, these molecules of DNA may be covalently modified with a biotin molecule that allows removal of newly formed double stranded DNA comprising these primers after one cycle of PCR. Double stranded DNA formed during that first round is likely maternal in origin. Removal of the hybrid material may be accomplish by the used of magnetic streptavidin beads. There are other methods of tagging that may work equally well. In an embodiment, size selection methods may be used to enrich the sample for shorter strands of DNA; for example those less than about 800 bp, less than about 500 bp, or less than about 300 bp. Amplification of short fragments can then proceed as usual.

The mini-PCR method described in this disclosure enables highly multiplexed amplification and analysis of hundreds to thousands or even millions of loci in a single reaction, from a single sample. At the same, the detection of the amplified DNA can be multiplexed; tens to hundreds of samples can be multiplexed in one sequencing lane by using barcoding PCR. This multiplexed detection has been successfully tested up to 49-plex, and a much higher degree of multiplexing is possible. In effect, this allows hundreds of samples to be genotyped at thousands of SNPs in a single sequencing run. For these samples, the method allows determination of genotype and heterozygosity rate and simultaneously determination of copy number, both of which may be used for the purpose of aneuploidy detection. This method is particularly useful in detecting aneuploidy of a gestating fetus from the free floating DNA found in maternal plasma. This method may be used as part of a method for sexing a fetus, and/or predicting the paternity of the fetus. It may be used as part of a method for mutation dosage. This method may be used for any amount of DNA or RNA, and the targeted regions may be SNPs, other polymorphic regions, non-polymorphic regions, and combinations thereof.

In some embodiments, ligation mediated universal-PCR amplification of fragmented DNA may be used. The ligation mediated universal-PCR amplification can be used to amplify plasma DNA, which can then be divided into multiple parallel reactions. It may also be used to preferentially amplify short fragments, thereby enriching fetal fraction. In some embodiments the addition of tags to the fragments by ligation can enable detection of shorter fragments, use of shorter target sequence specific portions of the primers and/or annealing at higher temperatures which reduces unspecific reactions.

The methods described herein may be used for a number of purposes where there is a target set of DNA that is mixed with an amount of contaminating DNA. In some embodiments, the target DNA and the contaminating DNA may be from individuals who are genetically related. For example, genetic abnormalities in a fetus (target) may be detected from maternal plasma which contains fetal (target) DNA and also maternal (contaminating) DNA; the abnormalities include whole chromosome abnormalities (e.g. aneuploidy) partial chromosome abnormalities (e.g. deletions, duplications, inversions, and translocations), polynucleotide polymorphisms (e.g. STRs), single nucleotide polymorphisms, and/or other genetic abnormalities or differences. In some embodiments, the target and contaminating DNA may be from the same individual, but where the target and contaminating DNA are different by one or more mutations, for example in the case of cancer. (see e.g. H. Mamon et al. *Preferential Amplification of Apoptotic DNA from Plasma: Potential for Enhancing Detection of Minor DNA Alterations in Circulating DNA*. Clinical Chemistry 54:9 (2008). In some embodiments, the DNA may be found in cell culture (apoptotic) supernatant. In some embodiments, it is possible to induce apoptosis in biological samples (e.g., blood) for subsequent library preparation, amplification and/or sequencing. A number of enabling workflows and protocols to achieve this end are presented elsewhere in this disclosure.

In some embodiments, the target DNA may originate from single cells, from samples of DNA consisting of less than one copy of the target genome, from low amounts of DNA, from DNA from mixed origin (e.g. pregnancy plasma: placental and maternal DNA; cancer patient plasma and tumors: mix between healthy and cancer DNA, transplantation etc), from other body fluids, from cell cultures, from culture supernatants, from forensic samples of DNA, from ancient samples of DNA (e.g. insects trapped in amber), from other samples of DNA, and combinations thereof.

In some embodiments, a short amplicon size may be used. Short amplicon sizes are especially suited for fragmented DNA (see e.g. A. Sikora, et al. Detection of increased amounts of cell-free fetal DNA with short PCR amplicons. Clin Chem. 2010 January; 56(1):136-8.)

The use of short amplicon sizes may result in some significant benefits. Short amplicon sizes may result in optimized amplification efficiency. Short amplicon sizes typically produce shorter products, therefore there is less chance for nonspecific priming. Shorter products can be clustered more densely on sequencing flow cell, as the clusters will be smaller. Note that the methods described herein may work equally well for longer PCR amplicons. Amplicon length may be increased if necessary, for example, when sequencing larger sequence stretches. Experiments with 146-plex targeted amplification with assays of 100 bp to 200 bp length as first step in a nested-PCR protocol were run on single cells and on genomic DNA with positive results.

In some embodiments, the methods described herein may be used to amplify and/or detect SNPs, copy number, nucleotide methylation, mRNA levels, other types of RNA expression levels, other genetic and/or epigenetic features. The mini-PCR methods described herein may be used along with next-generation sequencing; it may be used with other downstream methods such as microarrays, counting by digital PCR, real-time PCR, Mass-spectrometry analysis etc.

In some embodiment, the mini-PCR amplification methods described herein may be used as part of a method for accurate quantification of minority populations. It may be used for absolute quantification using spike calibrators. It may be used for mutation/minor allele quantification through very deep sequencing, and may be run in a highly multiplexed fashion. It may be used for standard paternity and identity testing of relatives or ancestors, in human, animals, plants or other creatures. It may be used for forensic testing. It may be used for rapid genotyping and copy number analysis (CN), on any kind of material, e.g. amniotic fluid and CVS, sperm, product of conception (POC). It may be used for single cell analysis, such as genotyping on samples biopsied from embryos. It may be used for rapid embryo analysis (within less than one, one, or two days of biopsy) by targeted sequencing using min-PCR.

In some embodiments, it may be used for tumor analysis: tumor biopsies are often a mixture of health and tumor cells. Targeted PCR allows deep sequencing of SNPs and loci with close to no background sequences. It may be used for copy number and loss of heterozygosity analysis on tumor DNA. Said tumor DNA may be present in many different body fluids or tissues of tumor patients. It may be used for detection of tumor recurrence, and/or tumor screening. It may be used for quality control testing of seeds. It may be used for breeding, or fishing purposes. Note that any of these methods could equally well be used targeting non-polymorphic loci for the purpose of ploidy calling.

Some literature describing some of the fundamental methods that underlie the methods disclosed herein include: (1) Wang H Y, Luo M, Tereshchenko I V, Frikker D M, Cui X, Li J Y, Hu G, Chu Y, Azaro M A, Lin Y, Shen L, Yang Q, Kambouris M E, Gao R, Shih W, Li H. Genome Res. 2005 February; 15(2):276-83. Department of Molecular Genetics, Microbiology and Immunology/The Cancer Institute of New Jersey, Robert Wood Johnson Medical School, New Brunswick, N.J. 08903, USA. (2) High-throughput genotyping of single nucleotide polymorphisms with high sensitivity. Li H, Wang H Y, Cui X, Luo M, Hu G, Greenawalt D M, Tereshchenko I V, Li J Y, Chu Y, Gao R. Methods Mol Biol. 2007; 396-PubMed PMID: 18025699. (3) A method comprising multiplexing of an average of 9 assays for sequencing is described in: Nested Patch PCR enables highly multiplexed mutation discovery in candidate genes. Varley K E, Mitra R D. Genome Res. 2008 November; 18(11): 1844-50. Epub 2008 Oct. 10. Note that the methods disclosed herein allow multiplexing of orders of magnitude more than in the above references.

Targeted PCR Variants—Nesting

There are many workflows that are possible when conducting PCR; some workflows typical to the methods disclosed herein are described. The steps outlined herein are not meant to exclude other possible steps nor does it imply that any of the steps described herein are required for the method to work properly. A large number of parameter variations or other modifications are known in the literature, and may be made without affecting the essence of the invention. One particular generalized workflow is given below followed by a number of possible variants. The variants typically refer to possible secondary PCR reactions, for example different types of nesting that may be done (step 3). It is important to note that variants may be done at different times, or in different orders than explicitly described herein. Examples that use polymorphic loci for illustration can be readily adapted for the amplification of nonpolymorphic loci if desired.

The DNA in the sample may have ligation adapters, often referred to as library tags or ligation adaptor tags (LTs), appended, where the ligation adapters contain a universal priming sequence, followed by a universal amplification. In an embodiment, this may be done using a standard protocol designed to create sequencing libraries after fragmentation. In an embodiment, the DNA sample can be blunt ended, and then an A can be added at the 3' end. A Y-adaptor with a T-overhang can be added and ligated. In some embodiments, other sticky ends can be used other than an A or T overhang. In some embodiments, other adaptors can be added, for example looped ligation adaptors. In some embodiments, the adaptors may have tag designed for PCR amplification.

Specific Target Amplification (STA): Pre-amplification of hundreds to thousands to tens of thousands and even hundreds of thousands of targets may be multiplexed in one reaction volume. STA is typically run from 10 to 30 cycles, though it may be run from 5 to 40 cycles, from 2 to 50 cycles, and even from 1 to 100 cycles. Primers may be tailed, for example for a simpler workflow or to avoid sequencing of a large proportion of dimers. Note that typically, dimers of both primers carrying the same tag will not be amplified or sequenced efficiently. In some embodiments, between 1 and 10 cycles of PCR may be carried out; in some embodiments between 10 and 20 cycles of PCR may be carried out; in some embodiments between 20 and 30 cycles of PCR may be carried out; in some embodiments between 30 and 40 cycles of PCR may be carried out; in some embodiments more than 40 cycles of PCR may be carried out. The amplification may be a linear amplification. The number of PCR cycles may be optimized to result in an optimal depth of read (DOR) profile. Different DOR profiles may be desirable for different purposes. In some embodiments, a more even distribution of reads between all assays is desirable; if the DOR is too small for some assays, the stochastic noise can be too high for the data to be too useful, while if the depth of read is too high, the marginal usefulness of each additional read is relatively small.

Primer tails may improve the detection of fragmented DNA from universally tagged libraries. If the library tag and the primer-tails contain a homologous sequence, hybridization can be improved (for example, melting temperature ($T_M$) is lowered) and primers can be extended if only a portion of the primer target sequence is in the sample DNA fragment. In some embodiments, 13 or more target specific base pairs may be used. In some embodiments, 10 to 12 target specific base pairs may be used. In some embodiments, 8 to 9 target specific base pairs may be used. In some embodiments, 6 to 7 target specific base pairs may be used. In some embodiments, STA may be performed on pre-amplified DNA, e.g. MDA, RCA, other whole genome amplifications, or adaptor-mediated universal PCR. In some embodiments, STA may be performed on samples that are enriched or depleted of certain sequences and populations, e.g. by size selection, target capture, directed degradation.

In some embodiments, it is possible to perform secondary multiplex PCRs or primer extension reactions to increase specificity and reduce undesirable products. For example, full nesting, semi-nesting, hemi-nesting, and/or subdividing into parallel reactions of smaller assay pools are all techniques that may be used to increase specificity. Experiments have shown that splitting a sample into three 400-plex reactions resulted in product DNA with greater specificity than one 1,200-plex reaction with exactly the same primers. Similarly, experiments have shown that splitting a sample into four 2,400-plex reactions resulted in product DNA with greater specificity than one 9,600-plex reaction with exactly the same primers. In an embodiment, it is possible to use target-specific and tag specific primers of the same and opposing directionality.

In some embodiments, it is possible to amplify a DNA sample (dilution, purified or otherwise) produced by an STA reaction using tag-specific primers and "universal amplification", i.e. to amplify many or all pre-amplified and tagged targets. Primers may contain additional functional sequences, e.g. barcodes, or a full adaptor sequence necessary for sequencing on a high throughput sequencing platform.

These methods may be used for analysis of any sample of DNA, and are especially useful when the sample of DNA is particularly small, or when it is a sample of DNA where the DNA originates from more than one individual, such as in the case of maternal plasma. These methods may be used on DNA samples such as a single or small number of cells, genomic DNA, plasma DNA, amplified plasma libraries, amplified apoptotic supernatant libraries, or other samples of mixed DNA. In an embodiment, these methods may be used in the case where cells of different genetic constitution may be present in a single individual, such as with cancer or transplants. In an embodiment, some of the DNA is from the recipient of a transplant (such as recipient cell-free or cellular DNA) and some of the DNA is from the donor of the transplant (such as cell-free or cellular DNA from the transplant). In an embodiment, the method is used to amplify one or more loci that differ between the recipient and the donor (such as loci for which a different combination of alleles are present in the recipient compared to the donor). In some embodiments, the recipient is homozygous for a first allele (such as AA) and the donor is homozygous for a second allele (such as BB) or is heterozygous with the first allele and a second allele (such as AB) at one or more loci. In some embodiments, the method is used to measure the absolute or relative amount of DNA from the donor of the transplant (such as cell-free or cellular DNA from the transplant). In some embodiments, this method is used to prognose, diagnose, detect, or monitor a transplant status or outcome, such as transplant rejection, tolerance, non-rejection based allograft injury, transplant function, transplant survival, chronic transplant injury, or tittering of pharmacological immunosuppression.

Protocol Variants (Variants and/or Additions to the Workflow Above)

Direct Multiplexed Mini-PCR:

Specific target amplification (STA) of a plurality of target sequences with tagged primers is shown in FIG. 1. 101 denotes double stranded DNA with a polymorphic locus of interest at X. 102 denotes the double stranded DNA with ligation adaptors added for universal amplification. 103 denotes the single stranded DNA that has been universally amplified with PCR primers hybridized. 104 denotes the final PCR product. In some embodiments, STA may be done on more than 100, more than 200, more than 500, more than 1,000, more than 2,000, more than 5,000, more than 10,000, more than 20,000, more than 50,000, more than 100,000 or more than 200,000 targets. In a subsequent reaction, tag-specific primers amplify all target sequences and lengthen the tags to include all necessary sequences for sequencing, including sample indexes. In an embodiment, primers may not be tagged or only certain primers may be tagged. Sequencing adaptors may be added by conventional adaptor ligation. In an embodiment, the initial primers may carry the tags.

In an embodiment, primers are designed so that the length of DNA amplified is unexpectedly short. Prior art demonstrates that ordinary people skilled in the art typically design 100+ bp amplicons. In an embodiment, the amplicons may be designed to be less than 80 bp. In an embodiment, the amplicons may be designed to be less than 70 bp. In an embodiment, the amplicons may be designed to be less than 60 bp. In an embodiment, the amplicons may be designed to be less than 50 bp. In an embodiment, the amplicons may be designed to be less than 45 bp. In an embodiment, the amplicons may be designed to be less than 40 bp. In an embodiment, the amplicons may be designed to be less than 35 bp. In an embodiment, the amplicons may be designed to be between 40 and 65 bp.

An experiment was performed using this protocol using 1200-plex amplification. Both genomic DNA and pregnancy plasma were used; about 70% of sequence reads mapped to targeted sequences. Details are given elsewhere in this document. Sequencing of a 1042-plex without design and selection of assays resulted in >99% of sequences being primer dimer products.

Sequential PCR:

After STA1 multiple aliquots of the product may be amplified in parallel with pools of reduced complexity with the same primers. The first amplification can give enough material to split. This method is especially good for small samples, for example those that are about 6-100 pg, about 100 pg to 1 ng, about 1 ng to 10 ng, or about 10 ng to 100 ng. The protocol was performed with 1200-plex into three 400-plexes. Mapping of sequencing reads increased from around 60 to 70% in the 1200-plex alone to over 95%.

Figure 2:
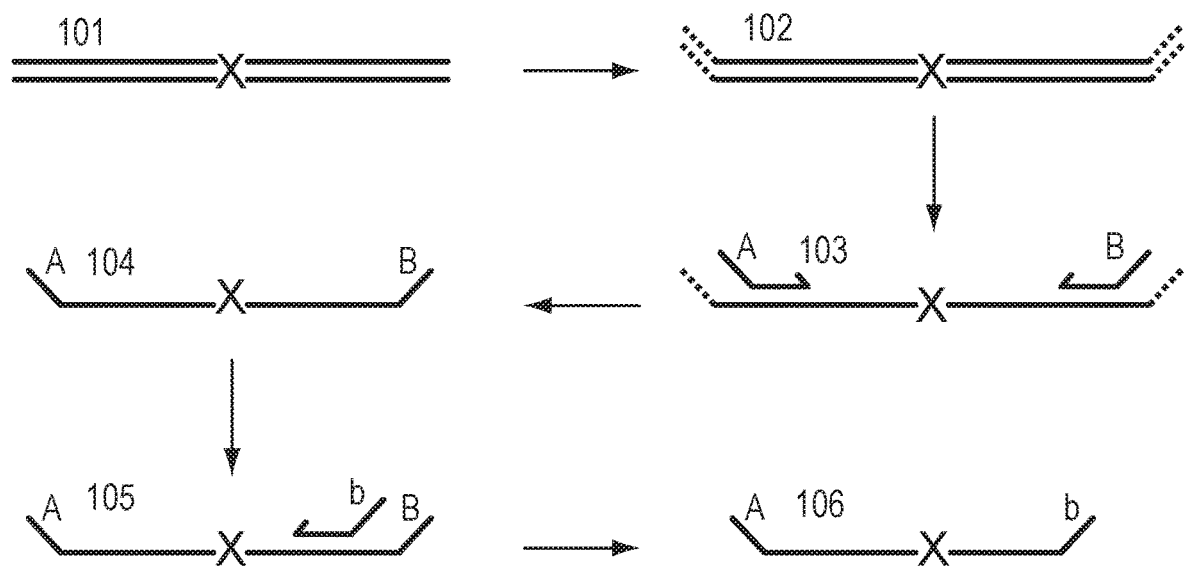
FIG. 2: Graphical representation of semi-nested mini-PCR method.

Semi-Nested Mini-PCR:

(see FIG. 2) After STA1 a second STA is performed comprising a multiplex set of internal nested Forward primers (103 B, 105 b) and one (or few) tag-specific Reverse primers (103 A). 101 denotes double stranded DNA with a polymorphic locus of interest at X. 102 denotes the double stranded DNA with ligation adaptors added for universal amplification. 103 denotes the single stranded DNA that has been universally amplified with Forward primer B and Reverse Primer A hybridized. 104 denotes the PCR product from 103. 105 denotes the product from 104 with nested Forward primer b hybridized, and Reverse tag A already part of the molecule from the PCR that occurred between 103 and 104. 106 denotes the final PCR product. With this workflow usually greater than 95% of sequences map to the intended targets. The nested primer may overlap with the outer Forward primer sequence but introduces additional 3'-end bases. In some embodiments it is possible to use between one and 20 extra 3' bases. Experiments have shown that using 9 or more extra 3' bases in a 1200-plex designs works well. As readily apparent, the primers for the second STA can alternatively be considered a multiplex set of internal nested Reverse primers and one (or a few) tag-specific Forward primers.

Figure 3:
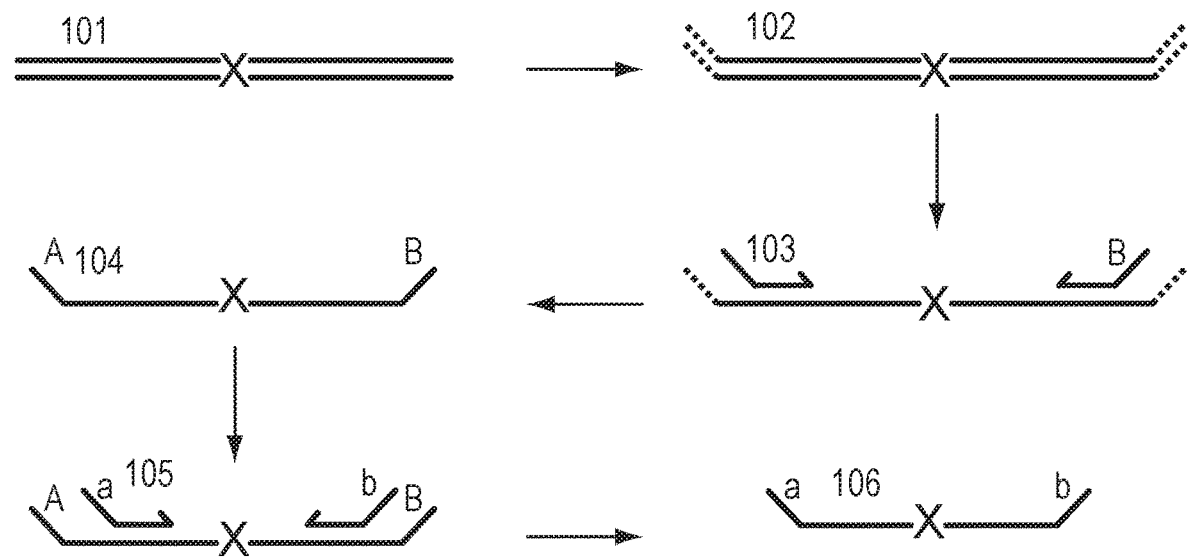
FIG. 3: Graphical representation of fully nested mini-PCR method.

Fully Nested Mini-PCR:

(see FIG. 3) After STA step 1, it is possible to perform a second multiplex PCR (or parallel m.p. PCRs of reduced complexity) with two nested primers carrying tags (A, a, B, b). 101 denotes double stranded DNA with a polymorphic locus of interest at X. 102 denotes the double stranded DNA with ligation adaptors added for universal amplification. 103 denotes the single stranded DNA that has been universally amplified with Forward primer B and Reverse Primer A hybridized. 104 denotes the PCR product from 103. 105 denotes the product from 104 with nested Forward primer b and nested Reverse primer a hybridized. 106 denotes the final PCR product. In some embodiments, it is possible to use two full sets of primers. Experiments using a fully nested mini-PCR protocol were used to perform 146-plex amplification on single and three cells without step 102 of appending universal ligation adaptors and amplifying.

Figure 4:
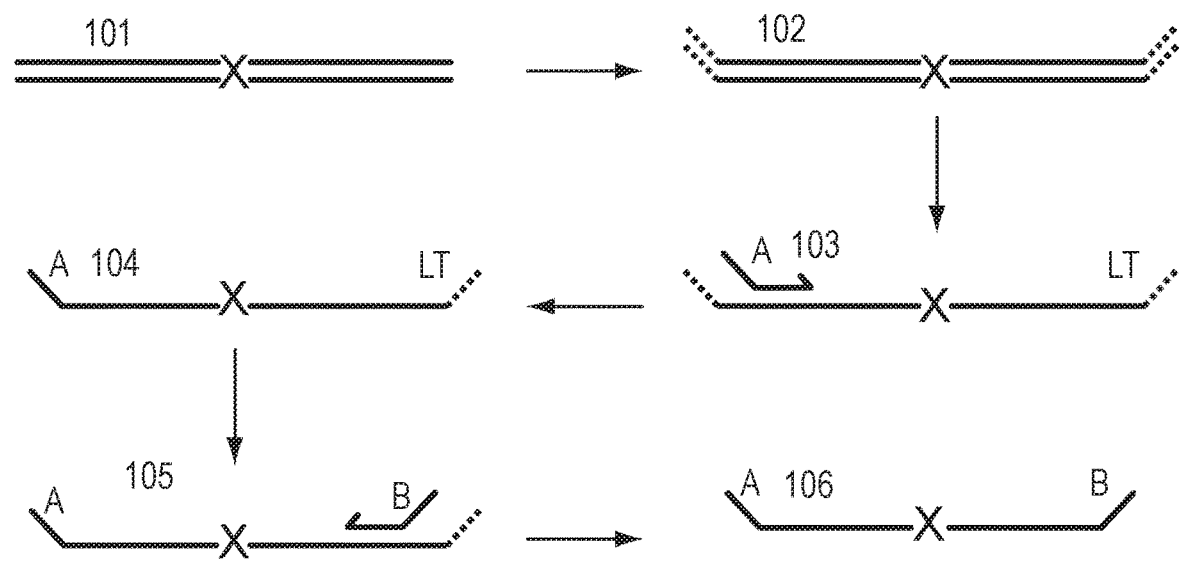
FIG. 4: Graphical representation of hemi-nested mini-PCR method.

Hemi-Nested Mini-PCR:

(see FIG. 4) It is possible to use target DNA that has and adaptors at the fragment ends. STA is performed comprising a multiplex set of Forward primers (B) and one (or few) tag-specific Reverse primers (A). A second STA can be performed using a universal tag-specific Forward primer and target specific Reverse primer. 101 denotes double stranded DNA with a polymorphic locus of interest at X. 102 denotes the double stranded DNA with ligation adaptors added for universal amplification. 103 denotes the single stranded DNA that has been universally amplified with Reverse Primer A hybridized. 104 denotes the PCR product from 103 that was amplified using Reverse primer A and ligation adaptor tag primer LT. 105 denotes the product from 104 with Forward primer B hybridized. 106 denotes the final PCR product. In this workflow, target specific Forward and Reverse primers are used in separate reactions, thereby reducing the complexity of the reaction and preventing dimer formation of forward and reverse primers. Note that in this example, primers A and B may be considered to be first primers, and primers 'a' and 'b' may be considered to be inner primers. This method is a big improvement on direct PCR as it is as good as direct PCR, but it avoids primer dimers. After first round of hemi nested protocol one typically sees ~99% non-targeted DNA, however, after second round there is typically a big improvement. As readily apparent, the primers for the first STA can be considered a multiplex set of Reverse primers and one (or few) tag-specific Forward primers, and the primers for the second STA can be considered a universal tag-specific Reverse primer and target specific Forward primer(s).

Figure 5:
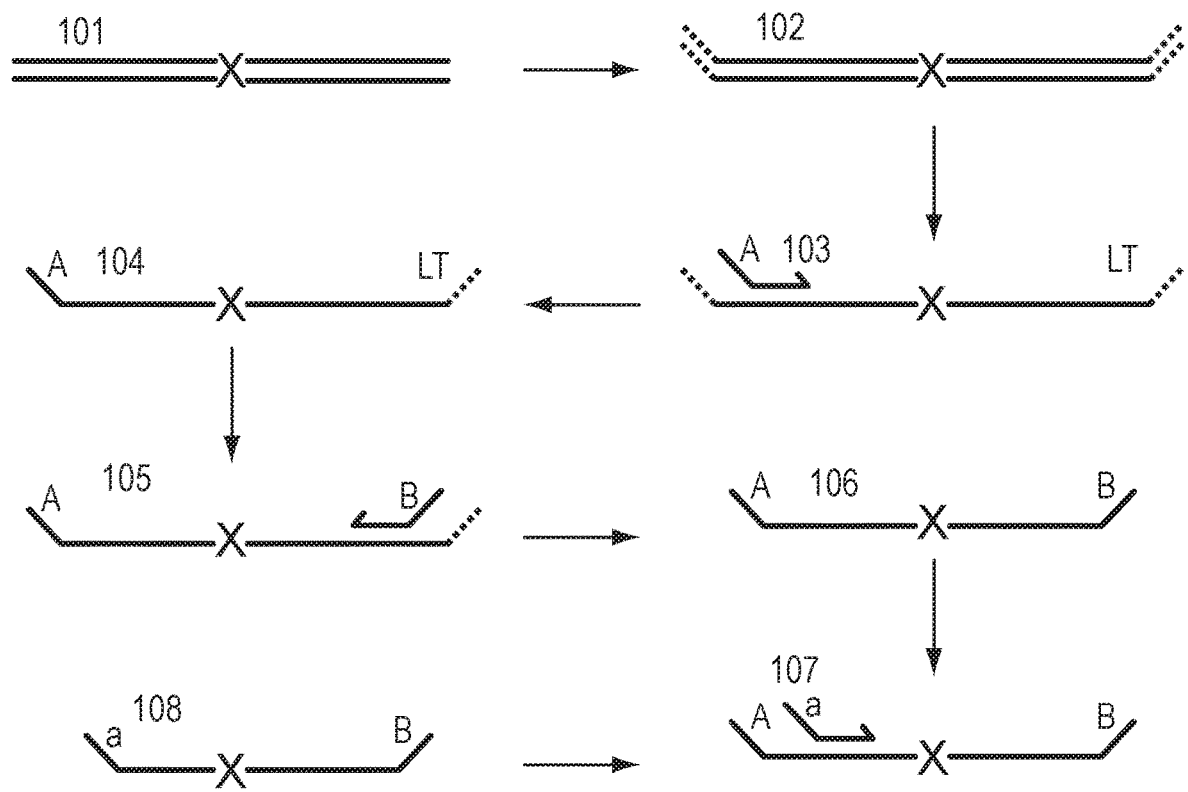
FIG. 5: Graphical representation of triply hemi-nested mini-PCR method.

Triply Hemi-Nested Mini-PCR:

(see FIG. 5) It is possible to use target DNA that has and adaptor at the fragment ends. STA is performed comprising a multiplex set of Forward primers (B) and one (or few) tag-specific Reverse primers (A) and (a). A second STA can be performed using a universal tag-specific Forward primer and target specific Reverse primer. 101 denotes double stranded DNA with a polymorphic locus of interest at X. 102 denotes the double stranded DNA with ligation adaptors added for universal amplification. 103 denotes the single stranded DNA that has been universally amplified with Reverse Primer A hybridized. 104 denotes the PCR product from 103 that was amplified using Reverse primer A and ligation adaptor tag primer LT. 105 denotes the product from 104 with Forward primer B hybridized. 106 denotes the PCR product from 105 that was amplified using Reverse primer A and Forward primer B. 107 denotes the product from 106 with Reverse primer 'a' hybridized. 108 denotes the final PCR product. Note that in this example, primers 'a' and B may be considered to be inner primers, and A may be considered to be a first primer. Optionally, both A and B may be considered to be first primers, and 'a' may be considered to be an inner primer. The designation of reverse and forward primers may be switched. In this workflow, target specific Forward and Reverse primers are used in separate reactions, thereby reducing the complexity of the reaction and preventing dimer formation of forward and reverse primers. This method is a big improvement on direct PCR as it is as good as direct PCR, but it avoids primer dimers. After first round of hemi nested protocol one typically sees ~99% non-targeted DNA, however, after second round there is typically a big improvement.

Figure 6:
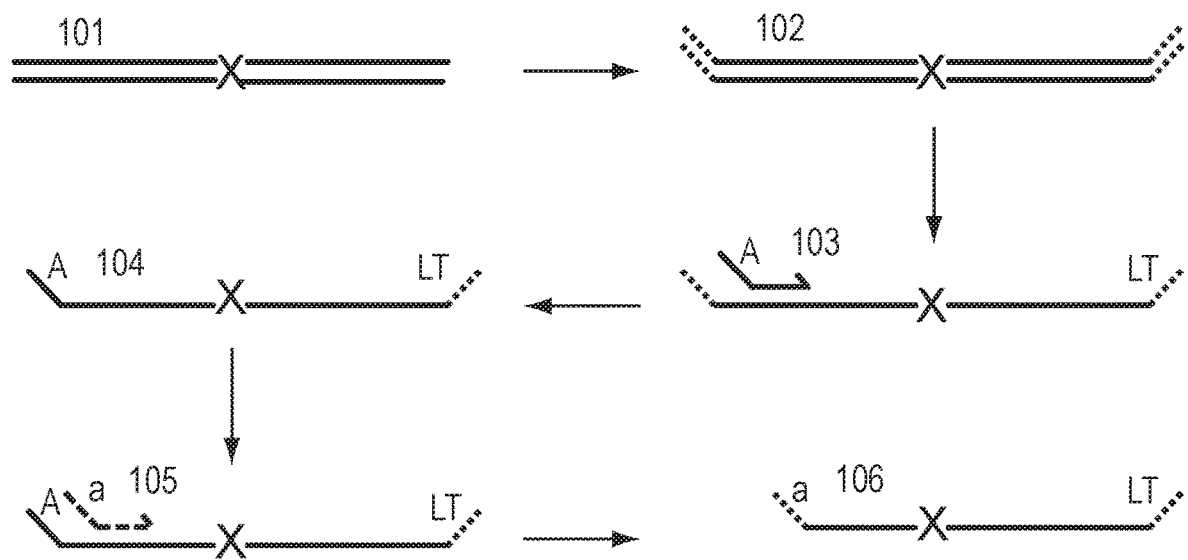
FIG. 6: Graphical representation of one-sided nested mini-PCR method.
Figure 7:
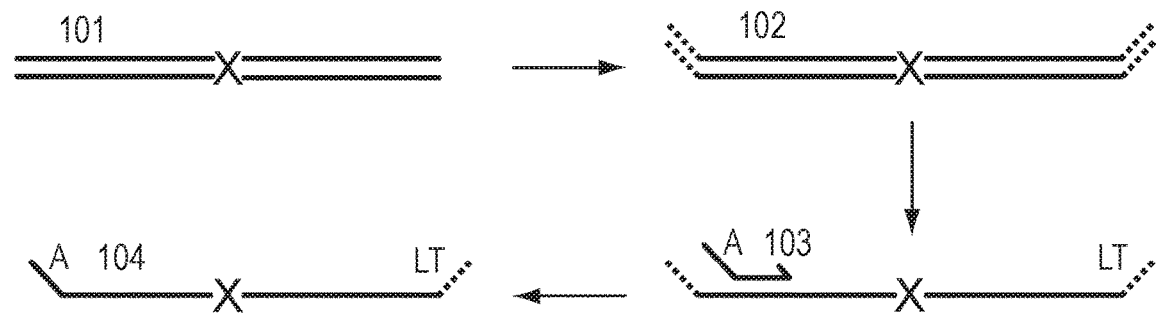
FIG. 7: Graphical representation of one-sided mini-PCR method.
Figure 8:
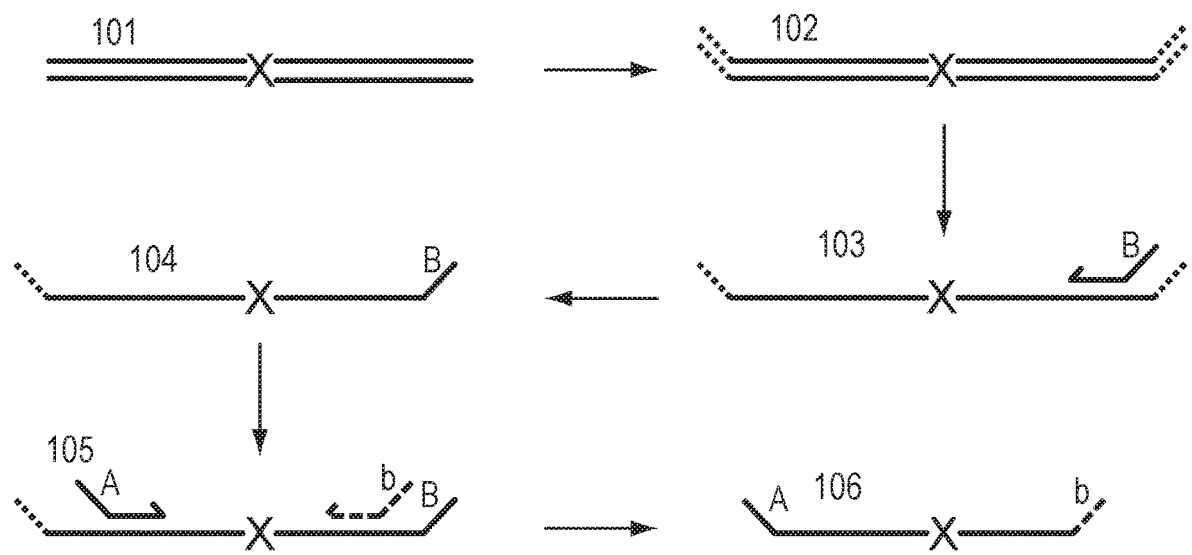
FIG. 8: Graphical representation of reverse semi-nested mini-PCR method.

One-Sided Nested Mini-PCR:

(See FIG. 6) it is possible to use target DNA that has an adaptor at the fragment ends. STA may also be performed with a multiplex set of nested Forward primers and using the ligation adapter tag as the Reverse primer. A second STA may then be performed using a set of nested Forward primers and a universal Reverse primer. 101 denotes double stranded DNA with a polymorphic locus of interest at X. 102 denotes the double stranded DNA with ligation adaptors added for universal amplification. 103 denotes the single stranded DNA that has been universally amplified with Forward Primer A hybridized. 104 denotes the PCR product from 103 that was amplified using Forward primer A and ligation adaptor tag Reverse primer LT. 105 denotes the product from 104 with nested Forward primer a hybridized. 106 denotes the final PCR product. This method can detect shorter target sequences than standard PCR by using overlapping primers in the first and second STAs. The method is typically performed off a sample of DNA that has already undergone STA step 1 above—appending of universal tags and amplification; the two nested primers are only on one side, other side uses the library tag. The method was performed on libraries of apoptotic supernatants and pregnancy plasma. With this workflow around 60% of sequences mapped to the intended targets. Note that reads that contained the reverse adaptor sequence were not mapped, so this number is expected to be higher if those reads that contain the reverse adaptor sequence are mapped One-Sided Mini-PCR:

It is possible to use target DNA that has an adaptor at the fragment ends (see FIG. 7). STA may be performed with a multiplex set of Forward primers and one (or few) tag-specific Reverse primer. 101 denotes double stranded DNA with a polymorphic locus of interest at X. 102 denotes the double stranded DNA with ligation adaptors added for universal amplification. 103 denotes the single stranded DNA with Forward Primer A hybridized. 104 denotes the PCR product from 103 that was amplified using Forward primer A and ligation adaptor tag Reverse primer LT, and which is the final PCR product. This method can detect shorter target sequences than standard PCR. However it may be relatively unspecific, as only one target specific primer is used. This protocol is effectively half of the one sided nested mini PCR Reverse Semi-Nested Mini-PCR:

It is possible to use target DNA that has an adaptor at the fragment ends (see FIG. 8). STA may be performed with a multiplex set of Forward primers and one (or few) tag-specific Reverse primer. 101 denotes double stranded DNA with a polymorphic locus of interest at X. 102 denotes the double stranded DNA with ligation adaptors added for universal amplification. 103 denotes the single stranded DNA with Reverse Primer B hybridized. 104 denotes the PCR product from 103 that was amplified using Reverse primer B and ligation adaptor tag Forward primer LT. 105 denotes the PCR product 104 with hybridized Forward Primer A, and inner Reverse primer 'b'. 106 denotes the PCR product that has been amplified from 105 using Forward primer A and Reverse primer 'b', and which is the final PCR product. This method can detect shorter target sequences than standard PCR.

There also may be more variants that are simply iterations or combinations of the above methods such as doubly nested PCR, where three sets of primers are used. Another variant is one-and-a-half sided nested mini-PCR, where STA may also be performed with a multiplex set of nested Forward primers and one (or few) tag-specific Reverse primer.

Note that in all of these variants, the identity of the Forward primer and the Reverse primer may be interchanged. Note that in some embodiments, the nested variant can equally well be run without the initial library preparation that comprises appending the adapter tags, and a universal amplification step. Note that in some embodiments, additional rounds of PCR may be included, with additional Forward and/or Reverse primers and amplification steps; these additional steps may be particularly useful if it is desirable to further increase the percent of DNA molecules that correspond to the targeted loci.

Nesting Workflows

Figure 9:
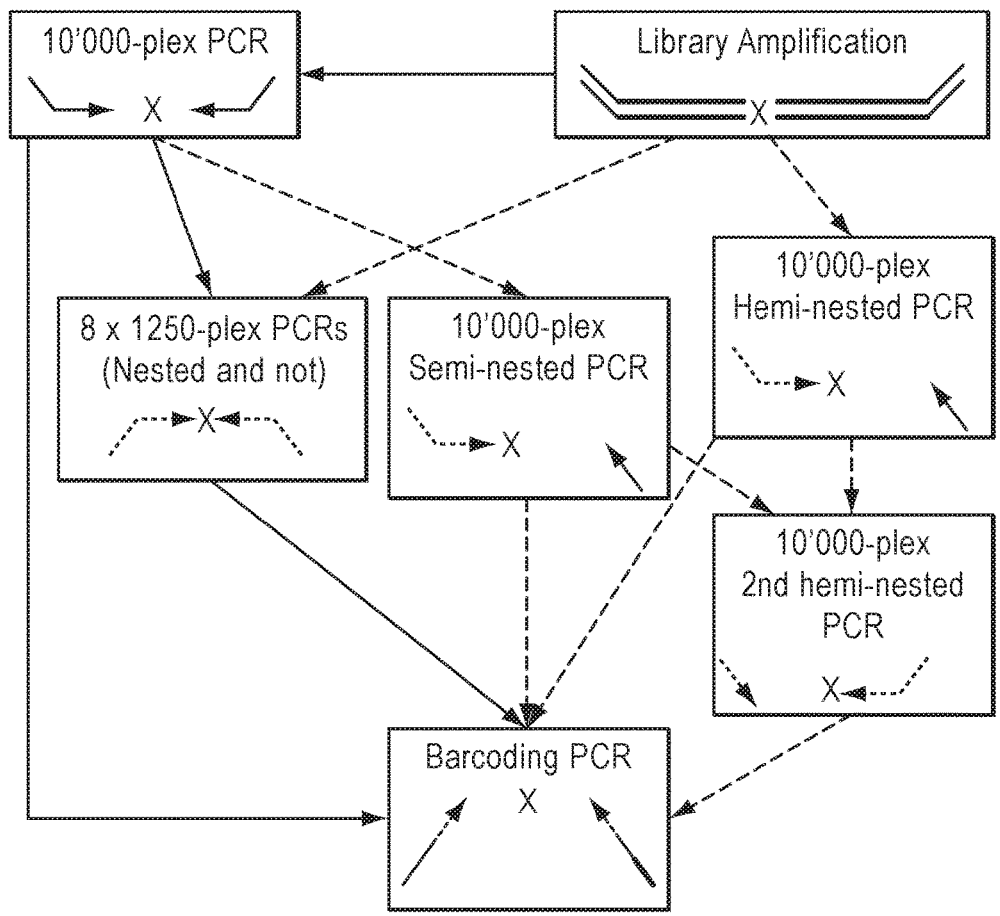
FIG. 9: Some possible workflows for semi-nested methods.

There are many ways to perform the amplification, with different degrees of nesting, and with different degrees of multiplexing. In FIG. 9, a flow chart is given with some of the possible workflows. Note that the use of 10,000-plex PCR is only meant to be an example; these flow charts would work equally well for other degrees of multiplexing.

Looped Ligation Adaptors

When adding universal tagged adaptors for example for the purpose of making a library for sequencing, there are a number of ways to ligate adaptors. One way is to blunt end the sample DNA, perform A-tailing, and ligate with adaptors that have a T-overhang. There are a number of other ways to ligate adaptors. There are also a number of adaptors that can be ligated. For example, a Y-adaptor can be used where the adaptor consists of two strands of DNA where one strand has a double strand region, and a region specified by a forward primer region, and where the other strand specified by a double strand region that is complementary to the double strand region on the first strand, and a region with a reverse primer. The double stranded region, when annealed, may contain a T-overhang for the purpose of ligating to double stranded DNA with an A overhang.

In an embodiment, the adaptor can be a loop of DNA where the terminal regions are complementary, and where the loop region contains a forward primer tagged region (LFT), a reverse primer tagged region (LRT), and a cleavage site between the two (See FIG. 10). 101 refers to the double stranded, blunt ended target DNA. 102 refers to the A-tailed target DNA. 103 refers to the looped ligation adaptor with T overhang 'T' and the cleavage site 'Z'. 104 refers to the target DNA with appended looped ligation adaptors. 105 refers to the target DNA with the ligation adaptors appended cleaved at the cleavage site. LFT refers to the ligation adaptor Forward tag, and the LRT refers to the ligation adaptor Reverse tag. The complementary region may end on a T overhang, or other feature that may be used for ligation to the target DNA. The cleavage site may be a series of uracils for cleavage by UNG, or a sequence that may be recognized and cleaved by a restriction enzyme or other method of cleavage or just a basic amplification. These adaptors can be uses for any library preparation, for example, for sequencing. These adaptors can be used in combination with any of the other methods described herein, for example the mini-PCR amplification methods.

Internally Tagged Primers

Figure 11:
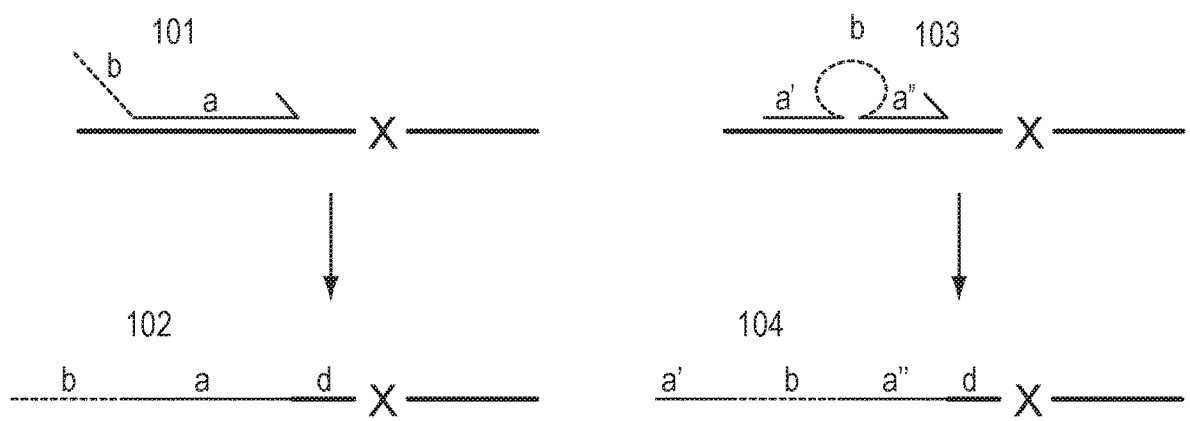
FIG. 11: Graphical representation of internally tagged primers.

When using sequencing to determine the allele present at a given polymorphic locus, the sequence read typically begins upstream of the primer binding site (a), and then to the polymorphic site (X). Tags are typically configured as shown in FIG. 11, left. 101 refers to the single stranded target DNA with polymorphic locus of interest 'X', and primer 'a' with appended tag 'b'. In order to avoid nonspecific hybridization, the primer binding site (region of target DNA complementary to 'a') is typically 18 to 30 bp in length. Sequence tag 'b' is typically about 20 bp; in theory these can be any length longer than about 15 bp, though many people use the primer sequences that are sold by the sequencing platform company. The distance 'd' between 'a' and 'X' may be at least 2 bp so as to avoid allele bias. When performing multiplexed PCR amplification using the methods disclosed herein or other methods, where careful primer design is necessary to avoid excessive primer primer interaction, the window of allowable distance 'd' between 'a' and 'X' may vary quite a bit: from 2 bp to 10 bp, from 2 bp to 20 bp, from 2 bp to 30 bp, or even from 2 bp to more than 30 bp. Therefore, when using the primer configuration shown in FIG. 11, left, sequence reads must be a minimum of 40 bp to obtain reads long enough to measure the polymorphic locus, and depending on the lengths of 'a' and 'd' the sequence reads may need to be up to 60 or 75 bp. Usually, the longer the sequence reads, the higher the cost and time of sequencing a given number of reads, therefore, minimizing the necessary read length can save both time and money. In addition, since, on average, bases read earlier on the read are read more accurately than those read later on the read, decreasing the necessary sequence read length can also increase the accuracy of the measurements of the polymorphic region.

In an embodiment, termed internally tagged primers, the primer binding site (a) is split in to a plurality of segments (a', a'', a''' . . . ), and the sequence tag (b) is on a segment of DNA that is in the middle of two of the primer binding sites, as shown in FIG. 11, 103. This configuration allows the sequencer to make shorter sequence reads. In an embodiment, a'+a'' should be at least about 18 bp, and can be as long as 30, 40, 50, 60, 80, 100 or more than 100 bp. In an embodiment, a'' should be at least about 6 bp, and in an embodiment is between about 8 and 16 bp. All other factors being equal, using the internally tagged primers can cut the length of the sequence reads needed by at least 6 bp, as much as 8 bp, 10 bp, 12 bp, 15 bp, and even by as many as 20 or 30 bp. This can result in a significant money, time and accuracy advantage. An example of internally tagged primers is given in FIG. 12.

Primers with Ligation Adaptor Binding Region

Figure 10:
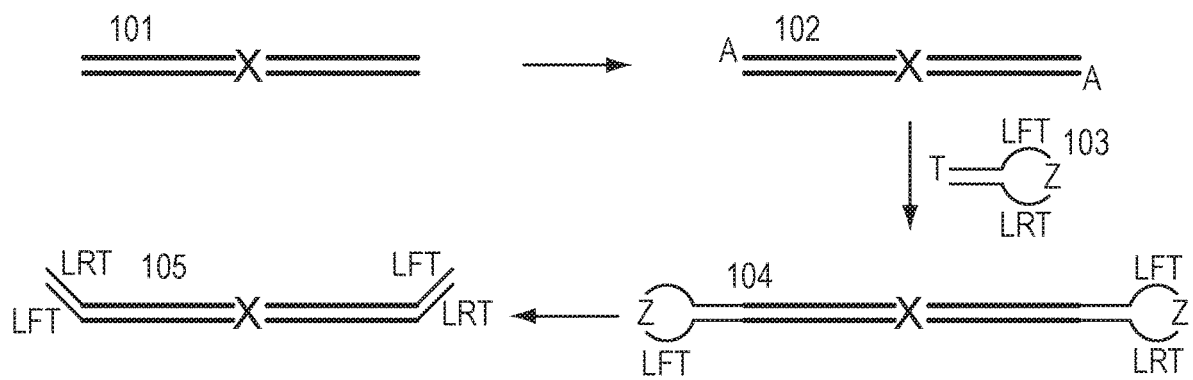
FIG. 10: Graphical representation of looped ligation adaptors.
Figure 13:
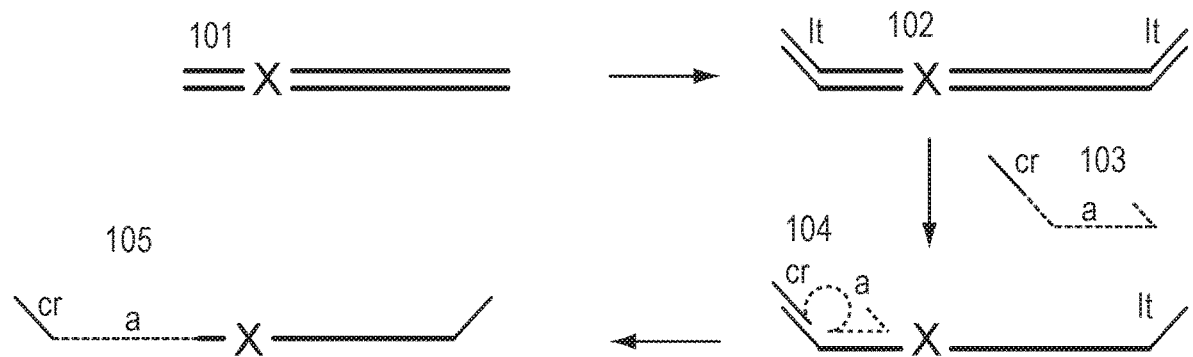
FIG. 13: Graphical representation of a method using primers with a ligation adaptor binding region.

One issue with fragmented DNA is that since it is short in length, the chance that a polymorphism is close to the end of a DNA strand is higher than for a long strand (e.g. 101, FIG. 10). Since PCR capture of a polymorphism requires a primer binding site of suitable length on both sides of the polymorphism, a significant number of strands of DNA with the targeted polymorphism will be missed due to insufficient overlap between the primer and the targeted binding site. In an embodiment, the target DNA 101 can have ligation adaptors appended 102, and the target primer 103 can have a region (cr) that is complementary to the ligation adaptor tag (lt) appended upstream of the designed binding region (a) (see FIG. 13); thus in cases where the binding region (region of 101 that is complementary to a) is shorter than the 18 bp typically required for hybridization, the region (cr) on the primer than is complementary to the library tag is able to increase the binding energy to a point where the PCR can proceed. Note that any specificity that is lost due to a shorter binding region can be made up for by other PCR primers with suitably long target binding regions. Note that this embodiment can be used in combination with direct PCR, or any of the other methods described herein, such as nested PCR, semi nested PCR, hemi nested PCR, one sided nested or semi or hemi nested PCR, or other PCR protocols.

When using the sequencing data to determine ploidy in combination with an analytical method that involves comparing the observed allele data to the expected allele distributions for various hypotheses, each additional read from alleles with a low depth of read will yield more information than a read from an allele with a high depth of read. Therefore, ideally, one would wish to see uniform depth of read (DOR) where each locus will have a similar number of representative sequence reads. Therefore, it is desirable to minimize the DOR variance. In an embodiment, it is possible to decrease the coefficient of variance of the DOR (this may be defined as the standard deviation of the DOR/the average DOR) by increasing the annealing times. In some embodiments the annealing temperatures may be longer than 2 minutes, longer than 4 minutes, longer than ten minutes, longer than 30 minutes, and longer than one hour, or even longer. Since annealing is an equilibrium process, there is no limit to the improvement of DOR variance with increasing annealing times. In an embodiment, increasing the primer concentration may decrease the DOR variance.

Exemplary Amplification Methods

Improved PCR amplification methods have also been developed that minimize or prevent interference due to the amplification of nearby or adjacent target loci in the same reaction volume (such as part of the sample multiplex PCR reaction that simultaneously amplifies all the target loci) (see, U.S. Ser. No. 61/982,245, filed Apr. 21, 2014; U.S. Ser. No. 61/987,407, filed May 1, 2014, and U.S. Ser. No. 62/066,514, filed Oct. 21, 2014, which are each hereby incorporated by reference in its entirety). These methods can be used to simultaneously amplify nearby or adjacent target loci, which is faster and cheaper than having to separate nearby target loci into different reaction volumes so that they can be amplified separately to avoid interference. In particular embodiments, these methods are used to tile a region such that the amplicons include all the nucleotides in the region (such as an exon or all the exons of a gene such as cystic fibrosis).

In some embodiments, the amplification of target loci is performed using a polymerase (e.g., a DNA polymerase, RNA polymerase, or reverse transcriptase) with low 5'→3' exonuclease and/or low strand displacement activity. In some embodiments, the low level of 5'→3' exonuclease reduces or prevents the degradation of a nearby primer (e.g., an unextended primer or a primer that has had one or more nucleotides added to during primer extension). In some embodiments, the low level of strand displacement activity reduces or prevents the displacement of a nearby primer (e.g., an unextended primer or a primer that has had one or more nucleotides added to it during primer extension). In some embodiments, target loci that are adjacent to each other (e.g., no bases between the target loci) or nearby (e.g., loci are within 50, 40, 30, 20, 15, 10, 9, 8, 7, 6, 5, 4, 3, 2, or 1 base) are amplified. In some embodiments, the 3' end of one locus is within 50, 40, 30, 20, 15, 10, 9, 8, 7, 6, 5, 4, 3, 2, or 1 base of the 5' end of next downstream locus.

In some embodiments, at least 100, 200, 500, 750, 1,000; 2,000; 5,000; 7,500; 10,000; 15,000; 19,000; 20,000; 25,000; 27,000; 28,000; 30,000; 40,000; 50,000; 75,000; or 100,000 different target loci are amplified, such as by the simultaneous amplification in one reaction volume In some embodiments, at least 50, 60, 70, 80, 90, 95, 96, 97, 98, 99, or 99.5% of the amplified products are target amplicons. In various embodiments, the amount of amplified products that are target amplicons is between 50 to 99.5%, such as between 60 to 99%, 70 to 98%, 80 to 98%, 90 to 99.5%, or 95 to 99.5%, inclusive. In some embodiments, at least 50, 60, 70, 80, 90, 95, 96, 97, 98, 99, or 99.5% of the target loci are amplified (e.g, amplified at least 5, 10, 20, 30, 50, or 100-fold compared to the amount prior to amplification), such as by the simultaneous amplification in one reaction volume. In various embodiments, the amount target loci that are amplified (e.g, amplified at least 5, 10, 20, 30, 50, or 100-fold compared to the amount prior to amplification) is between 50 to 99.5%, such as between 60 to 99%, 70 to 98%, 80 to 99%, 90 to 99.5%, 95 to 99.9%, or 98 to 99.99% inclusive. In some embodiments, fewer non-target amplicons are produced, such as fewer amplicons formed from a forward primer from a first primer pair and a reverse primer from a second primer pair. Such undesired non-target amplicons can be produced using prior amplification methods if, e.g., the reverse primer from the first primer pair and/or the forward primer from the second primer pair are degraded and/or displaced.

In some embodiments, these methods allows longer extension times to be used since the polymerase bound to a primer being extended is less likely to degrade and/or displace a nearby primer (such as the next downstream primer) given the low 5'→3' exonuclease and/or low strand displacement activity of the polymerase. In various embodiments, reaction conditions (such as the extension time and temperature) are used such that the extension rate of the polymerase allows the number of nucleotides that are added to a primer being extended to be equal to or greater than 80, 90, 95, 100, 110, 120, 130, 140, 150, 175, or 200% of the number of nucleotides between the 3' end of the primer binding site and the 5' end of the next downstream primer binding site on the same strand.

In some embodiments, a DNA polymerase is used produce DNA amplicons using DNA as a template. In some embodiments, a RNA polymerase is used produce RNA amplicons using DNA as a template. In some embodiments, a reverse transcriptase is used produce cDNA amplicons using RNA as a template.

In some embodiments, the low level of 5'→3' exonuclease of the polymerase is less than 80, 70, 60, 50, 40, 30, 20, 10, 5, 1, or 0.1% of the activity of the same amount of *Thermus aquaticus* polymerase ("Taq" polymerase, which is a commonly used DNA polymerase from a thermophilic bacterium, PDB 1BGX, EC 2.7.7.7, Murali et al., "Crystal structure of Taq DNA polymerase in complex with an inhibitory Fab: the Fab is directed against an intermediate in the helix-coil dynamics of the enzyme," Proc. Natl. Acad. Sci. USA 95:12562-12567, 1998, which is hereby incorporated by reference in its entirety) under the same conditions. In some embodiments, the low level of strand displacement activity of the polymerase is less than 80, 70, 60, 50, 40, 30, 20, 10, 5, 1, or 0.1% of the activity of the same amount of Taq polymerase under the same conditions.

In some embodiments, the polymerase is a PUSHION DNA polymerase, such as PHUSION High Fidelity DNA polymerase (M0530S, New England BioLabs, Inc.) or PHUSION Hot Start Flex DNA polymerase (M0535S, New England BioLabs, Inc.; Frey and Suppman *BioChemica.* 2:34-35, 1995; Chester and Marshak *Analytical Biochemistry.* 209:284-290, 1993, which are each hereby incorporated by reference in its entirety). The PHUSION DNA polymerase is a *Pyrococcus*-like enzyme fused with a processivity-enhancing domain. PHUSION DNA polymerase possesses 5'→3' polymerase activity and 3'→5' exonuclease activity, and generates blunt-ended products. PHUSION DNA polymerase lacks 5'→3' exonuclease activity and strand displacement activity.

In some embodiments, the polymerase is a Q5® DNA Polymerase, such as Q5® High-Fidelity DNA Polymerase (M0491S, New England BioLabs, Inc.) or Q5® Hot Start High-Fidelity DNA Polymerase (M0493S, New England BioLabs, Inc.). Q5® High-Fidelity DNA polymerase is a high-fidelity, thermostable, DNA polymerase with 3'→5' exonuclease activity, fused to a processivity-enhancing Sso7d domain. Q5® High-Fidelity DNA polymerase lacks 5'→3' exonuclease activity and strand displacement activity.

In some embodiments, the polymerase is a T4 DNA polymerase (M0203S, New England BioLabs, Inc.; Tabor and Struh. (1989). "DNA-Dependent DNA Polymerases," In Ausebel et al. (Ed.), *Current Protocols in Molecular Biology.* 3.5.10-3.5.12. New York: John Wiley & Sons, Inc., 1989; Sambrook et al. *Molecular Cloning: A Laboratory Manual.* (2nd ed.), 5.44-5.47. Cold Spring Harbor: Cold Spring Harbor Laboratory Press, 1989, which are each hereby incorporated by reference in its entirety). T4 DNA Polymerase catalyzes the synthesis of DNA in the 5'→3' direction and requires the presence of template and primer. This enzyme has a 3'→5' exonuclease activity which is much more active than that found in DNA Polymerase I. T4 DNA polymerase lacks 5'→3' exonuclease activity and strand displacement activity.

In some embodiments, the polymerase is a *Sulfolobus* DNA Polymerase IV (M0327S, New England BioLabs, Inc.; (Boudsocq, et al. (2001). *Nucleic Acids Res.,* 29:4607-4616, 2001; McDonald, et al. (2006). *Nucleic Acids Res.,* 34:1102-1111, 2006, which are each hereby incorporated by reference in its entirety). *Sulfolobus* DNA Polymerase IV is a thermostable Y-family lesion-bypass DNA Polymerase that efficiently synthesizes DNA across a variety of DNA template lesions McDonald, J. P. et al. (2006). *Nucleic Acids Res.,* 34, 1102-1111, which is hereby incorporated by reference in its entirety). *Sulfolobus* DNA Polymerase IV lacks 5'-3' exonuclease activity and strand displacement activity.

In some embodiments, if a primer binds a region with a SNP, the primer may bind and amplify the different alleles with different efficiencies or may only bind and amplify one allele. For subjects who are heterozygous, one of the alleles may not be amplified by the primer. In some embodiments, a primer is designed for each allele. For example, if there are two alleles (e.g., a biallelic SNP), then two primers can be used to bind the same location of a target locus (e.g., a forward primer to bind the "A" allele and a forward primer to bind the "B" allele). Standard methods, such as the dbSNP database, can be used to determine the location of known SNPs, such as SNP hot spots that have a high heterozygosity rate.

In some embodiments, the amplicons are similar in size. In some embodiments, the range of the length of the target amplicons is less than 100, 75, 50, 25, 15, 10, or 5 nucleotides. In some embodiments (such as the amplification of target loci in fragmented DNA or RNA), the length of the target amplicons is between 50 and 100 nucleotides, such as between 60 and 80 nucleotides, or 60 and 75 nucleotides, inclusive. In some embodiments (such as the amplification of multiple target loci throughout an exon or gene), the length of the target amplicons is between 100 and 500 nucleotides, such as between 150 and 450 nucleotides, 200 and 400 nucleotides, 200 and 300 nucleotides, or 300 and 400 nucleotides, inclusive.

In some embodiments, multiple target loci are simultaneously amplified using a primer pair that includes a forward and reverse primer for each target locus to be amplified in that reaction volume. In some embodiments, one round of PCR is performed with a single primer per target locus, and then a second round of PCR is performed with a primer pair per target locus. For example, the first round of PCR may be performed with a single primer per target locus such that all the primers bind the same strand (such as using a forward primer for each target locus). This allows the PCR to amplify in a linear manner and reduces or eliminates amplification bias between amplicons due to sequence or length differences. In some embodiments, the amplicons are then amplified using a forward and reverse primer for each target locus.

Exemplary Whole Genome Amplification Methods

In some embodiments, a method of the present disclosure may involve amplifying DNA, such as the use of whole genome application to amplify a nucleic acid sample before amplifying just the target loci. Amplification of the DNA, a process which transforms a small amount of genetic material to a larger amount of genetic material that comprises a similar set of genetic data, can be done by a wide variety of methods, including, but not limited to polymerase chain reaction (PCR). One method of amplifying DNA is whole genome amplification (WGA). There are a number of methods available for WGA: ligation-mediated PCR (LM-PCR), degenerate oligonucleotide primer PCR (DOP-PCR), and multiple displacement amplification (MDA). In LM-PCR, short DNA sequences called adapters are ligated to blunt ends of DNA. These adapters contain universal amplification sequences, which are used to amplify the DNA by PCR. In DOP-PCR, random primers that also contain universal amplification sequences are used in a first round of annealing and PCR. Then, a second round of PCR is used to amplify the sequences further with the universal primer sequences. MDA uses the phi-29 polymerase, which is a highly processive and non-specific enzyme that replicates DNA and has been used for single-cell analysis. The major limitations to amplification of material from a single cell are (1) necessity of using extremely dilute DNA concentrations or extremely small volume of reaction mixture, and (2) difficulty of reliably dissociating DNA from proteins across the whole genome. Regardless, single-cell whole genome amplification has been used successfully for a variety of applications for a number of years. There are other methods of amplifying DNA from a sample of DNA. The DNA amplification transforms the initial sample of DNA into a sample of DNA that is similar in the set of sequences, but of much greater quantity. In some cases, amplification may not be required.

In some embodiments, DNA may be amplified using a universal amplification, such as WGA or MDA. In some embodiments, DNA may be amplified by targeted amplification, for example using targeted PCR, or circularizing probes. In some embodiments, the DNA may be preferentially enriched using a targeted amplification method, or a method that results in the full or partial separation of desired from undesired DNA, such as capture by hybridization approaches. In some embodiments, DNA may be amplified by using a combination of a universal amplification method and a preferential enrichment method. A fuller description of some of these methods can be found elsewhere in this document.

Exemplary Enrichment and Sequencing Methods

In an embodiment, a method disclosed herein uses selective enrichment techniques that preserve the relative allele frequencies that are present in the original sample of DNA at each target loci (e.g., each polymorphic locus) from a set of target loci (e.g., polymorphic loci). While enrichment is particularly advantageous for methods for analyzing polymorphic loci, these enrichment methods can be readily adapted for nonpolymorphic loci if desired. In some embodiments the amplification and/or selective enrichment technique may involve PCR such as ligation mediated PCR, fragment capture by hybridization, Molecular Inversion Probes, or other circularizing probes. In some embodiments, methods for amplification or selective enrichment may involve using probes where, upon correct hybridization to the target sequence, the 3-prime end or 5-prime end of a nucleotide probe is separated from the polymorphic site of the allele by a small number of nucleotides. This separation reduces preferential amplification of one allele, termed allele bias. This is an improvement over methods that involve using probes where the 3-prime end or 5-prime end of a correctly hybridized probe are directly adjacent to or very near to the polymorphic site of an allele. In an embodiment, probes in which the hybridizing region may or certainly contains a polymorphic site are excluded. Polymorphic sites at the site of hybridization can cause unequal hybridization or inhibit hybridization altogether in some alleles, resulting in preferential amplification of certain alleles. These embodiments are improvements over other methods that involve targeted amplification and/or selective enrichment in that they better preserve the original allele frequencies of the sample at each polymorphic locus, whether the sample is pure genomic sample from a single individual or mixture of individuals.

The use of a technique to enrich a sample of DNA at a set of target loci followed by sequencing as part of a method for non-invasive prenatal allele calling or ploidy calling may confer a number of unexpected advantages. In some embodiments of the present disclosure, the method involves measuring genetic data for use with an informatics based method, such as PARENTAL SUPPORT™ (PS). The ultimate outcome of some of the embodiments is the actionable genetic data of an embryo or a fetus. There are many methods that may be used to measure the genetic data of the individual and/or the related individuals as part of embodied methods. In an embodiment, a method for enriching the concentration of a set of targeted alleles is disclosed herein, the method comprising one or more of the following steps: targeted amplification of genetic material, addition of loci specific oligonucleotide probes, ligation of specified DNA strands, isolation of sets of desired DNA, removal of unwanted components of a reaction, detection of certain sequences of DNA by hybridization, and detection of the sequence of one or a plurality of strands of DNA by DNA sequencing methods. In some cases the DNA strands may refer to target genetic material, in some cases they may refer to primers, in some cases they may refer to synthesized sequences, or combinations thereof. These steps may be carried out in a number of different orders.

For example, a universal amplification step of the DNA prior to targeted amplification may confer several advantages, such as removing the risk of bottlenecking and reducing allelic bias. The DNA may be mixed an oligonucleotide probe that can hybridize with two neighboring regions of the target sequence, one on either side. After hybridization, the ends of the probe may be connected by adding a polymerase, a means for ligation, and any necessary reagents to allow the circularization of the probe. After circularization, an exonuclease may be added to digest to non-circularized genetic material, followed by detection of the circularized probe. The DNA may be mixed with PCR primers that can hybridize with two neighboring regions of the target sequence, one on either side. After hybridization, the ends of the probe may be connected by adding a polymerase, a means for ligation, and any necessary reagents to complete PCR amplification. Amplified or unamplified DNA may be targeted by hybrid capture probes that target a set of loci; after hybridization, the probe may be localized and separated from the mixture to provide a mixture of DNA that is enriched in target sequences.

The use of a method to target certain loci followed by sequencing as part of a method for allele calling or ploidy calling may confer a number of unexpected advantages. Some methods by which DNA may be targeted, or preferentially enriched, include using circularizing probes, linked inverted probes (LIPs, MIPs), capture by hybridization methods such as SURESELECT, and targeted PCR or ligation-mediated PCR amplification strategies.

In some embodiments, a method of the present disclosure involves measuring genetic data for use with an informatics based method, such as PARENTAL SUPPORT™ (PS), which is described further herein. PARENTAL SUPPORT™ is an informatics based approach to manipulating genetic data, aspects of which are described herein. The ultimate outcome of some of the embodiments is the actionable genetic data of an embryo or a fetus followed by a clinical decision based on the actionable data. The algorithms behind the PS method take the measured genetic data of the target individual, often an embryo or fetus, and the measured genetic data from related individuals, and are able to increase the accuracy with which the genetic state of the target individual is known. In an embodiment, the measured genetic data is used in the context of making ploidy determinations during prenatal genetic diagnosis. In an embodiment, the measured genetic data is used in the context of making ploidy determinations or allele calls on embryos during in vitro fertilization. There are many methods that may be used to measure the genetic data of the individual and/or the related individuals in the aforementioned contexts. The different methods comprise a number of steps, those steps often involving amplification of genetic material, addition of oligonucleotide probes, ligation of specified DNA strands, isolation of sets of desired DNA, removal of unwanted components of a reaction, detection of certain sequences of DNA by hybridization, detection of the sequence of one or a plurality of strands of DNA by DNA sequencing methods. In some cases the DNA strands may refer to target genetic material, in some cases they may refer to primers, in some cases they may refer to synthesized sequences, or combinations thereof. These steps may be carried out in a number of different orders.

Note that in theory it is possible to target any number loci in the genome, anywhere from one loci to well over one million loci. If a sample of DNA is subjected to targeting, and then sequenced, the percentage of the alleles that are read by the sequencer will be enriched with respect to their natural abundance in the sample. The degree of enrichment can be anywhere from one percent (or even less) to ten-fold, a hundred-fold, a thousand-fold or even many million-fold. In the human genome there are roughly 3 billion base pairs, and nucleotides, comprising approximately 75 million polymorphic loci. The more loci that are targeted, the smaller the degree of enrichment is possible. The fewer the number of loci that are targeted, the greater degree of enrichment is possible, and the greater depth of read may be achieved at those loci for a given number of sequence reads.

In an embodiment of the present disclosure, the targeting or preferential may focus entirely on SNPs. In an embodiment, the targeting or preferential may focus on any polymorphic site. A number of commercial targeting products are available to enrich exons. Surprisingly, targeting exclusively SNPs, or exclusively polymorphic loci, is particularly advantageous when using a method for NPD that relies on allele distributions. There are also published methods for NPD using sequencing, for example U.S. Pat. No. 7,888, 017, involving a read count analysis where the read counting focuses on counting the number of reads that map to a given chromosome, where the analyzed sequence reads do not focused on regions of the genome that are polymorphic. Those types of methodology that do not focus on polymorphic alleles would not benefit as much from targeting or preferential enrichment of a set of alleles.

In an embodiment of the present disclosure, it is possible to use a targeting method that focuses on SNPs to enrich a genetic sample in polymorphic regions of the genome. In an embodiment, it is possible to focus on a small number of SNPs, for example between 1 and 100 SNPs, or a larger number, for example, between 100 and 1,000, between 1,000 and 10,000, between 10,000 and 100,000 or more than 100,000 SNPs. In an embodiment, it is possible to focus on one or a small number of chromosomes that are correlated with live trisomic births, for example chromosomes 13, 18, 21, X and Y, or some combination thereof. In an embodiment, it is possible to enrich the targeted SNPs by a small factor, for example between 1.01 fold and 100 fold, or by a larger factor, for example between 100 fold and 1,000,000 fold, or even by more than 1,000,000 fold. In an embodiment of the present disclosure, it is possible to use a targeting method to create a sample of DNA that is preferentially enriched in polymorphic regions of the genome. In an embodiment, it is possible to use this method to create a mixture of DNA with any of these characteristics where the mixture of DNA contains maternal DNA and also free floating fetal DNA. In an embodiment, it is possible to use this method to create a mixture of DNA that has any combination of these factors. For example, the method described herein may be used to produce a mixture of DNA that comprises maternal DNA and fetal DNA, and that is preferentially enriched in DNA that corresponds to 200 SNPs, all of which are located on either chromosome 18 or 21, and which are enriched an average of 1000 fold. In another example, it is possible to use the method to create a mixture of DNA that is preferentially enriched in 10,000 SNPs that are all or mostly located on chromosomes 13, 18, 21, X and Y, and the average enrichment per loci is greater than 500 fold. Any of the targeting methods described herein can be used to create mixtures of DNA that are preferentially enriched in certain loci.

In some embodiments, a method of the present disclosure further includes measuring the DNA in the mixed fraction using a high throughput DNA sequencer, where the DNA in the mixed fraction contains a disproportionate number of sequences from one or more chromosomes, wherein the one or more chromosomes are taken from the group comprising chromosome 13, chromosome 18, chromosome 21, chromosome X, chromosome Y and combinations thereof.

Described herein are three methods: multiplex PCR, targeted capture by hybridization, and linked inverted probes (LIPs), which may be used to obtain and analyze measurements from a sufficient number of polymorphic loci from a maternal plasma sample in order to detect fetal aneuploidy; this is not meant to exclude other methods of selective enrichment of targeted loci. Other methods may equally well be used without changing the essence of the method. In each case the polymorphism assayed may include single nucleotide polymorphisms (SNPs), small indels, or STRs. A preferred method involves the use of SNPs. Each approach produces allele frequency data; allele frequency data for each targeted locus and/or the joint allele frequency distributions from these loci may be analyzed to determine the ploidy of the fetus. Each approach has its own considerations due to the limited source material and the fact that maternal plasma consists of mixture of maternal and fetal DNA. This method may be combined with other approaches to provide a more accurate determination. In an embodiment, this method may be combined with a sequence counting approach such as that described in U.S. Pat. No. 7,888,017. The approaches described could also be used to detect fetal paternity noninvasively from maternal plasma samples. In addition each approach may be applied to other mixtures of DNA or pure DNA samples to detect the presence or absence of aneuploid chromosomes, to genotype a large number of SNP from degraded DNA samples, to detect segmental copy number variations (CNVs), to detect other genotypic states of interest, or some combination thereof.

Accurately Measuring the Allelic Distributions in a Sample

Current sequencing approaches can be used to estimate the distribution of alleles in a sample. One such method involves randomly sampling sequences from a pool DNA, termed shotgun sequencing. The proportion of a particular allele in the sequencing data is typically very low and can be determined by simple statistics. The human genome contains approximately 3 billion base pairs. So, if the sequencing method used make 100 bp reads, a particular allele will be measured about once in every 30 million sequence reads.

In an embodiment, a method of the present disclosure is used to determine the presence or absence of two or more different haplotypes that contain the same set of loci in a sample of DNA from the measured allele distributions of loci from that chromosome. The different haplotypes could represent two different homologous chromosomes from one individual, three different homologous chromosomes from a trisomic individual, three different homologous haplotypes from a mother and a fetus where one of the haplotypes is shared between the mother and the fetus, three or four haplotypes from a mother and fetus where one or two of the haplotypes are shared between the mother and the fetus, or other combinations. Alleles that are polymorphic between the haplotypes tend to be more informative, however any alleles where the mother and father are not both homozygous for the same allele will yield useful information through measured allele distributions beyond the information that is available from simple read count analysis.

Shotgun sequencing of such a sample, however, is extremely inefficient as it results in many sequences for regions that are not polymorphic between the different haplotypes in the sample, or are for chromosomes that are not of interest, and therefore reveal no information about the proportion of the target haplotypes. Described herein are methods that specifically target and/or preferentially enrich segments of DNA in the sample that are more likely to be polymorphic in the genome to increase the yield of allelic information obtained by sequencing. Note that for the measured allele distributions in an enriched sample to be truly representative of the actual amounts present in the target individual, it is critical that there is little or no preferential enrichment of one allele as compared to the other allele at a given loci in the targeted segments. Current methods known in the art to target polymorphic alleles are designed to ensure that at least some of any alleles present are detected. However, these methods were not designed for the purpose of measuring the unbiased allelic distributions of polymorphic alleles present in the original mixture. It is non-obvious that any particular method of target enrichment would be able to produce an enriched sample wherein the measured allele distributions would accurately represent the allele distributions present in the original unamplified sample better than any other method. While many enrichment methods may be expected, in theory, to accomplish such an aim, an ordinary person skilled in the art is well aware that there is a great deal of stochastic or deterministic bias in current amplification, targeting and other preferential enrichment methods. One embodiment of a method described herein allows a plurality of alleles found in a mixture of DNA that correspond to a given locus in the genome to be amplified, or preferentially enriched in a way that the degree of enrichment of each of the alleles is nearly the same. Another way to say this is that the method allows the relative quantity of the alleles present in the mixture as a whole to be increased, while the ratio between the alleles that correspond to each locus remains essentially the same as they were in the original mixture of DNA. For some reported methods, preferential enrichment of loci can result in allelic biases of more than 1%, more than 2%, more than 5% and even more than 10%. This preferential enrichment may be due to capture bias when using a capture by hybridization approach, or amplification bias which may be small for each cycle, but can become large when compounded over 20, 30 or 40 cycles. For the purposes of this disclosure, for the ratio to remain essentially the same means that the ratio of the alleles in the original mixture divided by the ratio of the alleles in the resulting mixture is between 0.95 and 1.05, between 0.98 and 1.02, between 0.99 and 1.01, between 0.995 and 1.005, between 0.998 and 1.002, between 0.999 and 1.001, or between 0.9999 and 1.0001. Note that the calculation of the allele ratios presented here may not be used in the determination of the ploidy state of the target individual, and may only a metric to be used to measure allelic bias.

In an embodiment, once a mixture has been preferentially enriched at the set of target loci, it may be sequenced using any one of the previous, current, or next generation of sequencing instruments that sequences a clonal sample (a sample generated from a single molecule; examples include ILLUMINA GAIIx, ILLUMINA HISEQ, LIFE TECHNOLOGIES SOLiD, 5500XL). The ratios can be evaluated by sequencing through the specific alleles within the targeted region. These sequencing reads can be analyzed and counted according the allele type and the rations of different alleles determined accordingly. For variations that are one to a few bases in length, detection of the alleles will be performed by sequencing and it is essential that the sequencing read span the allele in question in order to evaluate the allelic composition of that captured molecule. The total number of captured molecules assayed for the genotype can be increased by increasing the length of the sequencing read. Full sequencing of all molecules would guarantee collection of the maximum amount of data available in the enriched pool. However, sequencing is currently expensive, and a method that can measure allele distributions using a lower number of sequence reads will have great value. In addition, there are technical limitations to the maximum possible length of read as well as accuracy limitations as read lengths increase. The alleles of greatest utility will be of one to a few bases in length, but theoretically any allele shorter than the length of the sequencing read can be used. While allele variations come in all types, the examples provided herein focus on SNPs or variants contained of just a few neighboring base pairs. Larger variants such as segmental copy number variants can be detected by aggregations of these smaller variations in many cases as whole collections of SNP internal to the segment are duplicated. Variants larger than a few bases, such as STRs require special consideration and some targeting approaches work while others will not.

There are multiple targeting approaches that can be used to specifically isolate and enrich a one or a plurality of variant positions in the genome. Typically, these rely on taking advantage of the invariant sequence flanking the variant sequence. There are reports by others related to targeting in the context of sequencing where the substrate is maternal plasma (see, e.g., Liao et al., Clin. Chem. 2011; 57(1): pp. 92-101). However, these approaches use targeting probes that target exons, and do not focus on targeting polymorphic regions of the genome. In an embodiment, a method of the present disclosure involves using targeting probes that focus exclusively or almost exclusively on polymorphic regions. In an embodiment, a method of the present disclosure involves using targeting probes that focus exclusively or almost exclusively on SNPs. In some embodiments of the present disclosure, the targeted polymorphic sites consist of at least 10% SNPs, at least 20% SNPs, at least 30% SNPs, at least 40% SNPs, at least 50% SNPs, at least 60% SNPs, at least 70% SNPs, at least 80% SNPs, at least 90% SNPs, at least 95% SNPs, at least 98% SNPs, at least 99% SNPs, at least 99.9% SNPs, or exclusively SNPs.

In an embodiment, a method of the present disclosure can be used to determine genotypes (base composition of the DNA at specific loci) and relative proportions of those genotypes from a mixture of DNA molecules, where those DNA molecules may have originated from one or a number of genetically distinct individuals. In an embodiment, a method of the present disclosure can be used to determine the genotypes at a set of polymorphic loci, and the relative ratios of the amount of different alleles present at those loci. In an embodiment the polymorphic loci may consist entirely of SNPs. In an embodiment, the polymorphic loci can comprise SNPs, single tandem repeats, and other polymorphisms. In an embodiment, a method of the present disclosure can be used to determine the relative distributions of alleles at a set of polymorphic loci in a mixture of DNA, where the mixture of DNA comprises DNA that originates from a mother, and DNA that originates from a fetus. In an embodiment, the joint allele distributions can be determined on a mixture of DNA isolated from blood from a pregnant woman. In an embodiment, the allele distributions at a set of loci can be used to determine the ploidy state of one or more chromosomes on a gestating fetus.

In an embodiment, the mixture of DNA molecules could be derived from DNA extracted from multiple cells of one individual. In an embodiment, the original collection of cells from which the DNA is derived may comprise a mixture of diploid or haploid cells of the same or of different genotypes, if that individual is mosaic (germline or somatic). In an embodiment, the mixture of DNA molecules could also be derived from DNA extracted from single cells. In an embodiment, the mixture of DNA molecules could also be derived from DNA extracted from mixture of two or more cells of the same individual, or of different individuals. In an embodiment, the mixture of DNA molecules could be derived from DNA isolated from biological material that has already liberated from cells such as blood plasma, which is known to contain cell free DNA. In an embodiment, the this biological material may be a mixture of DNA from one or more individuals, as is the case during pregnancy where it has been shown that fetal DNA is present in the mixture. In an embodiment, the biological material could be from a mixture of cells that were found in maternal blood, where some of the cells are fetal in origin. In an embodiment, the biological material could be cells from the blood of a pregnant which have been enriched in fetal cells.

Circularizing Probes

Some embodiments of the present disclosure involve the use of "Linked Inverted Probes" (LIPs), which have been previously described in the literature, to amplify the target loci before or after amplification using primers that are not LIPs in the multiplex PCR methods of the invention. LIPs is a generic term meant to encompass technologies that involve the creation of a circular molecule of DNA, where the probes are designed to hybridize to targeted region of DNA on either side of a targeted allele, such that addition of appropriate polymerases and/or ligases, and the appropriate conditions, buffers and other reagents, will complete the complementary, inverted region of DNA across the targeted allele to create a circular loop of DNA that captures the information found in the targeted allele. LIPs may also be called pre-circularized probes, pre-circularizing probes, or circularizing probes. The LIPs probe may be a linear DNA molecule between 50 and 500 nucleotides in length, and in an embodiment between 70 and 100 nucleotides in length; in some embodiments, it may be longer or shorter than described herein. Others embodiments of the present disclosure involve different incarnations, of the LIPs technology, such as Padlock Probes and Molecular Inversion Probes (MIPs).

One method to target specific locations for sequencing is to synthesize probes in which the 3' and 5' ends of the probes anneal to target DNA at locations adjacent to and on either side of the targeted region, in an inverted manner, such that the addition of DNA polymerase and DNA ligase results in extension from the 3' end, adding bases to single stranded probe that are complementary to the target molecule (gap-fill), followed by ligation of the new 3' end to the 5' end of the original probe resulting in a circular DNA molecule that can be subsequently isolated from background DNA. The probe ends are designed to flank the targeted region of interest. One aspect of this approach is commonly called MIPS and has been used in conjunction with array technologies to determine the nature of the sequence filled in. One drawback to the use of MIPs in the context of measuring allele ratios is that the hybridization, circularization and amplification steps do not happed at equal rates for different alleles at the same loci. This results in measured allele ratios that are not representative of the actual allele ratios present in the original mixture.

In an embodiment, the circularizing probes are constructed such that the region of the probe that is designed to hybridize upstream of the targeted polymorphic locus and the region of the probe that is designed to hybridize downstream of the targeted polymorphic locus are covalently connected through a non-nucleic acid backbone. This backbone can be any biocompatible molecule or combination of biocompatible molecules. Some examples of possible biocompatible molecules are poly(ethylene glycol), polycarbonates, polyurethanes, polyethylenes, polypropylenes, sulfone polymers, silicone, cellulose, fluoropolymers, acrylic compounds, styrene block copolymers, and other block copolymers.

In an embodiment of the present disclosure, this approach has been modified to be easily amenable to sequencing as a means of interrogating the filled in sequence. In order to retain the original allelic proportions of the original sample at least one key consideration must be taken into account. The variable positions among different alleles in the gap-fill region must not be too close to the probe binding sites as there can be initiation bias by the DNA polymerase resulting in differential of the variants. Another consideration is that additional variations may be present in the probe binding sites that are correlated to the variants in the gap-fill region which can result unequal amplification from different alleles. In an embodiment of the present disclosure, the 3' ends and 5' ends of the pre-circularized probe are designed to hybridize to bases that are one or a few positions away from the variant positions (polymorphic sites) of the targeted allele. The number of bases between the polymorphic site (SNP or otherwise) and the base to which the 3' end and/or 5' of the pre-circularized probe is designed to hybridize may be one base, it may be two bases, it may be three bases, it may be four bases, it may be five bases, it may be six bases, it may be seven to ten bases, it may be eleven to fifteen bases, or it may be sixteen to twenty bases, twenty to thirty bases, or thirty to sixty bases. The forward and reverse primers may be designed to hybridize a different number of bases away from the polymorphic site. Circularizing probes can be generated in large numbers with current DNA synthesis technology allowing very large numbers of probes to be generated and potentially pooled, enabling interrogation of many loci simultaneously. It has been reported to work with more than 300,000 probes. Two papers that discuss a method involving circularizing probes that can be used to measure the genomic data of the target individual include: Porreca et al., Nature Methods, 2007 4(11), pp. 931-936; and also Turner et al., Nature Methods, 2009, 6(5), pp. 315-316. The methods described in these papers may be used in combination with other methods described herein. Certain steps of the method from these two papers may be used in combination with other steps from other methods described herein.

In some embodiments of the methods disclosed herein, the genetic material of the target individual is optionally amplified, followed by hybridization of the pre-circularized probes, performing a gap fill to fill in the bases between the two ends of the hybridized probes, ligating the two ends to form a circularized probe, and amplifying the circularized probe, using, for example, rolling circle amplification. Once the desired target allelic genetic information is captured by circularizing appropriately designed oligonucleotide probes, such as in the LIPs system, the genetic sequence of the circularized probes may be being measured to give the desired sequence data. In an embodiment, the appropriately designed oligonucleotides probes may be circularized directly on unamplified genetic material of the target individual, and amplified afterwards. Note that a number of amplification procedures may be used to amplify the original genetic material, or the circularized LIPs, including rolling circle amplification, MDA, or other amplification protocols. Different methods may be used to measure the genetic information on the target genome, for example using high throughput sequencing, Sanger sequencing, other sequencing methods, capture-by-hybridization, capture-by-circularization, multiplex PCR, other hybridization methods, and combinations thereof.

Once the genetic material of the individual has been measured using one or a combination of the above methods, an informatics based method, such as the PARENTAL SUPPORT™ method, along with the appropriate genetic measurements, can then be used to determination the ploidy state of one or more chromosomes on the individual, and/or the genetic state of one or a set of alleles, specifically those alleles that are correlated with a disease or genetic state of interest. Note that the use of LIPs has been reported for multiplexed capture of genetic sequences, followed by genotyping with sequencing. However, the use of sequencing data resulting from a LIPs-based strategy for the amplification of the genetic material found in a single cell, a small number of cells, or extracellular DNA, has not been used for the purpose of determining the ploidy state of a target individual.

Applying an informatics based method to determine the ploidy state of an individual from genetic data as measured by hybridization arrays, such as the ILLUMINA INFINIUM array, or the AFFYMETRIX gene chip has been described in documents references elsewhere in this document. However, the method described herein shows improvements over methods described previously in the literature. For example, the LIPs based approach followed by high throughput sequencing unexpectedly provides better genotypic data due to the approach having better capacity for multiplexing, better capture specificity, better uniformity, and low allelic bias. Greater multiplexing allows more alleles to be targeted, giving more accurate results. Better uniformity results in more of the targeted alleles being measured, giving more accurate results. Lower rates of allelic bias result in lower rates of miscalls, giving more accurate results. More accurate results result in an improvement in clinical outcomes, and better medical care.

It is important to note that LIPs may be used as a method for targeting specific loci in a sample of DNA for genotyping by methods other than sequencing. For example, LIPs may be used to target DNA for genotyping using SNP arrays or other DNA or RNA based microarrays.

Ligation-Mediated PCR

Ligation-mediated PCR may be used to amplify the target loci before or after PCR amplification using primers that are not ligated. Ligation-mediated PCR is a method of PCR used to preferentially enrich a sample of DNA by amplifying one or a plurality of loci in a mixture of DNA, the method comprising: obtaining a set of primer pairs, where each primer in the pair contains a target specific sequence and a non-target sequence, where the target specific sequence is preferably designed to anneal to a target region, one upstream and one downstream from the polymorphic site, and which can be separated from the polymorphic site by 0, 1, 2, 3, 4, 5, 6, 7, 8, 9, 10, 11-20, 21-30, 31-40, 41-50, 51-100, or more than 100; polymerization of the DNA from the 3-prime end of upstream primer to the fill the single strand region between it and the 5-prime end of the downstream primer with nucleotides complementary to the target molecule; ligation of the last polymerized base of the upstream primer to the adjacent 5-prime base of the downstream primer; and amplification of only polymerized and ligated molecules using the non-target sequences contained at the 5-prime end of the upstream primer and the 3-prime end of the downstream primer. Pairs of primers to distinct targets may be mixed in the same reaction. The non-target sequences serve as universal sequences such that of all pairs of primers that have been successfully polymerized and ligated may be amplified with a single pair of amplification primers.

Capture by Hybridization

In some embodiments, a method of the present disclosure may involve using any of the following capture by hybridization methods in addition to using multiplex PCR to amplify the target loci. Preferential enrichment of a specific set of sequences in a target genome can be accomplished in a number of ways. Elsewhere in this document is a description of how LIPs can be used to target a specific set of sequences, but in all of those applications, other targeting and/or preferential enrichment methods can be used equally well for the same ends. One example of another targeting method is the capture by hybridization approach. Some examples of commercial capture by hybridization technologies include AGILENT's SURE SELECT and ILLUMINA's TRUSEQ. In capture by hybridization, a set of oligonucleotides that is complimentary or mostly complimentary to the desired targeted sequences is allowed to hybridize to a mixture of DNA, and then physically separated from the mixture. Once the desired sequences have hybridized to the targeting oligonucleotides, the effect of physically removing the targeting oligonucleotides is to also remove the targeted sequences. Once the hybridized oligos are removed, they can be heated to above their melting temperature and they can be amplified. Some ways to physically remove the targeting oligonucleotides is by covalently bonding the targeting oligos to a solid support, for example a magnetic bead, or a chip. Another way to physically remove the targeting oligonucleotides is by covalently bonding them to a molecular moiety with a strong affinity for another molecular moiety. An example of such a molecular pair is biotin and streptavidin, such as is used in SURE SELECT. Thus that targeted sequences could be covalently attached to a biotin molecule, and after hybridization, a solid support with streptavidin affixed can be used to pull down the biotinylated oligonucleotides, to which are hybridized to the targeted sequences.

Hybrid capture involves hybridizing probes that are complementary to the targets of interest to the target molecules. Hybrid capture probes were originally developed to target and enrich large fractions of the genome with relative uniformity between targets. In that application, it was important that all targets be amplified with enough uniformity that all regions could be detected by sequencing, however, no regard was paid to retaining the proportion of alleles in original sample. Following capture, the alleles present in the sample can be determined by direct sequencing of the captured molecules. These sequencing reads can be analyzed and counted according the allele type. However, using the current technology, the measured allele distributions the captured sequences are typically not representative of the original allele distributions.

In an embodiment, detection of the alleles is performed by sequencing. In order to capture the allele identity at the polymorphic site, it is essential that the sequencing read span the allele in question in order to evaluate the allelic composition of that captured molecule. Since the capture molecules are often of variable lengths upon sequencing cannot be guaranteed to overlap the variant positions unless the entire molecule is sequenced. However, cost considerations as well as technical limitations as to the maximum possible length and accuracy of sequencing reads make sequencing the entire molecule unfeasible. In an embodiment, the read length can be increased from about 30 to about 50 or about 70 bases can greatly increase the number of reads that overlap the variant positions within the targeted sequences.

Another way to increase the number of reads that interrogate the position of interest is to decrease the length of the probe, as long as it does not result in bias in the underlying enriched alleles. The length of the synthesized probe should be long enough such that two probes designed to hybridize to two different alleles found at one locus will hybridize with near equal affinity to the various alleles in the original sample. Currently, methods known in the art describe probes that are typically longer than 120 bases. In a current embodiment, if the allele is one or a few bases then the capture probes may be less than about 110 bases, less than about 100 bases, less than about 90 bases, less than about 80 bases, less than about 70 bases, less than about 60 bases, less than about 50 bases, less than about 40 bases, less than about 30 bases, and less than about 25 bases, and this is sufficient to ensure equal enrichment from all alleles. When the mixture of DNA that is to be enriched using the hybrid capture technology is a mixture comprising free floating DNA isolated from blood, for example maternal blood, the average length of DNA is quite short, typically less than 200 bases. The use of shorter probes results in a greater chance that the hybrid capture probes will capture desired DNA fragments. Larger variations may require longer probes. In an embodiment, the variations of interest are one (a SNP) to a few bases in length. In an embodiment, targeted regions in the genome can be preferentially enriched using hybrid capture probes wherein the hybrid capture probes are of a length below 90 bases, and can be less than 80 bases, less than 70 bases, less than 60 bases, less than 50 bases, less than 40 bases, less than 30 bases, or less than 25 bases. In an embodiment, to increase the chance that the desired allele is sequenced, the length of the probe that is designed to hybridize to the regions flanking the polymorphic allele location can be decreased from above 90 bases, to about 80 bases, or to about 70 bases, or to about 60 bases, or to about 50 bases, or to about 40 bases, or to about 30 bases, or to about 25 bases.

There is a minimum overlap between the synthesized probe and the target molecule in order to enable capture. This synthesized probe can be made as short as possible while still being larger than this minimum required overlap. The effect of using a shorter probe length to target a polymorphic region is that there will be more molecules that overlap the target allele region. The state of fragmentation of the original DNA molecules also affects the number of reads that will overlap the targeted alleles. Some DNA samples such as plasma samples are already fragmented due to biological processes that take place in vivo. However, samples with longer fragments by benefit from fragmentation prior to sequencing library preparation and enrichment. When both probes and fragments are short (~60-80 bp) maximum specificity may be achieved relatively few sequence reads failing to overlap the critical region of interest.

In an embodiment, the hybridization conditions can be adjusted to maximize uniformity in the capture of different alleles present in the original sample. In an embodiment, hybridization temperatures are decreased to minimize differences in hybridization bias between alleles. Methods known in the art avoid using lower temperatures for hybridization because lowering the temperature has the effect of increasing hybridization of probes to unintended targets. However, when the goal is to preserve allele ratios with maximum fidelity, the approach of using lower hybridization temperatures provides optimally accurate allele ratios, despite the fact that the current art teaches away from this approach. Hybridization temperature can also be increased to require greater overlap between the target and the synthesized probe so that only targets with substantial overlap of the targeted region are captured. In some embodiments of the present disclosure, the hybridization temperature is lowered from the normal hybridization temperature to about 40° C., to about 45° C., to about 50° C., to about 55° C., to about 60° C., to about 65, or to about 70° C.

In an embodiment, the hybrid capture probes can be designed such that the region of the capture probe with DNA that is complementary to the DNA found in regions flanking the polymorphic allele is not immediately adjacent to the polymorphic site. Instead, the capture probe can be designed such that the region of the capture probe that is designed to hybridize to the DNA flanking the polymorphic site of the target is separated from the portion of the capture probe that will be in van der Waals contact with the polymorphic site by a small distance that is equivalent in length to one or a small number of bases. In an embodiment, the hybrid capture probe is designed to hybridize to a region that is flanking the polymorphic allele but does not cross it; this may be termed a flanking capture probe. The length of the flanking capture probe may be less than about 120 bases, less than about 110 bases, less than about 100 bases, less than about 90 bases, and can be less than about 80 bases, less than about 70 bases, less than about 60 bases, less than about 50 bases, less than about 40 bases, less than about 30 bases, or less than about 25 bases. The region of the genome that is targeted by the flanking capture probe may be separated by the polymorphic locus by 1, 2, 3, 4, 5, 6, 7, 8, 9, 10, 11-20, or more than 20 base pairs.

Description of a targeted capture based disease screening test using targeted sequence capture. Custom targeted sequence capture, like those currently offered by AGILENT (SURE SELECT), ROCHE-NIMBLEGEN, or ILLUMINA. Capture probes could be custom designed to ensure capture of various types of mutations. For point mutations, one or more probes that overlap the point mutation should be sufficient to capture and sequence the mutation.

For small insertions or deletions, one or more probes that overlap the mutation may be sufficient to capture and sequence fragments comprising the mutation. Hybridization may be less efficient between the probe-limiting capture efficiency, typically designed to the reference genome sequence. To ensure capture of fragments comprising the mutation one could design two probes, one matching the normal allele and one matching the mutant allele. A longer probe may enhance hybridization. Multiple overlapping probes may enhance capture. Finally, placing a probe immediately adjacent to, but not overlapping, the mutation may permit relatively similar capture efficiency of the normal and mutant alleles.

For Simple Tandem Repeats (STRs), a probe overlapping these highly variable sites is unlikely to capture the fragment well. To enhance capture a probe could be placed adjacent to, but not overlapping the variable site. The fragment could then be sequenced as normal to reveal the length and composition of the STR.

For large deletions, a series of overlapping probes, a common approach currently used in exon capture systems may work. However, with this approach it may be difficult to determine whether or not an individual is heterozygous. Targeting and evaluating SNPs within the captured region could potentially reveal loss of heterozygosity across the region indicating that an individual is a carrier. In an embodiment, it is possible to place non-overlapping or singleton probes across the potentially deleted region and use the number of fragments captured as a measure of heterozygosity. In the case where an individual caries a large deletion, one-half the number of fragments are expected to be available for capture relative to a non-deleted (diploid) reference locus. Consequently, the number of reads obtained from the deleted regions should be roughly half that obtained from a normal diploid locus. Aggregating and averaging the sequencing read depth from multiple singleton probes across the potentially deleted region may enhance the signal and improve confidence of the diagnosis. The two approaches, targeting SNPs to identify loss of heterozygosity and using multiple singleton probes to obtain a quantitative measure of the quantity of underlying fragments from that locus can also be combined. Either or both of these strategies may be combined with other strategies to better obtain the same end.

If during testing cfDNA detection of a male fetus, as indicated by the presence of the Y-chromosome fragments, captured and sequenced in the same test, and either an X-linked dominant mutation where mother and father are unaffected, or a dominant mutation where mother is not affected would indicated heighted risk to the fetus. Detection of two mutant recessive alleles within the same gene in an unaffected mother would imply the fetus had inherited a mutant allele from father and potentially a second mutant allele from mother. In all cases, follow-up testing by amniocentesis or chorionic villus sampling may be indicated.

A targeted capture based disease screening test could be combined with a targeted capture based non-invasive prenatal diagnostic test for aneuploidy.

There are a number of ways to decrease depth of read (DOR) variability: for example, one could increase primer concentrations, one could use longer targeted amplification probes, or one could run more STA cycles (such as more than 25, more than 30, more than 35, or even more than 40) Exemplary Methods of Determining the Number of DNA Molecules in a Sample.

A method is described herein to determine the number of DNA molecules in a sample by generating a uniquely identified molecule for each original DNA molecules in the sample during the first round of DNA amplification. Described here is a procedure to accomplish the above end followed by a single molecule or clonal sequencing method.

The approach entails targeting one or more specific loci and generating a tagged copy of the original molecules such manner that most or all of the tagged molecules from each targeted locus will have a unique tag and can be distinguished from one another upon sequencing of this barcode using clonal or single molecule sequencing. Each unique sequenced barcode represents a unique molecule in the original sample. Simultaneously, sequencing data is used to ascertain the locus from which the molecule originates. Using this information one can determine the number of unique molecules in the original sample for each locus.

This method can be used for any application in which quantitative evaluation of the number of molecules in an original sample is required. Furthermore, the number of unique molecules of one or more targets can be related to the number of unique molecules to one or more other targets to determine the relative copy number, allele distribution, or allele ratio. Alternatively, the number of copies detected from various targets can be modeled by a distribution in order to identify the mostly likely number of copies of the original targets. Applications include but are not limited to detection of insertions and deletions such as those found in carriers of Duchenne Muscular Dystrophy; quantitation of deletions or duplications segments of chromosomes such as those observed in copy number variants; chromosome copy number of samples from born individuals; chromosome copy number of samples from unborn individuals such as embryos or fetuses.

The method can be combined with simultaneous evaluation of variations contained in the targeted by sequence. This can be used to determine the number of molecules representing each allele in the original sample. This copy number method can be combined with the evaluation of SNPs or other sequence variations to determine the chromosome copy number of born and unborn individuals; the discrimination and quantification of copies from loci which have short sequence variations, but in which PCR may amplifies from multiple target regions such as in carrier detection of Spinal Muscle Atrophy; determination of copy number of different sources of molecules from samples consisting of mixtures of different individual such as in detection of fetal aneuploidy from free floating DNA obtained from maternal plasma.

In an embodiment, the method as it pertains to a single target locus may comprise one or more of the following steps: (1) Designing a standard pair of oligomers for PCR amplification of a specific locus. (2) Adding, during synthesis, a sequence of specified bases with no or minimal complementarity to the target locus or genome to the 5' end of the one of the target specific oligomer. This sequence, termed the tail, is a known sequence, to be used for subsequent amplification, followed by a sequence of random nucleotides. These random nucleotides comprise the random region. The random region comprises a randomly generated sequence of nucleic acids that probabilistically differ between each probe molecule. Consequently, following synthesis, the tailed oligomer pool will consists of a collection of oligomers beginning with a known sequence followed by unknown sequence that differs between molecules, followed by the target specific sequence. (3) Performing one round of amplification (denaturation, annealing, extension) using only the tailed oligomer. (4) Adding exonuclease to the reaction, effectively stopping the PCR reaction, and incubating the reaction at the appropriate temperature to remove forward single stranded oligos that did not anneal to temple and extend to form a double stranded product. (5) Incubating the reaction at a high temperature to denature the exonuclease and eliminate its activity. (6) Adding to the reaction a new oligonucleotide that is complementary to tail of the oligomer used in the first reaction along with the other target specific oligomer to enable PCR amplification of the product generated in the first round of PCR. (7) Continuing amplification to generate enough product for downstream clonal sequencing. (8) Measuring the amplified PCR product by a multitude of methods, for example, clonal sequencing, to a sufficient number of bases to span the sequence.

In an embodiment, a method of the present disclosure involves targeting multiple loci in parallel or otherwise. Primers to different target loci can be generated independently and mixed to create multiplex PCR pools. In an embodiment, original samples can be divided into subpools and different loci can be targeted in each sub-pool before being recombined and sequenced. In an embodiment, the tagging step and a number of amplification cycles may be performed before the pool is subdivided to ensure efficient targeting of all targets before splitting, and improving subsequent amplification by continuing amplification using smaller sets of primers in subdivided pools.

One example of an application where this technology would be particularly useful is non-invasive prenatal aneuploidy diagnosis where the ratio of alleles at a given locus or a distribution of alleles at a number of loci can be used to help determine the number of copies of a chromosome present in a fetus. In this context, it is desirable to amplify the DNA present in the initial sample while maintaining the relative amounts of the various alleles. In some circumstances, especially in cases where there is a very small amount of DNA, for example, fewer than 5,000 copies of the genome, fewer than 1,000 copies of the genome, fewer than 500 copies of the genome, and fewer than 100 copies of the genome, one can encounter a phenomenon called bottle-necking. This is where there are a small number of copies of any given allele in the initial sample, and amplification biases can result in the amplified pool of DNA having significantly different ratios of those alleles than are in the initial mixture of DNA. By applying a unique or nearly unique set of barcodes to each strand of DNA before standard PCR amplification, it is possible to exclude n−1 copies of DNA from a set of n identical molecules of sequenced DNA that originated from the same original molecule.

For example, imagine a heterozygous SNP in the genome of an individual, and a mixture of DNA from the individual where ten molecules of each allele are present in the original sample of DNA. After amplification there may be 100,000 molecules of DNA corresponding to that locus. Due to stochastic processes, the ratio of DNA could be anywhere from 1:2 to 2:1, however, since each of the original molecules was tagged with a unique tag, it would be possible to determine that the DNA in the amplified pool originated from exactly 10 molecules of DNA from each allele. This method would therefore give a more accurate measure of the relative amounts of each allele than a method not using this approach. For methods where it is desirable for the relative amount of allele bias to be minimized, this method will provide more accurate data.

Association of the sequenced fragment to the target locus can be achieved in a number of ways. In an embodiment, a sequence of sufficient length is obtained from the targeted fragment to span the molecule barcode as well a sufficient number of unique bases corresponding to the target sequence to allow unambiguous identification of the target locus. In another embodiment, the molecular bar-coding primer that contains the randomly generated molecular barcode can also contain a locus specific barcode (locus barcode) that identifies the target to which it is to be associated. This locus barcode would be identical among all molecular bar-coding primers for each individual target and hence all resulting amplicons, but different from all other targets. In an embodiment, the tagging method described herein may be combined with a one-sided nesting protocol.

In an embodiment, the design and generation of molecular barcoding primers may be reduced to practice as follows: the molecular barcoding primers may consist of a sequence that is not complementary to the target sequence followed by random molecular barcode region followed by a target specific sequence. The sequence 5' of molecular barcode may be used for subsequence PCR amplification and may comprise sequences useful in the conversion of the amplicon to a library for sequencing. The random molecular barcode sequence could be generated in a multitude of ways. The preferred method synthesize the molecule tagging primer in such a way as to include all four bases to the reaction during synthesis of the barcode region. All or various combinations of bases may be specified using the IUPAC DNA ambiguity codes. In this manner the synthesized collection of molecules will contain a random mixture of sequences in the molecular barcode region. The length of the barcode region will determine how many primers will contain unique barcodes. The number of unique sequences is related to the length of the barcode region as $N^L$ where N is the number of bases, typically 4, and L is the length of the barcode. A barcode of five bases can yield up to 1024 unique sequences; a barcode of eight bases can yield 65536 unique barcodes.

In an embodiment, the DNA can be measured by a sequencing method, where the sequence data represents the sequence of a single molecule. This can include methods in which single molecules are sequenced directly or methods in which single molecules are amplified to form clones detectable by the sequence instrument, but that still represent single molecules, herein called clonal sequencing.

Exemplary Methods and Reagents for Quantification of Amplification Products

Quantitation of specific nucleic acid sequences of interest is typically done by quantitative real-time PCR techniques such as TAQMAN (LIFE TECHNOLOGIES), INVADER probes (THIRD WAVE TECHNOLOGIES), and the like. Such techniques suffer from numerous shortcomings such as limited ability to achieve the simultaneous analysis of multiple sequences in parallel (multiplexation) and the ability to provide accurate quantitative data for only a narrow range of possible amplification cycles (e.g., when the logarithm of PCR amplification production quantity versus the number of cycles is in the linear range). DNA sequencing techniques, particularly high throughput next-generation sequencing techniques (often referred to as massively parallel sequencing techniques) such as those employed in MYSEQ (ILLUMINA), HISEQ (ILLUMINA), ION TORRENT (LIFE TECHNOLOGIES), GENOME ANALYZER ILX (ILLUMINA), GS FLEX+(ROCHE 454) etc., can be used for by quantitative measurements of the number of copies of sequence of interest present in sample, thereby providing quantitative information about the starting materials, e.g., copy number or transcription levels. High throughput genetic sequencers are amenable to the use of bar coding (i.e., sample tagging with distinctive nucleic acid sequences) so as to identify specific samples from individuals thereby permitting the simultaneous analysis of multiple samples in a single run of the DNA sequencer. The number of times a given region of the genome in a library preparation (or other nucleic preparation of interest) is sequenced (number of reads) will be proportional to the number of copies of that sequence in the genome of interest (or expression level in the case of cDNA containing preparations). However, the preparation and sequencing of genetic libraries (and similar genome derived preparations) can introduce numerous biases that interfere with obtaining an accurate quantitative reading for the nucleic acid sequence of interest. For example, different nucleic acid sequences can amplify with different efficiencies during nucleic amplification steps that take place during the genetic library preparation or sample preparation.

The problem with differential amplification efficiencies can be mitigated by using certain embodiments of the subject invention. The subject invention includes various methods and compositions that relate to the use of standards for inclusion in amplification processes that can be used to improve the accuracy of quantitation. The invention is of use in, among other areas, the detection of aneuploidy in a fetus by analyzing free floating fetal DNA in maternal blood, as described herein and as described, among other places, U.S. Pat. Nos. 8,008,018; 7,332,277; PCT Published Application WO 2012/078792A2; and PCT Published Application WO 2011/146632 A1, which are each herein incorporated by reference in its entirety Embodiments of the invention are also of use in the detection of aneuploidy in an in vitro generated embryos. Commercially significant aneuploidies that may be detected include aneuploidy of the human chromosomes 13, 18, 21, X and Y.

Embodiments of the invention may be used with either human or non-human nucleic acids, and may be applied to both animal and plant derived nucleic acids. Embodiments of the invention may also be used to detect and/or quantitate alleles for other genetic disorders characterized by deletions or insertions. The deletion containing alleles can be detected in suspected carriers of the allele of interest.

One embodiment of the subject invention includes standards that are present in a known quantity (relative or absolute). For example, consider a genetic library made from a genetic source that is diploid for chromosome 8 (containing locus A) and triploid for chromosome 21 (containing locus B). A genetic library can be produced from this sample that will contain sequences in quantities that are a function of the number of chromosomes present in the sample, e.g., 200 copies of locus A and 300 copies of locus B. However, if locus A amplifies much more efficiently than locus B, after PCR there may be 60,000 copies of the A amplicon and 30,000 copies of the B amplicon, thus obscuring the true chromosomal copy number of the initial genomic sample when analysis by high throughput DNA sequencing (or other quantitative nucleic acid detection techniques). To mitigate this problem a standard sequence for locus A is employed, wherein the standard sequence amplifies with essentially the same efficiency as locus A. Similarly, a standard sequence for locus B is created, wherein the standard sequence amplifies with the essentially the same efficiency as locus B. A standard sequence of locus A and a standard sequence for locus B are added to the mixture prior to PCR (or other amplification techniques). These standard sequences are present in known quantities, either relative quantities or absolute quantities. Thus if a 1:1 mixture of standard sequence A and standard sequence B were added (prior to amplification) to the mixture in the previous example, 3000 copies of the standard A amplicon would be produced and 1000 copies of the standard B amplicon would be produced, showing that locus A is amplified 3 times more efficiently than locus B, under the same set of conditions.

In various embodiments one or more selected regions of a genome containing a SNP (or other polymorphism) of interest can be specifically amplified and subsequently sequenced. This target specific amplification can take place during the formation of a genetic library for sequencing. The library can contain numerous targeted regions for amplification. In some embodiments at least 10; 100, 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 regions of interest. Examples of such libraries are described herein and can be found in U.S. Patent Application No. 2012/0270212, filed Nov. 18, 2011, which is herein incorporated by reference in its entirety.

Many high throughput DNA sequencing techniques require the modification of the genetic starting material, e.g., the litigation of universal priming sites and/or barcodes, so as to form libraries to facilitate the clonal amplification of small nucleic acid fragments prior to performing subsequent sequencing reactions. In some embodiments, one or more standard sequences are added during genetic library formation or added to a precursor component of a genetic library prior to amplification of the library. The standard sequences can be selected so as to mimic (yet be distinguishable based on nucleotide base sequence) target genomic fragments to be prepared for sequencing by a high throughput genetic sequencing technique. In one embodiment, the standard sequence can be identical to the target genomic fragment excepting one, two, three, four to ten, or eleven to twenty nucleotides. In some embodiments, when the target genetic sequence contains a SNP, the standard sequence can be identical to the SNP excepting the nucleotide at the polymorphic base, which may be chosen to be one of the four nucleotides that is not observed at that location in nature. The standard sequences can be used in a highly multiplexed analysis of multiple target loci (such as polymorphic loci). Standard sequences can be added during the process of library formation (prior to amplification) in known quantities (relative or absolute) so as to provide a standard metric for greater accuracy in determining the amount of target sequence of interest in the sample of analysis. The combination of knowledge of the known quantities of the standard sequences used in conjunction with the knowledge of the ploidy level formation of library for sequencing formed from a genome of previously characterized ploidy level, e.g., known to be diploid for all autosomal chromosomes, can be used to calibrate the amplification properties of each standard sequence with respect to its corresponding target sequence and account for variations between batches of mixtures comprising multiple standard sequences. Given that it is often necessary to simultaneously analyze a large number of loci, it is useful to produce a mixture comprising a large set standard sequences. Embodiments of the invention include mixtures comprising multiple standard sequences. Ideally the amount of each standard sequence in the mixture is known with high precision. However, it is extremely difficult to achieve this ideal because as a practical matter there is a significant amount of variation in the quantity of each standard sequence in the mixture, particularly for mixtures comprising a large number of different synthetic oligonucleotides. This variation has numerous sources, e.g., variations in in vitro oligonucleotide synthesis reaction efficiencies between batch, inaccuracies in volume measurement, variations in pipetting. Furthermore, this variation can occur between different batches of that theoretically contain the exact same set of standard sequences in the exact same amounts. Accordingly, it is of interest to calibrate each batch of standard sequences independently. Batches of standard sequences can be calibrated against reference genomes of known chromosomal composition. Batched of standard sequences can be calibrated by sequencing the batch of standard sequences with minimal or no amplifications steps included in the sequencing protocol. Embodiments of the invention include calibrated mixtures of different standard sequences. Other embodiments of the invention include methods of calibrating mixtures of different standard sequences and calibrated mixtures of different standard sequences made by the subject methods.

Various embodiments of the subject mixtures of standard sequences and methods for using them can comprise at least 10; 100, 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 or more standards sequences, as well as various intermediate amounts. The number of the standard sequences can be the same as the number of target sequences selected for analysis during the generation of a targeted library for DNA sequencing. However, in some embodiments, it may be advantageous to use a lower number of standard sequences than the number of targeted regions in the library being constructed. It may be advantageous to use the lower number so as avoid coming up against the limits of the sequencing capacity of the high throughput DNA sequencer being employed. The number of standard sequences can be 50% or less than the number of targeted regions, 40% or less than the number of targeted regions, be 30% or less than the number of targeted regions, 20% or less than the number of targeted regions, be 10% or less than the number of targeted regions, 5% or less than the number of targeted regions, 1% or less than the number of targeted regions, as well as various intermediate values. For example, if a genetic library is created using 15,000 pairs of primers targeted to specific SNP containing loci, a suitable mixture containing 1500 standard sequences corresponding to 1500 of the 15,000 targeted loci can be added prior to the amplification step of library constructions.

The amount of standard sequences added during library construction can vary considerably among different embodiments. In some embodiments, the amount of each standard sequence can be approximately the same as the predicted amount of the target sequence present in the genomic material sample used for library preparation. In other embodiments, the amount of each standard sequence can be greater or less than the predicted amount of the target sequence present in the genomic material sample used for library preparation. While the initial relative amounts of the target sequence and the standard sequence are not critical for the function of the invention, it is preferable that the amount be within the range 100 times greater to 100 times less than the amount of the target sequence present in the genomic material sample used for library preparation. Excessive amounts of standard may use too much sequencing capacity of the DNA sequencer in a given run of the instrument. Using too low an amount of standard sequences will produce insufficient data to aid in the analysis of variation in amplification efficiency.

The standard sequences may be selected to be very similar in nucleotide base sequence to the amplified regions of interest; preferably the standard sequence has the exact same primer-binding sites as the analyzed genomic region, i.e., the "target sequence." The standard sequence must be distinguishable from the corresponding target sequence at a given locus. For the sake of convenience, this distinguishable region of the standard sequence will be referred to as a "marker sequence." In some embodiments, the marker sequence region of the target sequences contains the polymorphic region, e.g., a SNP, and can be flanked on both sides by primer binding regions. The standard sequence may be selected to closely match the GC content of the corresponding target sequence. In some embodiments, the primer binding regions of the standard sequence are flanked by universal priming sites. These universal priming sites are selected to match universal priming sites used in a genomic library for analysis. In other embodiments, the standard sequences do not have universal priming sites and the universal priming sites are added during the creation of a library. Standard sequences are typically provided in single stranded form. A standard sequence is defined with respect to a corresponding target sequence and the sequence specific reagents used to amplify the target sequence. In some embodiments, the target sequence contains the polymorphism of interest, e.g., a SNP, a deletion, or insertion, present in the nucleic acid sample for analysis. The standard sequence is a synthetic polynucleotide that is similar in nucleotide base sequence to the target sequence, but is nonetheless distinguishable from the target sequence by virtue of at least one nucleotide base difference, thereby providing a mechanism for distinguishing amplicon sequences derived from the standard sequence form amplicon sequences derived from the target sequence. Standard sequences are selected so as to have essentially the same amplification properties as the corresponding target sequence when amplified with the same set of amplification reagents, e.g., PCR primers. In some embodiments, the standard sequences can have the same primer sequence binding sites than the corresponding target sequences. In other embodiments, the standard sequences can have a different primer sequence binding sites than the corresponding target sequences. In some embodiments, the standard sequences can be selected to produce amplicons that have the same length as the length of amplicons produced from the corresponding target sequences. In other embodiments, the standard sequences can be selected to produce amplicons that have the slightly different lengths than the length of amplicons produced from the corresponding target sequences.

After the amplification reactions have been completed, the library is sequenced on a high throughput DNA sequencer where individual molecule are clonally amplified and sequenced. The number of sequence reads for each allele of the target sequence is counted, also counted are the number of sequence reads for the standard sequence corresponding to the target sequence. The process is also carried out for at least one other pair of target sequences and corresponding standard sequences. Consider for example, locus A, $X_{A1}$ reads for allele 1 of locus A are produced; $X_{A2}$ reads for allele 2 of locus A are produced, and $X_{AC}$ reads for standard sequence A are produced. The ratio of ($X_{A1}$ plus $X_{A2}$) to $X_{AC}$ is determined for each locus of interest. As discussed earlier, the process can be performed on a reference genome, e.g., a genome that is known to be diploid for all chromosomes. The process can be repeated many times in order to provide a large number of read values so as to determine a mean number of reads and the standard deviation in the number of reads. The process is performed with a mixture comprising a large number of different standard sequences corresponding to different loci. By assuming that (1) $X_{A1}$ plus $X_{A2}$ corresponds to the known number of chromosome, e.g., 2 for the normal human female genome and (2) the standard sequences have similar amplification (and detectability) properties as their corresponding natural loci, the relative amounts of the different standard sequences in the multiplex standard mixture can be determined. The calibrated multiplex standard sequence mixture can then be used to adjust for the variability in amplification efficiency between the different loci in a multiplex amplification reaction.

Other embodiments of the invention include methods and compositions for measuring the copy number of specific genes of interest, including duplications and mutant genes characterized by large deletions that would interfere with quantitation by sequencing. Sequencing would have problems detecting alleles having such deletions. Standard sequences included the amplification process can be used to reduce this problem.

In one embodiment of the invention the target sequence for analysis is a gene having a wild type (i.e. functional) form and a mutant form characterized by a deletion. Exemplary of such genes is SMN1, an allele having deletion being responsible for the genetic disease spinal muscular atrophy (SMA). It is of interest to detect an individual carrying the mutant form of the gene by means of high throughput genetic sequencing techniques. The application of such techniques to the detection of deletion mutations can be problematic because, among other reasons, the lack of sequences observed in sequencing (as opposed to detecting a simple point mutation or SNP). Such embodiments employ (1) a pair of amplification primers specific for the gene of interest, where in the amplification primers will amplify the gene of interest (or a portion thereof) and will not significantly amplify the mutant allele, (2) a standard sequence corresponding to the wild type allele of the gene of interest (i.e., a target sequence), but differing by at least one detectable nucleotide base, (3) a pair of amplification primers specific for a second target sequence that serves as a reference sequence, and (4) a standard sequence corresponding to the reference sequence.

In one embodiment of the invention is provided a method for measuring the number of copies of the gene of interest, where in the gene of interest has one meaning allele that comprises a deletion. The method can employ amplification reagent specific for the gene of interest, e.g., PCR primers, that are specific for the gene of interest by amplifying at least a portion of the gene of interest, or the entire gene of interest, or a region adjacent to the gene of interest, while not amplifying the deletion comprising allele of the gene of interest. Additionally the subject method employs a standard sequence corresponding to the gene of interest, wherein the standard sequence differs by at least one nucleotide base from the gene of interest (so that the sequence of the standard sequence can be readily distinguished from the naturally occurring gene of interest). Typically, the standard sequence will contain the same primer binding sites as the gene of interest so as to minimize any amplification discrimination between the gene of interest and the standard sequence corresponding to the gene of interest. The reaction will also comprises amplification reagents specific for a reference sequence. The reference sequence is a sequence of known (or at least assumed to be known) copy number in the genome to be analyzed. The reaction further comprises a standard sequence corresponding to the reference sequence. Typically, the standard sequence corresponding to the reference sequence will contain the same primer binding sites as the reference sequence so as to minimize any amplification discrimination between the reference sequence and the standard sequence corresponding to the reference sequence.

Exemplary PCR Conditions

If desired, any of the PCR conditions disclosed herein or any standard PCR conditions can be used to test a primer library to determine, e.g., the percent of primer dimers, percent of target amplicons, and percent of target loci that are amplified. If desired, standard methods can be used to optimize the reaction conditions to improve the performance of a primer library. Any of these PCR conditions may also be used in any of the methods of the invention to amplify target loci. It was determined that high ionic strength solutions can surprisingly be used for multiplex PCR. In some embodiments, monovalent cations are used to increase the ionic strength to, e.g., help the primers bind the template.

In some embodiments, the reaction volume includes ethylenediaminetetraacetic acid (EDTA), magnesium, tetramethyl ammonium chloride (TMAC), or any combination thereof. In some embodiments, the concentration of TMAC is between 20 and 80 mM, such as between 25 and 70 mM, 30 and 60 mM, 30 and 40 mM, 40 and 50 mM, 50 and 60 mM, or 60 and 70 mM, inclusive. While not meant to be bound to any particular theory, it is believed that TMAC binds to DNA, stabilizes duplexes, increases primer specificity, and/or equalizes the melting temperatures of different primers. In some embodiments, TMAC increases the uniformity in the amount of amplified products for the different targets. In some embodiments, the concentration of magnesium (such as magnesium from magnesium chloride) is between 1 and 10 mM, such as between 1 and 8 mM, 1 and 5 mM, 1 and 3 mM, 3 and 5 mM, 3 and 6 mM, or 5 and 8 mM, inclusive.

In some embodiments, the concentration of available magnesium (the concentration of magnesium that is assumed to be available for binding the polymerase and not bound to molecules other than the polymerase), such as the magnesium that is not bound by phosphate groups on dNTPs, primers, or nucleic acid templates, or carboxylic acid groups on magnetic or other beads, if present) is between 0.5 to 10 mM, such as between 1 and 8 mM, 1 and 5 mM, 1 and 3 mM, 3 and 5 mM, 3 and 6 mM, 4 and 6 mM, or 5 and 8 mM, inclusive. The large number of primers used for multiplex PCR of a large number of targets may chelate a lot of the magnesium (2 phosphates in the primers chelate 1 magnesium). For example, if enough primers are used such that the concentration of phosphate from the primers is ~9 mM, then the primers may reduce the effective magnesium concentration by ~4.5 mM. In some embodiments, EDTA is used to decrease the amount of magnesium available as a cofactor for the polymerase since high concentrations of magnesium can result in PCR errors, such as amplification of non-target loci. In some embodiments, the concentration of EDTA reduces the amount of available magnesium to between 1 and 5 mM (such as between 3 and 5 mM).

In some embodiments, the pH is between 7.5 and 8.5, such as between 7.5 and 8, 8 and 8.3, or 8.3 and 8.5, inclusive. In some embodiments, Tris is used at, for example, a concentration of between 10 and 100 mM, such as between 10 and 25 mM, 25 and 50 mM, 50 and 75 mM, or 25 and 75 mM, inclusive. In some embodiments, any of these concentrations of Tris are used at a pH between 7.5 and 8.5. In some embodiments, a combination of KCl and $(NH_4)_2SO_4$ is used, such as between 50 and 150 mM KCl and between 10 and 90 mM $(NH_4)_2SO_4$, inclusive. In some embodiments, the concentration of KCl is between 0 and 30 mM, between 50 and 100 mM, or between 100 and 150 mM, inclusive. In some embodiments, the concentration of $(NH_4)_2SO_4$ is between 10 and 50 mM, 50 and 90 mM, 10 and 20 mM, 20 and 40 mM, 40 mM and 60, or 60 mM and 80 mM $(NH_4)_2SO_4$, inclusive. In some embodiments, the ammonium $[NH_4^+]$ concentration is between 0 and 160 mM, such as between 0 to 50, 50 to 100, or 100 to 160 mM, inclusive. In some embodiments, the sum of the potassium and ammonium concentration ($[K^+]+[NH_4^+]$) is between 0 and 160 mM, such as between 0 to 25, 25 to 50, 50 to 150, 50 to 75, 75 to 100, 100 to 125, or 125 to 160 mM, inclusive. An exemplary buffer with $[K+]+[NH_{4+]=120}$ mM is 20 mM KCl and 50 mM $(NH_4)_2SO_4$. In some embodiments, the buffer includes 25 to 75 mM Tris, pH 7.2 to 8, 0 to 50 mM KCL, 10 to 80 mM ammonium sulfate, and 3 to 6 mM magnesium, inclusive. In some embodiments, the buffer includes 25 to 75 mM Tris pH 7 to 8.5, 3 to 6 mM $MgCl_2$, 10 to 50 mM KCl, and 20 to 80 mM $(NH_4)_2SO_4$, inclusive. In some embodiments, 100 to 200 Units/mL of polymerase are used. In some embodiments, 100 mM KCl, 50 mM $(NH_4)_2SO_4$, 3 mM $MgCl_2$, 7.5 nM of each primer in the library, 50 mM TMAC, and 7 ul DNA template in a 20 ul final volume at pH 8.1 is used.

In some embodiments, a crowding agent is used, such as polyethylene glycol (PEG, such as PEG 8,000) or glycerol. In some embodiments, the amount of PEG (such as PEG 8,000) is between 0.1 to 20%, such as between 0.5 to 15%, 1 to 10%, 2 to 8%, or 4 to 8%, inclusive. In some embodiments, the amount of glycerol is between 0.1 to 20%, such as between 0.5 to 15%, 1 to 10%, 2 to 8%, or 4 to 8%, inclusive. In some embodiments, a crowding agent allows either a low polymerase concentration and/or a shorter annealing time to be used. In some embodiments, a crowding agent improves the uniformity of the DOR and/or reduces dropouts (undetected alleles). For example, at 8% PEG, and 50 U/mL polymerase, the uniformity was as good as 150 U/mL polymerase and no PEG. If the error rate increases when PEG is included, a higher magnesium chloride concentration (such greater than or about 4, 5, 6, 7, 8, 9, or 10 $MgCl_2$) can be used to reduce or prevent the increase in error rate. Inclusion of 8% PEG 8,000 allowed successful multiplexing with an annealing time of only 1 minute at an annealing temperature of 63° C.

In some embodiments, a polymerase with proof-reading activity, a polymerase without (or with negligible) proof-reading activity, or a mixture of a polymerase with proof-reading activity and a polymerase without (or with negligible) proof-reading activity is used. In some embodiments, a hot start polymerase, a non-hot start polymerase, or a mixture of a hot start polymerase and a non-hot start polymerase is used. In some embodiments, a HotStarTaq DNA polymerase is used (see, for example, QIAGEN catalog No. 203203, see, e.g., information available at the World Wide Web at giagen.com/us/products/catalog/assay-technologies/end-point-per-and-rt-per-reagents/hotstartaq-dna-polymerase/, which is hereby incorporated by reference in its entirety). In some embodiments, AmpliTaq Gold® DNA Polymerase is used; it is a chemically modified form of AmpliTaq® DNA Polymerase requiring thermal activation (see, for example, Applied Biosystems catalog No. N8080241 see, e.g., information available at the World Wide Web at lifetechnologies.com/order/catalog/product/N8080241, which is hereby incorporated by reference in its entirety). In some embodiments, KAPA Taq DNA Polymerase or KAPA Taq HotStart DNA Polymerase is used; they are based on the single-subunit, wild-type Taq DNA polymerase of the thermophilic bacterium *Thermus aquaticus*. KAPA Taq and KAPA Taq HotStart DNA Polymerase have 5'-3' polymerase and 5'-3' exonuclease activities, but no 3' to 5' exonuclease (proofreading) activity (see, for example, KAPA BIOSYSTEMS catalog No._BK1000 see, e.g., information available at the World Wide Web at kapabiosystems.com/product-applications/products/per-2/kapa-taq-per-kits/, which is hereby incorporated by reference in its entirety). In some embodiments, Pfu DNA polymerase is used; it is a highly thermostable DNA polymerase from the hyperthermophilic archaeum *Pyrococcus furiosus*. The enzyme catalyzes the template-dependent polymerization of nucleotides into duplex DNA in the 5'→3' direction. Pfu DNA Polymerase also exhibits 3'→5' exonuclease (proofreading) activity that enables the polymerase to correct nucleotide incorporation errors. It has no 5'→3' exonuclease activity (see, for example, Thermo Scientific catalog No._EP0501 see, e.g., information available at the World Wide Web at thermoscientificbio.com/per-enzymes-master-mixes-and-reagents/pfu-dna-polymerase/, which is hereby incorporated by reference in its entirety). In some embodiments Klentaql is used; it is a Klenow-fragment analog of Taq DNA polymerase, it has no exonuclease or endonuclease activity (see, for example, DNA POLYMERASE TECHNOLOGY, Inc, St. Louis, Mo., catalog No._100 see, e.g., information available at the World Wide Web at klentaq.com/products/klentaq, which is hereby incorporated by reference in its entirety). In some embodiments, the polymerase is a PUSHION DNA polymerase, such as PHUSION High Fidelity DNA polymerase (M0530S, New England BioLabs, Inc.) or PHUSION Hot Start Flex DNA polymerase (M0535S, New England BioLabs, Inc.; Frey and Suppman *BioChemica*. 2:34-35, 1995; Chester and Marshak *Analytical Biochemistry*. 209:284-290, 1993, which are each hereby incorporated by reference in its entirety). In some embodiments, the polymerase is a Q5® DNA Polymerase, such as Q5® High-Fidelity DNA Polymerase (M0491S, New England BioLabs, Inc.) or Q5® Hot Start High-Fidelity DNA Polymerase (M0493S, New England BioLabs, Inc.). In some embodiments, the polymerase is a T4 DNA polymerase (M0203S, New England BioLabs, Inc.; Tabor and Struh. (1989). "DNA-Dependent DNA Polymerases," In Ausebel et al. (Ed.), *Current Protocols in Molecular Biology*. 3.5.10-3.5.12. New York: John Wiley & Sons, Inc., 1989; Sambrook et al. *Molecular Cloning: A Laboratory Manual*. (2nd ed.), 5.44-5.47. Cold Spring Harbor: Cold Spring Harbor Laboratory Press, 1989, which are each hereby incorporated by reference in its entirety).

In some embodiment, between 5 and 600 Units/mL (Units per 1 mL of reaction volume) of polymerase is used, such as between 5 to 100, 100 to 200, 200 to 300, 300 to 400, 400 to 500, or 500 to 600 Units/mL, inclusive. One unit is commonly defined as the amount of enzyme that will incorporate 15 nmol of dNTP into acid-insoluble material in 30 minutes at 75° C. Exemplary assay conditions for measuring unit activity include 1× THERMOPOL Reaction Buffer, 200 μM dNTPs including [$^3$H]-dTTP and 200 μg/ml activated Calf Thymus DNA (see, e.g., information available at the world wide web at neb.com/products/m0267-taq-dna-polymerase-with-thermopol-buffer, which is hereby incorporated by reference in its entirety). 1× THERMOPOL® Reaction Buffer contains 20 mM Tris-HCl, 10 mM $(NH_4)_2SO_4$, 10 mM KCl, 2 mM $MgSO_4$, and 0.1% TRITON® X-100, pH 8.8.

In some embodiments, hot-start PCR is used to reduce or prevent polymerization prior to PCR thermocycling. Exemplary hot-start PCR methods include initial inhibition of the DNA polymerase, or physical separation of reaction components reaction until the reaction mixture reaches the higher temperatures. In some embodiments, the enzyme is spatially separated from the reaction mixture by wax that melts when the reaction reaches high temperature. In some embodiments, slow release of magnesium is used. DNA polymerase requires magnesium ions for activity, so the magnesium is chemically separated from the reaction by binding to a chemical compound, and is released into the solution only at high temperature. In some embodiments, non-covalent binding of an inhibitor is used. In this method a peptide, antibody, or aptamer are non-covalently bound to the enzyme at low temperature and inhibit its activity. After incubation at elevated temperature, the inhibitor is released and the reaction starts. In some embodiments, a cold-sensitive Taq polymerase is used, such as a modified DNA polymerase with almost no activity at low temperature. In some embodiments, chemical modification is used. In this method, a molecule is covalently bound to the side chain of an amino acid in the active site of the DNA polymerase. The molecule is released from the enzyme by incubation of the reaction mixture at elevated temperature. Once the molecule is released, the enzyme is activated.

In some embodiments, the amount to template nucleic acids (such as an RNA or DNA sample) is between 20 and 5,000 ng, such as between 20 to 200, 200 to 400, 400 to 600, 600 to 1,000; 1,000 to 1,500; or 2,000 to 3,000 ng, inclusive.

In some embodiments QIAGEN Multiplex PCR Kit is used (QIAGEN catalog No. 206143; see, e.g., information available at the World Wide Web at qiagen.com/products/catalog/assay-technologies/end-point-per-and-rt-per-reagents/qiagen-multiplex-per-kit, which is hereby incorporated by reference in its entirety). For 100×50 μl multiplex PCR reactions, the kit includes 2× QIAGEN Multiplex PCR Master Mix (providing a final concentration of 3 mM $MgCl_2$, 3×0.85 ml), 5× Q-Solution (1×2.0 ml), and RNase-Free Water (2×1.7 ml). The QIAGEN Multiplex PCR Master Mix (MM) contains a combination of KCl and $(NH_4)_2SO_4$ as well as the PCR additive, Factor MP, which increases the local concentration of primers at the template. Factor MP stabilizes specifically bound primers, allowing efficient primer extension by HotStarTaq DNA Polymerase. HotStarTaq DNA Polymerase is a modified form of Taq DNA polymerase and has no polymerase activity at ambient temperatures. In some embodiments, HotStarTaq DNA Polymerase is activated by a 15-minute incubation at 95° C. which can be incorporated into any existing thermal-cycler program.

In some embodiments, 1× QIAGEN MM final concentration (the recommended concentration), 7.5 nM of each primer in the library, 50 mM TMAC, and 7 ul DNA template in a 20 ul final volume is used. In some embodiments, the PCR thermocycling conditions include 95° C. for 10 minutes (hot start); 20 cycles of 96° C. for 30 seconds; 65° C. for 15 minutes; and 72° C. for 30 seconds; followed by 72° C. for 2 minutes (final extension); and then a 4° C. hold.

In some embodiments, 2× QIAGEN MM final concentration (twice the recommended concentration), 2 nM of each primer in the library, 70 mM TMAC, and 7 ul DNA template in a 20 ul total volume is used. In some embodiments, up to 4 mM EDTA is also included. In some embodiments, the PCR thermocycling conditions include 95° C. for 10 minutes (hot start); 25 cycles of 96° C. for 30 seconds; 65° C. for 20 minutes; and 72° C. for 30 seconds); followed by 72° C. for 2 minutes (final extension); and then a 4° C. hold.

Another exemplary set of PCR thermocyling conditions includes 95° C. for 10 minutes, 15 cycles of 95° C. for 30 seconds, 65° C. for 1 minute, 60° C. for 5 minutes, 65° C. for 5 minutes and 72° C. for 30 seconds; and then 72° C. for 2 minutes. In some embodiments, this set of PCR thermocyling conditions is used with the following reaction conditions: 100 mM KCl, 50 mM $(NH_4)_2SO_4$, 3 mM $MgCl_2$, 7.5 nM of each primer in the library, 50 mM TMAC, and 7 ul DNA template in a 20 ul final volume at pH 8.1.

Another exemplary set of conditions includes a seminested PCR approach. The first PCR reaction uses 20 ul a reaction volume with 2× QIAGEN MM final concentration, 1.875 nM of each primer in the library (outer forward and reverse primers), and DNA template. Thermocycling parameters include 95° C. for 10 minutes; 25 cycles of 96° C. for 30 seconds, 65° C. for 1 minute, 58° C. for 6 minutes, 60° C. for 8 minutes, 65° C. for 4 minutes, and 72° C. for 30 seconds; and then 72° C. for 2 minutes, and then a 4° C. hold. Next, 2 ul of the resulting product, diluted 1:200, is as input in a second PCR reaction. This reaction uses a 10 ul reaction volume with 1× QIAGEN MM final concentration, 20 nM of each inner forward primer, and 1 uM of reverse primer tag. Thermocycling parameters include 95° C. for 10 minutes; 15 cycles of 9° 5 C for 30 seconds, 65° C. for 1 minute, 60° C. for 5 minutes, 65° C. for 5 minutes, and 72° C. for 30 seconds; and then 72° C. for 2 minutes, and then a 4° C. hold.

Any of the methods disclosed herein or any standard methods can be used to test a primer library to determine, e.g., the percent of primer dimers, percent of target amplicons, and percent of target loci that are amplified. In some embodiments, the PCR products are sequenced as described in Example 15 or using standard sequencing methods. In some embodiments, the percentage of primer dimers can be determined by measuring the number of sequencing reads from primer dimers, the percentage of amplified products that are target amplicons can be determined by measuring the number of sequencing reads that map to target loci; the percent of target loci that are amplified can be determined by measuring the number of target loci for which there are sequencing reads that map to the target loci; the number of copies of a particular amplified target loci can be determined based on the number of sequencing reads that map to that target loci (such as by comparing the number of sequencing reads compared to the sequences reads from a standard of known concentration or amount).

Figure 46:
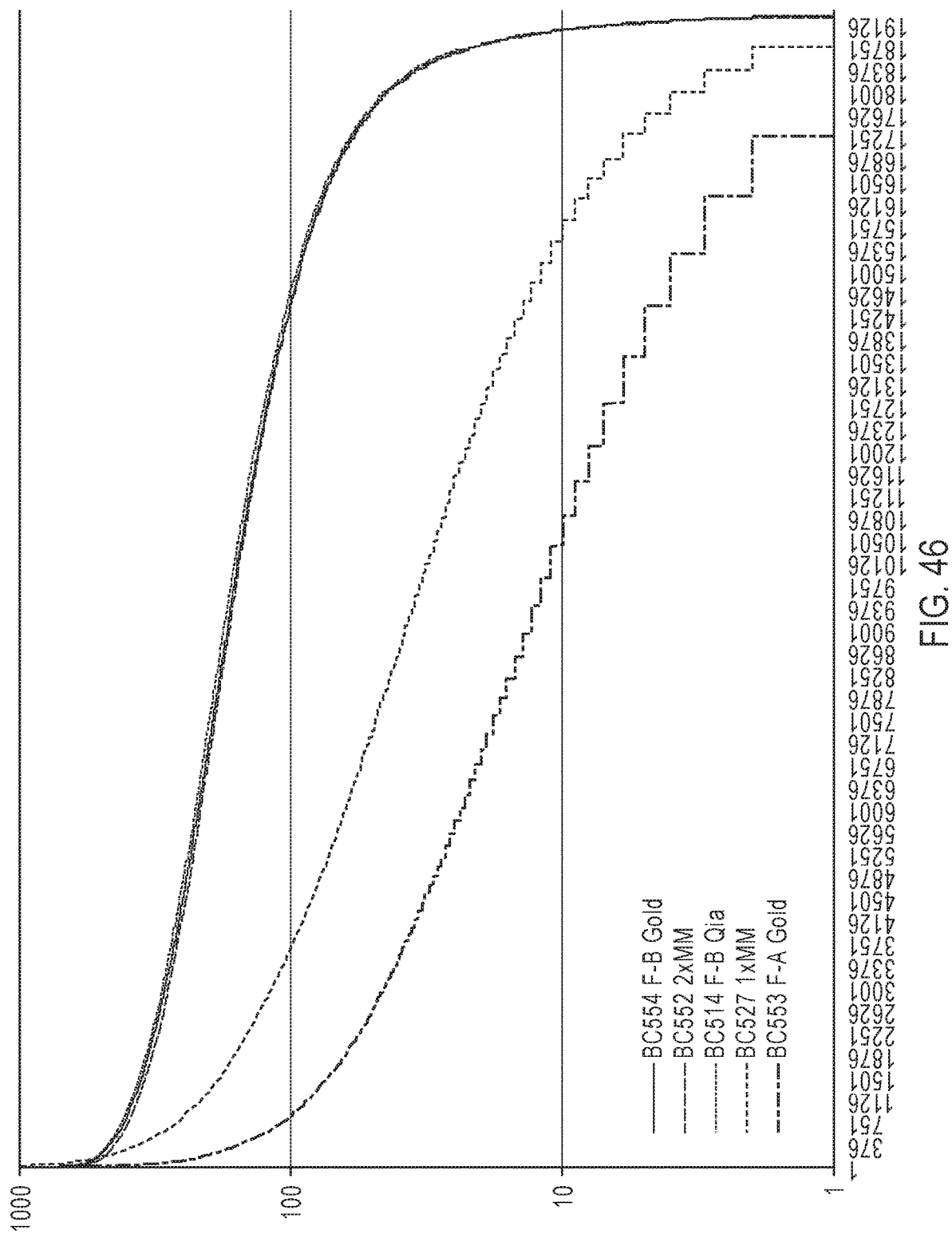
FIG. 46 is a graph illustrating the uniformity in DOR for multiplex PCR with buffers from FIG. 45.
Figure 47:
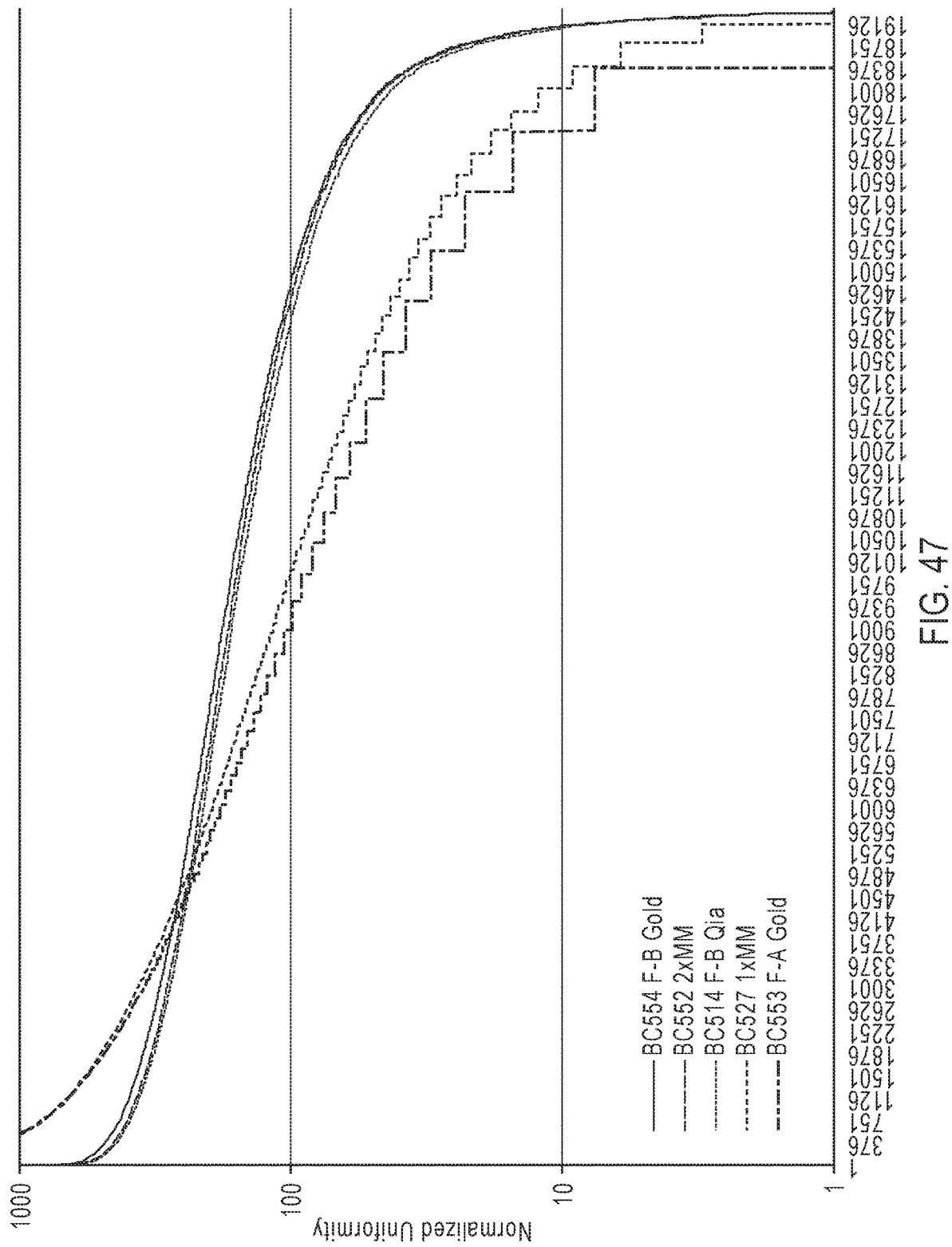
FIG. 47 is a graph illustrating the normalized depth of read (DOR) for multiplex PCR with buffers from FIG. 45 with the DOR normalized to that of buffer 2×MM.

FIG. 45 contains data (such as percent mapped reads and error rate) from multiplex PCR with various buffers. In this figure, "1×MM" denotes 1× QIAGEN Master Mix (the recommended concentration) discussed above, and "2×MM" denotes 2× QIAGEN Master Mix (twice the recommended concentration). FIG. 45 also lists the components of buffer F-A (also called F-A Gold), F-B (also called F-B Gold), F-D, and F-J (also called F-B Qiagen or F-B Qia) as well as the amount and type of polymerase used to generate the data. FIG. 46 is a graph illustrating the uniformity in DOR for multiplex PCR with buffers from FIG. 45. FIG. 47 is a graph illustrating the normalized depth of read (DOR) for multiplex PCR with buffers from FIG. 45 with the DOR normalized to that of buffer 2×MM.

Limit of Detection

As demonstrated by experiments provided in the Examples section, methods provided herein are capable of detecting an average allelic imbalance in a sample with a limit of detection or sensitivity of 0.45% AAI, which is the limit of detection for aneuploidy of an illustrative method of the present invention. Similarly, in certain embodiments, methods provided herein are capable of detecting an average allelic imbalance in a sample of 0.45, 0.5, 0.6, 0.8, 0.8, 0.9, or 1.0%. That is, the test method is capable of detecting chromosomal aneuploidy in a sample down to an AAI of 0.45, 0.5, 0.6, 0.8, 0.8, 0.9, or 1.0%. As demonstrated by experiments provided in the Examples section, methods provided herein are capable of detecting the presence of an SNV in a sample for at least some SNVs, with a limit of detection or sensitivity of 0.2%, which is the limit of detection for at least some SNVs in one illustrative embodiment. Similarly, in certain embodiments, the method is capable of detecting an SNV with a frequency or SNV AAI of 0.2, 0.3, 0.4, 0.5, 0.6, 0.8, 0.8, 0.9, or 1.0%. That is, the test method is capable of detecting an SNV in a sample down to a limit of detection of 0.2, 0.3, 0.4, 0.5, 0.6, 0.8, 0.8, 0.9, or 1.0% of the total allele counts at the chromosomal locus of the SNV.

In some embodiments, a limit of detection of a mutation (such as an SNV or CNV) of a method of the invention is less than or equal to 10, 5, 2, 1, 0.5, 0.1, 0.05, 0.01, or 0.005%. In some embodiments, a limit of detection of a mutation (such as an SNV or CNV) of a method of the invention is between 15 to 0.005%, such as between 10 to 0.005%, 10 to 0.01%, 10 to 0.1%, 5 to 0.005%, 5 to 0.01%, 5 to 0.1%, 1 to 0.005%, 1 to 0.01%, 1 to 0.1%, 0.5 to 0.005%, 0.5 to 0.01%, 0.5 to 0.1%, or 0.1 to 0.01, inclusive.

In some embodiments, a limit of detection is such that a mutation (such as an SNV or CNV) that is present in less than or equal to 10, 5, 2, 1, 0.5, 0.1, 0.05, 0.01, or 0.005% of the DNA or RNA molecules with that locus in a sample (such as a sample of cfDNA or cfRNA) is detected (or is capable of being detected). For example, the mutation can be detected even if less than or equal to 10, 5, 2, 1, 0.5, 0.1, 0.05, 0.01, or 0.005% of the DNA or RNA molecules that have that locus have that mutation in the locus (instead of, for example, a wild-type or non-mutated version of the locus or a different mutation at that locus). In some embodiments, a limit of detection is such that a mutation (such as an SNV or CNV) that is present in less than or equal to 10, 5, 2, 1, 0.5, 0.1, 0.05, 0.01, or 0.005% of the DNA or RNA molecules in a sample (such as a sample of cfDNA or cfRNA) is detected (or is capable of being detected). In some embodiments in which the CNV is a deletion, the deletion can be detected even if it is only present in less than or equal to 10, 5, 2, 1, 0.5, 0.1, 0.05, 0.01, or 0.005% of the DNA or RNA molecules that have a region of interest that may or may not contain the deletion in a sample. In some embodiments in which the CNV is a deletion, the deletion can be detected even if it is only present in less than or equal to 10, 5, 2, 1, 0.5, 0.1, 0.05, 0.01, or 0.005% of the DNA or RNA molecules in a sample. In some embodiments in which the CNV is a duplication, the duplication can be detected even if the extra duplicated DNA or RNA that is present is less than or equal to 10, 5, 2, 1, 0.5, 0.1, 0.05, 0.01, or 0.005% of the DNA or RNA molecules that have a region of interest that may or may not be duplicated in a sample in a sample. In some embodiments in which the CNV is a duplication, the duplication can be detected even if the extra duplicated DNA or RNA that is present is less than or equal to 10, 5, 2, 1, 0.5, 0.1, 0.05, 0.01, or 0.005% of the DNA or RNA molecules in a sample. Experiment 23 provides exemplary methods for calculating the limit of detection. In some embodiments, the "LOD-zs5.0-mr5" method of Example 23 is used.

Exemplary Nucleic Acid Samples

In some embodiments, the genetic sample may be prepared and/or purified. There are a number of standard procedures known in the art to accomplish such an end. In some embodiments, the sample may be centrifuged to separate various layers. In some embodiments, the DNA may be isolated using filtration. In some embodiments, the preparation of the DNA may involve amplification, separation, purification by chromatography, liquid separation, isolation, preferential enrichment, preferential amplification, targeted amplification, or any of a number of other techniques either known in the art or described herein.

In some embodiments, a method disclosed herein could be used in situations where there is a very small amount of DNA present, such as in in vitro fertilization, or in forensic situations, where one or a few cells are available (typically less than ten cells, less than twenty cells or less than 40 cells.) In these embodiments, a method disclosed herein serves to make ploidy calls from a small amount of DNA that is not contaminated by other DNA, but where the ploidy calling very difficult the small amount of DNA. In some embodiments, a method disclosed herein could be used in situations where the target DNA is contaminated with DNA of another individual, for example in maternal blood in the context of prenatal diagnosis, paternity testing, or products of conception testing. Some other situations where these methods would be particularly advantageous would be in the case of cancer testing where only one or a small number of cells were present among a larger amount of normal cells. The genetic measurements used as part of these methods could be made on any sample comprising DNA or RNA, for example but not limited to: blood, plasma, body fluids, urine, hair, tears, saliva, tissue, skin, fingernails, blastomeres, embryos, fetal cells, amniotic fluid, chorionic villus samples, feces, bile, lymph, cervical mucus, semen, or other cells or materials comprising nucleic acids. In an embodiment, a method disclosed herein could be run with nucleic acid detection methods such as sequencing, microarrays, qPCR, digital PCR, or other methods used to measure nucleic acids. If for some reason it were found to be desirable, the ratios of the allele count probabilities at a locus could be calculated, and the allele ratios could be used to determine ploidy state in combination with some of the methods described herein, provided the methods are compatible. In some embodiments, a method disclosed herein involves calculating, on a computer, allele ratios at the plurality of polymorphic loci from the DNA measurements made on the processed samples. In some embodiments, a method disclosed herein involves calculating, on a computer, allele ratios at the plurality of polymorphic loci from the DNA measurements made on the processed samples along with any combination of other improvements described in this disclosure. Exemplary methods for isolating fetal cells, such as a single fetal cell are disclosed in U.S. Ser. No. 61/978,648, filed Apr. 11, 2014 and U.S. Ser. No. 61/984,546, filed Apr. 25, 2014. Fetal cells or fetal nucleic acids can be isolated from a pregnant mother using invasive (such as CVS or amniocentesis) or noninvasive methods (such as from a maternal blood sample).

In some embodiments, this method may be used to genotype a single cell, a small number of cells, two to five cells, six to ten cells, ten to twenty cells, twenty to fifty cells, fifty to one hundred cells, one hundred to one thousand cells, or a small amount of extracellular DNA, for example from one to ten picograms, from ten to one hundred pictograms, from one hundred pictograms to one nanogram, from one to ten nanograms, from ten to one hundred nanograms, from 30 to 500 nanograms, or from one hundred nanograms to one microgram. In some embodiments, nucleic acids (such as DNA and/or RNA) from less than 100, 75, 50, 40, 30, 20, 10, 8, 6, 4, 2, or 1 cell is amplified with any of the methods of the invention. In some embodiments, the nucleic acid sample includes less than 80, 60, 40, 20, or 10% of the nucleic acids (such as DNA and/or RNA) from a single cell. In some embodiments, in which a small number of cells (such as one cell) or a small amount of nucleic acids is used, nested PCR such as hemi-nested or semi-nested PCR is used and/or the number of PCR cycles is increased compare to that used for samples with a larger amount of cells or nucleic acids. In some embodiments, a large amount of cells or nucleic acids are used (such as in cases in which a larger amount is desired to improve performance of any of the methods of the invention. In some embodiments, a sample with at least 2, 5, 10, 15, 20, 30, 50, 100, or more cells (or DNA or RNA from such cells) is used in any of the methods of the invention. In some embodiments, at least 0.5, 1, 10, 25, 50, 100, 500, 1,000; or 5,000 ng of DNA or RNA is used.

In some embodiments, the cells in the sample are lysed prior to PCR. In some embodiments, the Arcturus PicoPure DNA extraction kit from Applied Biosystems is used. (Applied Biosystems cat. No. KIT0103, see, e.g., information available at the World Wide Web at lifetechnologies.com/order/catalog/product/KIT0103?ICID=search-product, which is hereby incorporated by reference in its entirety). This kit contains Arcturus reconstitution buffer and Protease K. In some embodiments, the following cell lysis thermocycling protocol is used: 56° C. for 1 hour, 95° C. for 10 minutes, 25° C. for 15 minutes, and then a 4° C. hold.

In some embodiments, the nucleic acids are processed using the consecutive steps of end-repairing, dA-tailing, and adaptor ligating the nucleic acids. The consecutive steps exclude purifying the end-repaired products prior to the dA-tailing step and exclude purifying the dA-tailing products prior to the adaptor ligating step. The resulting products are amplified in any of the multiplex PCR methods of the invention. In some embodiments, the amplified products are then sequenced.

Exemplary Nucleic Acid Studies

The multiplex PCR methods of the invention can be used to increase the number of target loci that can be evaluated to measure the amount of one or more specific nucleic acid molecules of interest or of one or more types of nucleic acids. In some embodiments, there is a change in the total amount or concentration of one or more types of DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA). In some embodiments, there is a change in the amount or concentration of one or more specific DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA) molecules. In some embodiments, one allele is expressed more than another allele of a locus of interest. Exemplary miRNAs are short 20-22 nucleotide RNA molecules that regulate the expression of a gene. In some embodiments, there is a change in the transcriptome, such as a change in the identity or amount of one or more RNA molecules.

In some embodiments, an increase in the total amount or concentration of cfDNA or cfRNA is associated with a disease such as cancer, or an increased risk for a disease such as cancer. In some embodiments, the total concentration of a type of DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA) increases by at least 2, 3, 4, 5, 6, 7, 8, 9, 10-fold, or more compared to the total concentration of that type of DNA or RNA in healthy (such as non-cancerous) subjects. In some embodiments, a total concentration of cfDNA between 75 to 100 ng/mL, 100 to 150 ng/mL, 150 to 200 ng/mL, 200 to 300 ng/mL, 300 to 400 ng/mgL, 400 to 600 ng/mL, 600 to 800 ng/mL, 800 to 1,000 ng/mL, inclusive, or a total concentration of cfDNA of more than 100 ng, mL, such as more than 200, 300, 400, 500, 600, 700, 800, 900, or 1,000 ng/mL is indicative of cancer, an increased risk for cancer, an increased risk of a tumor being malignant rather than benign, a decreased probably of the cancer going into remission, or a worse prognosis for the cancer. In some embodiments, the amount of a type of DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA) having one or more polymorphisms/mutations (such as deletions or duplications) associated with a disease such as cancer or an increased risk for a disease such as cancer is at least 2, 3, 4, 5, 6, 7, 8, 9, 10, 11, 12, 14, 16, 18, 20, or 25% of the total amount of that type of DNA or RNA. In some embodiments, at least 2, 3, 4, 5, 6, 7, 8, 9, 10, 11, 12, 14, 16, 18, 20, or 25% of the total amount of a type of DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA) has a particular polymorphism or mutation (such as a deletion or duplication) associated with a disease such as cancer or an increased risk for a disease such as cancer.

Exemplary RNA Expression Studies

The multiplex PCR methods of the invention can be used to increase the number of target loci that can be evaluated during gene expression profiling experiments. For example, the expression levels of thousands of genes can be simultaneously monitored to determine whether a person has a sequence (such as a polymorphism or other mutation) associated with a disease (such as cancer) or an increased risk of a disease. These methods can be used to identify sequences (such as polymorphisms or other mutations) associated with an increased or decreased risk for a disease such as cancer by comparing gene expression (such as the expression of particular mRNA alleles) in samples from patients with and without the disease. Additionally, the effect of particular treatments, diseases, or developmental stages on gene expression can be determined. Similarly, these methods can be used to identify genes whose expression is changed in response to pathogens or other organisms by comparing gene expression in infected and uninfected cells or tissues. In these methods the number of sequencing reads can be adjusted based on the frequency of the polymorphisms that are being analyzed such that sufficient reads are performed for the polymorphisms to be detected if they are present. In some embodiments, the polymorphisms or mutation is present at a higher frequency in subjects with a disease or disorder (such as cancer) than subjects without the disease or disorder (such as cancer). In some embodiments, the polymorphisms or mutation is indicative of cancer, such as a causative mutation.

In some embodiments, a sample containing RNA (such as mRNA) is amplified using a reverse transcriptase (RT) and the resulting DNA (such as cDNA) is then amplified using a DNA polymerase (PCR). The RT and PCR steps may be carried out sequentially in the same reaction volume or separately. Any of the primer libraries of the invention can be used in this reverse transcription polymerase chain reaction (RT-PCR) method. In various embodiments, the reverse transcription is performed using oligo-dT, random primers, a mixture of oligo-dT and random primers, or primers specific to the target loci. To avoid amplification of contaminating genomic DNA, primers for RT-PCR can be designed so that part of one primer hybridizes to the 3' end of one exon and the other part of the primer hybridizes to the 5' end of the adjacent exon. Such primers anneal to cDNA synthesized from spliced mRNAs, but not to genomic DNA. To detect amplification of contaminating DNA, RT-PCR primer pairs may be designed to flank a region that contains at least one intron. Products amplified from cDNA (no introns) are smaller than those amplified from genomic DNA (containing introns). Size difference in products is used to detect the presence of contaminating DNA. In some embodiments when only the mRNA sequence is known, primer annealing sites are chosen that are at least 300-400 base pairs apart since it is likely that fragments of this size from eukaryotic DNA contain splice junctions. Alternatively, the sample can be treated with DNase to degrade contaminating DNA.

Exemplary Methods for Paternity Testing

The multiplex PCR methods of the invention can be used to improve the accuracy of paternity testing since so many target loci can be analyzed at once (see, e.g, U.S. Publication No. 2012/0122701, filed Dec. 22, 2011, is which is hereby incorporated by reference in its entirety). For example, the multiplex PCR method can allow thousands of polymorphic loci (such as SNPs) to be analyzed for use in the PARENTAL SUPPORT algorithm described herein to determine whether an alleged father in is the biological father of a fetus. In some embodiments the method involves (i) simultaneously amplifying a plurality of polymorphic loci that includes at least 25; 50; 75; 100; 300; 500; 750; 1,000;

2,000; 5,000; 7,500; 10,000; 15,000; 19,000; 20,000; 25,000; 27,000; 28,000; 30,000; 40,000; 50,000; 75,000; or 100,000 different polymorphic loci on genetic material from the alleged father to produce a first set of amplified products; (ii) simultaneously amplifying the corresponding plurality of polymorphic loci on a mixed sample of DNA originating from a blood sample from the pregnant mother to produce a second set of amplified products; wherein the mixed sample of DNA comprises fetal DNA and maternal DNA; (iii) determining on a computer the probability that the alleged father is the biological father of the fetus using genotypic measurements based on the first and second sets of amplified products; and (iv) establishing whether the alleged father is the biological father of the fetus using the determined probability that the alleged father is the biological father of the fetus. In various embodiments, the method further includes simultaneously amplifying the corresponding plurality of polymorphic loci on genetic material from the mother to produce a third set of amplified products; wherein the probability that the alleged father is the biological father of the fetus is determined using genotypic measurements based on the first, second, and third sets of amplified products.

Exemplary Methods for Embryo Characterization and Selection

The multiplex PCR methods of the invention can be used to improve the selection of embryos for in vitro fertilization by allowing thousands of target loci to be analyzed at once (see, e.g, U.S. Pub. No. 2011/0092763, filed May 27, 2008, filed Dec. 22, 2011, is which is hereby incorporated by reference in its entirety). For example, the multiplex PCR method can allow thousands of polymorphic loci (such as SNPs) to be analyzed for use in the PARENTAL SUPPORT algorithm described herein to select an embryo out of a set of embryos for in vitro fertilization In some embodiments, the invention provides methods of estimating relative likelihoods that each embryo from a set of embryos will develop as desired. In some embodiments, the method involves contacting a sample from each embryo with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture for each embryo, wherein the samples are each derived from one or more cells from an embryo. In some embodiments, each reaction mixture is subjected to primer extension reaction conditions to produce amplified products. In some embodiments, the method includes determining on a computer one or more characteristics of at least one cell from each embryo based on the amplified products; and estimating on a computer the relative likelihoods that each embryo will develop as desired, based on the one or more characteristics of the at least one cell for each embryo. In some embodiments, the method includes using an informatics based method to determine the at least one characteristic, such as the PARENTAL SUPPORT algorithm described herein. In some embodiments, the characteristic includes a ploidy state. In some embodiments, the characteristic is selected from the group consisting of aneuploid, euploid, mosaic, nullsomy, monosomy, uniparental disomy, trisomy, tetrasomy, a type of aneuploidy, unmatched copy error trisomy, matched copy error trisomy, maternal origin of aneuploidy, paternal origin of aneuploidy, a presence or absence of a disease-linked gene, a chromosomal identity of any aneuploid chromosome, an abnormal genetic condition, a deletion or duplication, a likelihood of a characteristic, and combinations thereof. The characteristic may be associated with a chromosome taken from the group consisting of chromosome one, chromosome two, chromosome three, chromosome four, chromosome five, chromosome six, chromosome seven, chromosome eight, chromosome nine, chromosome ten, chromosome eleven, chromosome twelve, chromosome thirteen, chromosome fourteen, chromosome fifteen, chromosome sixteen, chromosome seventeen, chromosome eighteen, chromosome nineteen, chromosome twenty, chromosome twenty-one, chromosome twenty-two, X chromosome or Y chromosome, and combinations thereof.

Exemplary Prenatal Diagnostic Methods

The multiplex PCR methods of the present invention can be used to improve prenatal diagnostic methods, such as the determination of the ploidy status of fetal chromosomes. Given that the large number of target loci that can be simultaneously amplified, more accurate determinations can be made.

In an embodiment, the present disclosure provides ex vivo methods for determining the ploidy status of a chromosome in a gestating fetus from genotypic data measured from a mixed sample of DNA (i.e., DNA from the mother of the fetus, and DNA from the fetus) and optionally from genotypic data measured from a sample of genetic material from the mother and possibly also from the father, wherein the determining is done by using a joint distribution model to create a set of expected allele distributions for different possible fetal ploidy states given the parental genotypic data, and comparing the expected allelic distributions to the actual allelic distributions measured in the mixed sample, and choosing the ploidy state whose expected allelic distribution pattern most closely matches the observed allelic distribution pattern. In an embodiment, the mixed sample is derived from maternal blood, or maternal serum or plasma. In an embodiment, the mixed sample of DNA may be preferentially enriched at a target loci (e.g., plurality of polymorphic loci). In an embodiment, the preferential enrichment is done in a way that minimizes the allelic bias. In an embodiment, the present disclosure relates to a composition of DNA that has been preferentially enriched at a plurality of loci such that the allelic bias is low. In an embodiment, the allelic distribution(s) are measured by sequencing the DNA from the mixed sample. In an embodiment, the joint distribution model assumes that the alleles will be distributed in a binomial fashion. In an embodiment, the set of expected joint allele distributions are created for genetically linked loci while considering the extant recombination frequencies from various sources, for example, using data from the International HapMap Consortium.

In an embodiment, the present disclosure provides methods for non-invasive prenatal diagnosis (NPD), specifically, determining the aneuploidy status of a fetus by observing allele measurements at a plurality of polymorphic loci in genotypic data measured on DNA mixtures, where certain allele measurements are indicative of an aneuploid fetus, while other allele measurements are indicative of a euploid fetus. In an embodiment, the genotypic data is measured by sequencing DNA mixtures that were derived from maternal plasma. In an embodiment, the DNA sample may be preferentially enriched in molecules of DNA that correspond to the plurality of loci whose allele distributions are being calculated. In an embodiment a sample of DNA comprising only or almost only genetic material from the mother and possibly also a sample of DNA comprising only or almost only genetic material from the father are measured. In an embodiment, the genetic measurements of one or both parents along with the estimated fetal fraction are used to create a plurality of expected allele distributions corresponding to different possible underlying genetic states of the fetus; the expected allele distributions may be termed hypotheses. In an embodiment, the maternal genetic data is not determined by measuring genetic material that is exclusively or almost exclusively maternal in nature, rather, it is estimated from the genetic measurements made on maternal plasma that comprises a mixture of maternal and fetal DNA. In some embodiments the hypotheses may comprise the ploidy of the fetus at one or more chromosomes, which segments of which chromosomes in the fetus were inherited from which parents, and combinations thereof. In some embodiments, the ploidy state of the fetus is determined by comparing the observed allele measurements to the different hypotheses where at least some of the hypotheses correspond to different ploidy states, and selecting the ploidy state that corresponds to the hypothesis that is most likely to be true given the observed allele measurements. In an embodiment, this method involves using allele measurement data from some or all measured SNPs, regardless of whether the loci are homozygous or heterozygous, and therefore does not involve using alleles at loci that are only heterozygous. This method may not be appropriate for situations where the genetic data pertains to only one polymorphic locus. This method is particularly advantageous when the genetic data comprises data for more than ten polymorphic loci for a target chromosome or more than twenty polymorphic loci. This method is especially advantageous when the genetic data comprises data for more than 50 polymorphic loci for a target chromosome, more than 100 polymorphic loci or more than 200 polymorphic loci for a target chromosome. In some embodiments, the genetic data may comprise data for more than 500 polymorphic loci for a target chromosome, more than 1,000 polymorphic loci, more than 2,000 polymorphic loci, or more than 5,000 polymorphic loci for a target chromosome.

In an embodiment, a method disclosed herein yields a quantitative measure of the number of independent observations of each allele at a polymorphic locus. This is unlike most methods such as microarrays or qualitative PCR which provide information about the ratio of two alleles but do not quantify the number of independent observations of either allele. With methods that provide quantitative information regarding the number of independent observations, only the ratio is utilized in ploidy calculations, while the quantitative information by itself is not useful. To illustrate the importance of retaining information about the number of independent observations consider the sample locus with two alleles, A and B. In a first experiment twenty A alleles and twenty B alleles are observed, in a second experiment 200 A alleles and 200 B alleles are observed. In both experiments the ratio (A/(A+B)) is equal to 0.5, however the second experiment conveys more information than the first about the certainty of the frequency of the A or B allele. Some methods by others involve averaging or summing allele ratios (channel ratios) (i.e. $x_i/y_i$) from individual allele and analyzes this ratio, either comparing it to a reference chromosome or using a rule pertaining to how this ratio is expected to behave in particular situations. No allele weighting is implied in such methods, where it is assumed that one can ensure about the same amount of PCR product for each allele and that all the alleles should behave the same way. Such a method has a number of disadvantages, and more importantly, precludes the use of a number of improvements that are described elsewhere in this disclosure.

In an embodiment, a method disclosed herein explicitly models the allele frequency distributions expected in disomy as well as a plurality of allele frequency distributions that may be expected in cases of trisomy resulting from nondisjunction during meiosis I, nondisjunction during meiosis II, and/or nondisjunction during mitosis early in fetal development. To illustrate why this is important, imagine a case where there were no crossovers: nondisjunction during meiosis I would result a trisomy in which two different homologs were inherited from one parent; in contrast, nondisjunction during meiosis II or during mitosis early in fetal development would result in two copies of the same homolog from one parent. Each scenario would result in different expected allele frequencies at each polymorphic locus and also at all loci considered jointly, due to genetic linkage. Crossovers, which result in the exchange of genetic material between homologs, make the inheritance pattern more complex; in an embodiment, the instant method accommodates for this by using recombination rate information in addition to the physical distance between loci. In an embodiment, to enable improved distinction between meiosis I nondisjunction and meiosis II or mitotic nondisjunction the instant method incorporate into the model an increasing probability of crossover as the distance from the centromere increases. Meiosis II and mitotic nondisjunction can distinguished by the fact that mitotic nondisjunction typically results in identical or nearly identical copies of one homolog while the two homologs present following a meiosis II nondisjunction event often differ due to one or more crossovers during gametogenesis.

In some embodiments, a method disclosed herein involves comparing the observed allele measurements to theoretical hypotheses corresponding to possible fetal genetic aneuploidy, and does not involve a step of quantitating a ratio of alleles at a heterozygous locus. Where the number of loci is lower than about 20, the ploidy determination made using a method comprising quantitating a ratio of alleles at a heterozygous locus and a ploidy determination made using a method comprising comparing the observed allele measurements to theoretical allele distribution hypotheses corresponding to possible fetal genetic states may give a similar result. However, where the number of loci is above 50 these two methods is likely to give significantly different results; where the number of loci is above 400, above, 1,000 or above 2,000 these two methods are very likely to give results that are increasingly significantly different. These differences are due to the fact that a method that comprises quantitating a ratio of alleles at a heterozygous locus without measuring the magnitude of each allele independently and aggregating or averaging the ratios precludes the use of techniques including using a joint distribution model, performing a linkage analysis, using a binomial distribution model, and/or other advanced statistical techniques, whereas using a method comprising comparing the observed allele measurements to theoretical allele distribution hypotheses corresponding to possible fetal genetic states may use these techniques which can substantially increase the accuracy of the determination.

In an embodiment, a method disclosed herein involves determining whether the distribution of observed allele measurements is indicative of a euploid or an aneuploid fetus using a joint distribution model. The use of a joint distribution model is a different from and a significant improvement over methods that determine heterozygosity rates by treating polymorphic loci independently in that the resultant determinations are of significantly higher accuracy. Without being bound by any particular theory, it is believed that one reason they are of higher accuracy is that the joint distribution model takes into account the linkage between SNPs, and likelihood of crossovers having occurred during the meiosis that gave rise to the gametes that formed the embryo that grew into the fetus. The purpose of using the concept of linkage when creating the expected distribution of allele measurements for one or more hypotheses is that it allows the creation of expected allele measurements distributions that correspond to reality considerably better than when linkage is not used. For example, imagine that there are two SNPs, 1 and 2 located nearby one another, and the mother is A at SNP 1 and A at SNP 2 on one homolog, and B at SNP 1 and B at SNP 2 on homolog two. If the father is A for both SNPs on both homologs, and a B is measured for the fetus SNP 1, this indicates that homolog two has been inherited by the fetus, and therefore that there is a much higher likelihood of a B being present on the fetus at SNP 2. A model that takes into account linkage would predict this, while a model that does not take linkage into account would not. Alternately, if a mother was AB at SNP 1 and AB at nearby SNP 2, then two hypotheses corresponding to maternal trisomy at that location could be used—one involving a matching copy error (nondisjunction in meiosis II or mitosis in early fetal development), and one involving an unmatching copy error (nondisjunction in meiosis I). In the case of a matching copy error trisomy, if the fetus inherited an AA from the mother at SNP 1, then the fetus is much more likely to inherit either an AA or BB from the mother at SNP 2, but not AB. In the case of an unmatching copy error, the fetus would inherit an AB from the mother at both SNPs. The allele distribution hypotheses made by a ploidy calling method that takes into account linkage would make these predictions, and therefore correspond to the actual allele measurements to a considerably greater extent than a ploidy calling method that did not take into account linkage. Note that a linkage approach is not possible when using a method that relies on calculating allele ratios and aggregating those allele ratios.

One reason that it is believed that ploidy determinations that use a method that comprises comparing the observed allele measurements to theoretical hypotheses corresponding to possible fetal genetic states are of higher accuracy is that when sequencing is used to measure the alleles, this method can glean more information from data from alleles where the total number of reads is low than other methods; for example, a method that relies on calculating and aggregating allele ratios would produce disproportionately weighted stochastic noise. For example, imagine a case that involved measuring the alleles using sequencing, and where there was a set of loci where only five sequence reads were detected for each locus. In an embodiment, for each of the alleles, the data may be compared to the hypothesized allele distribution, and weighted according to the number of sequence reads; therefore the data from these measurements would be appropriately weighted and incorporated into the overall determination. This is in contrast to a method that involved quantitating a ratio of alleles at a heterozygous locus, as this method could only calculate ratios of 0%, 20%, 40%, 60%, 80% or 100% as the possible allele ratios; none of these may be close to expected allele ratios. In this latter case, the calculated allele rations would either have to be discarded due to insufficient reads or else would have disproportionate weighting and introduce stochastic noise into the determination, thereby decreasing the accuracy of the determination. In an embodiment, the individual allele measurements may be treated as independent measurements, where the relationship between measurements made on alleles at the same locus is no different from the relationship between measurements made on alleles at different loci.

In an embodiment, a method disclosed herein involves determining whether the distribution of observed allele measurements is indicative of a euploid or an aneuploid fetus without comparing any metrics to observed allele measurements on a reference chromosome that is expected to be disomic (termed the RC method). This is a significant improvement over methods, such as methods using shotgun sequencing which detect aneuploidy by evaluating the proportion of randomly sequenced fragments from a suspect chromosomes relative to one or more presumed disomic reference chromosome. This RC method yields incorrect results if the presumed disomic reference chromosome is not actually disomic. This can occur in cases where aneuploidy is more substantial than trisomy of a single chromosome or where the fetus is triploid and all autosomes are trisomic. In the case of a female triploid (69, XXX) fetus there are in fact no disomic chromosomes at all. The method described herein does not require a reference chromosome and would be able to correctly identify trisomic chromosomes in a female triploid fetus. For each chromosome, hypothesis, child fraction and noise level, a joint distribution model may be fit, without any of: reference chromosome data, an overall child fraction estimate, or a fixed reference hypothesis.

In an embodiment, a method disclosed herein demonstrates how observing allele distributions at polymorphic loci can be used to determine the ploidy state of a fetus with greater accuracy than methods in the prior art. In an embodiment, the method uses the targeted sequencing to obtain mixed maternal-fetal genotypes and optionally mother and/or father genotypes at a plurality of SNPs to first establish the various expected allele frequency distributions under the different hypotheses, and then observing the quantitative allele information obtained on the maternal-fetal mixture and evaluating which hypothesis fits the data best, where the genetic state corresponding to the hypothesis with the best fit to the data is called as the correct genetic state. In an embodiment, a method disclosed herein also uses the degree of fit to generate a confidence that the called genetic state is the correct genetic state. In an embodiment, a method disclosed herein involves using algorithms that analyze the distribution of alleles found for loci that have different parental contexts, and comparing the observed allele distributions to the expected allele distributions for different ploidy states for the different parental contexts (different parental genotypic patterns). This is different from and an improvement over methods that do not use methods that enable the estimation of the number of independent instances of each allele at each locus in a mixed maternal-fetal sample. In an embodiment, a method disclosed herein involves determining whether the distribution of observed allele measurements is indicative of a euploid or an aneuploid fetus using observed allelic distributions measured at loci where the mother is heterozygous. This is different from and an improvement over methods that do not use observed allelic distributions at loci where the mother is heterozygous because, in cases where the DNA is not preferentially enriched or is preferentially enriched for loci that are not known to be highly informative for that particular target individual, it allows the use of about twice as much genetic measurement data from a set of sequence data in the ploidy determination, resulting in a more accurate determination.

In an embodiment, a method disclosed herein uses a joint distribution model that assumes that the allele frequencies at each locus are multinomial (and thus binomial when SNPs are biallelic) in nature. In some embodiments the joint distribution model uses beta-binomial distributions. When using a measuring technique, such as sequencing, provides a quantitative measure for each allele present at each locus, binomial model can be applied to each locus and the degree underlying allele frequencies and the confidence in that frequency can be ascertained. With methods known in the art that generate ploidy calls from allele ratios, or methods in which quantitative allele information is discarded, the certainty in the observed ratio cannot be ascertained. The instant method is different from and an improvement over methods that calculate allele ratios and aggregate those ratios to make a ploidy call, since any method that involves calculating an allele ratio at a particular locus, and then aggregating those ratios, necessarily assumes that the measured intensities or counts that are indicative of the amount of DNA from any given allele or locus will be distributed in a Gaussian fashion. The method disclosed herein does not involve calculating allele ratios. In some embodiments, a method disclosed herein may involve incorporating the number of observations of each allele at a plurality of loci into a model. In some embodiments, a method disclosed herein may involve calculating the expected distributions themselves, allowing the use of a joint binomial distribution model which may be more accurate than any model that assumes a Gaussian distribution of allele measurements. The likelihood that the binomial distribution model is significantly more accurate than the Gaussian distribution increases as the number of loci increases. For example, when fewer than 20 loci are interrogated, the likelihood that the binomial distribution model is significantly better is low. However, when more than 100, or especially more than 400, or especially more than 1,000, or especially more than 2,000 loci are used, the binomial distribution model will have a very high likelihood of being significantly more accurate than the Gaussian distribution model, thereby resulting in a more accurate ploidy determination. The likelihood that the binomial distribution model is significantly more accurate than the Gaussian distribution also increases as the number of observations at each locus increases. For example, when fewer than 10 distinct sequences are observed at each locus are observed, the likelihood that the binomial distribution model is significantly better is low. However, when more than 50 sequence reads, or especially more than 100 sequence reads, or especially more than 200 sequence reads, or especially more than 300 sequence reads are used for each locus, the binomial distribution model will have a very high likelihood of being significantly more accurate than the Gaussian distribution model, thereby resulting in a more accurate ploidy determination.

In an embodiment, a method disclosed herein uses sequencing to measure the number of instances of each allele at each locus in a DNA sample. Each sequencing read may be mapped to a specific locus and treated as a binary sequence read; alternately, the probability of the identity of the read and/or the mapping may be incorporated as part of the sequence read, resulting in a probabilistic sequence read, that is, the probable whole or fractional number of sequence reads that map to a given loci. Using the binary counts or probability of counts it is possible to use a binomial distribution for each set of measurements, allowing a confidence interval to be calculated around the number of counts. This ability to use the binomial distribution allows for more accurate ploidy estimations and more precise confidence intervals to be calculated. This is different from and an improvement over methods that use intensities to measure the amount of an allele present, for example methods that use microarrays, or methods that make measurements using fluorescence readers to measure the intensity of fluorescently tagged DNA in electrophoretic bands.

In an embodiment, a method disclosed herein uses aspects of the present set of data to determine parameters for the estimated allele frequency distribution for that set of data. This is an improvement over methods that utilize training set of data or prior sets of data to set parameters for the present expected allele frequency distributions, or possibly expected allele ratios. This is because there are different sets of conditions involved in the collection and measurement of every genetic sample, and thus a method that uses data from the instant set of data to determine the parameters for the joint distribution model that is to be used in the ploidy determination for that sample will tend to be more accurate.

In an embodiment, a method disclosed herein involves determining whether the distribution of observed allele measurements is indicative of a euploid or an aneuploid fetus using a maximum likelihood technique. The use of a maximum likelihood technique is different from and a significant improvement over methods that use single hypothesis rejection technique in that the resultant determinations will be made with significantly higher accuracy. One reason is that single hypothesis rejection techniques set cut off thresholds based on only one measurement distribution rather than two, meaning that the thresholds are usually not optimal. Another reason is that the maximum likelihood technique allows the optimization of the cut off threshold for each individual sample instead of determining a cut off threshold to be used for all samples regardless of the particular characteristics of each individual sample. Another reason is that the use of a maximum likelihood technique allows the calculation of a confidence for each ploidy call. The ability to make a confidence calculation for each call allows a practitioner to know which calls are accurate, and which are more likely to be wrong. In some embodiments, a wide variety of methods may be combined with a maximum likelihood estimation technique to enhance the accuracy of the ploidy calls. In an embodiment, the maximum likelihood technique may be used in combination with the method described in U.S. Pat. No. 7,888,017. In an embodiment, the maximum likelihood technique may be used in combination with the method of using targeted PCR amplification to amplify the DNA in the mixed sample followed by sequencing and analysis using a read counting method such as used by TANDEM DIAGNOSTICS, as presented at the International Congress of Human Genetics 2011, in Montreal in October 2011. In an embodiment, a method disclosed herein involves estimating the fetal fraction of DNA in the mixed sample and using that estimation to calculate both the ploidy call and the confidence of the ploidy call. Note that this is both different and distinct from methods that use estimated fetal fraction as a screen for sufficient fetal fraction, followed by a ploidy call made using a single hypothesis rejection technique that does not take into account the fetal fraction nor does it produce a confidence calculation for the call.

In an embodiment, a method disclosed herein takes into account the tendency for the data to be noisy and contain errors by attaching a probability to each measurement. The use of maximum likelihood techniques to choose the correct hypothesis from the set of hypotheses that were made using the measurement data with attached probabilistic estimates makes it more likely that the incorrect measurements will be discounted, and the correct measurements will be used in the calculations that lead to the ploidy call. To be more precise, this method systematically reduces the influence of data that is incorrectly measured on the ploidy determination. This is an improvement over methods where all data is assumed to be equally correct or methods where outlying data is arbitrarily excluded from calculations leading to a ploidy call. Existing methods using channel ratio measurements claim to extend the method to multiple SNPs by averaging individual SNP channel ratios. Not weighting individual SNPs by expected measurement variance based on the SNP quality and observed depth of read reduces the accuracy of the resulting statistic, resulting in a reduction of the accuracy of the ploidy call significantly, especially in borderline cases.

In an embodiment, a method disclosed herein does not presuppose the knowledge of which SNPs or other polymorphic loci are heterozygous on the fetus. This method allows a ploidy call to be made in cases where paternal genotypic information is not available. This is an improvement over methods where the knowledge of which SNPs are heterozygous must be known ahead of time in order to appropriately select loci to target, or to interpret the genetic measurements made on the mixed fetal/maternal DNA sample.

The methods described herein are particularly advantageous when used on samples where a small amount of DNA is available, or where the percent of fetal DNA is low. This is due to the correspondingly higher allele dropout rate that occurs when only a small amount of DNA is available and/or the correspondingly higher fetal allele dropout rate when the percent of fetal DNA is low in a mixed sample of fetal and maternal DNA. A high allele dropout rate, meaning that a large percentage of the alleles were not measured for the target individual, results in poorly accurate fetal fractions calculations, and poorly accurate ploidy determinations. Since methods disclosed herein may use a joint distribution model that takes into account the linkage in inheritance patterns between SNPs, significantly more accurate ploidy determinations may be made. The methods described herein allow for an accurate ploidy determination to be made when the percent of molecules of DNA that are fetal in the mixture is less than 40%, less than 30%, less than 20%, less than 10%, less than 8%, and even less than 6%.

In an embodiment, it is possible to determine the ploidy state of an individual based on measurements when that individual's DNA is mixed with DNA of a related individual. In an embodiment, the mixture of DNA is the free floating DNA found in maternal plasma, which may include DNA from the mother, with known karyotype and known genotype, and which may be mixed with DNA of the fetus, with unknown karyotype and unknown genotype. It is possible to use the known genotypic information from one or both parents to predict a plurality of potential genetic states of the DNA in the mixed sample for different ploidy states, different chromosome contributions from each parent to the fetus, and optionally, different fetal DNA fractions in the mixture. Each potential composition may be referred to as a hypothesis. The ploidy state of the fetus can then be determined by looking at the actual measurements, and determining which potential compositions are most likely given the observed data.

Further discussion of the points above may be found elsewhere in this document.

Non-Invasive Prenatal Diagnosis (NPD)

The process of non-invasive prenatal diagnosis involves a number of steps. Some of the steps may include: (1) obtaining the genetic material from the fetus; (2) enriching the genetic material of the fetus that may be in a mixed sample, ex vivo; (3) amplifying the genetic material, ex vivo; (4) preferentially enriching specific loci in the genetic material, ex vivo; (5) measuring the genetic material, ex vivo; and (6) analyzing the genotypic data, on a computer, and ex vivo. Methods to reduce to practice these six and other relevant steps are described herein. At least some of the method steps are not directly applied on the body. In an embodiment, the present disclosure relates to methods of treatment and diagnosis applied to tissue and other biological materials isolated and separated from the body. At least some of the method steps are executed on a computer.

Some embodiments of the present disclosure allow a clinician to determine the genetic state of a fetus that is gestating in a mother in a non-invasive manner such that the health of the baby is not put at risk by the collection of the genetic material of the fetus, and that the mother is not required to undergo an invasive procedure. Moreover, in certain aspects, the present disclosure allows the fetal genetic state to be determined with high accuracy, significantly greater accuracy than, for example, the non-invasive maternal serum analyte based screens, such as the triple test, that are in wide use in prenatal care.

The high accuracy of the methods disclosed herein is a result of an informatics approach to analysis of the genotype data, as described herein. Modern technological advances have resulted in the ability to measure large amounts of genetic information from a genetic sample using such methods as high throughput sequencing and genotyping arrays. The methods disclosed herein allow a clinician to take greater advantage of the large amounts of data available, and make a more accurate diagnosis of the fetal genetic state. The details of a number of embodiments are given below. Different embodiments may involve different combinations of the aforementioned steps. Various combinations of the different embodiments of the different steps may be used interchangeably.

In an embodiment, a blood sample is taken from a pregnant mother, and the free floating DNA in the plasma of the mother's blood, which contains a mixture of both DNA of maternal origin, and DNA of fetal origin, is isolated and used to determine the ploidy status of the fetus. In an embodiment, a method disclosed herein involves preferential enrichment of those DNA sequences in a mixture of DNA that correspond to polymorphic alleles in a way that the allele ratios and/or allele distributions remain mostly consistent upon enrichment. In an embodiment, a method disclosed herein involves the highly efficient targeted PCR based amplification such that a very high percentage of the resulting molecules correspond to targeted loci. In an embodiment, a method disclosed herein involves sequencing a mixture of DNA that contains both DNA of maternal origin, and DNA of fetal origin. In an embodiment, a method disclosed herein involves using measured allele distributions to determine the ploidy state of a fetus that is gestating in a mother. In an embodiment, a method disclosed herein involves reporting the determined ploidy state to a clinician. In an embodiment, a method disclosed herein involves taking a clinical action, for example, performing follow up invasive testing such as chorionic villus sampling or amniocentesis, preparing for the birth of a trisomic individual or an elective termination of a trisomic fetus.

This application makes reference to U.S. Utility application Ser. No. 11/603,406, filed Nov. 28, 2006 (US Publication No.: 20070184467); U.S. Utility application Ser. No. 12/076,348, filed Mar. 17, 2008 (US Publication No.: 20080243398); PCT Application Serial No. PCT/US09/52730, filed Aug. 4, 2009 (PCT Publication No.: WO/2010/017214); PCT Application Serial No. PCT/US10/050824, filed Sep. 30, 2010 (PCT Publication No.: WO/2011/041485), U.S. Utility application Ser. No. 13/110,685, filed May 18, 2011, and PCT Application Serial No. PCT/12/58578, filed Oct. 3, 2012, which are each herein incorporated by reference in its entirety. Some of the vocabulary used in this filing may have its antecedents in these references. Some of the concepts described herein may be better understood in light of the concepts found in these references.

Screening Maternal Blood Comprising Free Floating Fetal DNA

The methods described herein may be used to help determine the genotype of a child, fetus, or other target individual where the genetic material of the target is found in the presence of a quantity of other genetic material. In some embodiments the genotype may refer to the ploidy state of one or a plurality of chromosomes, it may refer to one or a plurality of disease linked alleles, or some combination thereof. In this disclosure, the discussion focuses on determining the genetic state of a fetus where the fetal DNA is found in maternal blood, but this example is not meant to limit to possible contexts that this method may be applied to. In addition, the method may be applicable in cases where the amount of target DNA is in any proportion with the non-target DNA; for example, the target DNA could make up anywhere between 0.000001 and 99.999999% of the DNA present. In addition, the non-target DNA does not necessarily need to be from one individual, or even from a related individual, as long as genetic data from some or all of the relevant non-target individual(s) is known. In an embodiment, a method disclosed herein can be used to determine genotypic data of a fetus from maternal blood that contains fetal DNA. It may also be used in a case where there are multiple fetuses in the uterus of a pregnant woman, or where other contaminating DNA may be present in the sample, for example from other already born siblings.

This technique may make use of the phenomenon of fetal blood cells gaining access to maternal circulation through the placental villi. Ordinarily, only a very small number of fetal cells enter the maternal circulation in this fashion (not enough to produce a positive Kleihauer-Betke test for fetal-maternal hemorrhage). The fetal cells can be sorted out and analyzed by a variety of techniques to look for particular DNA sequences, but without the risks that invasive procedures inherently have. This technique may also make use of the phenomenon of free floating fetal DNA gaining access to maternal circulation by DNA release following apoptosis of placental tissue where the placental tissue in question contains DNA of the same genotype as the fetus. The free floating DNA found in maternal plasma has been shown to contain fetal DNA in proportions as high as 30-40% fetal DNA.

In an embodiment, blood may be drawn from a pregnant woman. Research has shown that maternal blood may contain a small amount of free floating DNA from the fetus, in addition to free floating DNA of maternal origin. In addition, there also may be enucleated fetal blood cells comprising DNA of fetal origin, in addition to many blood cells of maternal origin, which typically do not contain nuclear DNA. There are many methods know in the art to isolate fetal DNA, or create fractions enriched in fetal DNA. For example, chromatography has been show to create certain fractions that are enriched in fetal DNA.

Once the sample of maternal blood, plasma, or other fluid, drawn in a relatively non-invasive manner, and that contains an amount of fetal DNA, either cellular or free floating, either enriched in its proportion to the maternal DNA, or in its original ratio, is in hand, one may genotype the DNA found in said sample. In some embodiments, the blood may be drawn using a needle to withdraw blood from a vein, for example, the basilica vein. The method described herein can be used to determine genotypic data of the fetus. For example, it can be used to determine the ploidy state at one or more chromosomes, it can be used to determine the identity of one or a set of SNPs, including insertions, deletions, and translocations. It can be used to determine one or more haplotypes, including the parent of origin of one or more genotypic features.

Note that this method will work with any nucleic acids that can be used for any genotyping and/or sequencing methods, such as the ILLUMINA INFINIUM ARRAY platform, AFFYMETRIX GENECHIP, ILLUMINA GENOME ANALYZER, or LIFE TECHNOLGIES' SOLID SYSTEM. This includes extracted free-floating DNA from plasma or amplifications (e.g. whole genome amplification, PCR) of the same; genomic DNA from other cell types (e.g. human lymphocytes from whole blood) or amplifications of the same. For preparation of the DNA, any extraction or purification method that generates genomic DNA suitable for the one of these platforms will work as well. This method could work equally well with samples of RNA. In an embodiment, storage of the samples may be done in a way that will minimize degradation (e.g. below freezing, at about −20 C, or at a lower temperature).

Parental Support

Some embodiments may be used in combination with the PARENTAL SUPPORT™ (PS) method, embodiments of which are described in U.S. application Ser. No. 11/603,406 (US Publication No.: 20070184467), U.S. application Ser. No. 12/076,348 (US Publication No.: 20080243398), U.S. application Ser. No. 13/110,685, PCT Application PCT/US09/52730 (PCT Publication No.: WO/2010/017214), and PCT Application No. PCT/US10/050824 (PCT Publication No.: WO/2011/041485) which are incorporated herein by reference in their entirety. PARENTAL SUPPORT™ is an informatics based approach that can be used to analyze genetic data. In some embodiments, the methods disclosed herein may be considered as part of the PARENTAL SUPPORT™ method. In some embodiments, The PARENTAL SUPPORT™ method is a collection of methods that may be used to determine the genetic data of a target individual, with high accuracy, of one or a small number of cells from that individual, or of a mixture of DNA consisting of DNA from the target individual and DNA from one or a plurality of other individuals, specifically to determine disease-related alleles, other alleles of interest, and/or the ploidy state of one or a plurality of chromosomes in the target individual. PARENTAL SUPPORT™ may refer to any of these methods. PARENTAL SUPPORT™ is an example of an informatics based method. Exemplary embodiments of the PARENTAL SUPPORT™ method are illustrated in FIGS. 29-31G and described in Example 19.

The PARENTAL SUPPORT™ method makes use of known parental genetic data, i.e. haplotypic and/or diploid genetic data of the mother and/or the father, together with the knowledge of the mechanism of meiosis and the imperfect measurement of the target DNA, and possibly of one or more related individuals, along with population based crossover frequencies, in order to reconstruct, in silico, the genotype at a plurality of alleles, and/or the ploidy state of an embryo or of any target cell(s), and the target DNA at the location of key loci with a high degree of confidence. The PARENTAL SUPPORT™ method can reconstruct not only single nucleotide polymorphisms (SNPs) that were measured poorly, but also insertions and deletions, and SNPs or whole regions of DNA that were not measured at all. Furthermore, the PARENTAL SUPPORT™ method can both measure multiple disease-linked loci as well as screen for aneuploidy, from a single cell. In some embodiments, the PARENTAL SUPPORT™ method may be used to characterize one or more cells from embryos biopsied during an IVF cycle to determine the genetic condition of the one or more cells.

The PARENTAL SUPPORT™ method allows the cleaning of noisy genetic data. This may be done by inferring the correct genetic alleles in the target genome (embryo) using the genotype of related individuals (parents) as a reference. PARENTAL SUPPORT™ may be particularly relevant where only a small quantity of genetic material is available (e.g. PGD) and where direct measurements of the genotypes are inherently noisy due to the limited amounts of genetic material. PARENTAL SUPPORT™ may be particularly relevant where only a small fraction of the genetic material available is from the target individual (e.g. NPD) and where direct measurements of the genotypes are inherently noisy due to the contaminating DNA signal from another individual. The PARENTAL SUPPORT™ method is able to reconstruct highly accurate ordered diploid allele sequences on the embryo, together with copy number of chromosomes segments, even though the conventional, unordered diploid measurements may be characterized by high rates of allele dropouts, drop-ins, variable amplification biases and other errors. The method may employ both an underlying genetic model and an underlying model of measurement error. The genetic model may determine both allele probabilities at each SNP and crossover probabilities between SNPs. Allele probabilities may be modeled at each SNP based on data obtained from the parents and model crossover probabilities between SNPs based on data obtained from the HapMap database, as developed by the International HapMap Project. Given the proper underlying genetic model and measurement error model, maximum a posteriori (MAP) estimation may be used, with modifications for computationally efficiency, to estimate the correct, ordered allele values at each SNP in the embryo.

The techniques outlined above, in some cases, are able to determine the genotype of an individual given a very small amount of DNA originating from that individual. This could be the DNA from one or a small number of cells, or it could be from the small amount of fetal DNA found in maternal blood.

Hypotheses

In the context of this disclosure, a hypothesis refers to a possible genetic state. It may refer to a possible ploidy state. It may refer to a possible allelic state. A set of hypotheses may refer to a set of possible genetic states, a set of possible allelic states, a set of possible ploidy states, or combinations thereof. In some embodiments, a set of hypotheses may be designed such that one hypothesis from the set will correspond to the actual genetic state of any given individual. In some embodiments, a set of hypotheses may be designed such that every possible genetic state may be described by at least one hypothesis from the set. In some embodiments of the present disclosure, one aspect of a method is to determine which hypothesis corresponds to the actual genetic state of the individual in question.

In another embodiment of the present disclosure, one step involves creating a hypothesis. In some embodiments it may be a copy number hypothesis. In some embodiments it may involve a hypothesis concerning which segments of a chromosome from each of the related individuals correspond genetically to which segments, if any, of the other related individuals. Creating a hypothesis may refer to the act of setting the limits of the variables such that the entire set of possible genetic states that are under consideration are encompassed by those variables.

A "copy number hypothesis," also called a "ploidy hypothesis," or a "ploidy state hypothesis," may refer to a hypothesis concerning a possible ploidy state for a given chromosome copy, chromosome type, or section of a chromosome, in the target individual. It may also refer to the ploidy state at more than one of the chromosome types in the individual. A set of copy number hypotheses may refer to a set of hypotheses where each hypothesis corresponds to a different possible ploidy state in an individual. A set of hypotheses may concern a set of possible ploidy states, a set of possible parental haplotypes contributions, a set of possible fetal DNA percentages in the mixed sample, or combinations thereof. In some embodiments, the copy number hypotheses include all fetuses in a multiple pregnancy being euploid, all fetuses in a multiple pregnancy being aneuploid (such as any of the aneuploidies disclosed herein), and/or one or more fetuses in a multiple pregnancy being euploid and one or more fetuses in a multiple pregnancy being aneuploidy. In some embodiments, the copy number hypotheses include identical twins (also referred to as monozygotic twins) or fraternal twins (also referred to as dizygotic twins). In some embodiments, the copy number hypotheses include a molar pregnancy, such as a complete or partial molar pregnancy.

A normal individual contains one of each chromosome type from each parent. However, due to errors in meiosis and mitosis, it is possible for an individual to have 0, 1, 2, or more of a given chromosome type from each parent. In practice, it is rare to see more that two of a given chromosomes from a parent. In this disclosure, some embodiments only consider the possible hypotheses where 0, 1, or 2 copies of a given chromosome come from a parent; it is a trivial extension to consider more or less possible copies originating from a parent. In some embodiments, for a given chromosome, there are nine possible hypotheses: the three possible hypothesis concerning 0, 1, or 2 chromosomes of maternal origin, multiplied by the three possible hypotheses concerning 0, 1, or 2 chromosomes of paternal origin. Let (m,f) refer to the hypothesis where m is the number of a given chromosome inherited from the mother, and f is the number of a given chromosome inherited from the father. Therefore, the nine hypotheses are (0,0), (0,1), (0,2), (1,0), (1,1), (1,2), (2,0), (2,1), and (2,2). These may also be written as $H_{00}$, $H_{01}$, $H_{02}$, $H_{10}$, $H_{12}$, $H_{20}$, $H_{21}$, and $H_{22}$. The different hypotheses correspond to different ploidy states. For example, (1,1) refers to a normal disomic chromosome; (2,1) refers to a maternal trisomy, and (0,1) refers to a paternal monosomy. In some embodiments, the case where two chromosomes are inherited from one parent and one chromosome is inherited from the other parent may be further differentiated into two cases: one where the two chromosomes are identical (matched copy error), and one where the two chromosomes are homologous but not identical (unmatched copy error). In these embodiments, there are sixteen possible hypotheses. It should be understood that it is possible to use other sets of hypotheses, and a different number of hypotheses.

In some embodiments of the present disclosure, the ploidy hypothesis refers to a hypothesis concerning which chromosome from other related individuals correspond to a chromosome found in the target individual's genome. In some embodiments, a key to the method is the fact that related individuals can be expected to share haplotype blocks, and using measured genetic data from related individuals, along with a knowledge of which haplotype blocks match between the target individual and the related individual, it is possible to infer the correct genetic data for a target individual with higher confidence than using the target individual's genetic measurements alone. As such, in some embodiments, the ploidy hypothesis may concern not only the number of chromosomes, but also which chromosomes in related individuals are identical, or nearly identical, with one or more chromosomes in the target individual.

Once the set of hypotheses have been defined, when the algorithms operate on the input genetic data, they may output a determined statistical probability for each of the hypotheses under consideration. The probabilities of the various hypotheses may be determined by mathematically calculating, for each of the various hypotheses, the value that the probability equals, as stated by one or more of the expert techniques, algorithms, and/or methods described elsewhere in this disclosure, using the relevant genetic data as input.

Once the probabilities of the different hypotheses are estimated, as determined by a plurality of techniques, they may be combined. This may entail, for each hypothesis, multiplying the probabilities as determined by each technique. The product of the probabilities of the hypotheses may be normalized. Note that one ploidy hypothesis refers to one possible ploidy state for a chromosome.

The process of "combining probabilities," also called "combining hypotheses," or combining the results of expert techniques, is a concept that should be familiar to one skilled in the art of linear algebra. One possible way to combine probabilities is as follows: When an expert technique is used to evaluate a set of hypotheses given a set of genetic data, the output of the method is a set of probabilities that are associated, in a one-to-one fashion, with each hypothesis in the set of hypotheses. When a set of probabilities that were determined by a first expert technique, each of which are associated with one of the hypotheses in the set, are combined with a set of probabilities that were determined by a second expert technique, each of which are associated with the same set of hypotheses, then the two sets of probabilities are multiplied. This means that, for each hypothesis in the set, the two probabilities that are associated with that hypothesis, as determined by the two expert methods, are multiplied together, and the corresponding product is the output probability. This process may be expanded to any number of expert techniques. If only one expert technique is used, then the output probabilities are the same as the input probabilities. If more than two expert techniques are used, then the relevant probabilities may be multiplied at the same time. The products may be normalized so that the probabilities of the hypotheses in the set of hypotheses sum to 100%.

In some embodiments, if the combined probabilities for a given hypothesis are greater than the combined probabilities for any of the other hypotheses, then it may be considered that that hypothesis is determined to be the most likely. In some embodiments, a hypothesis may be determined to be the most likely, and the ploidy state, or other genetic state, may be called if the normalized probability is greater than a threshold. In an embodiment, this may mean that the number and identity of the chromosomes that are associated with that hypothesis may be called as the ploidy state. In an embodiment, this may mean that the identity of the alleles that are associated with that hypothesis may be called as the allelic state. In some embodiments, the threshold may be between about 50% and about 80%. In some embodiments the threshold may be between about 80% and about 90%. In some embodiments the threshold may be between about 90% and about 95%. In some embodiments the threshold may be between about 95% and about 99%. In some embodiments the threshold may be between about 99% and about 99.9%. In some embodiments the threshold may be above about 99.9%.

Parental Contexts

The parental context refers to the genetic state of a given allele, on each of the two relevant chromosomes for one or both of the two parents of the target. Note that in an embodiment, the parental context does not refer to the allelic state of the target, rather, it refers to the allelic state of the parents. The parental context for a given SNP may consist of four base pairs, two paternal and two maternal; they may be the same or different from one another. It is typically written as "$m_1m_2|f_1f_2$," where $m_1$ and $m_2$ are the genetic state of the given SNP on the two maternal chromosomes, and $f_1$ and $f_2$ are the genetic state of the given SNP on the two paternal chromosomes. In some embodiments, the parental context may be written as "$f_1f_2|m_1m_2$" Note that subscripts "1" and "2" refer to the genotype, at the given allele, of the first and second chromosome; also note that the choice of which chromosome is labeled "1" and which is labeled "2" is arbitrary.

Note that in this disclosure, A and B are often used to generically represent base pair identities; A or B could equally well represent C (cytosine), G (guanine), A (adenine) or T (thymine). For example, if, at a given SNP based allele, the mother's genotype was T at that SNP on one chromosome, and G at that SNP on the homologous chromosome, and the father's genotype at that allele is G at that SNP on both of the homologous chromosomes, one may say that the target individual's allele has the parental context of AB|BB; it could also be said that the allele has the parental context of AB|AA. Note that, in theory, any of the four possible nucleotides could occur at a given allele, and thus it is possible, for example, for the mother to have a genotype of AT, and the father to have a genotype of GC at a given allele. However, empirical data indicate that in most cases only two of the four possible base pairs are observed at a given allele. It is possible, for example when using single tandem repeats, to have more than two parental, more than four and even more than ten contexts. In this disclosure the discussion assumes that only two possible base pairs will be observed at a given allele, although the embodiments disclosed herein could be modified to take into account the cases where this assumption does not hold.

A "parental context" may refer to a set or subset of target SNPs that have the same parental context. For example, if one were to measure 1000 alleles on a given chromosome on a target individual, then the context AA|BB could refer to the set of all alleles in the group of 1,000 alleles where the genotype of the mother of the target was homozygous, and the genotype of the father of the target is homozygous, but where the maternal genotype and the paternal genotype are dissimilar at that locus. If the parental data is not phased, and thus AB=BA, then there are nine possible parental contexts: AA|AA, AA|AB, AA|BB, AB|AA, AB|AB, AB|BB, BB|AA, BB|AB, and BB|BB. If the parental data is phased, and thus AB BA, then there are sixteen different possible parental contexts: AA|AA, AA|AB, AA|BA, AA|BB, AB|AA, AB|AB, AB|BA, AB|BB, BA|AA, BA|AB, BA|BA, BA|BB, BB|AA, BB|AB, BB|BA, and BB|BB. Every SNP allele on a chromosome, excluding some SNPs on the sex chromosomes, has one of these parental contexts. The set of SNPs wherein the parental context for one parent is heterozygous may be referred to as the heterozygous context.

Use of Parental Contexts in NPD

Non-invasive prenatal diagnosis is an important technique that can be used to determine the genetic state of a fetus from genetic material that is obtained in a non-invasive manner, for example from a blood draw on the pregnant mother. The blood could be separated and the plasma isolated, followed by isolation of the plasma DNA. Size selection could be used to isolate the DNA of the appropriate length. The DNA may be preferentially enriched at a set of loci. This DNA can then be measured by a number of means, such as by hybridizing to a genotyping array and measuring the fluorescence, or by sequencing on a high throughput sequencer.

When sequencing is used for ploidy calling of a fetus in the context of non-invasive prenatal diagnosis, there are a number of ways to use the sequence data. The most common way one could use the sequence data is to simply count the number of reads that map to a given chromosome. For example, imagine if you are trying to determine the ploidy state of chromosome 21 on the fetus. Further imagine that the DNA in the sample is comprised of 10% DNA of fetal origin, and 90% DNA of maternal origin. In this case, you could look at the average number of reads on a chromosome which can be expected to be disomic, for example chromosome 3, and compare that to the number of read on chromosome 21, where the reads are adjusted for the number of base pairs on that chromosome that are part of a unique sequence. If the fetus were euploid, one would expect the amount of DNA per unit of genome to be about equal at all locations (subject to stochastic variations). On the other hand, if the fetus were trisomic at chromosome 21, then one would expect there to be more slightly more DNA per genetic unit from chromosome 21 than the other locations on the genome. Specifically one would expect there to be about 5% more DNA from chromosome 21 in the mixture. When sequencing is used to measure the DNA, one would expect about 5% more uniquely mappable reads from chromosome 21 per unique segment than from the other chromosomes. One could use the observation of an amount of DNA from a particular chromosome that is higher than a certain threshold, when adjusted for the number of sequences that are uniquely mappable to that chromosome, as the basis for an aneuploidy diagnosis. Another method that may be used to detect aneuploidy is similar to that above, except that parental contexts could be taken into account.

When considering which alleles to target, one may consider the likelihood that some parental contexts are likely to be more informative than others. For example, AA|BB and the symmetric context BB|AA are the most informative contexts, because the fetus is known to carry an allele that is different from the mother. For reasons of symmetry, both AA|BB and BB|AA contexts may be referred to as AA|BB. Another set of informative parental contexts are AA|AB and BB|AB, because in these cases the fetus has a 50% chance of carrying an allele that the mother does not have. For reasons of symmetry, both AA|AB and BB|AB contexts may be referred to as AA|AB. A third set of informative parental contexts are AB|AA and AB|BB, because in these cases the fetus is carrying a known paternal allele, and that allele is also present in the maternal genome. For reasons of symmetry, both AB|AA and AB|BB contexts may be referred to as AB|AA. A fourth parental context is AB|AB where the fetus has an unknown allelic state, and whatever the allelic state, it is one in which the mother has the same alleles. The fifth parental context is AA|AA, where the mother and father are heterozygous.

Different Implementations of the Presently Disclosed Embodiments

Methods are disclosed herein for determining the ploidy state of a target individual. The target individual may be a blastomere, an embryo, or a fetus. In some embodiments of the present disclosure, a method for determining the ploidy state of one or more chromosome in a target individual may include any of the steps described in this document, and combinations thereof:

In some embodiments the source of the genetic material to be used in determining the genetic state of the fetus may be fetal cells, such as nucleated fetal red blood cells, isolated from the maternal blood. The method may involve obtaining a blood sample from the pregnant mother. The method may involve isolating a fetal red blood cell using visual techniques, based on the idea that a certain combination of colors are uniquely associated with nucleated red blood cell, and a similar combination of colors is not associated with any other present cell in the maternal blood. The combination of colors associated with the nucleated red blood cells may include the red color of the hemoglobin around the nucleus, which color may be made more distinct by staining, and the color of the nuclear material which can be stained, for example, blue. By isolating the cells from maternal blood and spreading them over a slide, and then identifying those points at which one sees both red (from the Hemoglobin) and blue (from the nuclear material) one may be able to identify the location of nucleated red blood cells. One may then extract those nucleated red blood cells using a micromanipulator, use genotyping and/or sequencing techniques to measure aspects of the genotype of the genetic material in those cells.

In an embodiment, one may stain the nucleated red blood cell with a die that only fluoresces in the presence of fetal hemoglobin and not maternal hemoglobin, and so remove the ambiguity between whether a nucleated red blood cell is derived from the mother or the fetus. Some embodiments of the present disclosure may involve staining or otherwise marking nuclear material. Some embodiments of the present disclosure may involve specifically marking fetal nuclear material using fetal cell specific antibodies.

There are many other ways to isolate fetal cells from maternal blood, or fetal DNA from maternal blood, or to enrich samples of fetal genetic material in the presence of maternal genetic material. Some of these methods are listed here, but this is not intended to be an exhaustive list. Some appropriate techniques are listed here for convenience: using fluorescently or otherwise tagged antibodies, size exclusion chromatography, magnetically or otherwise labeled affinity tags, epigenetic differences, such as differential methylation between the maternal and fetal cells at specific alleles, density gradient centrifugation succeeded by CD45/14 depletion and CD71-positive selection from CD45/14 negative-cells, single or double Percoll gradients with different osmolalities, or galactose specific lectin method.

In an embodiment of the present disclosure, the target individual is a fetus, and the different genotype measurements are made on a plurality of DNA samples from the fetus. In some embodiments of the present disclosure, the fetal DNA samples are from isolated fetal cells where the fetal cells may be mixed with maternal cells. In some embodiments of the present disclosure, the fetal DNA samples are from free floating fetal DNA, where the fetal DNA may be mixed with free floating maternal DNA. In some embodiments, the fetal DNA samples may be derived from maternal plasma or maternal blood that contains a mixture of maternal DNA and fetal DNA. In some embodiments, the fetal DNA may be mixed with maternal DNA in maternal:fetal ratios ranging from 99.9:0.1% to 99:1%;

99:1% to 90:10%; 90:10% to 80:20%; 80:20% to 70:30%; 70:30% to 50:50%; 50:50% to 10:90%; or 10:90% to 1:99%; 1:99% to 0.1:99.9%.

The genetic data of the target individual and/or of the related individual can be transformed from a molecular state to an electronic state by measuring the appropriate genetic material using tools and or techniques taken from a group including, but not limited to: genotyping microarrays, and high throughput sequencing. Some high throughput sequencing methods include Sanger DNA sequencing, pyrosequencing, the ILLUMINA SOLEXA platform, ILLUMINA's GENOME ANALYZER, or APPLIED BIOSYSTEM's 454 sequencing platform, HELICOS's TRUE SINGLE MOLECULE SEQUENCING platform, HALCYON MOLECULAR's electron microscope sequencing method, or any other sequencing method. All of these methods physically transform the genetic data stored in a sample of DNA into a set of genetic data that is typically stored in a memory device in route to being processed.

A relevant individual's genetic data may be measured by analyzing substances taken from a group including, but not limited to: the individual's bulk diploid tissue, one or more diploid cells from the individual, one or more haploid cells from the individual, one or more blastomeres from the target individual, extra-cellular genetic material found on the individual, extra-cellular genetic material from the individual found in maternal blood, cells from the individual found in maternal blood, one or more embryos created from (a) gamete(s) from the related individual, one or more blastomeres taken from such an embryo, extra-cellular genetic material found on the related individual, genetic material known to have originated from the related individual, and combinations thereof.

In some embodiments, a set of at least one ploidy state hypothesis may be created for each of the chromosomes types of interest of the target individual. Each of the ploidy state hypotheses may refer to one possible ploidy state of the chromosome or chromosome segment of the target individual. The set of hypotheses may include some or all of the possible ploidy states that the chromosome of the target individual may be expected to have. Some of the possible ploidy states may include nullsomy, monosomy, disomy, uniparental disomy, euploidy, trisomy, matching trisomy, unmatching trisomy, maternal trisomy, paternal trisomy, tetrasomy, balanced (2:2) tetrasomy, unbalanced (3:1) tetrasomy, pentasomy, hexasomy, other aneuploidy, and combinations thereof. Any of these aneuploidy states may be mixed or partial aneuploidy such as unbalanced translocations, balanced translocations, Robertsonian translocations, recombinations, deletions, insertions, crossovers, and combinations thereof.

In some embodiments, the knowledge of the determined ploidy state may be used to make a clinical decision. This knowledge, typically stored as a physical arrangement of matter in a memory device, may then be transformed into a report. The report may then be acted upon. For example, the clinical decision may be to terminate the pregnancy; alternately, the clinical decision may be to continue the pregnancy. In some embodiments the clinical decision may involve an intervention designed to decrease the severity of the phenotypic presentation of a genetic disorder, or a decision to take relevant steps to prepare for a special needs child.

In an embodiment of the present disclosure, any of the methods described herein may be modified to allow for multiple targets to come from same target individual, for example, multiple blood draws from the same pregnant mother. This may improve the accuracy of the model, as multiple genetic measurements may provide more data with which the target genotype may be determined. In an embodiment, one set of target genetic data served as the primary data which was reported, and the other served as data to double-check the primary target genetic data. In an embodiment, a plurality of sets of genetic data, each measured from genetic material taken from the target individual, are considered in parallel, and thus both sets of target genetic data serve to help determine which sections of parental genetic data, measured with high accuracy, composes the fetal genome.

In an embodiment, the method may be used for the purpose of paternity testing. For example, given the SNP-based genotypic information from the mother, and from a man who may or may not be the genetic father, and the measured genotypic information from the mixed sample, it is possible to determine if the genotypic information of the male indeed represents that actual genetic father of the gestating fetus. A simple way to do this is to simply look at the contexts where the mother is AA, and the possible father is AB or BB. In these cases, one may expect to see the father contribution half (AA|AB) or all (AA|BB) of the time, respectively. Taking into account the expected ADO, it is straightforward to determine whether or not the fetal SNPs that are observed are correlated with those of the possible father.

One embodiment of the present disclosure could be as follows: a pregnant woman wants to know if her fetus is afflicted with Down Syndrome, and/or if it will suffer from Cystic Fibrosis, and she does not wish to bear a child that is afflicted with either of these conditions. A doctor takes her blood, and stains the hemoglobin with one marker so that it appears clearly red, and stains nuclear material with another marker so that it appears clearly blue. Knowing that maternal red blood cells are typically a nuclear, while a high proportion of fetal cells contain a nucleus, the doctor is able to visually isolate a number of nucleated red blood cells by identifying those cells that show both a red and blue color. The doctor picks up these cells off the slide with a micromanipulator and sends them to a lab which amplifies and genotypes ten individual cells. By using the genetic measurements, the PARENTAL SUPPORT™ method is able to determine that six of the ten cells are maternal blood cells, and four of the ten cells are fetal cells. If a child has already been born to a pregnant mother, PARENTAL SUPPORT™ can also be used to determine that the fetal cells are distinct from the cells of the born child by making reliable allele calls on the fetal cells and showing that they are dissimilar to those of the born child. Note that this method is similar in concept to the paternal testing embodiment of the present disclosure. The genetic data measured from the fetal cells may be of very poor quality, comprising many allele drop outs, due to the difficulty of genotyping single cells. The clinician is able to use the measured fetal DNA along with the reliable DNA measurements of the parents to infer aspects of the genome of the fetus with high accuracy using PARENTAL SUPPORT™, thereby transforming the genetic data contained on genetic material from the fetus into the predicted genetic state of the fetus, stored on a computer. The clinician is able to determine both the ploidy state of the fetus, and the presence or absence of a plurality of disease-linked genes of interest. It turns out that the fetus is euploid, and is not a carrier for cystic fibrosis, and the mother decides to continue the pregnancy.

In an embodiment of the present disclosure, a pregnant mother would like to determine if her fetus is afflicted with any whole chromosomal abnormalities. She goes to her doctor, and gives a sample of her blood, and she and her husband gives samples of their own DNA from cheek swabs. A laboratory researcher genotypes the parental DNA using the MDA protocol to amplify the parental DNA, and ILLUMINA INFINIUM arrays to measure the genetic data of the parents at a large number of SNPs. The researcher then spins down the blood, takes the plasma, and isolates a sample of free-floating DNA using size exclusion chromatography. Alternately, the researcher uses one or more fluorescent antibodies, such as one that is specific to fetal hemoglobin to isolate a nucleated fetal red blood cell. The researcher then takes the isolated or enriched fetal genetic material and amplifies it using a library of 70-mer oligonucleotides appropriately designed such that two ends of each oligonucleotide corresponded to the flanking sequences on either side of a target allele. Upon addition of a polymerase, ligase, and the appropriate reagents, the oligonucleotides underwent gap-filling circularization, capturing the desired allele. An exonuclease was added, heat-inactivated, and the products were used directly as a template for PCR amplification. The PCR products were sequenced on an ILLUMINA GENOME ANALYZER. The sequence reads were used as input for the PARENTAL SUPPORT™ method, which then predicted the ploidy state of the fetus.

In another embodiment, a couple—where the mother, who is pregnant, and is of advanced maternal age—wants to know whether the gestating fetus has Down syndrome, Turner Syndrome, Prader Willi syndrome, or some other whole chromosomal abnormality. The obstetrician takes a blood draw from the mother and father. The blood is sent to a laboratory, where a technician centrifuges the maternal sample to isolate the plasma and the buffy coat. The DNA in the buffy coat and the paternal blood sample are transformed through amplification and the genetic data encoded in the amplified genetic material is further transformed from molecularly stored genetic data into electronically stored genetic data by running the genetic material on a high throughput sequencer to measure the parental genotypes. The plasma sample is preferentially enriched at a set of loci using a 5,000-plex hemi-nested targeted PCR method. The mixture of DNA fragments is prepared into a DNA library suitable for sequencing. The DNA is then sequenced using a high throughput sequencing method, for example, the ILLUMINA GAIIx GENOME ANALYZER. The sequencing transforms the information that is encoded molecularly in the DNA into information that is encoded electronically in computer hardware. An informatics based technique that includes the presently disclosed embodiments, such as PARENTAL SUPPORT™, may be used to determine the ploidy state of the fetus. This may involve calculating, on a computer, allele count probabilities at the plurality of polymorphic loci from the DNA measurements made on the prepared sample; creating, on a computer, a plurality of ploidy hypotheses each pertaining to a different possible ploidy state of the chromosome; building, on a computer, a joint distribution model for the expected allele counts at the plurality of polymorphic loci on the chromosome for each ploidy hypothesis; determining, on a computer, a relative probability of each of the ploidy hypotheses using the joint distribution model and the allele counts measured on the prepared sample; and calling the ploidy state of the fetus by selecting the ploidy state corresponding to the hypothesis with the greatest probability. It is determined that the fetus has Down syndrome. A report is printed out, or sent electronically to the pregnant woman's obstetrician, who transmits the diagnosis to the woman. The woman, her husband, and the doctor sit down and discuss their options. The couple decides to terminate the pregnancy based on the knowledge that the fetus is afflicted with a trisomic condition.

In an embodiment, a company may decide to offer a diagnostic technology designed to detect aneuploidy in a gestating fetus from a maternal blood draw. Their product may involve a mother presenting to her obstetrician, who may draw her blood. The obstetrician may also collect a genetic sample from the father of the fetus. A clinician may isolate the plasma from the maternal blood, and purify the DNA from the plasma. A clinician may also isolate the buffy coat layer from the maternal blood, and prepare the DNA from the buffy coat. A clinician may also prepare the DNA from the paternal genetic sample. The clinician may use molecular biology techniques described in this disclosure to append universal amplification tags to the DNA in the DNA derived from the plasma sample. The clinician may amplify the universally tagged DNA. The clinician may preferentially enrich the DNA by a number of techniques including capture by hybridization and targeted PCR. The targeted PCR may involve nesting, hemi-nesting or semi-nesting, or any other approach to result in efficient enrichment of the plasma derived DNA. The targeted PCR may be massively multiplexed, for example with 10,000 primers in one reaction volume, where the primers target SNPs on chromosomes 13, 18, 21, X and those loci that are common to both X and Y, and optionally other chromosomes as well. The selective enrichment and/or amplification may involve tagging each individual molecule with different tags, molecular barcodes, tags for amplification, and/or tags for sequencing. The clinician may then sequence the plasma sample, and also possibly also the prepared maternal and/or paternal DNA. The molecular biology steps may be executed either wholly or partly by a diagnostic box. The sequence data may be fed into a single computer, or to another type of computing platform such as may be found in 'the cloud'. The computing platform may calculate allele counts at the targeted polymorphic loci from the measurements made by the sequencer. The computing platform may create a plurality of ploidy hypotheses pertaining to nullsomy, monosomy, disomy, matched trisomy, and unmatched trisomy for each of chromosomes 13, 18, 21, X and Y. The computing platform may build a joint distribution model for the expected allele counts at the targeted loci on the chromosome for each ploidy hypothesis for each of the five chromosomes being interrogated. The computing platform may determine a probability that each of the ploidy hypotheses is true using the joint distribution model and the allele counts measured on the preferentially enriched DNA derived from the plasma sample. The computing platform may call the ploidy state of the fetus, for each of chromosome 13, 18, 21, X and Y by selecting the ploidy state corresponding to the germane hypothesis with the greatest probability. A report may be generated comprising the called ploidy states, and it may be sent to the obstetrician electronically, displayed on an output device, or a printed hard copy of the report may be delivered to the obstetrician. The obstetrician may inform the patient and optionally the father of the fetus, and they may decide which clinical options are open to them, and which is most desirable.

In another embodiment, a pregnant woman, hereafter referred to as "the mother" may decide that she wants to know whether or not her fetus(es) are carrying any genetic abnormalities or other conditions. She may want to ensure that there are not any gross abnormalities before she is confident to continue the pregnancy. She may go to her obstetrician, who may take a sample of her blood. He may also take a genetic sample, such as a buccal swab, from her cheek. He may also take a genetic sample from the father of the fetus, such as a buccal swab, a sperm sample, or a blood sample. He may send the samples to a clinician. The clinician may enrich the fraction of free floating fetal DNA in the maternal blood sample. The clinician may enrich the fraction of enucleated fetal blood cells in the maternal blood sample. The clinician may use various aspects of the methods described herein to determine genetic data of the fetus. That genetic data may include the ploidy state of the fetus, and/or the identity of one or a number of disease linked alleles in the fetus. A report may be generated summarizing the results of the prenatal diagnosis. The report may be transmitted or mailed to the doctor, who may tell the mother the genetic state of the fetus. The mother may decide to discontinue the pregnancy based on the fact that the fetus has one or more chromosomal, or genetic abnormalities, or undesirable conditions. She may also decide to continue the pregnancy based on the fact that the fetus does not have any gross chromosomal or genetic abnormalities, or any genetic conditions of interest.

Another example may involve a pregnant woman who has been artificially inseminated by a sperm donor, and is pregnant. She wants to minimize the risk that the fetus she is carrying has a genetic disease. She has blood drawn at a phlebotomist, and techniques described in this disclosure are used to isolate three nucleated fetal red blood cells, and a tissue sample is also collected from the mother and genetic father. The genetic material from the fetus and from the mother and father are amplified as appropriate and genotyped using the ILLUMINA INFINIUM BEADARRAY, and the methods described herein clean and phase the parental and fetal genotype with high accuracy, as well as to make ploidy calls for the fetus. The fetus is found to be euploid, and phenotypic susceptibilities are predicted from the reconstructed fetal genotype, and a report is generated and sent to the mother's physician so that they can decide what clinical decisions may be best.

In an embodiment, the raw genetic material of the mother and the father is transformed by way of amplification to an amount of DNA that is similar in sequence, but larger in quantity. Then, by way of a genotyping method, the genotypic data that is encoded by nucleic acids is transformed into genetic measurements that may be stored physically and/or electronically on a memory device, such as those described above. The relevant algorithms that makeup the PARENTAL SUPPORT™ algorithm, relevant parts of which are discussed in detail herein, are translated into a computer program, using a programming language. Then, through the execution of the computer program on the computer hardware, instead of being physically encoded bits and bytes, arranged in a pattern that represents raw measurement data, they become transformed into a pattern that represents a high confidence determination of the ploidy state of the fetus. The details of this transformation will rely on the data itself and the computer language and hardware system used to execute the method described herein. Then, the data that is physically configured to represent a high quality ploidy determination of the fetus is transformed into a report which may be sent to a health care practitioner. This transformation may be carried out using a printer or a computer display. The report may be a printed copy, on paper or other suitable medium, or else it may be electronic. In the case of an electronic report, it may be transmitted, it may be physically stored on a memory device at a location on the computer accessible by the health care practitioner; it also may be displayed on a screen so that it may be read. In the case of a screen display, the data may be transformed to a readable format by causing the physical transformation of pixels on the display device. The transformation may be accomplished by way of physically firing electrons at a phosphorescent screen, by way of altering an electric charge that physically changes the transparency of a specific set of pixels on a screen that may lie in front of a substrate that emits or absorbs photons. This transformation may be accomplished by way of changing the nanoscale orientation of the molecules in a liquid crystal, for example, from nematic to cholesteric or smectic phase, at a specific set of pixels. This transformation may be accomplished by way of an electric current causing photons to be emitted from a specific set of pixels made from a plurality of light emitting diodes arranged in a meaningful pattern. This transformation may be accomplished by any other way used to display information, such as a computer screen, or some other output device or way of transmitting information. The health care practitioner may then act on the report, such that the data in the report is transformed into an action. The action may be to continue or discontinue the pregnancy, in which case a gestating fetus with a genetic abnormality is transformed into non-living fetus. The transformations listed herein may be aggregated, such that, for example, one may transform the genetic material of a pregnant mother and the father, through a number of steps outlined in this disclosure, into a medical decision consisting of aborting a fetus with genetic abnormalities, or consisting of continuing the pregnancy. Alternately, one may transform a set of genotypic measurements into a report that helps a physician treat his pregnant patient.

In an embodiment of the present disclosure, the method described herein can be used to determine the ploidy state of a fetus even when the host mother, i.e. the woman who is pregnant, is not the biological mother of the fetus she is carrying. In an embodiment of the present disclosure, the method described herein can be used to determine the ploidy state of a fetus using only the maternal blood sample, and without the need for a paternal genetic sample.

Some of the math in the presently disclosed embodiments makes hypotheses concerning a limited number of states of aneuploidy. In some cases, for example, only zero, one or two chromosomes are expected to originate from each parent. In some embodiments of the present disclosure, the mathematical derivations can be expanded to take into account other forms of aneuploidy, such as quadrosomy, where three chromosomes originate from one parent, pentasomy, hexasomy etc., without changing the fundamental concepts of the present disclosure. At the same time, it is possible to focus on a smaller number of ploidy states, for example, only trisomy and disomy. Note that ploidy determinations that indicate a non-whole number of chromosomes may indicate mosaicism in a sample of genetic material.

In some embodiments, the genetic abnormality is a type of aneuploidy, such as Down syndrome (or trisomy 21), Edwards syndrome (trisomy 18), Patau syndrome (trisomy 13), Turner Syndrome (45×), Klinefelter's syndrome (a male with 2×chromosomes), Prader-Willi syndrome, and DiGeorge syndrome (UPD 15). Congenital disorders, such as those listed in the prior sentence, are commonly undesirable, and the knowledge that a fetus is afflicted with one or more phenotypic abnormalities may provide the basis for a decision to terminate the pregnancy, to take necessary precautions to prepare for the birth of a special needs child, or to take some therapeutic approach meant to lessen the severity of a chromosomal abnormality.

In some embodiments, the methods described herein can be used at a very early gestational age, for example as early as four week, as early as five weeks, as early as six weeks, as early as seven weeks, as early as eight weeks, as early as nine weeks, as early as ten weeks, as early as eleven weeks, and as early as twelve weeks.

In some embodiments, a method disclosed herein is used in the context of pre-implantation genetic diagnosis (PGD) for embryo selection during in vitro fertilization, where the target individual is an embryo, and the parental genotypic data can be used to make ploidy determinations about the embryo from sequencing data from a single or two cell biopsy from a day 3 embryo or a trophectoderm biopsy from a day 5 or day 6 embryo. In a PGD setting, only the child DNA is measured, and only a small number of cells are tested, generally one to five but as many as ten, twenty or fifty. The total number of starting copies of the A and B alleles (at a SNP) are then trivially determined by the child genotype and the number of cells. In NPD, the number of starting copies is very high and so the allele ratio after PCR is expected to accurately reflect the starting ratio. However, the small number of starting copies in PGD means that contamination and imperfect PCR efficiency have a non-trivial effect on the allele ratio following PCR. This effect may be more important than depth of read in predicting the variance in the allele ratio measured after sequencing. The distribution of measured allele ratio given a known child genotype may be created by Monte Carlo simulation of the PCR process based on the PCR probe efficiency and probability of contamination. Given an allele ratio distribution for each possible child genotype, the likelihoods of various hypotheses can be calculated as described for NIPD.

Maximum Likelihood Estimates

Most methods known in the art for detecting the presence or absence of biological phenomenon or medical condition involve the use of a single hypothesis rejection test, where a metric that is correlated with the condition is measured, and if the metric is on one side of a given threshold, the condition is present, while of the metric falls on the other side of the threshold, the condition is absent. A single-hypothesis rejection test only looks at the null distribution when deciding between the null and alternate hypotheses. Without taking into account the alternate distribution, one cannot estimate the likelihood of each hypothesis given the observed data and therefore cannot calculate a confidence on the call. Hence with a single-hypothesis rejection test, one gets a yes or no answer without a feeling for the confidence associated with the specific case.

In some embodiments, the method disclosed herein is able to detect the presence or absence of biological phenomenon or medical condition using a maximum likelihood method. This is a substantial improvement over a method using a single hypothesis rejection technique as the threshold for calling absence or presence of the condition can be adjusted as appropriate for each case. This is particularly relevant for diagnostic techniques that aim to determine the presence or absence of aneuploidy in a gestating fetus from genetic data available from the mixture of fetal and maternal DNA present in the free floating DNA found in maternal plasma. This is because as the fraction of fetal DNA in the plasma derived fraction changes, the optimal threshold for calling aneuploidy vs. euploidy changes. As the fetal fraction drops, the distribution of data that is associated with an aneuploidy becomes increasingly similar to the distribution of data that is associated with a euploidy.

The maximum likelihood estimation method uses the distributions associated with each hypothesis to estimate the likelihood of the data conditioned on each hypothesis. These conditional probabilities can then be converted to a hypothesis call and confidence. Similarly, maximum a posteriori estimation method uses the same conditional probabilities as the maximum likelihood estimate, but also incorporates population priors when choosing the best hypothesis and determining confidence.

Therefore, the use of a maximum likelihood estimate (MLE) technique, or the closely related maximum a posteriori (MAP) technique give two advantages, first it increases the chance of a correct call, and it also allows a confidence to be calculated for each call. In an embodiment, selecting the ploidy state corresponding to the hypothesis with the greatest probability is carried out using maximum likelihood estimates or maximum a posteriori estimates. In an embodiment, a method is disclosed for determining the ploidy state of a gestating fetus that involves taking any method currently known in the art that uses a single hypothesis rejection technique and reformulating it such that it uses a MLE or MAP technique. Some examples of methods that can be significantly improved by applying these techniques can be found in U.S. Pat. Nos. 8,008,018, 7,888,017, or U.S. Pat. No. 7,332,277.

In an embodiment, a method is described for determining presence or absence of fetal aneuploidy in a maternal plasma sample comprising fetal and maternal genomic DNA, the method comprising: obtaining a maternal plasma sample; measuring the DNA fragments found in the plasma sample with a high throughput sequencer; mapping the sequences to the chromosome and determining the number of sequence reads that map to each chromosome; calculating the fraction of fetal DNA in the plasma sample; calculating an expected distribution of the amount of a target chromosome that would be expected to be present if that if the second target chromosome were euploid and one or a plurality of expected distributions that would be expected if that chromosome were aneuploid, using the fetal fraction and the number of sequence reads that map to one or a plurality of reference chromosomes expected to be euploid; and using a MLE or MAP determine which of the distributions is most likely to be correct, thereby indicating the presence or absence of a fetal aneuploidy. In an embodiment, the measuring the DNA from the plasma may involve conducting massively parallel shotgun sequencing. In an embodiment, the measuring the DNA from the plasma sample may involve sequencing DNA that has been preferentially enriched, for example through targeted amplification, at a plurality of polymorphic or non-polymorphic loci. The plurality of loci may be designed to target one or a small number of suspected aneuploid chromosomes and one or a small number of reference chromosomes. The purpose of the preferential enrichment is to increase the number of sequence reads that are informative for the ploidy determination.

Ploidy Calling Informatics Methods

Described herein is a method for determining the ploidy state of a fetus given sequence data. In some embodiments, this sequence data may be measured on a high throughput sequencer. In some embodiments, the sequence data may be measured on DNA that originated from free floating DNA isolated from maternal blood, wherein the free floating DNA comprises some DNA of maternal origin, and some DNA of fetal/placental origin. This section will describe one embodiment of the present disclosure in which the ploidy state of the fetus is determined assuming that fraction of fetal DNA in the mixture that has been analyzed is not known and will be estimated from the data. It will also describe an embodiment in which the fraction of fetal DNA ("fetal fraction") or the percentage of fetal DNA in the mixture can be measured by another method, and is assumed to be known in determining the ploidy state of the fetus. In some embodiments the fetal fraction can be calculated using only the genotyping measurements made on the maternal blood sample itself, which is a mixture of fetal and maternal DNA. In some embodiments the fraction may be calculated also using the measured or otherwise known genotype of the mother and/or the measured or otherwise known genotype of the father. In another embodiment ploidy state of the fetus can be determined solely based on the calculated fraction of fetal DNA for the chromosome in question compared to the calculated fraction of fetal DNA for the reference chromosome assumed disomic.

In the preferred embodiment, suppose that, for a particular chromosome, we observe and analyze N SNPs, for which we have:

Set of NR free floating DNA sequence measurements $S=(s_1, \ldots, s_{NR})$. Since this method utilizes the SNP measurements, all sequence data that corresponds to non-polymorphic loci can be disregarded. In a simplified version, where we have (A,B) counts on each SNP, where A and B correspond to the two alleles present at a given locus, S can be written as $S=((a_1,b_1), \ldots, (a_N, b_N))$, where $a_i$ is the A count on SNP i, $b_i$ is the B count on SNP i, and $\Sigma_{i=1:N}(a_i+b_i)=NR$ Parent data consisting of Genotypes from a SNP microarray or other intensity based genotyping platform: mother $M=(m_1, \ldots, m_N)$, father $F=(f_1, \ldots, f_N)$, where $m_i, f_i \in (AA,AB, BB)$.

AND/OR sequence data measurements: NRM mother measurements $SM=(sm_1, \ldots sm_{nrm})$, NRF father measurements $SF=(sf_1, \ldots, sf_{nrf})$. Similar to the above simplification, if we have (A,B) counts on each SNP $SM=((am_1, bm_1), \ldots, (am_N, bm_N))$, $SF=((af_1,bf_1), \ldots, (af_N, bf_N))$ Collectively, the mother, father child data are denoted as D=(M,F,SM,SF,S). Note that the parent data is desired and increases the accuracy of the algorithm, but is NOT necessary, especially the father data. This means that even in the absence of mother and/or father data, it is possible to get very accurate copy number results.

It is possible to derive the best copy number estimate (H*) by maximizing the data log likelihood LIK(D|H) over all hypotheses (H) considered. In particular it is possible to determine the relative probability of each of the ploidy hypotheses using the joint distribution model and the allele counts measured on the prepared sample, and using those relative probabilities to determine the hypothesis most likely to be correct as follows:

$$H^* = \underset{H}{\mathrm{argmax}} LIK(D \mid H)$$

Similarly the a posteriori hypothesis likelihood given the data may be written as:

$$H^* = \underset{H}{\mathrm{argmax}} LIK(D \mid H) * priorprob(H)$$

Where priorprob(H) is the prior probability assigned to each hypothesis H, based on model design and prior knowledge.

It is also possible to use priors to find the maximum a posteriori estimate:

$$H_{MA} = \underset{H}{\mathrm{argmax}} LIK(D \mid H)$$

In an embodiment, the copy number hypotheses that may be considered are:
Monosomy:
  maternal H10 (one copy from mother)
  paternal H01 (one copy from father)
Disomy: H11 (one copy each mother and father)
Simple trisomy, no crossovers considered:
  Maternal: H21_matched (two identical copies from mother, one copy from father),
  H21_unmatched (BOTH copies from mother, one copy from father)
  Paternal: H12_matched (one copy from mother, two identical copies from father),
  H12_unmatched (one copy from mother, both copies from father)
Composite trisomy, allowing for crossovers (using a joint distribution model):
  maternal H21 (two copies from mother, one from father),
  paternal H12 (one copy from mother, two copies from father)

In other embodiments, other ploidy states, such as nullsomy (H00), uniparental disomy (H20 and H02), and tetrasomy (H04, H13, H22, H31 and H40), may be considered.

If there are no crossovers, each trisomy, whether the origin was mitosis, meiosis I, or meiosis II, would be one of the matched or unmatched trisomies. Due to crossovers, true trisomy is usually a combination of the two. First, a method to derive hypothesis likelihoods for simple hypotheses is described. Then a method to derive hypothesis likelihoods for composite hypotheses is described, combining individual SNP likelihood with crossovers.

LIK(D|H) for a Simple Hypothesis

In an embodiment, LIK(D|H) may be determined for simple hypotheses, as follows. For simple hypotheses H, LIK(H), the log likelihood of hypothesis H on a whole chromosome, may be calculated as the sum of log likelihoods of individual SNPs, assuming known or derived child fraction cf. In an embodiment it is possible to derive cf from the data.

$$LIK(D \mid H) = \sum_i LIK(D \mid H, cf, i)$$

This hypothesis does not assume any linkage between SNPs, and therefore does not utilize a joint distribution model.

In some embodiments, the Log Likelihood may be determined on a per SNP basis. On a particular SNP i, assuming fetal ploidy hypothesis H and percent fetal DNA cf, log likelihood of observed data D is defined as:

$$LIK(D \mid H, i) = \log P(D \mid H, cf, i) = \\ \log\left(\sum_{m,f,c} P(D \mid m, f, c, H, cf, i)P(c \mid m, f, H)P(m \mid i)P(f \mid i)\right)$$

where m are possible true mother genotypes, f are possible true father genotypes, where m,f $\in$ {AA,AB,BB}, and c are possible child genotypes given the hypothesis H. In particular, for monosomy c $\in$ {A, B}, for disomy c $\in$ {AA, AB, BB}, for trisomy c $\in$ {AAA, AAB, ABB, BBB}. Genotype prior frequency: p(m|i) is the general prior probability of mother genotype m on SNP i, based on the known population frequency at SNP I, denoted $pA_i$. In particular $$p(AA|pA_i)=(pA_i)^2, p(AB|pA_i)=2(pA_i)*(1-pA_i), p(BB|pA_i)=(1-pA_i)^2$$

Father genotype probability, p(f|i), may be determined in an analogous fashion. True child probability: p(c|m, f, H) is the probability of getting true child genotype=c, given parents m, f, and assuming hypothesis H, which can be easily calculated. For example, for H11, H21 matched and H21 unmatched, p(c|m,f,H) is given below.

| | | p(c|m, f, H) | | | | | | | | | | |
|---|---|---|---|---|---|---|---|---|---|---|---|---|
| | | H11 | | | H21 matched | | | | H21 unmatched | | | |
| m | f | AA | AB | BB | AAA | AAB | ABB | BBB | AAA | AAB | ABB | BBB |
| AA | AA | 1 | 0 | 0 | 1 | 0 | 0 | 0 | 1 | 0 | 0 | 0 |
| AB | AA | 0.5 | 0.5 | 0 | 0.5 | 0 | 0.5 | 0 | 0 | 1 | 0 | 0 |
| BB | AA | 0 | 1 | 0 | 0 | 0 | 1 | 0 | 0 | 0 | 1 | 0 |
| AA | AB | 0.5 | 0.5 | 0 | 0.5 | 0.5 | 0 | 0 | 0.5 | 0.5 | 0 | 0 |
| AB | AB | 0.25 | 0.5 | 0.25 | 0.25 | 0.25 | 0.25 | 0.25 | 0 | 0.5 | 0.5 | 0 |
| BB | AB | 0 | 0.5 | 0.5 | 0 | 0 | 0.5 | 0.5 | 0 | 0 | 0.5 | 0.5 |
| AA | BB | 0 | 1 | 0 | 0 | 1 | 0 | 0 | 0 | 1 | 0 | 0 |
| AB | BB | 0 | 0.5 | 0.5 | 0 | 0.5 | 0 | 0.5 | 0 | 0 | 1 | 0 |
| BB | BB | 0 | 0 | 1 | 0 | 0 | 0 | 1 | 0 | 0 | 0 | 1 |

Data likelihood: P(D|m, f, c, H, i, cf) is the probability of given data D on SNP i, given true mother genotype m, true father genotype f, true child genotype c, hypothesis H and child fraction cf. It can be broken down into the probability of mother, father and child data as follows:

$$P(D|m,f,c,H,cf,i)=P(SM|m,i)P(M|m,OP(SF|f,i)P(F|f,i)P(S|m,c,H,cf,i)$$

Mother SNP array data likelihood: Probability of mother SNP array genotype data $m_i$ at SNP i compared to true genotype m, assuming SNP array genotypes are correct, is simply $$P(M|m,i) = \begin{cases} 1 & m_i = m \\ 0 & m_i \neq m \end{cases}$$

Mother sequence data likelihood: the probability of the mother sequence data at SNP i, in the case of counts $S_i=(am_i, bm_i)$, with no extra noise or bias involved, is the binomial probability defined as $P(SM|m,i)=P_{X|m}(am_i)$ where $X|m \sim Binom(p_m(A), am_i+bm_i)$ with $p_m(A)$ defined as

| m | AA | AB | BB | A | B | nocall |
|---|---|---|---|---|---|---|
| p(A) | 1 | 0.5 | 0 | 1 | 0 | 0.5 |

Father data likelihood: a similar equation applies for father data likelihood.

Note that it is possible to determine the child genotype without the parent data, especially father data. For example if no father genotype data F is available, one may just use P(F|f, i)=1. If no father sequence data SF is available, one may just use P(SF|f,i)=1.

In some embodiments, the method involves building a joint distribution model for the expected allele counts at a plurality of polymorphic loci on the chromosome for each ploidy hypothesis; one method to accomplish such an end is described here. Free fetal DNA data likelihood: P(S|m, c, H, cf, i) is the probability of free fetal DNA sequence data on SNP i, given true mother genotype m, true child genotype c, child copy number hypothesis H, and assuming child fraction cf. It is in fact the probability of sequence data S on SNP I, given the true probability of A content on SNP i $\mu$(m, c, cf, H)

$$P(S|m,c,H,cf,i)=P(S|\mu(m,c,cf,H),i)$$

For counts, where $S_i=(a_i, b_i)$, with no extra noise or bias in data involved, $$P(S|\mu(m,c,cf,H),i)=P_x(a_i)$$

where X~Binom(p(A), $a_i+b_i$) with p(A)=$\mu$(m, c, cf, H). In a more complex case where the exact alignment and (A,B) counts per SNP are not known, P(S|$\mu$(m, c, cf, H), i) is a combination of integrated binomials.

True A content probability: $\mu$(m, c, cf, H), the true probability of A content on SNP i in this mother/child mixture, assuming that true mother genotype=m, true child genotype=c, and overall child fraction=cf, is defined as $$\mu(m, c, cf, H) = \frac{\#A(m)*(1-cf) + \#A(c)*cf}{n_m*(1-cf) + n_c*cf}$$

where #A(g)=number of A's in genotype g, $n_m$=2 is somy of mother and $n_c$ is ploidy of the child under hypothesis H (1 for monosomy, 2 for disomy, 3 for trisomy).

Using A Joint Distribution Model: LIK(D|H) for a Composite Hypothesis

In some embodiments, the method involves building a joint distribution model for the expected allele counts at the plurality of polymorphic loci on the chromosome for each ploidy hypothesis; one method to accomplish such an end is described here. In many cases, trisomy is usually not purely matched or unmatched, due to crossovers, so in this section results for composite hypotheses H21 (maternal trisomy) and H12 (paternal trisomy) are derived, which combine matched and unmatched trisomy, accounting for possible crossovers.

In the case of trisomy, if there were no crossovers, trisomy would be simply matched or unmatched trisomy. Matched trisomy is where child inherits two copies of the identical chromosome segment from one parent. Unmatched trisomy is where child inherits one copy of each homologous chromosome segment from the parent. Due to crossovers, some segments of a chromosome may have matched trisomy, and other parts may have unmatched trisomy. Described in this section is how to build a joint distribution model for the heterozygosity rates for a set of alleles; that is, for the expected allele counts at a number of loci for one or more hypotheses.

Suppose that on SNP i, LIK(D|Hm, i) is the fit for matched hypothesis $H_m$, and LIK(D|Hu, i) is the fit for unmatched hypothesis $H_u$, and pc(i)=probability of crossover between SNPs i−1 and i. One may then calculate the full likelihood as:

$$LIK(D \mid H) = \sum_E LIK(D \mid E, 1{:}N)$$

where LIK(D|E, 1: N) is the likelihood of ending in hypothesis E, for SNPs 1:N. E=hypothesis of the last SNP, E ∈(Hm, Hu). Recursively, one may calculate:

LIK(D|E,1:i)=LIK(D|E,i)+log(exp(LIK(D|E,1:i−1))*
 (1−pc(i))+exp(LIK(D|~E,1:i−1))*pc(i))

where ~E is the hypothesis other than E (not E), where hypotheses considered are $H_m$ and $H_u$. In particular, one may calculate the likelihood of 1:i SNPs, based on likelihood of 1 to (i−1) SNPs with either the same hypothesis and no crossover, or the opposite hypothesis and a crossover, multiplied by the likelihood of the SNP i For SNP1,i=1,LIK(D|E,1:1)=LIK(D|E,1).

For SNP2,i=2,LIK(D|E,1:2)=LIK(D|E,2)+log(exp
 (LIK(D|E,1))*(1−pc(2))+exp(LIK(D|~E,1))*pc
 (2)), and so on for i=3:N.

In some embodiments, the child fraction may be determined. The child fraction may refer to the proportion of sequences in a mixture of DNA that originate from the child. In the context of non-invasive prenatal diagnosis, the child fraction may refer to the proportion of sequences in the maternal plasma that originate from the fetus or the portion of the placenta with fetal genotype. It may refer to the child fraction in a sample of DNA that has been prepared from the maternal plasma, and may be enriched in fetal DNA. One purpose of determining the child fraction in a sample of DNA is for use in an algorithm that can make ploidy calls on the fetus, therefore, the child fraction could refer to whatever sample of DNA was analyzed by sequencing for the purpose of non-invasive prenatal diagnosis.

Some of the algorithms presented in this disclosure that are part of a method of non-invasive prenatal aneuploidy diagnosis assume a known child fraction, which may not always the case. In an embodiment, it is possible to find the most likely child fraction by maximizing the likelihood for disomy on selected chromosomes, with or without the presence of the parental data In particular, suppose that LIK(D| H11, cf, chr)=log likelihood as described above, for the disomy hypothesis, and for child fraction cf on chromosome chr. For selected chromosomes in Cset (usually 1:16), assumed to be euploid, the full likelihood is:

LIK(cf)=$\Sigma_{chr \in Cset}$Lik(D|H11,cf,chr)

The most likely child fraction (cf*) is derived as $$cf^* = \underset{cf}{\operatorname{argmax}} LIK(cf).$$

It is possible to use any set of chromosomes. It is also possible to derive child fraction without assuming euploidy on the reference chromosomes. Using this method it is possible to determine the child fraction for any of the following situations: (1) one has array data on the parents and shotgun sequencing data on the maternal plasma; (2) one has array data on the parents and targeted sequencing data on the maternal plasma; (3) one has targeted sequencing data on both the parents and maternal plasma; (4) one has targeted sequencing data on both the mother and the maternal plasma fraction; (5) one has targeted sequencing data on the maternal plasma fraction; (6) other combinations of parental and child fraction measurements.

In some embodiments the informatics method may incorporate data dropouts; this may result in ploidy determinations of higher accuracy. Elsewhere in this disclosure it has been assumed that the probability of getting an A is a direct function of the true mother genotype, the true child genotype, the fraction of the child in the mixture, and the child copy number. It is also possible that mother or child alleles can drop out, for example instead of measuring true child AB in the mixture, it may be the case that only sequences mapping to allele A are measured. One may denote the parent dropout rate for genomic Illumina data $d_{pg}$, parent dropout rate for sequence data $d_{ps}$ and child dropout rate for sequence data $d_{cs}$. In some embodiments, the mother dropout rate may be assumed to be zero, and child dropout rates are relatively low; in this case, the results are not severely affected by dropouts. In some embodiments the possibility of allele dropouts may be sufficiently large that they result in a significant effect of the predicted ploidy call. For such a case, allele dropouts have been incorporated into the algorithm here:

Parent SNP array data dropouts: For mother genomic data M, suppose that the genotype after the dropout is md, then $$P(M \mid m, i) = \sum_{m_d} P(M \mid m_d, i) P(m_d \mid m)$$

$$\text{where } P(M \mid m_d, i) = \begin{cases} 1 & m_i = m_d \\ 0 & m_i \neq m_d \end{cases}$$

as before, and P ($m_d$|m) is the likelihood of genotype $m_d$ after the possible dropout given the true genotype m, defined as below, for dropout rate d

| | md | | | | | |
|---|---|---|---|---|---|---|
| m | AA | AB | BB | A | B | nocall |
| AA | (1−d)^2 | 0 | 0 | 2d(1−d) | 0 | d^2 |
| AB | 0 | (1−d)^2 | 0 | d(1−d) | d(1−d) | d^2 |
| BB | 0 | 0 | (1−d)^2 | 0 | 2d(1−d) | d^2 |

A similar equation applies for father SNP array data.
Parent sequence data dropouts: For mother sequence data SM $$P(SM \mid m, i) = \sum_{m_d} P_{X \mid m_d}(am_i) P(m_d \mid m)$$

where P ($m_d|m$) is defined as in previous section and $P_{X|m_d}$ ($am_i$) probability from a binomial distribution is defined as before in the parent data likelihood section. A similar equation applies to the paternal sequence data.

Free floating DNA sequence data dropout:

$$P(S \mid m, c, H, cf, i) = \sum_{m_d, c_d} P(S \mid \mu(m_d, c_d, cf, H), i) P(m_d \mid m) P(c_d \mid c)$$

where $P(S|\mu(m_d, c_d, cf, H), i)$ is as defined in the section on free floating data likelihood.

In an embodiment, $p(m_d|M)$ is the probability of observed mother genotype $m_d$, given true mother genotype m, assuming dropout rate $d_{ps}$, and $p(c_d|c)$ is the probability of observed child genotype $c_d$, given true child genotype c, assuming dropout rate $d_{cs}$. If $nA_T$=number of A alleles in true genotype c, $nA_D$=number of A alleles in observed genotype $c_d$, where $nA_T \geq nA_D$, and similarly $nB_T$=number of B alleles in true genotype c, $nB_D$=number of B alleles in observed genotype $c_d$, where $nB_T \geq nB_D$ and d=dropout rate, then $$p(c_d \mid c) = \binom{nA_T}{nA_D} * d^{nA_T - nA_D} * (1-d)^{nA_D} * \binom{nB_T}{nB_D} * d^{nB_T - nB_D} * (1-d)^{nB_D}$$

In an embodiment, the informatics method may incorporate random and consistent bias. In an ideal word there is no per SNP consistent sampling bias or random noise (in addition to the binomial distribution variation) in the number of sequence counts. In particular, on SNP i, for mother genotype m, true child genotype c and child fraction cf, and X=the number of A's in the set of (A+B) reads on SNP i, X acts like a X~Binomial(p, A+B), where p=$\mu$(m, c, cf, H)=true probability of A content.

In an embodiment, the informatics method may incorporate random bias. As is often the case, suppose that there is a bias in the measurements, so that the probability of getting an A on this SNP is equal to q, which is a bit different than p as defined above. How much different p is from q depends on the accuracy of the measurement process and number of other factors and can be quantified by standard deviations of q away from p. In an embodiment, it is possible to model q as having a beta distribution, with parameters α, β depending on the mean of that distribution being centered at p, and some specified standard deviation s. In particular, this gives X|q~Bin(q, $D_i$), where q~Beta(α, β). If we let E(q)=p, V (q)=$s^2$, and parameters α, β can be derived as α=pN, β=(1−p)N, where $$N = \frac{p(1-p)}{s^2} - 1.$$

This is the definition of a beta-binomial distribution, where one is sampling from a binomial distribution with variable parameter q, where q follows a beta distribution with mean p. So, in a setup with no bias, on SNP i, the parent sequence data (SM) probability assuming true mother genotype (m), given mother sequence A count on SNP i ($am_i$) and mother sequence B count on SNP i ($bm_i$) may be calculated as:

$P(SM|m,i)=P_{X|m}(am_i)$ where $X|m$~Binom($p_m(A), am_i+bm_i$)

Now, including random bias with standard deviation s, this becomes:

$X|m$~BetaBinom($p_m(A), am_i+bm_i, s$)

In the case with no bias, the maternal plasma DNA sequence data (S) probability assuming true mother genotype (m), true child genotype (c), child fraction (cf), assuming child hypothesis H, given free floating DNA sequence A count on SNP i ($a_i$) and free floating sequence B count on SNP i ($b_i$) may be calculated as $P(S|m,c,cf,H,i)=P_x(a_i)$ where $X$~Binom(p(A), $a_i+b_i$) with $\mu$(A)=c, cf, H).

In an embodiment, including random bias with standard deviation s, this becomes $X$~BetaBinom(p(A), $a_i+b_i$, s), where the amount of extra variation is specified by the deviation parameter s, or equivalently N. The smaller the value of s (or the larger the value of N) the closer this distribution is to the regular binomial distribution. It is possible to estimate the amount of bias, i.e. estimate N above, from unambiguous contexts AA|AA, BB|BB, AA|BB, BB|AA and use estimated N̂ in the above probability. Depending on the behavior of the data, N may be made to be a constant irrespective of the depth of read $a_i+b_i$, or a function of $a_i+b_i$, making bias smaller for larger depths of read.

In an embodiment, the informatics method may incorporate consistent per-SNP bias. Due to artifacts of the sequencing process, some SNPs may have consistently lower or higher counts irrespective of the true amount of A content. Suppose that SNP i consistently adds a bias of $w_i$ percent to the number of A counts. In some embodiments, this bias can be estimated from the set of training data derived under same conditions, and added back in to the parent sequence data estimate as:

$P(SM|m,i)=P_{X|m}(am_i)$ where $X|m$~BetaBinom($p_m(A)+w_i, am_i+bm_i, s$)

and with the free floating DNA sequence data probability estimate as:

$P(S|m,c,cf,H,i)=P_x(a_i)$ where $X$~BetaBinom($p(A)+w_i, a_i+b_i, s$),

In some embodiments, the method may be written to specifically take into account additional noise, differential sample quality, differential SNP quality, and random sampling bias. An example of this is given here. This method has been shown to be particularly useful in the context of data generated using the massively multiplexed mini-PCR protocol, and was used in Examples 7 through 13. The method involves several steps that each introduce different kind of noise and/or bias to the final model:

Suppose the first sample that comprises a mixture of maternal and fetal DNA contains an original amount of DNA of size=$N_0$ molecules, usually in the range 1,000-40,000, where p=true % refs In the amplification using the universal ligation adaptors, assume that $N_1$ molecules are sampled; usually $N_1$~$N_0$/2 molecules and random sampling bias is introduced due to sampling. The amplified sample may contain a number of molecules $N_2$ where $N_2 \gg N_1$. Let $X_1$ represent the amount of reference loci (on per SNP basis) out of $N_1$ sampled molecules, with a variation in $p_1=X_1/N_1$ that introduces random sampling bias throughout the rest of protocol. This sampling bias is included in the model by using a Beta-Binomial (BB) distribution instead of using a simple Binomial distribution model. Parameter N of the Beta-Binomial distribution may be estimated later on per sample basis from training data after adjusting for leakage and amplification bias, on SNPs with 0<p<1. Leakage is the tendency for a SNP to be read incorrectly.

The amplification step will amplify any allelic bias, thus amplification bias introduced due to possible uneven amplification. Suppose that one allele at a locus is amplified f times another allele at that locus is amplified g times, where $f=ge^b$, where b=0 indicates no bias. The bias parameter, b, is centered at 0, and indicates how much more or less the A allele get amplified as opposed to the B allele on a particular SNP. The parameter b may differ from SNP to SNP. Bias parameter b may be estimated on per SNP basis, for example from training data.

The sequencing step involves sequencing a sample of amplified molecules. In this step there may be leakage, where leakage is the situation where a SNP is read incorrectly. Leakage may result from any number of problems, and may result in a SNP being read not as the correct allele A, but as another allele B found at that locus or as an allele C or D not typically found at that locus. Suppose the sequencing measures the sequence data of a number of DNA molecules from an amplified sample of size $N_3$, where $N_3 < N_2$. In some embodiments, $N_3$ may be in the range of 20,000 to 100,000; 100,000 to 500,000; 500,000 to 4,000,000; 4,000,000 to 20,000,000; or 20,000,000 to 100,000,000. Each molecule sampled has a probability $p_g$ of being read correctly, in which case it will show up correctly as allele A. The sample will be incorrectly read as an allele unrelated to the original molecule with probability $1-p_g$, and will look like allele A with probability $p_r$, allele B with probability $p_m$ or allele C or allele D with probability $p_o$, where $p_r+p_m+p_o=1$. Parameters $p_g$, $p_r$, $p_m$, $p_o$ are estimated on per SNP basis from the training data.

Different protocols may involve similar steps with variations in the molecular biology steps resulting in different amounts of random sampling, different levels of amplification and different leakage bias. The following model may be equally well applied to each of these cases. The model for the amount of DNA sampled, on per SNP basis, is given by:

$$X_3 \sim \text{BetaBinomial}(L(F(p,b),p_r,p_g), N^*H(p,b))$$

where p=the true amount of reference DNA, b=per SNP bias, and as described above, $p_g$ is the probability of a correct read, $p_r$ is the probability of read being read incorrectly but serendipitously looking like the correct allele, in case of a bad read, as described above, and:

$$F(p,b)=pe^b/(pe^b+(1-p)), H(p,b)=(e^b p+(1-p))^2/e^b, L(p,p_r,p_g)=p^*p_g+p_r^*(1-p_g).$$

In some embodiments, the method uses a Beta-Binomial distribution instead of a simple binomial distribution; this takes care of the random sampling bias. Parameter N of the Beta-Binomial distribution is estimated on per sample basis on an as needed basis. Using bias correction F(p,b), H(p,b), instead of just p, takes care of the amplification bias. Parameter b of the bias is estimated on per SNP basis from training data ahead of time.

In some embodiments the method uses leakage correction $L(p,p_r,p_g)$, instead of just p; this takes care of the leakage bias, i.e. varying SNP and sample quality. In some embodiments, parameters $p_g$, $p_r$, $p_o$ are estimated on per SNP basis from the training data ahead of time. In some embodiments, the parameters $p_g$, $p_r$, $p_o$ may be updated with the current sample on the go, to account for varying sample quality.

The model described herein is quite general and can account for both differential sample quality and differential SNP quality. Different samples and SNPs are treated differently, as exemplified by the fact that some embodiments use Beta-Binomial distributions whose mean and variance are a function of the original amount of DNA, as well as sample and SNP quality.

Platform Modeling

Consider a single SNP where the expected allele ratio present in the plasma is r (based on the maternal and fetal genotypes). The expected allele ratio is defined as the expected fraction of A alleles in the combined maternal and fetal DNA. For maternal genotype $g_m$ and child genotype $g_c$, the expected allele ratio is given by equation 1, assuming that the genotypes are represented as allele ratios as well.

$$r=fg_c+(1-f)g_m \qquad (1)$$

The observation at the SNP consists of the number of mapped reads with each allele present, $n_a$ and $n_b$, which sum to the depth of read d. Assume that thresholds have already been applied to the mapping probabilities and phred scores such that the mappings and allele observations can be considered correct. A phred score is a numerical measure that relates to the probability that a particular measurement at a particular base is wrong. In an embodiment, where the base has been measured by sequencing, the phred score may be calculated from the ratio of the dye intensity corresponding to the called base to the dye intensity of the other bases. The simplest model for the observation likelihood is a binomial distribution which assumes that each of the d reads is drawn independently from a large pool that has allele ratio r. Equation 2 describes this model.

$$P(n_a, n_b \mid r) = p_{bino}(n_a; n_a+n_b, r) = \binom{n_a+n_b}{n_a} r^{n_a}(1-r)^{n_b} \qquad (2)$$

The binomial model can be extended in a number of ways. When the maternal and fetal genotypes are either all A or all B, the expected allele ratio in plasma will be 0 or 1, and the binomial probability will not be well-defined. In practice, unexpected alleles are sometimes observed in practice. In an embodiment, it is possible to use a corrected allele ratio $\hat{r}=1/(n_a+n_b)$ to allow a small number of the unexpected allele. In an embodiment, it is possible to use training data to model the rate of the unexpected allele appearing on each SNP, and use this model to correct the expected allele ratio. When the expected allele ratio is not 0 or 1, the observed allele ratio may not converge with a sufficiently high depth of read to the expected allele ratio due to amplification bias or other phenomena. The allele ratio can then be modeled as a beta distribution centered at the expected allele ratio, leading to a beta-binomial distribution for $P(n_a, n_b \mid r)$ which has higher variance than the binomial.

The platform model for the response at a single SNP will be defined as $F(a, b, g_c, g_m, f)$ (3), or the probability of observing $n_a=a$ and $n_b=b$ given the maternal and fetal genotypes, which also depends on the fetal fraction through equation 1. The functional form of F may be a binomial distribution, beta-binomial distribution, or similar functions as discussed above.

$$F(a,b,g_c,g_m,f)=P(n_a=a,n_b=b \mid g_c,g_m,f)=P(n_a=a,n_b=b \mid r(g_c,g_m,f)) \qquad (3)$$

In an embodiment, the child fraction may be determined as follows. A maximum likelihood estimate of the fetal fraction f for a prenatal test may be derived without the use of paternal information. This may be relevant where the paternal genetic data is not available, for example where the father of record is not actually the genetic father of the fetus. The fetal fraction is estimated from the set of SNPs where the maternal genotype is 0 or 1, resulting in a set of only two possible fetal genotypes. Define $S_0$ as the set of SNPs with maternal genotype 0 and $S_1$ as the set of SNPs with maternal genotype 1. The possible fetal genotypes on $S_0$ are 0 and 0.5, resulting in a set of possible allele ratios $R_0(f)=\{0, f/2\}$. Similarly, $R_1(f)=\{1-f/2, 1\}$. This method can be trivially extended to include SNPs where maternal genotype is 0.5, but these SNPs will be less informative due to the larger set of possible allele ratios.

Define $N_{a0}$ and $N_{b0}$ as the vectors formed by $n_{as}$ and $n_{bs}$ for SNPs s in $S_0$, and $N_{a1}$ and $N_{b1}$ similarly for $S_1$. The maximum likelihood estimate $\hat{f}$ off is defined by equation 4.

$$\hat{f} = \arg\max_f P(N_{a0}, N_{b0}|f) P(N_{a1}, N_{b1}|f) \quad (4)$$

Assuming that the allele counts at each SNP are independent conditioned on the SNP's plasma allele ratio, the probabilities can be expressed as products over the SNPs in each set (5).

$$P(N_{a0}, N_{b0}|f) = \Pi_{s \in S_0} P(n_{as}, n_{bs}|f) \quad (5)$$

$$P(N_{a1}, N_{b1}|f) = \Pi_{s \in S_1} P(n_{as}, n_{bs}|f)$$

The dependence on f is through the sets of possible allele ratios $R_0(f)$ and $R_1(f)$. The SNP probability $P(n_{as}, n_{bs}|f)$ can be approximated by assuming the maximum likelihood genotype conditioned on f. At reasonably high fetal fraction and depth of read, the selection of the maximum likelihood genotype will be high confidence. For example, at fetal fraction of 10 percent and depth of read of 1000, consider a SNP where the mother has genotype zero. The expected allele ratios are 0 and 5 percent, which will be easily distinguishable at sufficiently high depth of read. Substitution of the estimated child genotype into equation 5 results in the complete equation (6) for the fetal fraction estimate.

$$\hat{f} = \arg\max_f \left[ \prod_{s \in S_0} \left( \max_{r_s \in R_0(f)} P(n_{as}, n_{bs}|r_s) \right) \prod_{s \in S_1} \left( \max_{r_s \in R_1(f)} P(n_{as}, n_{bs}|r_s) \right) \right] \quad (6)$$

The fetal fraction must be in the range [0, 1] and so the optimization can be easily implemented by a constrained one-dimensional search.

In the presence of low depth of read or high noise level, it may be preferable not to assume the maximum likelihood genotype, which may result in artificially high confidences. Another method would be to sum over the possible genotypes at each SNP, resulting in the following expression (7) for $P(n_a, n_b|f)$ for a SNP in $S_0$. The prior probability $P(r)$ could be assumed uniform over $R_0(f)$, or could be based on population frequencies. The extension to group $S_1$ is trivial.

$$P(n_a, n_b|f) = \Sigma_{r \in R_0(f)} P(n_a, n_a|r) P(r) \quad (7)$$

In some embodiments the probabilities may be derived as follows. A confidence can be calculated from the data likelihoods of the two hypotheses $H_t$ and $H_f$. The likelihood of each hypothesis is derived based on the response model, the estimated fetal fraction, the mother genotypes, allele population frequencies, and the plasma allele counts.

Define the following notation:
$G_m$, $G_c$ true maternal and child genotypes
$G_{af}$, $G_{tf}$ true genotypes of alleged father and of true father
$G(g_c, g_m, g_{tf}) = P(G_c = g_c | G_m = g_m, G_{tf} = g_{tf})$ inheritance probabilities $P(g) = P(G_{tf} = g)$ population frequency of genotype g at particular SNP Assuming that the observation at each SNP is independent conditioned on the plasma allele ratio, the likelihood of a paternity hypothesis is the product of the likelihoods on the SNPs. The following equations derive the likelihood for a single SNP. Equation 8 is a general expression for the likelihood of any hypothesis h, which will then be broken down into the specific cases of $H_t$ and $H_f$.

$$P(n_a, n_b | h, G_m, G_{tf}, f) = \quad (8)$$

$$\sum_{g_c \in (0, 0.5, 1)} P(n_a, n_b | G_c = g_c, G_m, G_{tf}, h, f)$$

$$P(G_c = g_c, G_m, G_{tf}, h, f) =$$

$$\sum_{g_c \in (0, 0.5, 1)} P(n_a, n_b | G_c = g_c, G_m, f) P(G_c = g_c | G_m, G_{tf}, h) =$$

$$\sum_{g_c \in (0, 0.5, 1)} F(n_a, n_b, g_c, g_m, f) P(G_c = g_c | G_m, G_{tf}, h)$$

In the case of $H_t$, the alleged father is the true father and the fetal genotypes are inherited from the maternal genotypes and alleged father genotypes according to equation 9.

$$P(n_a, n_b | H_t, G_m, G_{tf}, f) = \quad (9)$$

$$\sum_{g_c \in (0, 0.5, 1)} F(n_a, n_b, g_c, g_m, f) P(G_c = g_c | G_m, G_{tf}, H_t) =$$

$$\sum_{g_c \in (0, 0.5, 1)} F(n_a, n_b, g_c, g_m, f) G(g_c, G_m, G_{tf})$$

In the case of $H_f$, the alleged father is not the true father. The best estimate of the true father genotypes are given by the population frequencies at each SNP. Thus, the probabilities of child genotypes are determined by the known mother genotypes and the population frequencies, as in equation 10.

$$P(n_a, n_b | H_t, G_{tf}, f) =$$

$$\sum_{g_c \in (0, 0.5, 1)} F(n_a, n_b, g_c, g_m, f) P(G_c = g_c | G_m, G_{tf}, H_f) =$$

$$\sum_{g_c \in (0, 0.5, 1)} F(n_a, n_b, g_c, g_m, f) P(G_c = g_c | G_m) =$$

$$\sum_{g_c \in (0, 0.5, 1)} \sum_{g_{tf} \in (0, 0.5, 1)} F(n_a, n_b, g_c, g_m, f)$$

$$P(G_c = g_c | G_m, G_{tf} = g_{tf}) P(G_{tf} = g_{tf}) =$$

$$\sum_{g_c \in (0, 0.5, 1)} \sum_{g_{tf} \in (0, 0.5, 1)} F(n_a, n_b, g_c, g_m, f) G(g_c, G_m, g_{tf}) P(g_{tf})$$

The confidence $C_p$ on correct paternity is calculated from the product over SNPs of the two likelihoods using Bayes rule (11).

$$Cp = \frac{\Pi_s P(n_{as}, n_{bs} | H_t, G_{ms}, G_{tf}, f)}{\Pi_s P(n_{as}, n_{bs} | H_t, G_{ms}, G_{tf}, f) + \Pi_s P(n_{as}, n_{bs} | H_f, G_{ms}, G_{tf}, f)} \quad (11)$$

Exemplary Methods for Identifying and Analyzing Multiple Pregnancies

In some embodiments, any of the methods of the present invention are used to detect the presence of a multiple pregnancy, such as a twin pregnancy, where at least one of the fetuses is genetically different from at least one other fetus. In some embodiments, fraternal twins are identified based on the presence of two fetus with different allele, different allele ratios, or different allele distributions at some (or all) of the tested loci. In some embodiments, fraternal twins are identified by determining the expected allele ratio at each locus (such as SNP loci) for two fetuses that may have the same or different fetal fractions in the sample (such as a plasma sample). In some embodiments, the likelihood of a particular pair of fetal fractions (where f1 is the fetal fraction for fetus 1, and f2 is the fetal fraction for fetus 2) is calculated by considering some or all of the possible genotypes of the two fetuses, conditioned on the mother's genotype and genotype population frequencies. The mixture of two fetal and one maternal genotype, combined with the fetal fractions, determine the expected allele ratio at a SNP. For example, if the mother is AA, fetus 1 is AA, and fetus 2 is AB, the overall fraction of B allele at the SNP is one-half of f2. The likelihood calculation asks how well all of the SNPs together match the expected allele ratios based on all of the possible combinations of fetal genotypes. The fetal fraction pair (f1, f2) that best matches the data is selected. It is not necessary to calculated specific genotypes of the fetuses; instead, one can, for example, considered all of the possible genotypes in a statistical combination. In some embodiments, if the method does not distinguish between singleton and identical twins, an ultrasound can be performed to determine whether there is a singleton or identical twin pregnancy. If the ultrasound detects a twin pregnancy it can be assumed that the pregnancy is an identical twin pregnancy because a fraternal twin pregnancy would have been detected based on the SNP analysis discussed above.

In some embodiments, a pregnant mother is known to have a multiple pregnancy (such as a twin pregnancy) based on prior testing, such as an ultrasound. Any of the methods of the present invention can be used to determine whether the multiple pregnancy includes identical or fraternal twins. For example, the measured allele ratios can be compared to what would be expected for identical twins (the same allele ratios as a singleton pregnancy) or for fraternal twins (such as the calculation of allele ratios as described above). Some identical twins are monochorionic twins, which have a risk of twin-to-twin transfusion syndrome. Thus, twins determined to be identical twins using a method of the invention are desirably tested (such as by ultrasound) to determine if they are monochorionic twins, and if so, these twins can be monitored (such as bi-weekly ultrasounds from 16 weeks) for signs of win-to-twin transfusion syndrome.

In some embodiments, any of the methods of the present invention are used to determine whether any of the fetuses in a multiple pregnancy, such as a twin pregnancy, are aneuploid. Aneuploidy testing for twins begins with the fetal fraction estimate. In some embodiments, the fetal fraction pair (f1, f2) that best matches the data is selected as described above. In some embodiments, a maximum likelihood estimate is performed for the parameter pair (f1, f2) over the range of possible fetal fractions. In some embodiments, the range of f2 is from 0 to f1 because f2 is defined as the smaller fetal fraction. Given a pair (f1, f2), data likelihood is calculated from the allele ratios observed at a set of loci such as SNP loci. In some embodiments, the data likelihood reflects the genotypes of the mother, the father if available, population frequencies, and the resulting probabilities of fetal genotypes. In some embodiments, SNPs are assumed independent. The estimated fetal fraction pair is the one that produces the highest data likelihood. If f2 is 0 then the data is best explained by only one set of fetal genotypes, indicating identical twins, where f1 is the combined fetal fraction. Otherwise f1 and f2 are the estimates of the individual twin fetal fractions. Having established the best estimate of (f1, f2), one can predict the overall fraction of B allele in the plasma for any combination of maternal and fetal genotypes, if desired. It is not necessary to assign individual sequence reads to the individual fetuses. Ploidy testing is performed using another maximum likelihood estimate which compares the data likelihood of two hypotheses. In some embodiments for identical twins, one consider the hypotheses (i) both twins are euploid, and (ii) both twins are trisomic. In some embodiments for fraternal twins, one considers the hypotheses (i) both twins are euploid and (ii) at least one twin is trisomic. The trisomy hypotheses for fraternal twins are based on the lower fetal fraction, since a trisomy in the twin with a higher fetal fraction would also be detected. Ploidy likelihoods are calculated using a method which predicts the expected number of reads at each targeted genome locus conditioned on either the disomy or trisomy hypothesis. There is no requirement for a disomy reference chromosome. The variance model for the expected number of reads takes into account the performance of individual target loci as well as the correlation between loci (see, for example, U.S. Ser. No. 62/008,235, filed Jun. 5, 2014, and U.S. Ser. No. 62/032,785, filed Aug. 4, 2014, which are each hereby incorporated by reference in its entirety). If the smaller twin has fetal fraction f1, our ability to detect a trisomy in that twin is equivalent to our ability to detect a trisomy in a singleton pregnancy at the same fetal fraction. This is because the part of the method that detects the trisomy in some embodiments does not depend on genotypes and does not distinguish between multiple or singleton pregnancy. It simply looks for an increased number of reads in accordance with the determined fetal fraction.

In some embodiments, the method includes detecting the presence of twins based on SNP loci (such as described above). If twins are detected, SPNs are used to determine the fetal fraction of each fetus (f1, f2) such as described above. In some embodiments, samples that have high confidence disomy calls are used to determine the amplification bias on a per-SNP basis. In some embodiments, these samples with high confidence disomy calls are analyzed in the same run as one or more samples of interest. In some embodiments, the amplification bias on a per-SNP basis is used to model the distribution of reads for one or more chromosomes or chromosome segments of interest such as chromosome 21 that are expected or the disomy hypothesis and the trisomy hypothesis given the lower of the two twin fetal fraction. The likelihood or probability of disomy or trisomy is calculated given the two models and the measured quantity of the chromosome or chromosome segment of interest.

In some embodiments, the threshold for a positive aneuploidy call (such as a trisomy call) is set based on the twin with the lower fetal fraction. This way, if the other twin is positive, or if both are positive, the total chromosome representation is definitely above the threshold.

Maximum Likelihood Model Using Percent Fetal Fraction

Determining the ploidy status of a fetus by measuring the free floating DNA contained in maternal serum, or by measuring the genotypic material in any mixed sample, is a non-trivial exercise. There are a number of methods, for example, performing a read count analysis where the presumption is that if the fetus is trisomic at a particular chromosome, then the overall amount of DNA from that chromosome found in the maternal blood will be elevated with respect to a reference chromosome. One way to detect trisomy in such fetuses is to normalize the amount of DNA expected for each chromosome, for example, according to the number of SNPs in the analysis set that correspond to a given chromosome, or according to the number of uniquely mappable portions of the chromosome. Once the measurements have been normalized, any chromosomes for which the amount of DNA measured exceeds a certain threshold are determined to be trisomic. This approach is described in Fan, et al. PNAS, 2008; 105(42); pp. 16266-16271, and also in Chiu et al. BMJ 2011; 342:c7401. In the Chiu et al. paper, the normalization was accomplished by calculating a Z score as follows:

Z score for percentage chromosome 21 in test case=
((percentage chromosome 21 in test case)−
(mean percentage chromosome 21 in reference controls))/(standard deviation of percentage chromosome 21 in reference controls).

These methods determine the ploidy status of the fetus using a single hypothesis rejection method. However, they suffer from some significant shortcomings. Since these methods for determining ploidy in the fetus are invariant according to the percentage of fetal DNA in the sample, they use one cut off value; the result of this is that the accuracies of the determinations are not optimal, and those cases where the percentage of fetal DNA in the mixture are relatively low will suffer the worst accuracies.

In an embodiment, a method of the present disclosure is used to determine the ploidy state of the fetus involves taking into account the fraction of fetal DNA in the sample. In another embodiment of the present disclosure, the method involves the use of maximum likelihood estimations. In an embodiment, a method of the present disclosure involves calculating the percent of DNA in a sample that is fetal or placental in origin. In an embodiment, the threshold for calling aneuploidy is adaptively adjusted based on the calculated percent fetal DNA. In some embodiments, the method for estimating the percentage of DNA that is of fetal origin in a mixture of DNA, comprises obtaining a mixed sample that comprises genetic material from the mother, and genetic material from the fetus, obtaining a genetic sample from the father of the fetus, measuring the DNA in the mixed sample, measuring the DNA in the father sample, and calculating the percentage of DNA that is of fetal origin in the mixed sample using the DNA measurements of the mixed sample, and of the father sample.

In an embodiment of the present disclosure, the fraction of fetal DNA, or the percentage of fetal DNA in the mixture can be measured. In some embodiments the fraction can be calculated using only the genotyping measurements made on the maternal plasma sample itself, which is a mixture of fetal and maternal DNA. In some embodiments the fraction may be calculated also using the measured or otherwise known genotype of the mother and/or the measured or otherwise known genotype of the father. In some embodiments the percent fetal DNA may be calculated using the measurements made on the mixture of maternal and fetal DNA along with the knowledge of the parental contexts. In an embodiment, the fraction of fetal DNA may be calculated using population frequencies to adjust the model on the probability on particular allele measurements.

In an embodiment of the present disclosure, a confidence may be calculated on the accuracy of the determination of the ploidy state of the fetus. In an embodiment, the confidence of the hypothesis of greatest likelihood ($H_{major}$) may be calculated as $(1-H_{major})/\Sigma(\text{all } H)$. It is possible to determine the confidence of a hypothesis if the distributions of all of the hypotheses are known. It is possible to determine the distribution of all of the hypotheses if the parental genotype information is known. It is possible to calculate a confidence of the ploidy determination if the knowledge of the expected distribution of data for the euploid fetus and the expected distribution of data for the aneuploid fetus are known. It is possible to calculate these expected distributions if the parental genotype data are known. In an embodiment one may use the knowledge of the distribution of a test statistic around a normal hypothesis and around an abnormal hypothesis to determine both the reliability of the call as well as refine the threshold to make a more reliable call. This is particularly useful when the amount and/or percent of fetal DNA in the mixture is low. It will help to avoid the situation where a fetus that is actually aneuploid is found to be euploid because a test statistic, such as the Z statistic does not exceed a threshold that is made based on a threshold that is optimized for the case where there is a higher percent fetal DNA.

In an embodiment, a method disclosed herein can be used to determine a fetal aneuploidy by determining the number of copies of maternal and fetal target chromosomes in a mixture of maternal and fetal genetic material. This method may entail obtaining maternal tissue comprising both maternal and fetal genetic material; in some embodiments this maternal tissue may be maternal plasma or a tissue isolated from maternal blood. This method may also entail obtaining a mixture of maternal and fetal genetic material from said maternal tissue by processing the aforementioned maternal tissue. This method may entail distributing the genetic material obtained into a plurality of reaction samples, to randomly provide individual reaction samples that comprise a target sequence from a target chromosome and individual reaction samples that do not comprise a target sequence from a target chromosome, for example, performing high throughput sequencing on the sample. This method may entail analyzing the target sequences of genetic material present or absent in said individual reaction samples to provide a first number of binary results representing presence or absence of a presumably euploid fetal chromosome in the reaction samples and a second number of binary results representing presence or absence of a possibly aneuploid fetal chromosome in the reaction samples. Either of the number of binary results may be calculated, for example, by way of an informatics technique that counts sequence reads that map to a particular chromosome, to a particular region of a chromosome, to a particular locus or set of loci. This method may involve normalizing the number of binary events based on the chromosome length, the length of the region of the chromosome, or the number of loci in the set. This method may entail calculating an expected distribution of the number of binary results for a presumably euploid fetal chromosome in the reaction samples using the first number. This method may entail calculating an expected distribution of the number of binary results for a presumably aneuploid fetal chromosome in the reaction samples using the first number and an estimated fraction of fetal DNA found in the mixture, for example, by multiplying the expected read count distribution of the number of binary results for a presumably euploid fetal chromosome by $(1+n/2)$ where n is the estimated fetal fraction. In some embodiments, the sequence reads may be treated at probabilistic mappings rather than binary results; this method would yield higher accuracies, but require more computing power. The fetal fraction may be estimated by a plurality of methods, some of which are described elsewhere in this disclosure. This method may involve using a maximum likelihood approach to determine whether the second number corresponds to the possibly aneuploid fetal chromosome being euploid or being aneuploid. This method may involve calling the ploidy status of the fetus to be the ploidy state that corresponds to the hypothesis with the maximum likelihood of being correct given the measured data.

Note that the use of a maximum likelihood model may be used to increase the accuracy of any method that determines the ploidy state of a fetus. Similarly, a confidence maybe calculated for any method that determines the ploidy state of the fetus. The use of a maximum likelihood model would result in an improvement of the accuracy of any method where the ploidy determination is made using a single hypothesis rejection technique. A maximum likelihood model may be used for any method where a likelihood distribution can be calculated for both the normal and abnormal cases. The use of a maximum likelihood model implies the ability to calculate a confidence for a ploidy call.

Further Discussion of the Method

In an embodiment, a method disclosed herein utilizes a quantitative measure of the number of independent observations of each allele at a polymorphic locus, where this does not involve calculating the ratio of the alleles. This is different from methods, such as some microarray based methods, which provide information about the ratio of two alleles at a locus but do not quantify the number of independent observations of either allele. Some methods known in the art can provide quantitative information regarding the number of independent observations, but the calculations leading to the ploidy determination utilize only the allele ratios, and do not utilize the quantitative information. To illustrate the importance of retaining information about the number of independent observations consider the sample locus with two alleles, A and B. In a first experiment twenty A alleles and twenty B alleles are observed, in a second experiment 200 A alleles and 200 B alleles are observed. In both experiments the ratio (A/(A+B)) is equal to 0.5, however the second experiment conveys more information than the first about the certainty of the frequency of the A or B allele. The instant method, rather than utilizing the allele ratios, uses the quantitative data to more accurately model the most likely allele frequencies at each polymorphic locus.

In an embodiment, the instant methods build a genetic model for aggregating the measurements from multiple polymorphic loci to better distinguish trisomy from disomy and also to determine the type of trisomy. Additionally, the instant method incorporates genetic linkage information to enhance the accuracy of the method. This is in contrast to some methods known in the art where allele ratios are averaged across all polymorphic loci on a chromosome. The method disclosed herein explicitly models the allele frequency distributions expected in disomy as well as and trisomy resulting from nondisjunction during meiosis I, nondisjunction during meiosis II, and nondisjunction during mitosis early in fetal development. To illustrate why this is important, if there were no crossovers nondisjunction during meiosis I would result a trisomy in which two different homologs were inherited from one parent; nondisjunction during meiosis II or during mitosis early in fetal development would result in two copies of the same homolog from one parent. Each scenario results in different expected allele frequencies at each polymorphic locus and also at all physically linked loci (i.e. loci on the same chromosome) considered jointly. Crossovers, which result in the exchange of genetic material between homologs, make the inheritance pattern more complex, but the instant method accommodates for this by using genetic linkage information, i.e. recombination rate information and the physical distance between loci. To better distinguish between meiosis I nondisjunction and meiosis II or mitotic nondisjunction the instant method incorporates into the model an increasing probability of crossover as the distance from the centromere increases. Meiosis II and mitotic nondisjunction can distinguished by the fact that mitotic nondisjunction typically results in identical or nearly identical copies of one homolog while the two homologs present following a meiosis II nondisjunction event often differ due to one or more crossovers during gametogenesis.

In an embodiment, a method of the present disclosure may not determine the haplotypes of the parents if disomy is assumed. In an embodiment, in case of trisomy, the instant method can make a determination about the haplotypes of one or both parents by using the fact that plasma takes two copies from one parent, and parent phase information can be determined by noting which two copies have been inherited from the parent in question. In particular, a child can inherit either two of the same copies of the parent (matched trisomy) or both copies of the parent (unmatched trisomy). At each SNP one can calculate the likelihood of the matched trisomy and of the unmatched trisomy. A ploidy calling method that does not use the linkage model accounting for crossovers would calculate the overall likelihood of the trisomy as a simple weighted average of the matched and unmatched trisomies over all chromosomes. However, due to the biological mechanisms that result in disjunction error and crossing over, trisomy can change from matched to unmatched (and vice versa) on a chromosome only if a crossover occurs. The instant method probabilistically takes into account the likelihood of crossover, resulting in ploidy calls that are of greater accuracy than those methods that do not.

In an embodiment, a reference chromosome is used to determine the child fraction and noise level amount or probability distribution. In an embodiment, the child fraction, noise level, and/or probability distribution is determined using only the genetic information available from the chromosome whose ploidy state is being determined. The instant method works without the reference chromosome, as well as without fixing the particular child fraction or noise level. This is a significant improvement and point of differentiation from methods known in the art where genetic data from a reference chromosome is necessary to calibrate the child fraction and chromosome behavior.

In an embodiment where a reference chromosome is not needed to determine the fetal fraction, determining the hypothesis is done as follows:

$$H^* = \underset{H}{\mathrm{argmax}} LIK(D \mid H) * priorprob(H)$$

With the algorithm with reference chromosome, one typically assumes that the reference chromosome is a disomy, and then one may either (a) fix the most likely child fraction and random noise level N based on this assumption and reference chromosome data:

$$[cfr^*, N^*] = \underset{cfr, N}{\mathrm{argmax}} LIK(D(ref.chrom) \mid H11, cfr, N)$$

And then reduce $$LIK(D|H)=LIK(D|H,cfr^*,N^*)$$

or (b) estimate the child fraction and noise level distribution based on this assumption and reference chromosome data. In particular, one would not fix just one value for cfr and N, but assign probability p(cfr, N) for the wider range of possible cfr, N values:

$$p(cfr,N) \sim LIK(D(\text{ref.chrom})|H11,cfr,N)^* \text{priorprob}(cfr, N)$$

where priorprob(cfr, N) is the prior probability of particular child fraction and noise level, determined by prior knowledge and experiments. If desired, just uniform over the range of cfr, N. One may then write:

$$LIK(D \mid H) = \sum_{cfr,N} LIK(D \mid H, cfr, N) * p(cfr, N)$$

Both methods above give good results.

Note that in some instances using a reference chromosome is not desirable, possible or feasible. In such a case, it is possible to derive the best ploidy call for each chromosome separately. In particular:

$$LIK(D \mid H) = \sum_{cfr,N} LIK(D \mid H, cfr, N) * p(cfr, N \mid H)$$

p(cfr, N|H) may be determined as above, for each chromosome separately, assuming hypothesis H, not just for the reference chromosome assuming disomy. It is possible, using this method, to keep both noise and child fraction parameters fixed, fix either of the parameters, or keep both parameters in probabilistic form for each chromosome and each hypothesis.

Measurements of DNA are noisy and/or error prone, especially measurements where the amount of DNA is small, or where the DNA is mixed with contaminating DNA. This noise results in less accurate genotypic data, and less accurate ploidy calls. In some embodiments, platform modeling or some other method of noise modeling may be used to counter the deleterious effects of noise on the ploidy determination. The instant method uses a joint model of both channels, which accounts for the random noise due to the amount of input DNA, DNA quality, and/or protocol quality.

This is in contrast to some methods known in the art where the ploidy determinations are made using the ratio of allele intensities at a locus. This method precludes accurate SNP noise modeling. In particular, errors in the measurements typically do not specifically depend on the measured channel intensity ratio, which reduces the model to using one-dimensional information. Accurate modeling of noise, channel quality and channel interaction requires a two-dimensional joint model, which can not be modeled using allele ratios.

In particular, projecting two channel information to the ratio r where f(x,y) is r=x/y, does not lend itself to accurate channel noise and bias modeling. Noise on a particular SNP is not a function of the ratio, i.e. noise(x,y)≠f(x,y) but is in fact a joint function of both channels. For example, in the binomial model, noise of the measured ratio has a variance of r(1−r)/(x+y) which is not a function purely of r. In such a model, where any channel bias or noise is included, suppose that on SNP i, the observed channel X value is $x=a_iX+b_i$, where X is the true channel value, $b_i$ is the extra channel bias and random noise. Similarly, suppose that $y=c_iY+d_i$. The observed ratio r=x/y can not accurately predict the true ratio X/Y or model the leftover noise, since (aiX+bi)/(ciY+di) is not a function of X/Y.

The method disclosed herein describes an effective way to model noise and bias using joint binomial distributions of all of the measurement channels individually. Relevant equations may be found elsewhere in the document in sections which speaks of per SNP consistent bias, P(good) and P(reflbad), P(mutlbad) which effectively adjust SNP behavior. In an embodiment, a method of the present disclosure uses a BetaBinomial distribution, which avoids the limiting practice of relying on the allele ratios only, but instead models the behavior based on both channel counts.

In an embodiment, a method disclosed herein can call the ploidy of a gestating fetus from genetic data found in maternal plasma by using all available measurements. In an embodiment, a method disclosed herein can call the ploidy of a gestating fetus from genetic data found in maternal plasma by using the measurements from only a subset of parental contexts. Some methods known in the art only use measured genetic data where the parental context is from the AA|BB context, that is, where the parents are both homozygous at a given locus, but for a different allele. One problem with this method is that a small proportion of polymorphic loci are from the AA|BB context, typically less than 10%. In an embodiment of a method disclosed herein, the method does not use genetic measurements of the maternal plasma made at loci where the parental context is AA|BB. In an embodiment, the instant method uses plasma measurements for only those polymorphic loci with the AA|AB, AB|AA, and AB|AB parental context.

Some methods known in the art involve averaging allele ratios from SNPs in the AA|BB context, where both parent genotypes are present, and claim to determine the ploidy calls from the average allele ratio on these SNPs. This method suffers from significant inaccuracy due differential SNP behavior. Note that this method assumes that have both parent genotypes are known. In contrast, in some embodiments, the instant method uses a joint channel distribution model that does not assume the presence of either of the parents, and does not assume the uniform SNP behavior. In some embodiments, the instant method accounts for the different SNP behavior/weighing. In some embodiments, the instant method does not require the knowledge of one or both parental genotypes. An example of how the instant method may accomplish this follows:

In some embodiments, the log likelihood of a hypothesis may be determined on a per SNP basis. On a particular SNP i, assuming fetal ploidy hypothesis H and percent fetal DNA cf, the log likelihood of observed data D is defined as:

$$LIK(D \mid H, i) = \log P(D \mid H, cf, i) = \\ \log\left(\sum_{m,f,c} P(D \mid m, f, c, H, cf, i)P(c \mid m, f, H)P(m \mid i)P(f \mid i)\right)$$

where m are possible true mother genotypes, f are possible true father genotypes, where m,f ∈{AA,AB,BB}, and where c are possible child genotypes given the hypothesis H. In particular, for monosomy c {A, B}, for disomy c ∈{AA, AB, BB}, for trisomy c ∈{AAA, AAB, ABB, BBB}. Note that including parental genotypic data typically results in more accurate ploidy determinations, however, parental genotypic data is not necessary for the instant method to work well.

Some methods known in the art involve averaging allele ratios from SNPs where the mother is homozygous but a different allele is measured in the plasma (either AA|AB or AA|BB contexts), and claim to determine the ploidy calls from the average allele ratio on these SNPs. This method is intended for cases where the paternal genotype is not available. Note that it is questionable how accurately one can claim that plasma is heterozygous on a particular SNP without the presence of homozygous and opposite father BB: for cases with low child fraction, what looks like presence of B allele could be just presence of noise; additionally, what looks like no B present could be simple allele drop out of the fetal measurements. Even in a case where one can actually determine heterozygosity of the plasma, this method will not be able to distinguish paternal trisomies. In particular, for SNPs where mother is AA, and where some B is measured in the plasma, if the father is GG, the resulting child genotype is AGG, resulting in an average ratio of 33% A (for child fraction=100%). But in the case where the father is AG, the resulting child genotype could be AGG for matched trisomy, contributing to the 33% A ratio, or AAG for unmatched trisomy, drawing the average ratio more toward 66% A. Given that many trisomies are on chromosomes with crossovers, the overall chromosome can have anywhere between no unmatched trisomy and all unmatched trisomy, this ratio can vary anywhere between 33-66%. For a plain disomy, the ratio should be around 50%. Without the use of a linkage model or an accurate error model of the average, this method would miss many cases of paternal trisomy. In contrast, the method disclosed herein assigns parental genotype probabilities for each parental genotypic candidate, based on available genotypic information and population frequency, and does not explicitly require parental genotypes. Additionally, the method disclosed herein is able to detect trisomy even in the absence or presence of parent genotypic data, and can compensate by identifying the points of possible crossovers from matched to unmatched trisomy using a linkage model.

Some methods known in the art claim a method for averaging allele ratios from SNPs where neither the maternal or paternal genotype is known, and for determining the ploidy calls from average ratio on these SNPs. However, a method to accomplish these ends is not disclosed. The method disclosed herein is able to make accurate ploidy calls in such a situation, and the reduction to practice is disclosed elsewhere in this document, using a joint probability maximum likelihood method and optionally utilizes SNP noise and bias models, as well as a linkage model.

Some methods known in the art involve averaging allele ratios and claim to determine the ploidy calls from the average allele ratio at one or a few SNPs. However, such methods do not utilize the concept of linkage. The methods disclosed herein do not suffer from these drawbacks.

Using Sequence Length as a Prior to Determine the Origin of DNA

It has been reported that the distribution of length of sequences differ for maternal and fetal DNA, with fetal generally being shorter. In an embodiment of the present disclosure, it is possible to use previous knowledge in the form of empirical data, and construct prior distribution for expected length of both mother($P(X|$ maternal)) and fetal DNA ($P(X|$ fetal)). Given new unidentified DNA sequence of length x, it is possible to assign a probability that a given sequence of DNA is either maternal or fetal DNA, based on prior likelihood of x given either maternal or fetal. In particular if $P(x|$maternal$)>P(x|$fetal$)$, then the DNA sequence can be classified as maternal, with $P(x|$maternal$)=P(x|$maternal$)/[(P(x|$maternal$)+P(x|$ fetal$)]$, and if $p(x|$maternal$)<p(x|$fetal$)$, then the DNA sequence can be classified as fetal, $P(x|$ fetal$)=P(x|$ fetal$)/[(P(x|$maternal$)+P(x|$ fetal$)]$. In an embodiment of the present disclosure, a distributions of maternal and fetal sequence lengths can be determined that is specific for that sample by considering the sequences that can be assigned as maternal or fetal with high probability, and then that sample specific distribution can be used as the expected size distribution for that sample.

Variable Read Depth to Minimize Sequencing Cost

In many clinical trials concerning a diagnostic, for example, in Chiu et al. BMJ 2011; 342:c7401, a protocol with a number of parameters is set, and then the same protocol is executed with the same parameters for each of the patients in the trial. In the case of determining the ploidy status of a fetus gestating in a mother using sequencing as a method to measure genetic material one pertinent parameter is the number of reads. The number of reads may refer to the number of actual reads, the number of intended reads, fractional lanes, full lanes, or full flow cells on a sequencer. In these studies, the number of reads is typically set at a level that will ensure that all or nearly all of the samples achieve the desired level of accuracy. Sequencing is currently an expensive technology, a cost of roughly $200 per 5 mappable million reads, and while the price is dropping, any method which allows a sequencing based diagnostic to operate at a similar level of accuracy but with fewer reads will necessarily save a considerable amount of money.

The accuracy of a ploidy determination is typically dependent on a number of factors, including the number of reads and the fraction of fetal DNA in the mixture. The accuracy is typically higher when the fraction of fetal DNA in the mixture is higher. At the same time, the accuracy is typically higher if the number of reads is greater. It is possible to have a situation with two cases where the ploidy state is determined with comparable accuracies wherein the first case has a lower fraction of fetal DNA in the mixture than the second, and more reads were sequenced in the first case than the second. It is possible to use the estimated fraction of fetal DNA in the mixture as a guide in determining the number of reads necessary to achieve a given level of accuracy.

In an embodiment of the present disclosure, a set of samples can be run where different samples in the set are sequenced to different reads depths, wherein the number of reads run on each of the samples is chosen to achieve a given level of accuracy given the calculated fraction of fetal DNA in each mixture. In an embodiment of the present disclosure, this may entail making a measurement of the mixed sample to determine the fraction of fetal DNA in the mixture; this estimation of the fetal fraction may be done with sequencing, it may be done with TAQMAN, it may be done with qPCR, it may be done with SNP arrays, it may be done with any method that can distinguish different alleles at a given loci. The need for a fetal fraction estimate may be eliminated by including hypotheses that cover all or a selected set of fetal fractions in the set of hypotheses that are considered when comparing to the actual measured data. After the fraction fetal DNA in the mixture has been determined, the number of sequences to be read for each sample may be determined.

In an embodiment of the present disclosure, 100 pregnant women visit their respective OB's, and their blood is drawn into blood tubes with an anti-lysant and/or something to inactivate DNAase. They each take home a kit for the father of their gestating fetus who gives a saliva sample. Both sets of genetic materials for all 100 couples are sent back to the laboratory, where the mother blood is spun down and the buffy coat is isolated, as well as the plasma. The plasma comprises a mixture of maternal DNA as well as placentally derived DNA. The maternal buffy coat and the paternal blood is genotyped using a SNP array, and the DNA in the maternal plasma samples are targeted with SURESELECT hybridization probes. The DNA that was pulled down with the probes is used to generate 100 tagged libraries, one for each of the maternal samples, where each sample is tagged with a different tag. A fraction from each library is withdrawn, each of those fractions are mixed together and added to two lanes of a ILLUMINA HISEQ DNA sequencer in a multiplexed fashion, wherein each lane resulted in approximately 50 million mappable reads, resulting in approximately 100 million mappable reads on the 100 multiplexed mixtures, or approximately 1 million reads per sample. The sequence reads were used to determine the fraction of fetal DNA in each mixture. 50 of the samples had more than 15% fetal DNA in the mixture, and the 1 million reads were sufficient to determine the ploidy status of the fetuses with a 99.9% confidence.

Of the remaining mixtures, 25 had between 10 and 15% fetal DNA; a fraction of each of the relevant libraries prepped from these mixtures were multiplexed and run down one lane of the HISEQ generating an additional 2 million reads for each sample. The two sets of sequence data for each of the mixture with between 10 and 15% fetal DNA were added together, and the resulting 3 million reads per sample which were sufficient to determine the ploidy state of those fetuses with 99.9% confidence.

Of the remaining mixtures, 13 had between 6 and 10% fetal DNA; a fraction of each of the relevant libraries prepped from these mixtures were multiplexed and run down one lane of the HISEQ generating an additional 4 million reads for each sample. The two sets of sequence data for each of the mixture with between 6 and 10% fetal DNA were added together, and the resulting 5 million total reads per mixture which were sufficient to determine the ploidy state of those fetuses with 99.9% confidence.

Of the remaining mixtures, 8 had between 4 and 6% fetal DNA; a fraction of each of the relevant libraries prepped from these mixtures were multiplexed and run down one lane of the HISEQ generating an additional 6 million reads for each sample. The two sets of sequence data for each of the mixture with between 4 and 6% fetal DNA were added together, and the resulting 7 million total reads per mixture which were sufficient to determine the ploidy state of those fetuses with 99.9% confidence.

Of the remaining four mixtures, all of them had between 2 and 4% fetal DNA; a fraction of each of the relevant libraries prepped from these mixtures were multiplexed and run down one lane of the HISEQ generating an additional 12 million reads for each sample. The two sets of sequence data for each of the mixture with between 2 and 4% fetal DNA were added together, and the resulting 13 million total reads per mixture which were sufficient to determine the ploidy state of those fetuses with 99.9% confidence.

This method required six lanes of sequencing on a HISEQ machine to achieve 99.9% accuracy over 100 samples. If the same number of runs had been required for every sample, to ensure that every ploidy determination was made with a 99.9% accuracy, it would have taken 25 lanes of sequencing, and if a no-call rate or error rate of 4% was tolerated, it could have been achieved with 14 lanes of sequencing.

Using Raw Genotyping Data

There are a number of methods that can accomplish NPD using fetal genetic information measured on fetal DNA found in maternal blood. Some of these methods involve making measurements of the fetal DNA using SNP arrays, some methods involve untargeted sequencing, and some methods involve targeted sequencing. The targeted sequencing may target SNPs, it may target STRs, it may target other polymorphic loci, it may target non-polymorphic loci, or some combination thereof. Some of these methods may involve using a commercial or proprietary allele caller that calls the identity of the alleles from the intensity data that comes from the sensors in the machine doing the measuring. For example, the ILLUMINA INFINIUM system or the AFFYMETRIX GENECHIP microarray system involves beads or microchips with attached DNA sequences that can hybridize to complementary segments of DNA; upon hybridization, there is a change in the fluorescent properties of the sensor molecule that can be detected. There are also sequencing methods, for example the ILLUMINA SOLEXA GENOME SEQUENCER or the ABI SOLID GENOME SEQUENCER, wherein the genetic sequence of fragments of DNA are sequenced; upon extension of the strand of DNA complementary to the strand being sequenced, the identity of the extended nucleotide is typically detected via a fluorescent or radio tag appended to the complementary nucleotide. In all of these methods the genotypic or sequencing data is typically determined on the basis of fluorescent or other signals, or the lack thereof. These systems are typically combined with low level software packages that make specific allele calls (secondary genetic data) from the analog output of the fluorescent or other detection device (primary genetic data). For example, in the case of a given allele on a SNP array, the software will make a call, for example, that a certain SNP is present or not present if the fluorescent intensity is measure above or below a certain threshold. Similarly, the output of a sequencer is a chromatogram that indicates the level of fluorescence detected for each of the dyes, and the software will make a call that a certain base pair is A or T or C or G. High throughput sequencers typically make a series of such measurements, called a read, that represents the most likely structure of the DNA sequence that was sequenced. The direct analog output of the chromatogram is defined here to be the primary genetic data, and the base pair/SNP calls made by the software are considered here to be the secondary genetic data. In an embodiment, primary data refers to the raw intensity data that is the unprocessed output of a genotyping platform, where the genotyping platform may refer to a SNP array, or to a sequencing platform. The secondary genetic data refers to the processed genetic data, where an allele call has been made, or the sequence data has been assigned base pairs, and/or the sequence reads have been mapped to the genome.

Many higher level applications take advantage of these allele calls, SNP calls and sequence reads, that is, the secondary genetic data, that the genotyping software produces. For example, DNA NEXUS, ELAND or MAQ will take the sequencing reads and map them to the genome. For example, in the context of non-invasive prenatal diagnosis, complex informatics, such as PARENTAL SUPPORT™, may leverage a large number of SNP calls to determine the genotype of an individual. Also, in the context of preimplantation genetic diagnosis, it is possible to take a set of sequence reads that are mapped to the genome, and by taking a normalized count of the reads that are mapped to each chromosome, or section of a chromosome, it may be possible to determine the ploidy state of an individual. In the context of non-invasive prenatal diagnosis it may be possible to take a set of sequence reads that have been measured on DNA present in maternal plasma, and map them to the genome. One may then take a normalized count of the reads that are mapped to each chromosome, or section of a chromosome, and use that data to determine the ploidy state of an individual. For example, it may be possible to conclude that those chromosomes that have a disproportionately large number of reads are trisomic in the fetus that is gestating in the mother from which the blood was drawn.

However, in reality, the initial output of the measuring instruments is an analog signal. When a certain base pair is called by the software that is associated with the sequencing software, for example the software may call the base pair a T, in reality the call is the call that the software believes to be most likely. In some cases, however, the call may be of low confidence, for example, the analog signal may indicate that the particular base pair is only 90% likely to be a T, and 10% likely to be an A. In another example, the genotype calling software that is associated with a SNP array reader may call a certain allele to be G. However, in reality, the underlying analog signal may indicate that it is only 70% likely that the allele is G, and 30% likely that the allele is T. In these cases, when the higher level applications use the genotype calls and sequence calls made by the lower level software, they are losing some information. That is, the primary genetic data, as measured directly by the genotyping platform, may be messier than the secondary genetic data that is determined by the attached software packages, but it contains more information. In mapping the secondary genetic data sequences to the genome, many reads are thrown out because some bases are not read with enough clarity and or mapping is not clear. When the primary genetic data sequence reads are used, all or many of those reads that may have been thrown out when first converted to secondary genetic data sequence read can be used by treating the reads in a probabilistic manner.

In an embodiment of the present disclosure, the higher level software does not rely on the allele calls, SNP calls, or sequence reads that are determined by the lower level software. Instead, the higher level software bases its calculations on the analog signals directly measured from the genotyping platform. In an embodiment of the present disclosure, an informatics based method such as PARENTAL SUPPORT™ is modified so that its ability to reconstruct the genetic data of the embryo/fetus/child is engineered to directly use the primary genetic data as measured by the genotyping platform. In an embodiment of the present disclosure, an informatics based method such as PARENTAL SUPPORT™ is able to make allele calls, and/or chromosome copy number calls using primary genetic data, and not using the secondary genetic data. In an embodiment of the present disclosure, all genetic calls, SNPs calls, sequence reads, sequence mapping is treated in a probabilistic manner by using the raw intensity data as measured directly by the genotyping platform, rather than converting the primary genetic data to secondary genetic calls. In an embodiment, the DNA measurements from the prepared sample used in calculating allele count probabilities and determining the relative probability of each hypothesis comprise primary genetic data.

In some embodiments, the method can increase the accuracy of genetic data of a target individual which incorporates genetic data of at least one related individual, the method comprising obtaining primary genetic data specific to a target individual's genome and genetic data specific to the genome(s) of the related individual(s), creating a set of one or more hypotheses concerning possibly which segments of which chromosomes from the related individual(s) correspond to those segments in the target individual's genome, determining the probability of each of the hypotheses given the target individual's primary genetic data and the related individual(s)'s genetic data, and using the probabilities associated with each hypothesis to determine the most likely state of the actual genetic material of the target individual. In some embodiments, the method can determining the number of copies of a segment of a chromosome in the genome of a target individual, the method comprising creating a set of copy number hypotheses about how many copies of the chromosome segment are present in the genome of a target individual, incorporating primary genetic data from the target individual and genetic information from one or more related individuals into a data set, estimating the characteristics of the platform response associated with the data set, where the platform response may vary from one experiment to another, computing the conditional probabilities of each copy number hypothesis, given the data set and the platform response characteristics, and determining the copy number of the chromosome segment based on the most probable copy number hypothesis. In an embodiment, a method of the present disclosure can determine a ploidy state of at least one chromosome in a target individual, the method comprising obtaining primary genetic data from the target individual and from one or more related individuals, creating a set of at least one ploidy state hypothesis for each of the chromosomes of the target individual, using one or more expert techniques to determine a statistical probability for each ploidy state hypothesis in the set, for each expert technique used, given the obtained genetic data, combining, for each ploidy state hypothesis, the statistical probabilities as determined by the one or more expert techniques, and determining the ploidy state for each of the chromosomes in the target individual based on the combined statistical probabilities of each of the ploidy state hypotheses. In an embodiment, a method of the present disclosure can determine an allelic state in a set of alleles, in a target individual, and from one or both parents of the target individual, and optionally from one or more related individuals, the method comprising obtaining primary genetic data from the target individual, and from the one or both parents, and from any related individuals, creating a set of at least one allelic hypothesis for the target individual, and for the one or both parents, and optionally for the one or more related individuals, where the hypotheses describe possible allelic states in the set of alleles, determining a statistical probability for each allelic hypothesis in the set of hypotheses given the obtained genetic data, and determining the allelic state for each of the alleles in the set of alleles for the target individual, and for the one or both parents, and optionally for the one or more related individuals, based on the statistical probabilities of each of the allelic hypotheses.

In some embodiments, the genetic data of the mixed sample may comprise sequence data wherein the sequence data may not uniquely map to the human genome. In some embodiments, the genetic data of the mixed sample may comprise sequence data wherein the sequence data maps to a plurality of locations in the genome, wherein each possible mapping is associated with a probability that the given mapping is correct. In some embodiments, the sequence reads are not assumed to be associated with a particular position in the genome. In some embodiments, the sequence reads are associated with a plurality of positions in the genome, and an associated probability belonging to that position.

Counting Method to Determine Chromosome Copy Number

In one aspect, the invention features methods of testing for an abnormal distribution of a fetal chromosome by comparing the number of sequence tags that align to different chromosomes (see, e.g., U.S. Pat. No. 8,296,076, filed Apr. 20, 2012, which is hereby incorporated by reference in its entirety). As is known in the art, the term "sequence tag" refers to a relatively short (e.g., 15-100) nucleic acid sequence that can be used to identify a certain larger sequence, e.g., be mapped to a chromosome or genomic region or gene. In some embodiments, the method involves (i) contacting a sample that includes a mixture of maternal and fetal DNA with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture; wherein the target loci are from a plurality of different chromosomes; and wherein the plurality of different chromosomes comprise at least one first chromosome suspected of having an abnormal distribution in the sample and at least one second chromosome presumed to be normally distributed in the sample; (ii) subjecting the reaction mixture to primer extension reaction conditions to produce amplified products; (iii) sequencing the amplified products to obtain a plurality of sequence tags aligning to the target loci; wherein the sequence tags are of sufficient length to be assigned to a specific target locus; (iv) assigning on a computer the plurality of sequence tags to their corresponding target loci; (v) determining on a computer a number of sequence tags aligning to the target loci of the first chromosome and a number of sequence tags aligning to the target loci of the second chromosome; and (vi) comparing the numbers from step (v) to determine the presence or absence of an abnormal distribution of the first chromosome.

In one aspect, the invention provides methods for detecting the presence or absence of a fetal aneuploidy by comparing the relative frequency of target amplicons between chromosomes (see, e.g., PCT Publ. No. WO 2012/103031, filed Jan. 23, 2012, which is hereby incorporated by reference in its entirety). In some embodiments, the method involves (i) contacting a sample that includes a mixture of maternal and fetal DNA with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different non-polymorphic target loci to produce a reaction mixture; wherein the target loci are from a plurality of different chromosomes; (ii) subjecting the reaction mixture to primer extension reaction conditions to produce amplified products that includes target amplicons; (iii) quantifying on a computer a relative frequency of the target amplicons from the first and second chromosomes of interest; (iv) comparing on a computer the relative frequency of the target amplicons from the first and second chromosomes of interest; and (v) identifying the presence or absence of an aneuploidy based on the compared relative frequencies of the first and second chromosome of interest. In some embodiments, the first chromosome is a chromosome suspected of being euploid. In some embodiments, the second chromosome is a chromosome suspected of being aneuploidy Combining Methods of Prenatal Diagnosis There are many methods that may be used for prenatal diagnosis or prenatal screening of aneuploidy or other genetic defects. Described elsewhere in this document, and in U.S. Utility application Ser. No. 11/603,406, filed Nov. 28, 2006; U.S. Utility application Ser. No. 12/076,348, filed Mar. 17, 2008, and PCT Application Serial No. PCT/S09/52730 is one such method that uses the genetic data of related individuals to increase the accuracy with which genetic data of a target individual, such as a fetus, is known, or estimated. Other methods used for prenatal diagnosis involve measuring the levels of certain hormones in maternal blood, where those hormones are correlated with various genetic abnormalities. An example of this is called the triple test, a test wherein the levels of several (commonly two, three, four or five) different hormones are measured in maternal blood. In a case where multiple methods are used to determine the likelihood of a given outcome, where none of the methods are definitive in and of themselves, it is possible to combine the information given by those methods to make a prediction that is more accurate than any of the individual methods. In the triple test, combining the information given by the three different hormones can result in a prediction of genetic abnormalities that is more accurate than the individual hormone levels may predict.

Disclosed herein is a method for making more accurate predictions about the genetic state of a fetus, specifically the possibility of genetic abnormalities in a fetus that comprises combining predictions of genetic abnormalities in a fetus where those predictions were made using a variety of methods. A "more accurate" method may refer to a method for diagnosing an abnormality that has a lower false negative rate at a given false positive rate. In a favored embodiment of the present disclosure, one or more of the predictions are made based on the genetic data known about the fetus, where the genetic knowledge was determined using the PARENTAL SUPPORT™ method, that is, using genetic data of individual related to the fetus to determine the genetic data of the fetus with greater accuracy. In some embodiments the genetic data may include ploidy states of the fetus. In some embodiments, the genetic data may refer to a set of allele calls on the genome of the fetus. In some embodiments some of the predictions may have been made using the triple test. In some embodiments, some of the predictions may have been made using measurements of other hormone levels in maternal blood. In some embodiments, predictions made by methods considered diagnoses may be combined with predictions made by methods considered screening. In some embodiments, the method involves measuring maternal blood levels of alpha-fetoprotein (AFP). In some embodiments, the method involves measuring maternal blood levels of unconjugated estriol ($UE_3$). In some embodiments, the method involves measuring maternal blood levels of beta human chorionic gonadotropin (beta-hCG). In some embodiments, the method involves measuring maternal blood levels of invasive trophoblast antigen (ITA). In some embodiments, the method involves measuring maternal blood levels of inhibin. In some embodiments, the method involves measuring maternal blood levels of pregnancy-associated plasma protein A (PAPP-A). In some embodiments, the method involves measuring maternal blood levels of other hormones or maternal serum markers. In some embodiments, some of the predictions may have been made using other methods. In some embodiments, some of the predictions may have been made using a fully integrated test such as one that combines ultrasound and blood test at around 12 weeks of pregnancy and a second blood test at around 16 weeks. In some embodiments, the method involves measuring the fetal nuchal translucency (NT). In some embodiments, the method involves using the measured levels of the aforementioned hormones for making predictions. In some embodiments the method involves a combination of the aforementioned methods.

There are many ways to combine the predictions, for example, one could convert the hormone measurements into a multiple of the median (MoM) and then into likelihood ratios (LR). Similarly, other measurements could be transformed into LRs using the mixture model of NT distributions. The LRs for NT and the biochemical markers could be multiplied by the age and gestation-related risk to derive the risk for various conditions, such as trisomy 21. Detection rates (DRs) and false-positive rates (FPRs) could be calculated by taking the proportions with risks above a given risk threshold.

In an embodiment, a method to call the ploidy state involves combining the relative probabilities of each of the ploidy hypotheses determined using the joint distribution model and the allele count probabilities with relative probabilities of each of the ploidy hypotheses that are calculated using statistical techniques taken from other methods that determine a risk score for a fetus being trisomic, including but not limited to: a read count analysis, comparing heterozygosity rates, a statistic that is only available when parental genetic information is used, the probability of normalized genotype signals for certain parent contexts, a statistic that is calculated using an estimated fetal fraction of the first sample or the prepared sample, and combinations thereof.

Another method could involve a situation with four measured hormone levels, where the probability distribution around those hormones is known: $p(x_1, x_2, x_3, x_4|e)$ for the euploid case and $p(x_1, x_2, x_3, x_4|a)$ for the aneuploid case. Then one could measure the probability distribution for the DNA measurements, $g(y|e)$ and $g(y|a)$ for the euploid and aneuploid cases respectively. Assuming they are independent given the assumption of euploid/aneuploid, one could combine as $p(x_1, x_2, x_3, x_4|a)g(y|a)$ and $p(x_1, x_2, x_3, x_4|e)g(y|e)$ and then multiply each by the prior $p(a)$ and $p(e)$ given the maternal age. One could then choose the one that is highest.

In an embodiment, it is possible to evoke central limit theorem to assume distribution on $g(y|a$ ore$)$ is Gaussian, and measure mean and standard deviation by looking at multiple samples. In another embodiment, one could assume they are not independent given the outcome and collect enough samples to estimate the joint distribution $p(x_1, x_2, x_3, x_4|a$ or $e)$.

In an embodiment, the ploidy state for the target individual is determined to be the ploidy state that is associated with the hypothesis whose probability is the greatest. In some cases, one hypothesis will have a normalized, combined probability greater than 90%. Each hypothesis is associated with one, or a set of, ploidy states, and the ploidy state associated with the hypothesis whose normalized, combined probability is greater than 90%, or some other threshold value, such as 50%, 80%, 95%, 98%, 99%, or 99.9%, may be chosen as the threshold required for a hypothesis to be called as the determined ploidy state.

DNA from Children from Previous Pregnancies in Maternal Blood

One difficulty to non-invasive prenatal diagnosis is differentiating fetal cells from the current pregnancy from fetal cells from previous pregnancies. Some believe that genetic matter from prior pregnancies will go away after some time, but conclusive evidence has not been shown. In an embodiment of the present disclosure, it is possible to determine fetal DNA present in the maternal blood of paternal origin (that is, DNA that the fetus inherited from the father) using the PARENTAL SUPPORT™ (PS) method, and the knowledge of the paternal genome. This method may utilize phased parental genetic information. It is possible to phase the parental genotype from unphased genotypic information using grandparental genetic data (such as measured genetic data from a sperm from the grandfather), or genetic data from other born children, or a sample of a miscarriage. One could also phase unphased genetic information by way of a HapMap-based phasing, or a haplotyping of paternal cells. Successful haplotyping has been demonstrated by arresting cells at phase of mitosis when chromosomes are tight bundles and using microfluidics to put separate chromosomes in separate wells. In another embodiment it is possible to use the phased parental haplotypic data to detect the presence of more than one homolog from the father, implying that the genetic material from more than one child is present in the blood. By focusing on chromosomes that are expected to be euploid in a fetus, one could rule out the possibility that the fetus was afflicted with a trisomy. Also, it is possible to determine if the fetal DNA is not from the current father, in which case one could use other methods such as the triple test to predict genetic abnormalities.

There may be other sources of fetal genetic material available via methods other than a blood draw. In the case of the fetal genetic material available in maternal blood, there are two main categories: (1) whole fetal cells, for example, nucleated fetal red blood cells or erythroblats, and (2) free floating fetal DNA. In the case of whole fetal cells, there is some evidence that fetal cells can persist in maternal blood for an extended period of time such that it is possible to isolate a cell from a pregnant woman that contains the DNA from a child or fetus from a prior pregnancy. There is also evidence that the free floating fetal DNA is cleared from the system in a matter of weeks. One challenge is how to determine the identity of the individual whose genetic material is contained in the cell, namely to ensure that the measured genetic material is not from a fetus from a prior pregnancy. In an embodiment of the present disclosure, the knowledge of the maternal genetic material can be used to ensure that the genetic material in question is not maternal genetic material. There are a number of methods to accomplish this end, including informatics based methods such as PARENTAL SUPPORT™, as described in this document or any of the patents referenced in this document.

In an embodiment of the present disclosure, the blood drawn from the pregnant mother may be separated into a fraction comprising free floating fetal DNA, and a fraction comprising nucleated red blood cells. The free floating DNA may optionally be enriched, and the genotypic information of the DNA may be measured. From the measured genotypic information from the free floating DNA, the knowledge of the maternal genotype may be used to determine aspects of the fetal genotype. These aspects may refer to ploidy state, and/or a set of allele identities. Then, individual nucleated red blood cells may be genotyped using methods described elsewhere in this document, and other referent patents, especially those mentioned in the first section of this document. The knowledge of the maternal genome would allow one to determine whether or not any given single blood cell is genetically maternal. And the aspects of the fetal genotype that were determined as described above would allow one to determine if the single blood cell is genetically derived from the fetus that is currently gestating. In essence, this aspect of the present disclosure allows one to use the genetic knowledge of the mother, and possibly the genetic information from other related individuals, such as the father, along with the measured genetic information from the free floating DNA found in maternal blood to determine whether an isolated nucleated cell found in maternal blood is either (a) genetically maternal, (b) genetically from the fetus currently gestating, or (c) genetically from a fetus from a prior pregnancy.

Prenatal Sex Chromosome Aneuploidy Determination

In methods known in the art, people attempting to determine the sex of a gestating fetus from the blood of the mother have used the fact that fetal free floating DNA (fffDNA) is present in the plasma of the mother. If one is able to detect Y-specific loci in the maternal plasma, this implies that the gestating fetus is a male. However, the lack of detection of Y-specific loci in the plasma does not always guarantee that the gestating fetus is a female when using methods known in the art, as in some cases the amount of fffDNA is too low to ensure that the Y-specific loci would be detected in the case of a male fetus.

Presented here is a novel method that does not require the measurement of Y-specific nucleic acids, that is, DNA that is from loci that are exclusively paternally derived. The Parental Support method, disclosed previously, uses crossover frequency data, parental genotypic data, and informatics techniques, to determine the ploidy state of a gestating fetus. The sex of a fetus is simply the ploidy state of the fetus at the sex chromosomes. A child that is XX is female, and XY is male. The method described herein is also able to determine the ploidy state of the fetus. Note that sexing is effectively synonymous with ploidy determination of the sex chromosomes; in the case of sexing, an assumption is often made that the child is euploid, therefore there are fewer possible hypotheses.

The method disclosed herein involves looking at loci that are common to both the X and Y chromosome to create a baseline in terms of expected amount of fetal DNA present for a fetus. Then, those regions that are specific only to the X chromosome can be interrogated to determine if the fetus is female or male. In the case of a male, we expect to see less fetal DNA from loci that are specific to the X chromosome than from loci that are specific to both the X and the Y. In contrast, in female fetuses, we expect the amount of DNA for each of these groups to be the same. The DNA in question can be measured by any technique that can quantitate the amount of DNA present on a sample, for example, qPCR, SNP arrays, genotyping arrays, or sequencing. For DNA that is exclusively from an individual we would expect to see the following:

|  | DNA specific to X | DNA specific to X and Y | DNA specific to Y |
| --- | --- | --- | --- |
| Male (XY) | A | 2A | A |
| Female (XX) | 2A | 2A | 0 |

In the case of DNA from a fetus that is mixed with DNA from the mother, and where the fraction of fetal DNA in the mixture is F, and where the fraction of maternal DNA in the mixture is M, such that F+M=100%, we would expect to see the following:

|  | DNA specific to X | DNA specific to X and Y | DNA specific to Y |
| --- | --- | --- | --- |
| Male fetus (XY) | M + ½ F | M + F | ½ F |
| Female fetus (XX) | M + F | M + F | 0 |

In the case where F and M are known, the expected ratios can be computed, and the observed data can be compared to the expected data. In the case where M and F are not known, a threshold can be selected based on historical data. In both cases, the measured amount of DNA at loci specific to both X and Y can be used as a baseline, and the test for the sex of the fetus can be based on the amount of DNA observed on loci specific to only the X chromosome. If that amount is lower than the baseline by an amount roughly equal to ½ F, or by an amount that causes it to fall below a predefined threshold, the fetus is determined to be male, and if that amount is about equal to the baseline, or if is not lower by an amount that causes it to fall below a predefined threshold, the fetus is determined to be female.

In another embodiment, one can look only at those loci that are common to both the X and the Y chromosomes, often termed the Z chromosome. A subset of the loci on the Z chromosome are typically always A on the X chromosome, and B on the Y chromosome. If SNPs from the Z chromosome are found to have the B genotype, then the fetus is called a male; if the SNPs from the Z chromosome are found to only have A genotype, then the fetus is called a female. In another embodiment, one can look at the loci that are found only on the X chromosome. Contexts such as AA|B are particularly informative as the presence of a B indicates that the fetus has an X chromosome from the father. Contexts such as AB|B are also informative, as we expect to see B present only half as often in the case of a female fetus as compared to a male fetus. In another embodiment, one can look at the SNPs on the Z chromosome where both A and B alleles are present on both the X and the Y chromosome, and where the it is known which SNPs are from the paternal Y chromosome, and which are from the paternal X chromosome.

In an embodiment, it is possible to amplify single nucleotide positions known to varying between the homologous non-recombining (HNR) region shared by chromosome Y and chromosome X. The sequence within this HNR region is largely identical between the X and Y chromosomes. Within this identical region are single nucleotide positions that, while invariant among X chromosomes and among Y chromosomes in the population, are different between the X and Y chromosomes. Each PCR assay could amplify a sequence from loci that are present on both the X and Y chromosomes. Within each amplified sequence would be a single base that can be detected using sequencing or some other method (see, for example, U.S. Publication No. 2011/0178719, filed Feb. 3, 2011, which is hereby incorporated by reference in its entirety).

In an embodiment, the sex of the fetus could be determined from the fetal free floating DNA found in maternal plasma, the method comprising some or all of the following steps: 1) Design PCR (either regular or mini-PCR, plus multiplexing if desired) primers amplify X/Y variant single nucleotide positions within HNR region, 2) obtain maternal plasma, 3) PCR Amplify targets from maternal plasma using HNR X/Y PCR assays, 4) sequence the amplicons, 5) Examine sequence data for presence of Y-allele within one or more of the amplified sequences. The presence of one or more would indicate a male fetus. Absence of all Y-alleles from all amplicons indicates a female fetus.

In an embodiment, one could use targeted sequencing to measure the DNA in the maternal plasma and/or the parental genotypes. In an embodiment, one could ignore all sequences that clearly originate from paternally sourced DNA. For example, in the context AA|AB, one could count the number of A sequences and ignore all the B sequences.

In order to determine a heterozygosity rate for the above algorithm, one could compare the number of observed A sequences to the expected number of total sequences for the given probe. There are many ways one could calculate an expected number of sequences for each probe on a per sample basis. In an embodiment, it is possible to use historical data to determine what fraction of all sequence reads belongs to each specific probe and then use this empirical fraction, combined with the total number of sequence reads, to estimate the number of sequences at each probe. Another approach could be to target some known homozygous alleles and then use historical data to relate the number of reads at each probe with the number of reads at the known homozygous alleles. For each sample, one could then measure the number of reads at the homozygous alleles and then use this measurement, along with the empirically derived relationships, to estimate the number of sequence reads at each probe.

In some embodiments, it is possible to determine the sex of the fetus by combining the predictions made by a plurality of methods. In some embodiments the plurality of methods are taken from methods described in this disclosure. In some embodiments, at least one of the plurality of methods are taken from methods described in this disclosure.

In some embodiments the method described herein can be used to determine the ploidy state of the gestating fetus. In an embodiment, the ploidy calling method uses loci that are specific to the X chromosome, or common to both the X and Y chromosome, but does not make use of any Y-specific loci. In an embodiment, the ploidy calling method uses one or more of the following: loci that are specific to the X chromosome, loci that are common to both the X and Y chromosome, and loci that are specific to the Y chromosome. In an embodiment, where the ratios of sex chromosomes are similar, for example 45,X (Turner Syndrome), 46,XX (normal female) and 47,XXX (trisomy X), the differentiation can be accomplished by comparing the allele distributions to expected allele distributions according to the various hypotheses. In another embodiment, this can be accomplished by comparing the relative number of sequence reads for the sex chromosomes to one or a plurality of reference chromosomes that are assumed to be euploid. Also note that these methods can be expanded to include aneuploid cases.

Single Gene Disease Screening

In an embodiment, a method for determining the ploidy state of the fetus may be extended to enable simultaneous testing for single gene disorders. Single-gene disease diagnosis leverages the same targeted approach used for aneuploidy testing, and requires additional specific targets. In an embodiment, the single gene NPD diagnosis is through linkage analysis. In many cases, direct testing of the cfDNA sample is not reliable, as the presence of maternal DNA makes it virtually impossible to determine if the fetus has inherited the mother's mutation. Detection of a unique paternally-derived allele is less challenging, but is only fully informative if the disease is dominant and carried by the father, limiting the utility of the approach. In an embodiment, the method involves PCR or related amplification approaches.

In some embodiments, the method involves phasing the abnormal allele with surrounding very tightly linked SNPs in the parents using information from first-degree relatives. Then Parental Support may be run on the targeted sequencing data obtained from these SNPs to determine which homologs, normal or abnormal, were inherited by the fetus from both parents. As long as the SNPs are sufficiently linked, the inheritance of the genotype of the fetus can be determined very reliably. In some embodiments, the method comprises (a) adding a set of SNP loci to densely flank a specified set of common diseases to our multiplex pool for aneuploidy testing; (b) reliably phasing the alleles from these added SNPs with the normal and abnormal alleles based on genetic data from various relatives; and (c) reconstructing the fetal haplotype, or set of phased SNP alleles on the inherited maternal and paternal homologs in the region surrounding the disease locus to determine fetal genotype. In some embodiments additional probes that are closely linked to a disease linked locus are added to the set of polymorphic locus being used for aneuploidy testing.

Reconstructing fetal diplotype is challenging because the sample is a mixture of maternal and fetal DNA. In some embodiments, the method incorporates relative information to phase the SNPs and disease alleles, then take into account physical distance of the SNPs and recombination data from location specific recombination likelihoods and the data observed from the genetic measurements of the maternal plasma to obtain the most likely genotype of the fetus.

In an embodiment, a number of additional probes per disease linked locus are included in the set of targeted polymorphic loci; the number of additional probes per disease linked locus may be between 4 and 10, between 11 and 20, between 21 and 40, between 41 and 60, between 61 and 80, or combinations thereof.

Phasing the diploid data from the parents can be challenging, and there are a number of ways this can be accomplished. Some are discussed in this disclosure, others are described in greater detail in other disclosures (see, e.g., PCT Publ. No. WO2009105531, filed Feb. 9, 2009, and PCT Publ. No. WO2010017214, filed Aug. 4, 2009, which are each hereby incorporated by reference in its entirety). In one embodiment, a parent can be phased by inference by measuring tissue from the parent that is haploid, for example by measuring one or more sperm or eggs. In one embodiment the parent can be phased by inference using the measured genotypic data of a first degree relative such as the parent's parent(s) or siblings. In one embodiment, the parent can be phased by dilution where the DNA is diluted, in one or a plurality of wells, to the point where there is expected to be no more than approximately one copy of each haplotype in each well, and then measuring the DNA in the one or more wells. In one embodiment, the parent genotype can be phased by using computer programs that use population based haplotype frequencies to infer the most likely phase. In one embodiment, the parent can be phased if the phased haplotypic data is known for the other parent, along with the unphased genetic data of one or more genetic offspring of the parents. In some embodiments, the genetic offspring of the parents may be one or more embryos, fetuses, and/or born children. Some of these methods and other methods for phasing one or both parents are disclosed in greater detail in, e.g., U.S. Publ. No. 2011/0033862, filed Aug. 19, 2010; U.S. Publ. No. 2011/0178719, filed Feb. 3, 2011; U.S. Publ. No. 2007/0184467, filed Nov. 22, 2006; U.S. Publ. No. 2008/0243398, filed Mar. 17, 2008, which are each hereby incorporated by reference in its entirety.

Fetal Genome Reconstruction

In one aspect, the invention features methods for determining a haplotype of a fetus. In various embodiments, this method allows one to determine which polymorphic loci (such as SNPs) were inherited by the fetus and to reconstruct which homologs (including recombination events) are present in the fetus (and thereby interpolate the sequence between the polymorphic loci). If desired, essentially the entire genome of the fetus can be reconstructed. If there is some remaining ambiguity in the genome of the fetus (such as in intervals with a crossover), this ambiguity can be minimized if desired by analyzing additional polymorphic loci. In various embodiments, the polymorphic loci are chosen to cover one or more of the chromosomes at a density to reduce any ambiguity to a desired level. This method has important applications for the detection of polymorphisms or other mutations of interest in a fetus since it enables their detection based on linkage (such as the presence of linked polymorphic loci in the fetal genome) rather than by directing detecting the polymorphism or other mutation of interest in the fetal genome. For example, if a parent is a carrier for a mutation associated with cystic fibrosis (CF), a nucleic acid sample that includes maternal DNA from the mother of the fetus and fetal DNA from the fetus can be analyzed to determine whether the fetal DNA include the haplotype containing the CF mutation. In particular, polymorphic loci can be analyzed to determine whether the fetal DNA includes the haplotype containing the CF mutation without having to detect the CF mutation itself in the fetal DNA. This is useful in screening for one or more mutations, such as disease-linked mutations, without having to directly detect the mutations.

In some embodiments, the method involves determining a parental haplotype (e.g., a haplotype of the mother or father of the fetus). In some embodiments, this determination is made without using data from a relative of the mother or father. In some embodiments, a parental haplotype is determined using a dilution approach followed by SNP genotyping or sequencing as described herein and elsewhere (see, e.g., U.S. Publ. No. 2011/0033862, filed Aug. 19, 2010, which is hereby incorporated by reference in its entirety). Because the DNA is diluted, it is unlikely that more than one haplotype is in the same fraction (or tube). Thus, there may be effectively a single molecule of DNA in the tube, which allows the haplotype on a single DNA molecule to be determined. In some embodiments, the method includes dividing a DNA sample into a plurality of fractions such that at least one of the fractions includes one chromosome or one chromosome segment from a pair of chromosomes, and genotyping (e.g., determining the presence of two or more polymorphic loci) the DNA sample in at least one of the fractions, thereby determining a parental haplotype. In some embodiments, the genotyping involves sequencing (such as shotgun sequencing). In some embodiments, the genotyping involves use of a SNP array to detect polymorphic loci, such as at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci. In some embodiments, the genotyping involves the use of multiplex PCR. In some embodiments, the method involves contacting the sample in a fraction with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci (such as SNPs) to produce a reaction mixture; and subjecting the reaction mixture to primer extension reaction conditions to produce amplified products that are measured with a high throughput sequencer to produce sequencing data.

In some embodiments, a haplotype of the mother is determined by any of the methods described herein using data from a relative of the mother. In some embodiments, a haplotype of the father is determined by any of the methods described herein using data from a relative of the father. In some embodiments, a haplotype is determined for both the father and the mother. In some embodiments, a SNP array is used to determine the presence of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci in a DNA sample from the mother (or father) and a relative of the mother (or father). In some embodiments, the method involves contacting a DNA sample from the mother (or father) and/or a relative of the mother (or father) with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci (such as SNPs) to produce a reaction mixture; and subjecting the reaction mixture to primer extension reaction conditions to produce amplified products that are measured with a high throughput sequencer to produce sequencing data. The parental haplotype may be determined based on the SNP array or sequencing data. In some embodiments, parental data may be phased by methods described or referred to elsewhere in this document.

This parental haplotype data can be used to determine if the fetus inherited the parental haplotype. In some embodiments, a nucleic acid sample that includes maternal DNA from the mother of the fetus and fetal DNA from the fetus is analyzed using a SNP array to detect at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci. In some embodiments, a nucleic acid sample that includes maternal DNA from the mother of the fetus and fetal DNA from the fetus is analyzed by contacting the sample with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci (such as SNPs) to produce a reaction mixture. In some embodiments, the reaction mixture is subjected to primer extension reaction conditions to produce amplified products. In some embodiments, the amplified products are measured with a high throughput sequencer to produce sequencing data. In various embodiments, the SNP array or sequencing data is used to determine a parental haplotype by using data about the probability of chromosomes crossing over at different locations in a chromosome (such as by using recombination data such as may be found in the HapMap database to create a recombination risk score for any interval) to model dependence between polymorphic alleles on the chromosome. In some embodiments, allele counts at the polymorphic loci are calculated on a computer based on the sequencing data. In some embodiments, a plurality of ploidy hypotheses each pertaining to a different possible ploidy state of the chromosome are created on a computer; a model (such as a joint distribution model) for the expected allele counts at the polymorphic loci on the chromosome is built on a computer for each ploidy hypothesis; a relative probability of each of the ploidy hypotheses is determined on a computer using the joint distribution model and the allele counts; and the ploidy state of the fetus is called by selecting the ploidy state corresponding to the hypothesis with the greatest probability. In some embodiments, building a joint distribution model for allele counts and the step of determining the relative probability of each hypothesis are done using a method that does not require the use of a reference chromosome.

In some embodiments, a fetal haplotype is determined for one or more chromosomes taken from the group consisting of chromosomes 13, 18, 21, X, and Y. In some embodiments, a fetal haplotype is determined for all of the fetal chromosomes. In various embodiments, the method determines essentially the entire genome of the fetus. In some embodiments, the haplotype is determined for at least 30, 40, 50, 60, 70, 80, 90, or 95% of the genome of the fetus. In some embodiments, the haplotype determination of the fetus includes information about which allele is present for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci.

Compositions of DNA

When performing an informatics analysis on sequencing data measured on a mixture of fetal and maternal blood to determine genomic information pertaining to the fetus, for example the ploidy state of the fetus, it may be advantageous to measure the allele distributions at a set of alleles. Unfortunately, in many cases, such as when attempting to determine the ploidy state of a fetus from the DNA mixture found in the plasma of a maternal blood sample, the amount of DNA available is not sufficient to directly measure the allele distributions with good fidelity in the mixture. In these cases, amplification of the DNA mixture will provide sufficient numbers of DNA molecules that the desired allele distributions may be measured with good fidelity. However, current methods of amplification typically used in the amplification of DNA for sequencing are often very biased, meaning that they do not amplify both alleles at a polymorphic locus by the same amount. A biased amplification can result in allele distributions that are quite different from the allele distributions in the original mixture. For most purposes, highly accurate measurements of the relative amounts of alleles present at polymorphic loci are not needed. In contrast, in an embodiment of the present disclosure, amplification or enrichment methods that specifically enrich polymorphic alleles and preserve allelic ratios is advantageous.

A number of methods are described herein that may be used to preferentially enrich a sample of DNA at a plurality of loci in a way that minimizes allelic bias. Some examples are using circularizing probes to target a plurality of loci where the 3' ends and 5' ends of the pre-circularized probe are designed to hybridize to bases that are one or a few positions away from the polymorphic sites of the targeted allele. Another is to use PCR probes where the 3' end PCR probe is designed to hybridize to bases that are one or a few positions away from the polymorphic sites of the targeted allele. Another is to use a split and pool approach to create mixtures of DNA where the preferentially enriched loci are enriched with low allelic bias without the drawbacks of direct multiplexing. Another is to use a hybrid capture approach where the capture probes are designed such that the region of the capture probe that is designed to hybridize to the DNA flanking the polymorphic site of the target is separated from the polymorphic site by one or a small number of bases.

In the case where measured allele distributions at a set of polymorphic loci are used to determine the ploidy state of an individual, it is desirable to preserve the relative amounts of alleles in a sample of DNA as it is prepared for genetic measurements. This preparation may involve WGA amplification, targeted amplification, selective enrichment techniques, hybrid capture techniques, circularizing probes or other methods meant to amplify the amount of DNA and/or selectively enhance the presence of molecules of DNA that correspond to certain alleles.

In some embodiments of the present disclosure, there is a set of DNA probes designed to target loci where the loci have maximal minor allele frequencies. In some embodiments of the present disclosure, there is a set of probes that are designed to target where the loci have the maximum likelihood of the fetus having a highly informative SNP at those loci. In some embodiments of the present disclosure, there is a set of probes that are designed to target loci where the probes are optimized for a given population subgroup. In some embodiments of the present disclosure, there is a set of probes that are designed to target loci where the probes are optimized for a given mix of population subgroups. In some embodiments of the present disclosure, there is a set of probes that are designed to target loci where the probes are optimized for a given pair of parents which are from different population subgroups that have different minor allele frequency profiles. In some embodiments of the present disclosure, there is a circularized strand of DNA that comprises at least one base pair that annealed to a piece of DNA that is of fetal origin. In some embodiments of the present disclosure, there is a circularized strand of DNA that comprises at least one base pair that annealed to a piece of DNA that is of placental origin. In some embodiments of the present disclosure, there is a circularized strand of DNA that circularized while at least some of the nucleotides were annealed to DNA that was of fetal origin. In some embodiments of the present disclosure, there is a circularized strand of DNA that circularized while at least some of the nucleotides were annealed to DNA that was of placental origin. In some embodiments of the present disclosure, there is a set of probes wherein some of the probes target single tandem repeats, and some of the probes target single nucleotide polymorphisms. In some embodiments, the loci are selected for the purpose of non-invasive prenatal diagnosis. In some embodiments, the probes are used for the purpose of non-invasive prenatal diagnosis. In some embodiments, the loci are targeted using a method that could include circularizing probes, MIPs, capture by hybridization probes, probes on a SNP array, or combinations thereof. In some embodiments, the probes are used as circularizing probes, MIPs, capture by hybridization probes, probes on a SNP array, or combinations thereof. In some embodiments, the loci are sequenced for the purpose of non-invasive prenatal diagnosis.

In the case where the relative informativeness of a sequence is greater when combined with relevant parent contexts, it follows that maximizing the number of sequence reads that contain a SNP for which the parental context is known may maximize the informativeness of the set of sequencing reads on the mixed sample. In an embodiment, the number of sequence reads that contain a SNP for which the parent contexts are known may be enhanced by using qPCR to preferentially amplify specific sequences. In an embodiment, the number of sequence reads that contain a SNP for which the parent contexts are known may be enhanced by using circularizing probes (for example, MIPs) to preferentially amplify specific sequences. In an embodiment, the number of sequence reads that contain a SNP for which the parent contexts are known may be enhanced by using a capture by hybridization method (for example SURESELECT) to preferentially amplify specific sequences. Different methods may be used to enhance the number of sequence reads that contain a SNP for which the parent contexts are known. In an embodiment, the targeting may be accomplished by extension ligation, ligation without extension, capture by hybridization, or PCR.

In a sample of fragmented genomic DNA, a fraction of the DNA sequences map uniquely to individual chromosomes;

other DNA sequences may be found on different chromosomes. Note that DNA found in plasma, whether maternal or fetal in origin is typically fragmented, often at lengths under 500 bp. In a typical genomic sample, roughly 3.3% of the mappable sequences will map to chromosome 13; 2.2% of the mappable sequences will map to chromosome 18; 1.35% of the mappable sequences will map to chromosome 21; 4.5% of the mappable sequences will map to chromosome X in a female; 2.25% of the mappable sequences will map to chromosome X (in a male); and 0.73% of the mappable sequences will map to chromosome Y (in a male). These are the chromosomes that are most likely to be aneuploid in a fetus. Also, among short sequences, approximately 1 in 20 sequences will contain a SNP, using the SNPs contained on dbSNP. The proportion may well be higher given that there may be many SNPs that have not been discovered.

In an embodiment of the present disclosure, targeting methods may be used to enhance the fraction of DNA in a sample of DNA that map to a given chromosome such that the fraction significantly exceeds the percentages listed above that are typical for genomic samples. In an embodiment of the present disclosure, targeting methods may be used to enhance the fraction of DNA in a sample of DNA such that the percentage of sequences that contain a SNP are significantly greater than what may be found in typical for genomic samples. In an embodiment of the present disclosure, targeting methods may be used to target DNA from a chromosome or from a set of SNPs in a mixture of maternal and fetal DNA for the purposes of prenatal diagnosis.

Note that a method has been reported (U.S. Pat. No. 7,888,017) for determining fetal aneuploidy by counting the number of reads that map to a suspect chromosome and comparing it to the number of reads that map to a reference chromosome, and using the assumption that an overabundance of reads on the suspect chromosome corresponds to a triploidy in the fetus at that chromosome. Those methods for prenatal diagnosis would not make use of targeting of any sort, nor do they describe the use of targeting for prenatal diagnosis.

By making use of targeting approaches in sequencing the mixed sample, it may be possible to achieve a certain level of accuracy with fewer sequence reads. The accuracy may refer to sensitivity, it may refer to specificity, or it may refer to some combination thereof. The desired level of accuracy may be between 90% and 95%; it may be between 95% and 98%; it may be between 98% and 99%; it may be between 99% and 99.5%; it may be between 99.5% and 99.9%; it may be between 99.9% and 99.99%; it may be between 99.99% and 99.999%, it may be between 99.999% and 100%. Levels of accuracy above 95% may be referred to as high accuracy.

There are a number of published methods in the prior art that demonstrate how one may determine the ploidy state of a fetus from a mixed sample of maternal and fetal DNA, for example: G. J. W. Liao et al. Clinical Chemistry 2011; 57(1) pp. 92-101. These methods focus on thousands of locations along each chromosome. The number of locations along a chromosome that may be targeted while still resulting in a high accuracy ploidy determination on a fetus, for a given number of sequence reads, from a mixed sample of DNA is unexpectedly low. In an embodiment of the present disclosure, an accurate ploidy determination may be made by using targeted sequencing, using any method of targeting, for example qPCR, ligand mediated PCR, other PCR methods, capture by hybridization, or circularizing probes, wherein the number of loci along a chromosome that need to be targeted may be between 5,000 and 2,000 loci; it may be between 2,000 and 1,000 loci; it may be between 1,000 and 500 loci; it may be between 500 and 300 loci; it may be between 300 and 200 loci; it may be between 200 and 150 loci; it may be between 150 and 100 loci; it may be between 100 and 50 loci; it may be between 50 and 20 loci; it may be between 20 and 10 loci. Optimally, it may be between 100 and 500 loci. The high level of accuracy may be achieved by targeting a small number of loci and executing an unexpectedly small number of sequence reads. The number of reads may be between 100 million and 50 million reads; the number of reads may be between 50 million and 20 million reads; the number of reads may be between 20 million and 10 million reads; the number of reads may be between 10 million and 5 million reads; the number of reads may be between 5 million and 2 million reads; the number of reads may be between 2 million and 1 million; the number of reads may be between 1 million and 500,000; the number of reads may be between 500,000 and 200,000; the number of reads may be between 200,000 and 100,000; the number of reads may be between 100,000 and 50,000; the number of reads may be between 50,000 and 20,000; the number of reads may be between 20,000 and 10,000; the number of reads may be below 10,000. Fewer number of read are necessary for larger amounts of input DNA.

In some embodiments, there is a composition comprising a mixture of DNA of fetal origin, and DNA of maternal origin, wherein the percent of sequences that uniquely map to chromosome 13 is greater than 4%, greater than 5%, greater than 6%, greater than 7%, greater than 8%, greater than 9%, greater than 10%, greater than 12%, greater than 15%, greater than 20%, greater than 25%, or greater than 30%. In some embodiments of the present disclosure, there is a composition comprising a mixture of DNA of fetal origin, and DNA of maternal origin, wherein the percent of sequences that uniquely map to chromosome 18 is greater than 3%, greater than 4%, greater than 5%, greater than 6%, greater than 7%, greater than 8%, greater than 9%, greater than 10%, greater than 12%, greater than 15%, greater than 20%, greater than 25%, or greater than 30%. In some embodiments of the present disclosure, there is a composition comprising a mixture of DNA of fetal origin, and DNA of maternal origin, wherein the percent of sequences that uniquely map to chromosome 21 is greater than 2%, greater than 3%, greater than 4%, greater than 5%, greater than 6%, greater than 7%, greater than 8%, greater than 9%, greater than 10%, greater than 12%, greater than 15%, greater than 20%, greater than 25%, or greater than 30%. In some embodiments of the present disclosure, there is a composition comprising a mixture of DNA of fetal origin, and DNA of maternal origin, wherein the percent of sequences that uniquely map to chromosome X is greater than 6%, greater than 7%, greater than 8%, greater than 9%, greater than 10%, greater than 12%, greater than 15%, greater than 20%, greater than 25%, or greater than 30%. In some embodiments of the present disclosure, there is a composition comprising a mixture of DNA of fetal origin, and DNA of maternal origin, wherein the percent of sequences that uniquely map to chromosome Y is greater than 1%, greater than 2%, greater than 3%, greater than 4%, greater than 5%, greater than 6%, greater than 7%, greater than 8%, greater than 9%, greater than 10%, greater than 12%, greater than 15%, greater than 20%, greater than 25%, or greater than 30%.

In some embodiments, a composition is described comprising a mixture of DNA of fetal origin, and DNA of maternal origin, wherein the percent of sequences that uniquely map to a chromosome, and that contains at least one single nucleotide polymorphism is greater than 0.2%, greater than 0.3%, greater than 0.4%, greater than 0.5%, greater than 0.6%, greater than 0.7%, greater than 0.8%, greater than 0.9%, greater than 1%, greater than 1.2%, greater than 1.4%, greater than 1.6%, greater than 1.8%, greater than 2%, greater than 2.5%, greater than 3%, greater than 4%, greater than 5%, greater than 6%, greater than 7%, greater than 8%, greater than 9%, greater than 10%, greater than 12%, greater than 15%, or greater than 20%, and where the chromosome is taken from the group 13, 18, 21, X, or Y. In some embodiments of the present disclosure, there is a composition comprising a mixture of DNA of fetal origin, and DNA of maternal origin, wherein the percent of sequences that uniquely map to a chromosome and that contain at least one single nucleotide polymorphism from a set of single nucleotide polymorphisms is greater than 0.15%, greater than 0.2%, greater than 0.3%, greater than 0.4%, greater than 0.5%, greater than 0.6%, greater than 0.7%, greater than 0.8%, greater than 0.9%, greater than 1%, greater than 1.2%, greater than 1.4%, greater than 1.6%, greater than 1.8%, greater than 2%, greater than 2.5%, greater than 3%, greater than 4%, greater than 5%, greater than 6%, greater than 7%, greater than 8%, greater than 9%, greater than 10%, greater than 12%, greater than 15%, or greater than 20%, where the chromosome is taken from the set of chromosome 13, 18, 21, X and Y, and where the number of single nucleotide polymorphisms in the set of single nucleotide polymorphisms is between 1 and 10, between 10 and 20, between 20 and 50, between 50 and 100, between 100 and 200, between 200 and 500, between 500 and 1,000, between 1,000 and 2,000, between 2,000 and 5,000, between 5,000 and 10,000, between 10,000 and 20,000, between 20,000 and 50,000, and between 50,000 and 100,000.

In theory, each cycle in the amplification doubles the amount of DNA present; however, in reality, the degree of amplification is slightly lower than two. In theory, amplification, including targeted amplification, will result in bias free amplification of a DNA mixture; in reality, however, different alleles tend to be amplified to a different extent than other alleles. When DNA is amplified, the degree of allelic bias typically increases with the number of amplification steps. In some embodiments, the methods described herein involve amplifying DNA with a low level of allelic bias. Since the allelic bias compounds with each additional cycle, one can determine the per cycle allelic bias by calculating the nth root of the overall bias where n is the base 2 logarithm of degree of enrichment. In some embodiments, there is a composition comprising a second mixture of DNA, where the second mixture of DNA has been preferentially enriched at a plurality of polymorphic loci from a first mixture of DNA where the degree of enrichment is at least 10, at least 100, at least 1,000, at least 10,000, at least 100,000 or at least 1,000,000, and where the ratio of the alleles in the second mixture of DNA at each locus differs from the ratio of the alleles at that locus in the first mixture of DNA by a factor that is, on average, less than 1,000%, 500%, 200%, 100%, 50%, 20%, 10%, 5%, 2%, 1%, 0.5%, 0.2%, 0.1%, 0.05%, 0.02%, or 0.01%. In some embodiments, there is a composition comprising a second mixture of DNA, where the second mixture of DNA has been preferentially enriched at a plurality of polymorphic loci from a first mixture of DNA where the per cycle allelic bias for the plurality of polymorphic loci is, on average, less than 10%, 5%, 2%, 1%, 0.5%, 0.2%, 0.1%, 0.05%, or 0.02%. In some embodiments, the plurality of polymorphic loci comprises at least 10 loci, at least 20 loci, at least 50 loci, at least 100 loci, at least 200 loci, at least 500 loci, at least 1,000 loci, at least 2,000 loci, at least 5,000 loci, at least 10,000 loci, at least 20,000 loci, or at least 50,000 loci.

SOME EMBODIMENTS

In some embodiments, a method is disclosed herein for generating a report disclosing the determined ploidy status of a chromosome in a gestating fetus, the method comprising: obtaining a first sample that contains DNA from the mother of the fetus and DNA from the fetus; obtaining genotypic data from one or both parents of the fetus; preparing the first sample by isolating the DNA so as to obtain a prepared sample; measuring the DNA in the prepared sample at a plurality of polymorphic loci; calculating, on a computer, allele counts or allele count probabilities at the plurality of polymorphic loci from the DNA measurements made on the prepared sample; creating, on a computer, a plurality of ploidy hypotheses concerning expected allele count probabilities at the plurality of polymorphic loci on the chromosome for different possible ploidy states of the chromosome; building, on a computer, a joint distribution model for allele count probability of each polymorphic locus on the chromosome for each ploidy hypothesis using genotypic data from the one or both parents of the fetus; determining, on a computer, a relative probability of each of the ploidy hypotheses using the joint distribution model and the allele count probabilities calculated for the prepared sample; calling the ploidy state of the fetus by selecting the ploidy state corresponding to the hypothesis with the greatest probability; and generating a report disclosing the determined ploidy status.

In some embodiments, the method is used to determine the ploidy state of a plurality of gestating fetuses in a plurality of respective mothers, the method further comprising: determining the percent of DNA that is of fetal origin in each of the prepared samples; and wherein the step of measuring the DNA in the prepared sample is done by sequencing a number of DNA molecules in each of the prepared samples, where more molecules of DNA are sequenced from those prepared samples that have a smaller fraction of fetal DNA than those prepared samples that have a larger fraction of fetal DNA.

In some embodiments, the method is used to determine the ploidy state of a plurality of gestating fetuses in a plurality of respective mothers, and where the measuring the DNA in the prepared sample is done, for each of the fetuses, by sequencing a first fraction of the prepared sample of DNA to give a first set of measurements, the method further comprising: making a first relative probability determination for each of the ploidy hypotheses for each of the fetuses, given the first set of DNA measurements; resequencing a second fraction of the prepared sample from those fetuses where the first relative probability determination for each of the ploidy hypotheses indicates that a ploidy hypothesis corresponding to an aneuploid fetus has a significant but not conclusive probability, to give a second set of measurements; making a second relative probability determination for ploidy hypotheses for the fetuses using the second set of measurements and optionally also the first set of measurements; and calling the ploidy states of the fetuses whose second sample was resequenced by selecting the ploidy state corresponding to the hypothesis with the greatest probability as determined by the second relative probability determination.

In some embodiments, a composition of matter is disclosed, the composition of matter comprising: a sample of preferentially enriched DNA, wherein the sample of preferentially enriched DNA has been preferentially enriched at a plurality of polymorphic loci from a first sample of DNA, wherein the first sample of DNA consisted of a mixture of maternal DNA and fetal DNA derived from maternal plasma, where the degree of enrichment is at least a factor of 2, and wherein the allelic bias between the first sample and the preferentially enriched sample is, on average, selected from the group consisting of less than 2%, less than 1%, less than 0.5%, less than 0.2%, less than 0.1%, less than 0.05%, less than 0.02%, and less than 0.01%. In some embodiments, a method is disclosed to create a sample of such preferentially enriched DNA.

In some embodiment, a method is disclosed for determining the presence or absence of a fetal aneuploidy in a maternal tissue sample comprising fetal and maternal genomic DNA, wherein the method comprises: (a) obtaining a mixture of fetal and maternal genomic DNA from said maternal tissue sample; (b) selectively enriching the mixture of fetal and maternal DNA at a plurality of polymorphic alleles; (c) distributing selectively enriched fragments from the mixture of fetal and maternal genomic DNA of step a to provide reaction samples comprising a single genomic DNA molecule or amplification products of a single genomic DNA molecule; (d) conducting massively parallel DNA sequencing of the selectively enriched fragments of genomic DNA in the reaction samples of step c) to determine the sequence of said selectively enriched fragments; (e) identifying the chromosomes to which the sequences obtained in step d) belong; (f) analyzing the data of step d) to determine i) the number of fragments of genomic DNA from step d) that belong to at least one first target chromosome that is presumed to be diploid in both the mother and the fetus, and ii) the number of fragments of genomic DNA from step d) that belong to a second target chromosome, wherein said second chromosome is suspected to be aneuploid in the fetus; (g) calculating an expected distribution of the number of fragments of genomic DNA from step d) for the second target chromosome if the second target chromosome is euploid, using the number determined in step f) part i); (h) calculating an expected distribution of the number of fragments of genomic DNA from step d) for the second target chromosome if the second target chromosome is aneuploid, using the first number is step f) part i) and an estimated fraction of fetal DNA found in the mixture of step b); and (i) using a maximum likelihood or maximum a posteriori approach to determine whether the number of fragments of genomic DNA determined in step f) part ii) is more likely to be part of the distribution calculated in step g) or the distribution calculated in step h); thereby indicating the presence or absence of a fetal aneuploidy.

Exemplary Cancer Diagnostic Methods

Note that it has been demonstrated that DNA that originated from cancer that is living in a host can be found in the blood of the host. In the same way that genetic diagnoses can be made from the measurement of mixed DNA found in maternal blood, genetic diagnoses can equally well be made from the measurement of mixed DNA found in host blood. The genetic diagnoses may include aneuploidy states, or gene mutations. Any claim in the instant disclosure that reads on determining the ploidy state or genetic state of a fetus from the measurements made on maternal blood can equally well read on determining the ploidy state or genetic state of a cancer from the measurements on host blood.

In some embodiments, a method of the present disclosure allows one to determine the ploidy status of a cancer, the method including obtaining a mixed sample that contains genetic material from the host, and genetic material from the cancer; measuring the DNA in the mixed sample; calculating the fraction of DNA that is of cancer origin in the mixed sample; and determining the ploidy status of the cancer using the measurements made on the mixed sample and the calculated fraction. In some embodiments, the method may further include administering a cancer therapeutic based on the determination of the ploidy state of the cancer. In some embodiments, the method may further include administering a cancer therapeutic based on the determination of the ploidy state of the cancer, wherein the cancer therapeutic is taken from the group comprising a pharmaceutical, a biologic therapeutic, and antibody based therapy and combination thereof.

Exemplary Clinical Actions

In some embodiments, any of the methods include taking a clinical action based on a result of a method of the invention (such as the determination of the presence or absence of a polymorphism or mutation, ploidy state, or paternity). In some embodiments in which an embryo or fetus has one or more one or more polymorphisms or mutations of interest (such as a CNV) based on a result of a method of the invention, the clinical action includes performing additional testing (such as testing to confirm the presence of the polymorphism or mutation), not implanting the embryo for IVF, implanting a different embryo for IVF, terminating a pregnancy, preparing for a special needs child, or undergoing an intervention designed to decrease the severity of the phenotypic presentation of a genetic disorder. In some embodiments, the clinical action is selected from the group consisting of performing an ultrasound, amniocentesis on the fetus, amniocentesis on a subsequent fetus that inherits genetic material from the mother and/or father, chorion villus biopsy on the fetus, chorion villus biopsy on a subsequent fetus that inherits genetic material from the mother and/or father, in vitro fertilization, preimplantation genetic diagnosis on one or more embryos that inherited genetic material from the mother and/or father, karyotyping on the mother, karyotyping on the father, fetal echocardiogram (such as an echocardiogram of a fetus with trisomy 21, 18, or 13, monosomy X, or a microdeletion), and combinations thereof. In some embodiments, the clinical action is selected from the group consisting of administering growth hormone to a born child with monosomy X (such as administration starting at ~9 months), administering calcium to a born child with a 22 q deletion (such as DiGeorge syndrome), administering an androgen such as testosterone to a born child with 47,XXY (such as one injection per month for 3 months of 25 mg testosterone enanthate to an infant or toddler), performing a test for cancer on a woman with a complete or partial molar pregnancy (such as a triploid fetus), administering a therapy for cancer such as a chemotherapeutic agent to a woman with a complete or partial molar pregnancy (such as a triploid fetus), screening a fetus determined to be male (such as a fetus determined to be male using a method of the invention) for one or more X-linked genetic disorders such as Duchenne muscular dystrophy (DMD), adrenoleukodystrophy, or hemophilia, performing amniocentesis on a male fetus at risk for an X-linked disorder, administering dexamethasone to a women with a female fetus at risk male (such as a fetus determined to be female using a method of the invention) for congenital adrenal hyperplasia, performing amniocentesis on a female fetus at risk for congenital adrenal hyperplasia, administering killed vaccines (instead of live vaccines) or not administering certain vaccines to a born child who is (or is suspected of being) immune deficient from a 22q11.2 deletion, performing occupational and/or physical therapy, performing early intervention in education, delivering the baby at a tertiary care center with a NICU and/or having pediatric specialists available at delivery, behavioral intervention for born child (such as a child with XXX, XXY, or XYY), and combinations thereof.

In some embodiments, ultrasound or another screening test is performed on a women determined to have multiple pregnancies (such as twins) to determine whether or not two or more of the fetus are monochorionic. Monozygotic twins result from ovulation and fertilization of a single oocyte, with subsequent division of the zygote; placentation may be dichorionic or monochorionic. Dizygotic twins occur from ovulation and fertilization of two oocytes, which usually results in dichorionic placentation. Monochorionic twins have a risk of twin-to-twin transfusion syndrome, which may cause unequal distribution of blood between fetuses that results in differences in their growth and development, sometimes resulting in stillbirth. Thus, twins determined to be monozygotic twins using a method of the invention are desirably tested (such as by ultrasound) to determine if they are monochorionic twins, and if so, these twins can be monitored (such as bi-weekly ultrasounds from 16 weeks) for signs of win-to-twin transfusion syndrome.

In some embodiments in which an embryo or fetus does not have one or more one or more polymorphisms or mutations of interest (such as a CNV) based on a result of a method of the invention, the clinical action includes implanting the embryo for IVF or continuing a pregnancy. In some embodiments, the clinical action is additional testing to confirm the absence of the polymorphism or mutation selected from the group consisting of performing an ultrasound, amniocentesis, chorion villus biopsy, and combinations thereof.

In some embodiments in which an individual has one or more polymorphisms or mutations (such as a polymorphism or mutation associated with a disease or disorder such as cancer or an increased risk for a disease or disorder such as cancer) based on a result of a method of the invention, the clinical action includes performing additional testing or administering one or more therapies for a disease or disorder (such as a therapy for cancer, a therapy for the specific type of cancer or type of mutation the individual is diagnosed with, or any of the therapies disclosed herein). In some embodiments, the clinical action is additional testing to confirm the presence or absence of a polymorphism or mutation selected from the group consisting of biopsy, surgery, medical imaging (such as a mammogram or an ultrasound), and combinations thereof.

In some embodiments, the additional testing includes performing the same or a different method (such as any of the methods described herein) to confirm the presence or absence of the polymorphism or mutation (such as a CNV), such as testing either a second fraction of the same sample that was tested or a different sample from the same individual (such as the same pregnant mother, fetus, embryo, or individual at increased risk for cancer). In some embodiments, the additional testing is performed for an individual for whom the probability of a polymorphism or mutation (such as a CNV) is above a threshold value. In some embodiments, the additional testing is performed for an individual for whom the confidence or z-score for the determination of a polymorphism or mutation (such as a CNV) is above a threshold value (such as additional testing to confirm the presence of a likely polymorphism or mutation). In some embodiments, the additional testing is performed for an individual for whom the confidence or z-score for the determination of a polymorphism or mutation (such as a CNV) is between minimum and maximum threshold values (such as additional testing to increase the confidence that the initial result is correct). In some embodiments, the additional testing is performed for an individual for whom the confidence for the determination of the presence or absence of a polymorphism or mutation (such as a CNV) is below a threshold value (such as a "no call" result due to not being able to determine the presence or absence of the CNV with sufficient confidence). An exemplary Z core is calculated in Chiu et al. BMJ 2011; 342:c7401 (which is hereby incorporated by reference in its entirety) in which chromosome 21 is used as an example and can be replaced with any other chromosome or chromosome segment in the test sample.

Z score for percentage chromosome 21 in test case=
((percentage chromosome 21 in test case)−
(mean percentage chromosome 21 in reference
controls))/(standard deviation of percentage
chromosome 21 in reference controls).

In some embodiments, the additional testing is performed for an individual for whom the initial sample did not meet quality control guidelines or had a fetal fraction or a tumor fraction below a threshold value. In some embodiments, the method includes selecting an individual for additional testing based on the result of a method of the invention, the probability of the result, the confidence of the result, or the z-score; and performing the additional testing on the individual (such as on the same or a different sample). In some embodiments, a subject diagnosed with a disease or disorder (such as cancer) undergoes repeat testing using a method of the invention or known testing for the disease or disorder at multiple time points to monitor the progression of the disease or disorder or the remission or reoccurrence of the disease or disorder.

Exemplary Implementation Methods

Any of the embodiments disclosed herein may be implemented in digital electronic circuitry, integrated circuitry, specially designed ASICs (application-specific integrated circuits), computer hardware, firmware, software, or in combinations thereof. Apparatus of the presently disclosed embodiments can be implemented in a computer program product tangibly embodied in a machine-readable storage device for execution by a programmable processor; and method steps of the presently disclosed embodiments can be performed by a programmable processor executing a program of instructions to perform functions of the presently disclosed embodiments by operating on input data and generating output. The presently disclosed embodiments can be implemented advantageously in one or more computer programs that are executable and/or interpretable on a programmable system including at least one programmable processor, which may be special or general purpose, coupled to receive data and instructions from, and to transmit data and instructions to, a storage system, at least one input device, and at least one output device. Each computer program can be implemented in a high-level procedural or object-oriented programming language or in assembly or machine language if desired; and in any case, the language can be a compiled or interpreted language. A computer program may be deployed in any form, including as a stand-alone program, or as a module, component, subroutine, or other unit suitable for use in a computing environment. A computer program may be deployed to be executed or interpreted on one computer or on multiple computers at one site, or distributed across multiple sites and interconnected by a communication network.

Computer readable storage media, as used herein, refers to physical or tangible storage (as opposed to signals) and includes without limitation volatile and non-volatile, removable and non-removable media implemented in any method or technology for the tangible storage of information such as computer-readable instructions, data structures, program modules or other data. Computer readable storage media includes, but is not limited to, RAM, ROM, EPROM, EEPROM, flash memory or other solid state memory technology, CD-ROM, DVD, or other optical storage, magnetic cassettes, magnetic tape, magnetic disk storage or other magnetic storage devices, or any other physical or material medium which can be used to tangibly store the desired information or data or instructions and which can be accessed by a computer or processor.

In some embodiments, the invention features a computer configured to accomplish one or more of the in vitro methods described herein. In some embodiments, the data is analyzed by the computer system as described herein. In some embodiments, genetic data (such as sequencing or microarray data) from at least 100; 200; 500; 750; 1,000; 2,000; 5,000; 7,500; 10,000; 20,000; 25,000; 30,000; 40,000; 50,000; 75,000; or 100,000 different loci is analyzed by the computer is less than 200, 100, 60, 30, 20, 10, 5, or 1 minute, or in less than 30 or 10 seconds to detect the present or absence of a mutation (such as a CNV or SNV) at the loci.

Any of the methods described herein may include the output of data in a physical format, such as on a computer screen, or on a paper printout. In explanations of any embodiments elsewhere in this document, it should be understood that the described methods may be combined with the output of the actionable data in a format that can be acted upon by a physician. In addition, the described methods may be combined with the actual execution of a clinical decision that results in a clinical treatment, or the execution of a clinical decision to make no action. Some of the embodiments described in the document for determining genetic data pertaining to a target individual may be combined with the decision to select one or more embryos for transfer in the context of IVF, optionally combined with the process of transferring the embryo to the womb of the prospective mother. Some of the embodiments described in the document for determining genetic data pertaining to a target individual may be combined with the notification of a potential chromosomal abnormality, or lack thereof, with a medical professional, optionally combined with the decision to abort, or to not abort, a fetus in the context of prenatal diagnosis. Some of the embodiments described herein may be combined with the output of the actionable data, and the execution of a clinical decision that results in a clinical treatment, or the execution of a clinical decision to make no action.

Exemplary Diagnostic Boxes

In an embodiment, the present disclosure comprises a diagnostic box that is capable of partly or completely carrying out any of the methods described in this disclosure. In an embodiment, the diagnostic box may be located at a physician's office, a hospital laboratory, or any suitable location reasonably proximal to the point of patient care. The box may be able to run the entire method in a wholly automated fashion, or the box may require one or a number of steps to be completed manually by a technician. In an embodiment, the box may be able to analyze at least the genotypic data measured on the maternal plasma. In an embodiment, the box may be linked to means to transmit the genotypic data measured on the diagnostic box to an external computation facility which may then analyze the genotypic data, and possibly also generate a report. The diagnostic box may include a robotic unit that is capable of transferring aqueous or liquid samples from one container to another. It may comprise a number of reagents, both solid and liquid. It may comprise a high throughput sequencer. It may comprise a computer.

Experimental Section

The presently disclosed embodiments are described in the following Examples, which are set forth to aid in the understanding of the disclosure, and should not be construed to limit in any way the scope of the disclosure as defined in the claims which follow thereafter. The following examples are put forth so as to provide those of ordinary skill in the art with a complete disclosure and description of how to use the described embodiments, and are not intended to limit the scope of the disclosure nor are they intended to represent that the Examples below are all or the only experiments performed. Efforts have been made to ensure accuracy with respect to numbers used (e.g. amounts, temperature, etc.) but some experimental errors and deviations should be accounted for. Unless indicated otherwise, parts are parts by volume, and temperature is in degrees Centigrade. It should be understood that variations in the methods as described may be made without changing the fundamental aspects that the Examples are meant to illustrate.

Example 1

The objective was to show that a Bayesian maximum likelihood estimation (MLE) algorithm that uses parent genotypes to calculate fetal fraction improves accuracy of non-invasive prenatal trisomy diagnosis compared to published methods.

Figure 14:
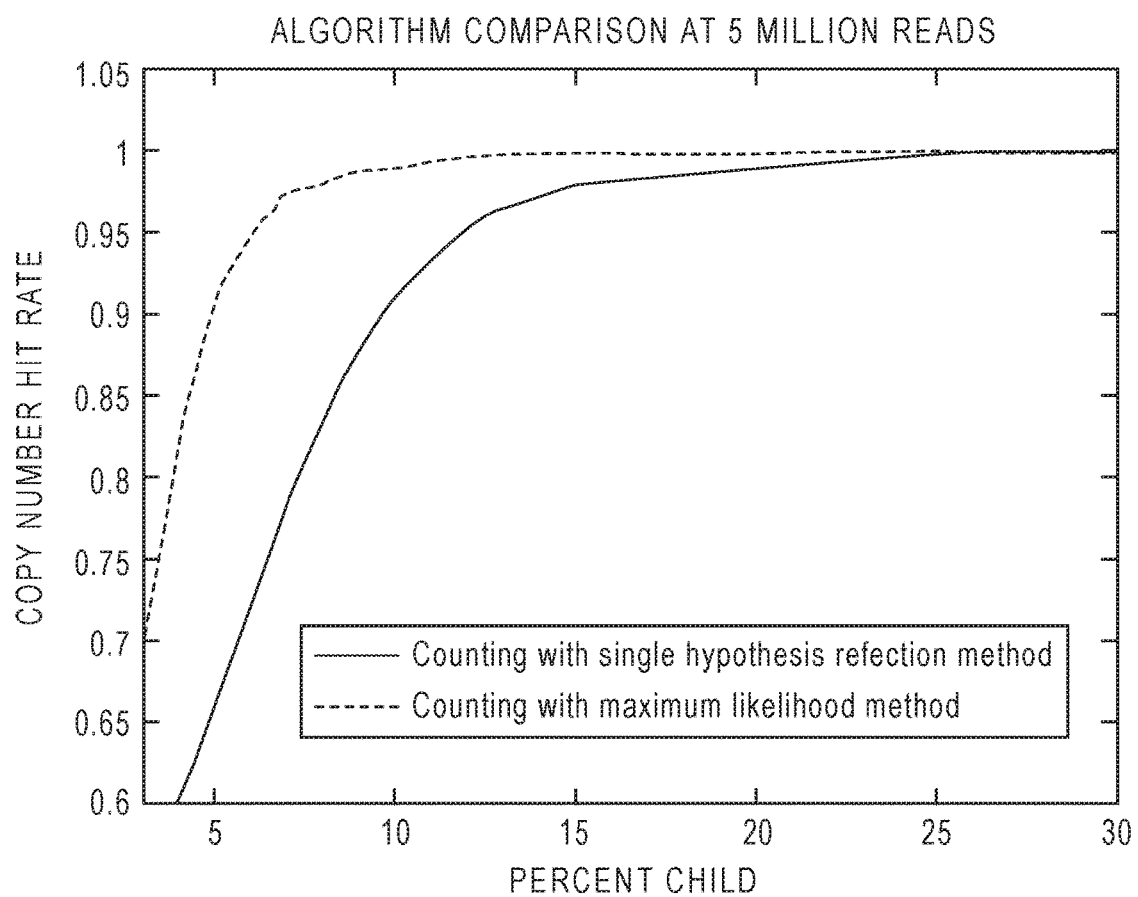
FIG. 14: Simulated ploidy call accuracies for counting method with two different analysis techniques.

Simulated sequencing data for maternal cfDNA was created by sampling reads obtained on trisomy-21 and respective mother cell lines. The rate of correct disomy and trisomy calls were determined from 500 simulations at various fetal fractions for a published method (Chiu et al. BMJ 2011; 342:c7401) and our MLE-based algorithm. We validated the simulations by obtaining 5 million shotgun reads from four pregnant mothers and respective fathers collected under an IRB-approved protocol. Parental genotypes were obtained on a 290K SNP array. (See FIG. 14)

In simulations, the MLE-based approach achieved 99.0% accuracy for fetal fractions as low as 9% and reported confidences that corresponded well to overall accuracy. We validated these results using four real samples wherein we obtained all correct calls with a computed confidence exceeding 99%. In contrast, our implementation of the published algorithm for Chiu et al. required 18% fetal fraction to achieve 99.0% accuracy, and achieved only 87.8% accuracy at 9% fetal DNA.

Fetal fraction determination from parental genotypes in conjunction with a MLE-based approach achieves greater accuracy than published algorithms at the fetal fractions expected during the 1st and early 2nd trimester. Furthermore, the method disclosed herein produces a confidence metric that is crucial in determining the reliability of the result, especially at low fetal fractions where ploidy detection is more difficult. Published methods use a less accurate threshold method for calling ploidy based on large sets of disomy training data, an approach that predefines a false positive rate. In addition, without a confidence metric, published methods are at risk of reporting false negative results when there is insufficient fetal cfDNA to make a call. In some embodiments, a confidence estimate is calculated for the called ploidy state.

Example 2

The objective was to improve non-invasive detection of fetal trisomy 18, 21, and X particularly in samples consisting of low fetal fraction by using a targeted sequencing approach combined with parent genotypes and Hapmap data in a Bayesian Maximum Likelihood Estimation (MLE) algorithm.

Maternal samples from four euploid and two trisomy-positive pregnancies and respective paternal samples were obtained under an IRB-approved protocol from patients where fetal karyotype was known. Maternal cfDNA was extracted from plasma and roughly 10 million sequence reads were obtained following preferential enrichment that targeted specific SNPs. Parent samples were similarly sequenced to obtain genotypes.

The described algorithm correctly called chromosome 18 and 21 disomy for all euploid samples and normal chromosomes of aneuploid samples. Trisomy 18 and 21 calls were correct, as were chromosome X copy numbers in male and female fetuses. The confidence produced by the algorithm was in excess of 98% in all cases.

The method described accurately reported the ploidy of all tested chromosomes from six samples, including samples comprised of less than 12% fetal DNA, which account for roughly 30% of $1^{st}$ and early $2^{nd}$-trimester samples. The crucial difference between the instant MLE algorithm and published methods is that it leverages parent genotypes and Hapmap data to improve accuracy and generate a confidence metric. At low fetal fractions, all methods become less accurate; it is important to correctly identify samples without sufficient fetal cfDNA to make a reliable call. Others have used chromosome Y specific probes to estimate fetal fraction of male fetuses, but concurrent parental genotyping enables estimation of fetal fraction for both sexes. Another inherent limitation of published methods using untargeted shotgun sequencing is that accuracy of ploidy calling varies among chromosomes due to differences in factors such as GC richness. The instant targeted sequencing approach is largely independent of such chromosome-scale variations and yields more consistent performance between chromosomes.

Example 3

The objective was to determine if trisomy is detectable with high confidence on a triploid fetus, using novel informatics to analyze SNP loci of free floating fetal DNA in maternal plasma.

20 mL of blood was drawn from a pregnant patient following abnormal ultrasound. After centrifugation, maternal DNA was extracted from the buffy coat (DNEASY, QIAGEN); cell-free DNA was extracted from plasma (QIAAMP QIAGEN). Targeted sequencing was applied to SNP loci on chromosomes 2, 21, and X in both DNA samples. Maximum-Likelihood Bayesian estimation selected the most likely hypothesis from the set of all possible ploidy states. The method determines fetal DNA fraction, ploidy state and explicit confidences in the ploidy determination. No assumptions are made about the ploidy of a reference chromosome. The diagnostic uses a test statistic that is independent of sequence read counts, which is the recent state of the art.

The instant method accurately diagnosed trisomy of chromosomes 2 and 21. Child fraction was estimated at 11.9% [CI 11.7-12.1]. The fetus was found to have one maternal and two paternal copies of chromosomes 2 and 21 with confidence of effectively 1 (error probability<$10^{-30}$). This was achieved with 92,600 and 258,100 reads on chromosomes 2 and 21 respectively.

This is the first demonstration of non-invasive prenatal diagnosis of trisomic chromosomes from maternal blood where the fetus was triploid, as confirmed by metaphase karyotype. Extant methods of non-invasive diagnosis would not detect aneuploidy in this sample. Current methods rely on a surplus of sequence reads on a trisomic chromosome relative to disomic reference chromosomes; but a triploid fetus has no disomic reference. Furthermore, extant methods would not achieve similarly high-confidence ploidy determination with this fraction of fetal DNA and number of sequence reads. It is straightforward to extend the approach to all 24 chromosomes.

Example 4

Figure 15:
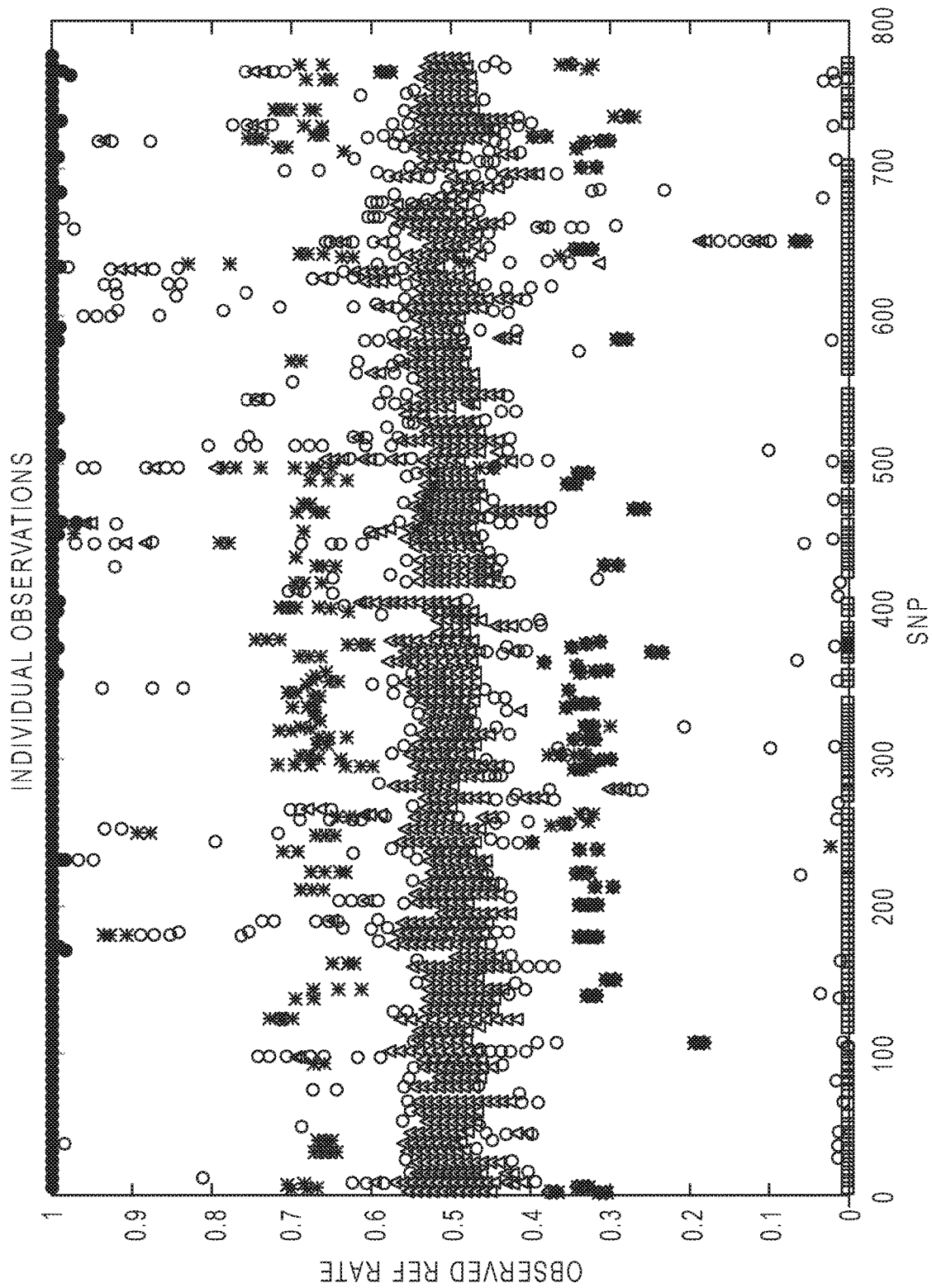
FIG. 15: Ratio of two alleles for a plurality of SNPs in a cell line in Example 4.
Figure 16:
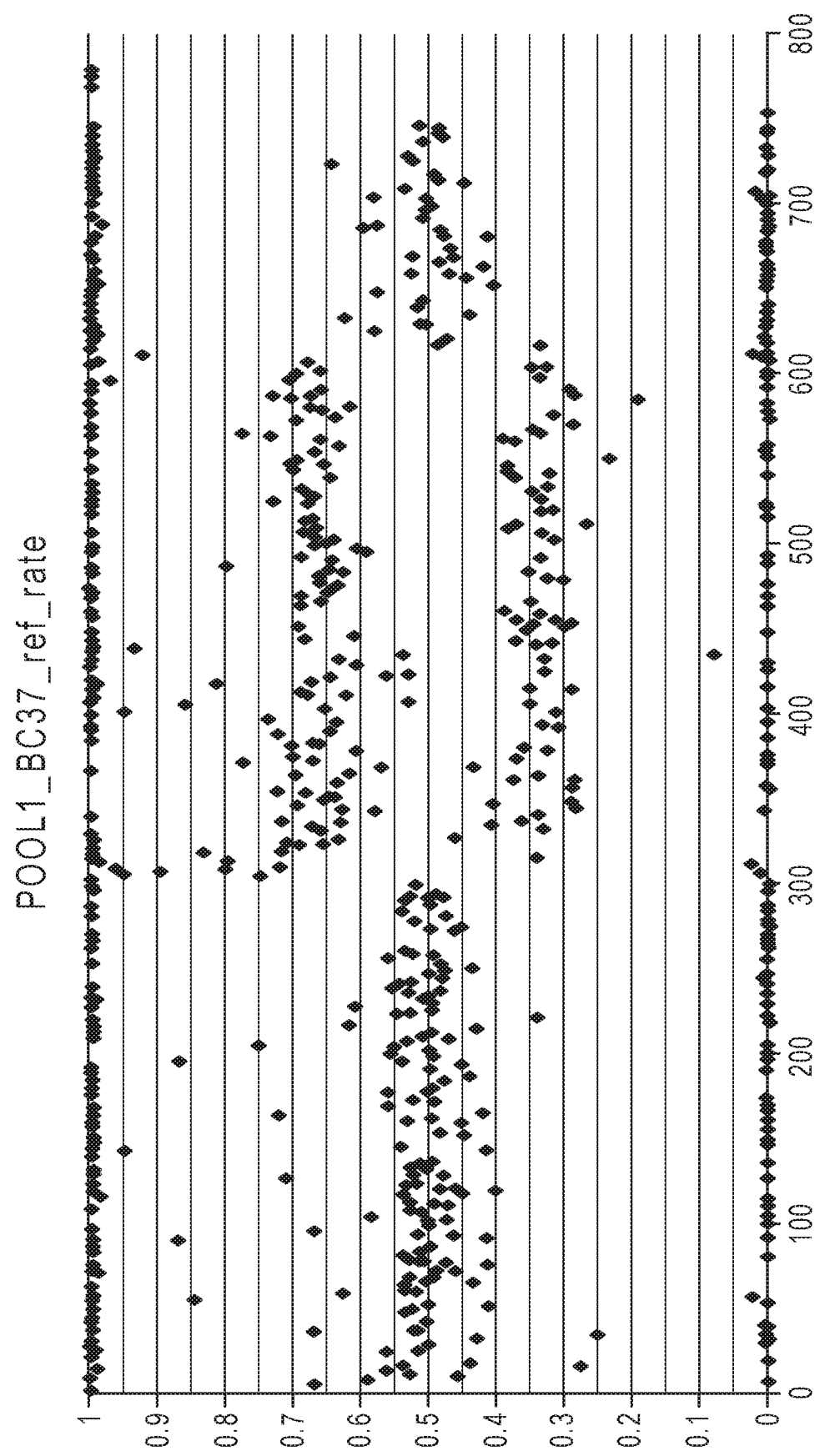
FIG. 16: Ratio of two alleles for a plurality of SNPs in a cell line in Example 4 sorted by chromosome.
Figure 17A:
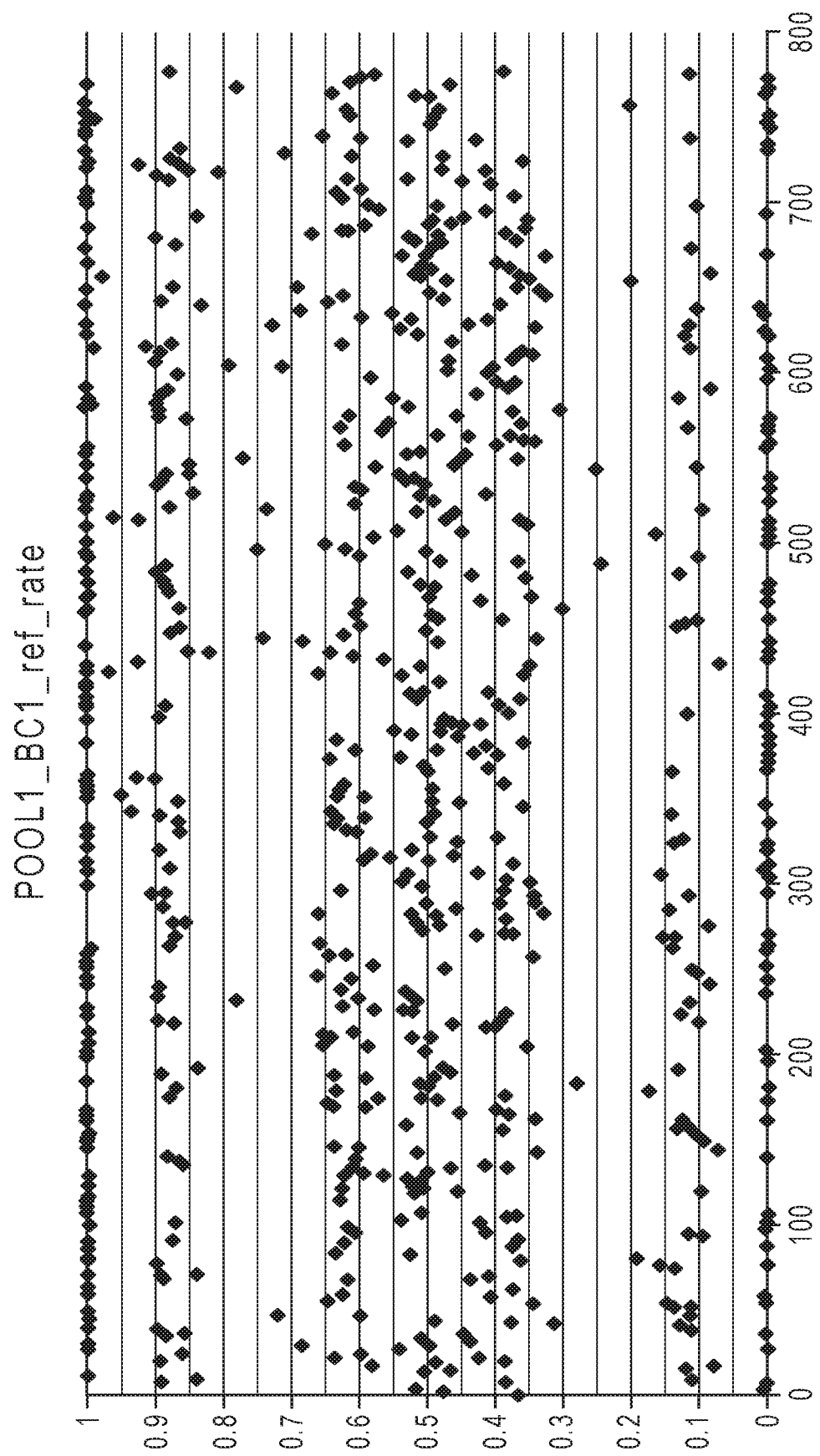
FIGS. 17A-17D: Ratio of two alleles for a plurality of SNPs in four pregnant women plasma samples, sorted by chromosome.
Figure 17B:
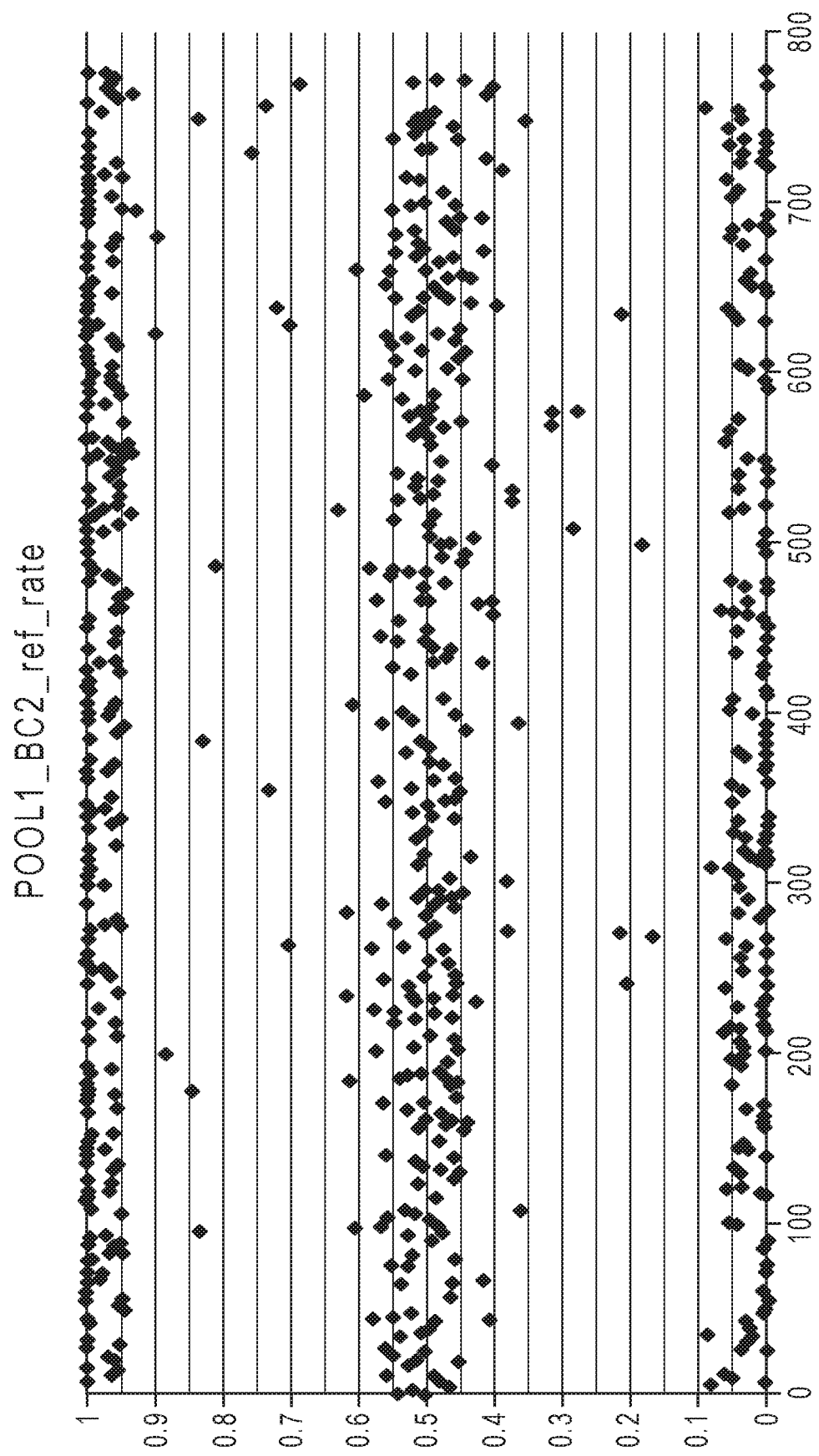
Figure 17C:
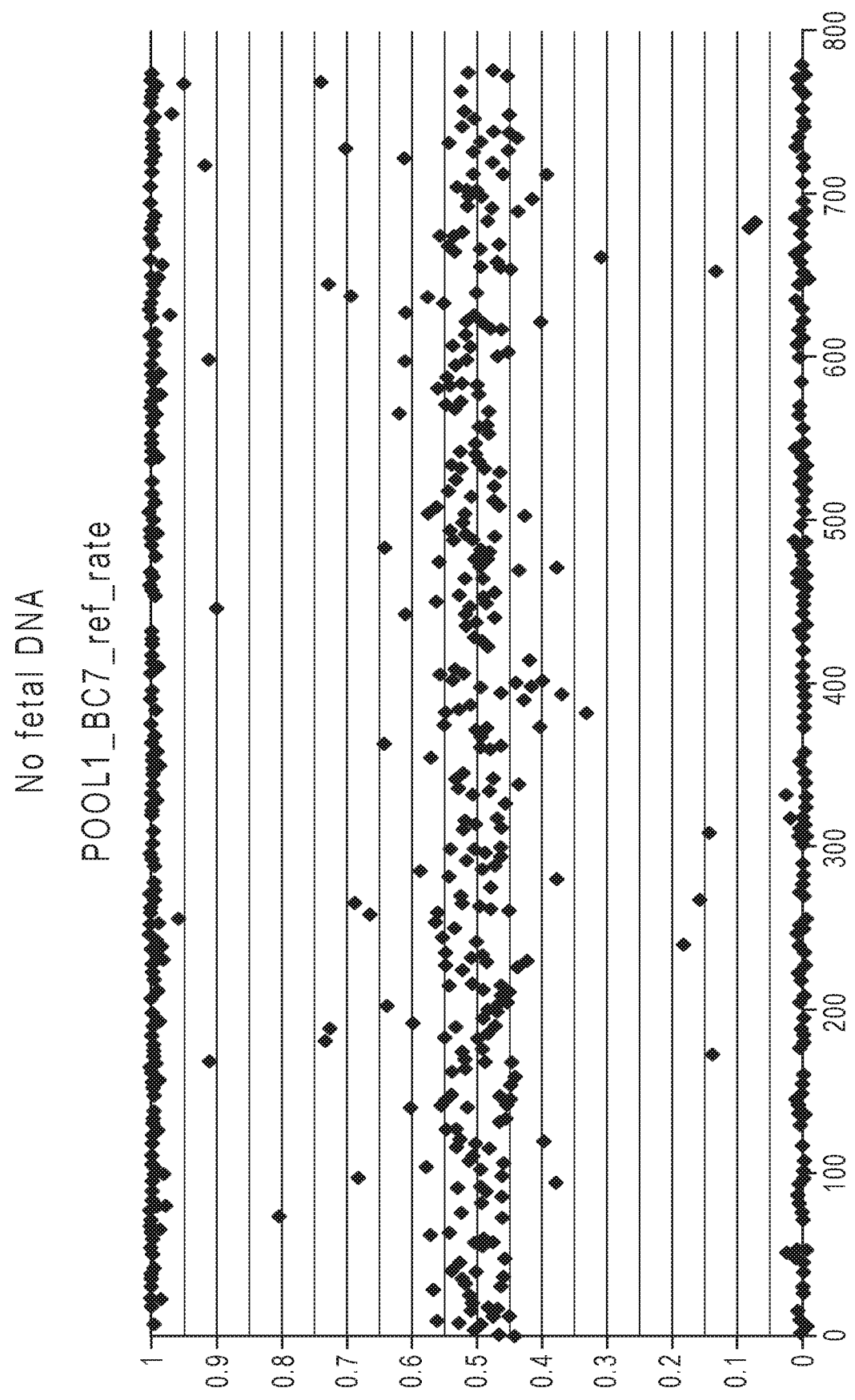
Figure 17D:
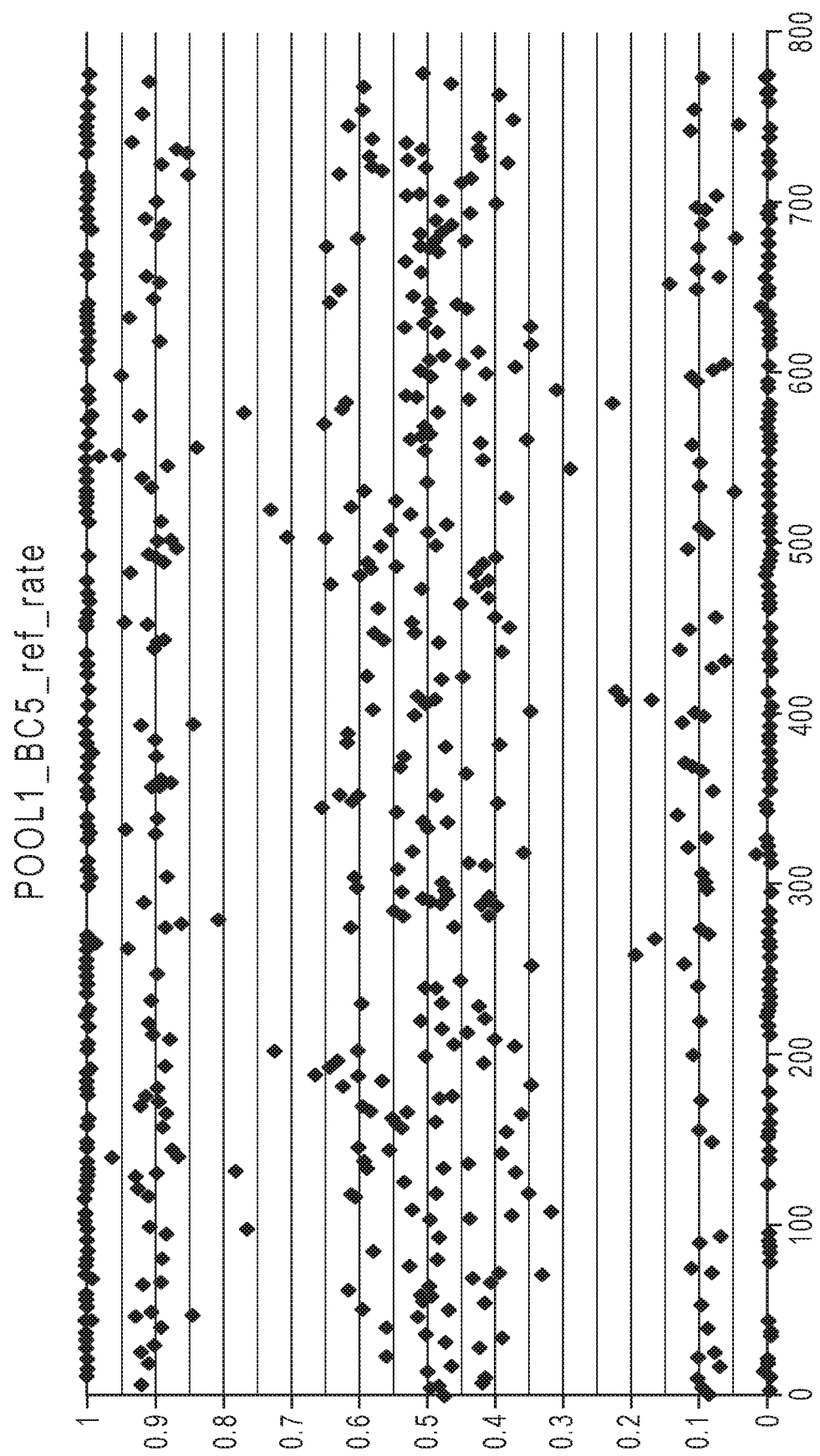

The following protocol was used for 800-plex amplification of DNA isolated from maternal plasma from a euploid pregnancy and also genomic DNA from a triploidy 21 cell line using standard PCR (meaning no nesting was used). Library preparation and amplification involved single tube blunt ending followed by A-tailing. Adaptor ligation was run using the ligation kit found in the AGILENT SURESELECT kit, and PCR was run for 7 cycles. Then, 15 cycles of STA (95° C. for 30 s; 72° C. for 1 min; 60° C. for 4 min; 65° C. for 1 min; 72° C. for 30 s) using 800 different primer pairs targeting SNPs on chromosomes 2, 21 and X. The reaction was run with 12.5 nM primer concentration. The DNA was then sequenced with an ILLUMINA IIGAX sequencer. The sequencer output 1.9 million reads, of which 92% mapped to the genome; of those reads that mapped to the genome, more than 99% mapped to one of the regions targeted by the targeted primers. The numbers were essentially the same for both the plasma DNA and the genomic DNA. FIG. 15 shows the ratio of the two alleles for the ~780 SNPs that were detected by the sequencer in the genomic DNA that was taken from a cell line with known trisomy at chromosome 21. Note that the allele ratios are plotted here for ease of visualization, because the allele distributions are not straightforward to read visually. The circles represent SNPs on disomic chromosomes, while the stars represent SNPs on a trisomic chromosome. FIG. 16 is another representation of the same data as in FIG. 15, where the Y-axis is the relative number of A and B measured for each SNP, and where the X-axis is the SNP number where the SNPs are separated by chromosome. In FIG. 16, SNP 1 to 312 are found on chromosome 2, from SNP 313 to 605 are found on chromosome 21 which is trisomic, and from SNP 606 to 800 are on chromosome X. The data from chromosomes 2 and X show a disomic chromosome, as the relative sequence counts lie in three clusters: AA at the top of the graph, BB at the bottom of the graph, and AB in the middle of the graph. The data from chromosome 21, which is trisomic, shows four clusters: AAA at the top of the graph, AAB around the 0.65 line (⅔), ABB around the 0.35 line (⅓), and BBB at the bottom of the graph.

FIGS. 17A-D show data for the same 800-plex protocol, but measured on DNA that was amplified from four plasma samples from pregnant women. For these four samples, we expect to see seven clusters of dots: (1) along the top of the graph are those loci where both the mother and the fetus are AA, (2) slightly below the top of the graph are those loci where the mother is AA and the fetus is AB, (3) slightly above the 0.5 line are those loci where the mother is AB and the fetus is AA, (4) along the 0.5 line are those loci where the mother and the fetus are both AB, (5) slightly below the 0.5 line are those loci where the mother is AB and the fetus is BB, (6) slightly above the bottom of the graph are those loci where the mother is BB and the fetus is AB, (1) along the bottom of the graph are those loci where both the mother and the fetus are BB. The smaller the fetal fraction, the less the separation between clusters (1) and (2), between clusters (3), (4) and (5), and between clusters (6) and (7). The separation is expected to be half of the fraction of DNA that is of fetal origin. For example if the DNA is 20% fetal, and 80% maternal, we expect (1) through (7) to be centered at 1.0, 0.9, 0.6, 0.5, 0.4, 0.1 and 0.0 respectively; see for example FIG. 17D, POOL1_BC5_ref_rate. If, instead the DNA is 8% fetal, and 92% maternal, we expect (1) through (7) to be centered at 1.00, 0.96, 0.54, 0.50, 0.46, 0.04 and 0.00 respectively; see for example FIG. 17B, POOL1_BC2_ref_rate. If there is not fetal DNA detected, we do not expect to see (2), (3), (5), or (6); alternately we could say that the separation is zero, and therefore (1) and (2) are on top of each other, as are (3), (4) and (5), and also (6) and (7); see e.g. FIG. 17C, POOL1_BC7_ref_rate. Note that the fetal fraction for FIG. 17A, POOL1_BC1_ref_rate is about 25%.

Example 5

Figure 18:
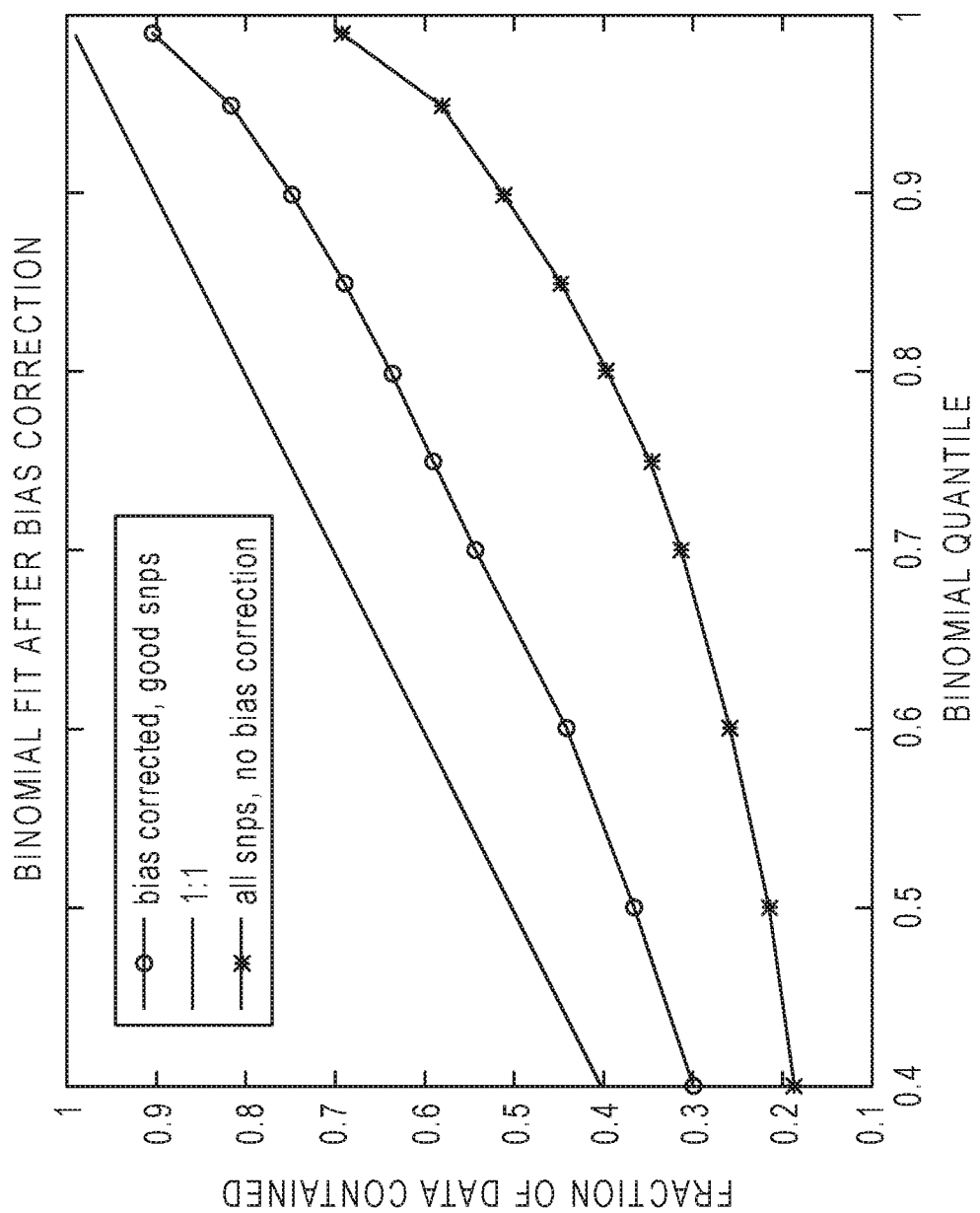
FIG. 18: Fraction of data that can be explained by binomial variance before and after data correction.

Most methods of DNA amplification and measurement will produce some allele bias, wherein the two alleles that are typically found at a locus are detected with intensities or counts that are not representative of the actual amounts of alleles in the sample of DNA. For example, for a single individual, at a heterozygous locus we expect to see a 1:1 ratio of the two alleles, which is the theoretical ratio expected for a heterozygous locus; however due to allele bias, we may see 55:45, or even 60:40. Also note that in the context of sequencing, if the depth of read is low, then simple stochastic noise could result in significant allele bias. In an embodiment, it is possible to model the behavior of each SNP such that if a consistent bias is observed for particular alleles, this bias can be corrected for. FIG. 18 shows the fraction of data that can be explained by binomial variance, before and after bias correction. In FIG. 18, the stars represent the observed allele bias on raw sequence data for the 800-plex experiment; the circles represent the allele bias after correction. Note that if there were no allele bias at all, we would expect the data to fall along the x=y line. A similar set of data that was produced by amplifying DNA using a 150-plex targeted amplification produced data that fell very closely on the 1:1 line after bias correction.

Example 6

Figure 19:
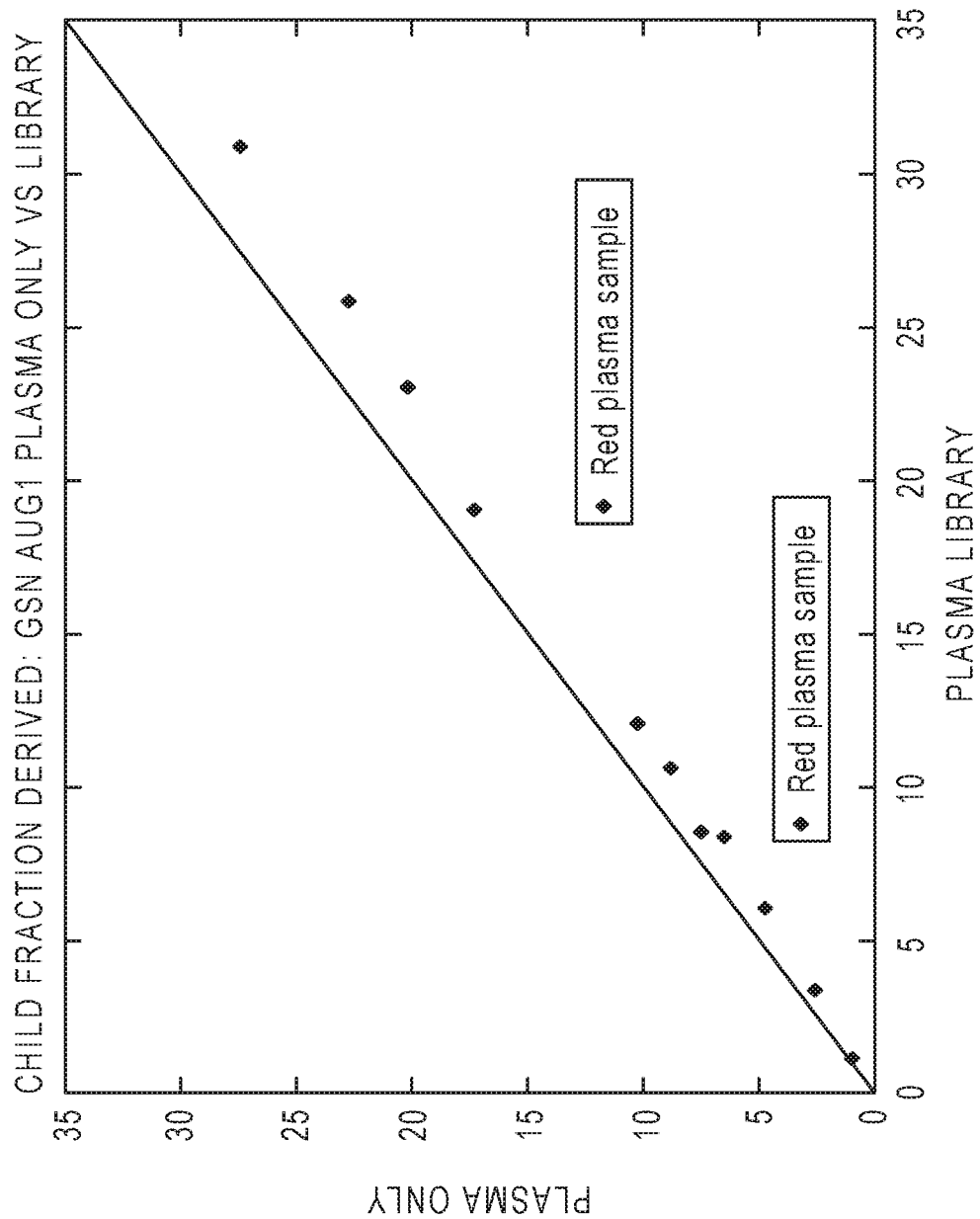
FIG. 19: Graph showing relative enrichment of fetal DNA in samples following a short library preparation protocol.

Universal amplification of DNA using ligated adaptors with primers specific to the adaptor tags, where the primer annealing and extension times are limited to a few minutes has the effect of enriching the proportion of shorter DNA strands. Most library protocols designed for creating DNA libraries suitable for sequencing contain such a step, and example protocols are published and well known to those in the art. In some embodiments of the invention, adaptors with a universal tag are ligated to the plasma DNA, and amplified using primers specific to the adaptor tag. In some embodiments, the universal tag can be the same tag as used for sequencing, it can be a universal tag only for PCR amplification, or it can be a set of tags. Since the fetal DNA is typically short in nature, while the maternal DNA can be both short and long in nature, this method has the effect of enriching the proportion of fetal DNA in the mixture. The free floating DNA, thought to be DNA from apoptotic cells, and which contains both fetal and maternal DNA, is short— mostly under 200 bp. Cellular DNA released by cell lysis, a common phenomenon after phlebotomy, is typically almost exclusively maternal, and is also quite long—mostly above 500 bp. Therefore, blood samples that have sat around for more than a few minutes will contain a mixture of short (fetal+maternal) and longer (maternal) DNA. Performing a universal amplification with relatively short extension times on maternal plasma followed by targeted amplification will tend to increase the relative proportion of fetal DNA when compared to the plasma that has been amplified using targeted amplification alone. This can be seen in FIG. 19 which shows the measured fetal percent when the input is plasma DNA (vertical axis) vs. the measured fetal percent when the input DNA is plasma DNA that has had a library prepared using the ILLUMINA GAIIx library preparation protocol. All the dots fall below the line, indicating that the library preparation step enriches the fraction of DNA that is of fetal origin. Two samples of plasma that were red, indicating hemolysis and therefore that there would be an increased amount of long maternal DNA present from cell lysis, show a particularly significant enrichment of fetal fraction when the library preparation is performed prior to targeted amplification. The method disclosed herein is particularly useful in cases where there is hemolysis or some other situation has occurred where cells comprising relatively long strands of contaminating DNA have lysed, contaminating the mixed sample of short DNA with the long DNA. Typically the relatively short annealing and extension times are between 30 seconds and 2 minutes, though they could be as short as 5 or 10 seconds or less, or as long as 5 or 10 minutes.

Example 7

The following protocol was used for 1,200-plex amplification of DNA isolated from maternal plasma from a euploid pregnancy and also genomic DNA from a triploidy 21 cell line using a direct PCR protocol, and also a semi-nested approach. Library preparation and amplification involved single tube blunt ending followed by A-tailing. Adaptor ligation was run using a modification of the ligation kit found in the AGILENT SURESELECT kit, and PCR was run for 7 cycles. In the targeted primer pool, there were 550 assays for SNPs from chromosome 21, and 325 assays for SNPs from each of chromosomes 1 and X. Both protocols involved 15 cycles of STA (95° C. for 30 s; 72° C. for 1 min; 60° C. for 4 min; 65° C. for 30 s; 72° C. for 30 s) using 16 nM primer concentration. The semi-nested PCR protocol involved a second amplification of 15 cycles of STA (95° C. for 30 s; 72° C. for 1 min; 60° C. for 4 min; 65° C. for 30 s; 72° C. for 30 s) using an inner forward tag concentration of 29 nM, and a reverse tag concentration of 1 uM or 0.1 uM. The DNA was then sequenced with an ILLUMINA IIGAX sequencer. For the direct PCR protocol, 73% of the reads map to the genome; for the semi-nested protocol, 97.2% of the sequence reads map to the genome. Therefore, the semi-nested protocol result in approximately 30% more information, presumably mostly due to the elimination of primers that are most likely to cause primer dimers.

Figure 20:
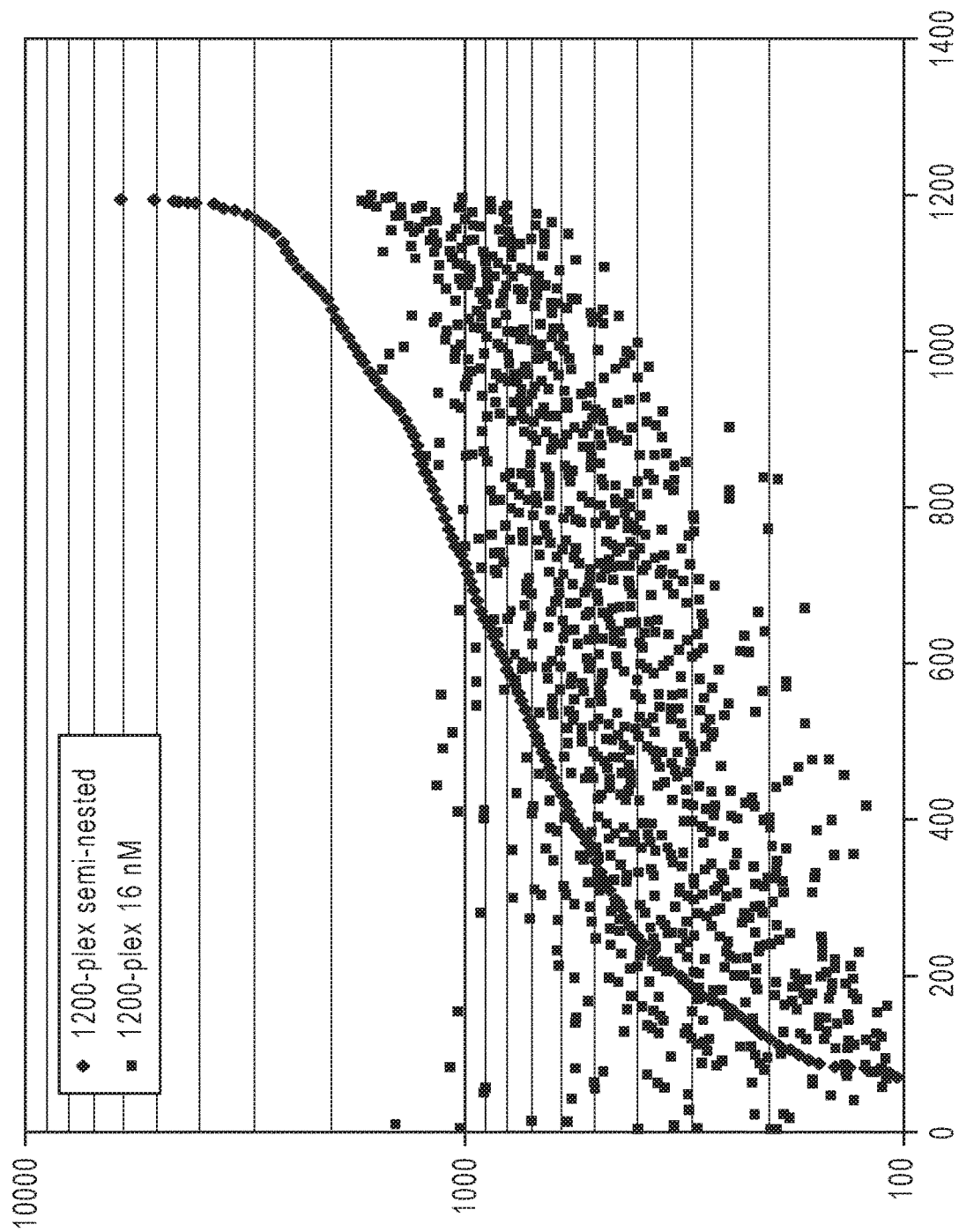
FIG. 20: Depth of read graph comparing direct PCR and semi-nested methods.

The depth of read variability tends to be higher when using the semi-nested protocol than when the direct PCR protocol is used (see FIG. 20) where the diamonds refer to the depth of read for loci run with the semi-nested protocol, and the squares refer to the depth of read for loci run with no nesting. The SNPs are arranged by depth of read for the diamonds, so the diamonds all fall on a curved line, while the squares appear to be loosely correlated; the arrangements of the SNPs is arbitrary, and it is the height of the dot that denotes depth of read rather than its location left to right.

Figure 21:
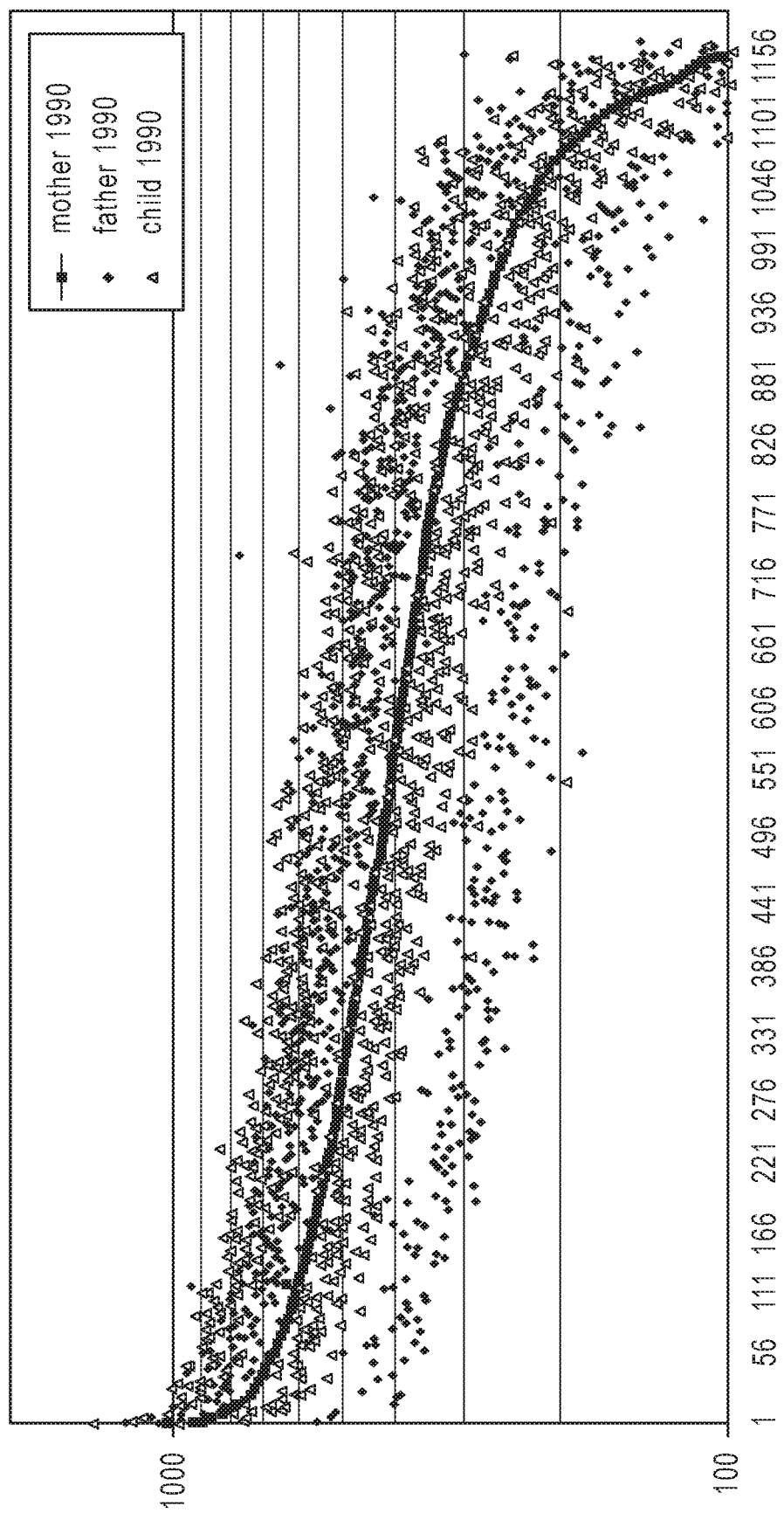
FIG. 21: Comparison of depth of read for direct PCR of three genomic samples.
Figure 22:
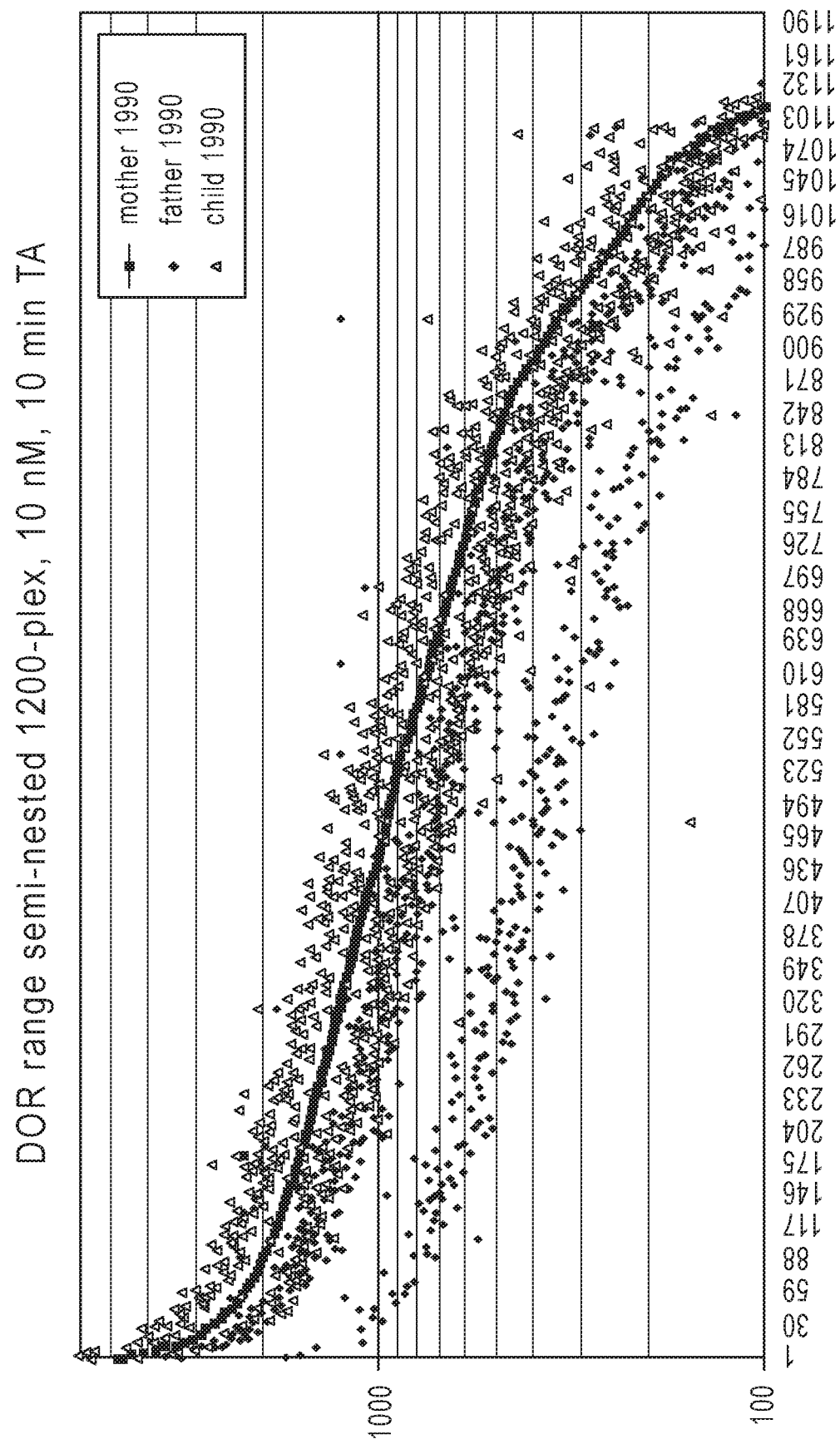
FIG. 22: Comparison of depth of read for semi-nested mini-PCR of three samples.

In some embodiments, the methods described herein can achieve excellent depth of read (DOR) variances. For example, in one version of this Example (FIG. 21) using a 1,200-plex direct PCR amplification of genomic DNA, of the 1,200 assays: 1186 assays had a DOR greater than 10; the average depth of read was 400; 1063 assays (88.6%) had a depth of read of between 200 and 800, and ideal window where the number of reads for each allele is high enough to give meaningful data, while the number of reads for each allele is not so high that the marginal use of those reads was particularly small. Only 12 alleles had higher depth of read with the highest at 1035 reads. The standard deviation of the DOR was 290, the average DOR was 453, the coefficient of variance of the DOR was 64%, there were 950,000 total reads, and 63.1% of the reads mapped to the genome. In another experiment (FIG. 22) using a 1,200-plex semi-nested protocol, the DOR was higher. The standard deviation of the DOR was 583, the average DOR was 630, the coefficient of variance of the DOR was 93%, there were 870,000 total reads, and 96.3% of the reads mapped to the genome. Note, in both these cases, the SNPs are arranged by the depth of read for the mother, so the curved line represents the maternal depth of read. The differentiation between child and father is not significant; it is only the trend that is significant for the purpose of this explanation.

Example 8

In an experiment, the semi-nested 1,200-plex PCR protocol was used to amplify DNA from one cell and from three cells. This experiment is relevant to prenatal aneuploidy testing using fetal cells isolated from maternal blood, or for preimplantation genetic diagnosis using biopsied blastomeres or trophectoderm samples. There were 3 replicates of 1 and 3 cells from 2 individuals (46 XY and 47 XX+21) per condition. Assays targeted chromosomes 1, 21 and X. Three different lysis methods were used: ARCTURUS, MPERv2 and Alkaline lysis. Sequencing was run multiplexing 48 samples in one sequencing lane. The algorithm returned correct ploidy calls for each of the three chromosomes, and for each of the replicates.

Example 9

In one experiment, four maternal plasma samples were prepared and amplified using a hemi-nested 9,600-plex protocol. The samples were prepared in the following way: Up to 40 mL of maternal blood were centrifuged to isolate the buffy coat and the plasma. The genomic DNA in the maternal sample was prepared from the buffy coat and paternal DNA was prepared from a blood sample or saliva sample. Cell-free DNA in the maternal plasma was isolated using the QIAGEN CIRCULATING NUCLEIC ACID kit and eluted in 45 uL TE buffer according to manufacturer's instructions. Universal ligation adapters were appended to the end of each molecule of 35 uL of purified plasma DNA and libraries were amplified for 7 cycles using adaptor specific primers. Libraries were purified with AGENCOURT AMPURE beads and eluted in 50 ul water.

3 ul of the DNA was amplified with 15 cycles of STA (95° C. for 10 min for initial polymerase activation, then 15 cycles of 95° C. for 30 s; 72° C. for 10 s; 65° C. for 1 min; 60° C. for 8 min; 65° C. for 3 min and 72° C. for 30 s; and a final extension at 72° C. for 2 min) using 14.5 nM primer concentration of 9600 target-specific tagged reverse primers and one library adaptor specific forward primer at 500 nM.

The hemi-nested PCR protocol involved a second amplification of a dilution of the first STAs product for 15 cycles of STA (95° C. for 10 min for initial polymerase activation, then 15 cycles of 95° C. for 30 s; 65° C. for 1 min; 60° C. for 5 min; 65° C. for 5 min and 72° C. for 30 s; and a final extension at 72° C. for 2 min) using reverse tag concentration of 1000 nM, and a concentration of 16.6 u nM for each of 9600 target-specific forward primers.

An aliquot of the STA products was then amplified by standard PCR for 10 cycles with 1 uM of tag-specific forward and barcoded reverse primers to generate barcoded sequencing libraries. An aliquot of each library was mixed with libraries of different barcodes and purified using a spin column.

In this way, 9,600 primers were used in the single-well reactions; the primers were designed to target SNPs found on chromosomes 1, 2, 13, 18, 21, X and Y. The amplicons were then sequenced using an ILLUMINA GAIIX sequencer. Per sample, approximately 3.9 million reads were generated by the sequencer, with 3.7 million reads mapping to the genome (94%), and of those, 2.9 million reads (74%) mapped to targeted SNPs with an average depth of read of 344 and a median depth of read of 255. The fetal fraction for the four samples was found to be 9.9%, 18.9%, 16.3%, and 21.2%

Relevant maternal and paternal genomic DNA samples amplified using a semi-nested 9600-plex protocol and sequenced. The semi-nested protocol is different in that it applies 9,600 outer forward primers and tagged reverse primers at 7.3 nM in the first STA. Thermocycling conditions and composition of the second STA, and the barcoding PCR were the same as for the hemi-nested protocol.

The sequencing data was analyzed using informatics methods disclosed herein and the ploidy state was called at six chromosomes for the fetuses whose DNA was present in the 4 maternal plasma samples. The ploidy calls for all 28 chromosomes in the set were called correctly with confidences above 99.2% except for one chromosome that was called correctly, but with a confidence of 83%.

Figure 23:
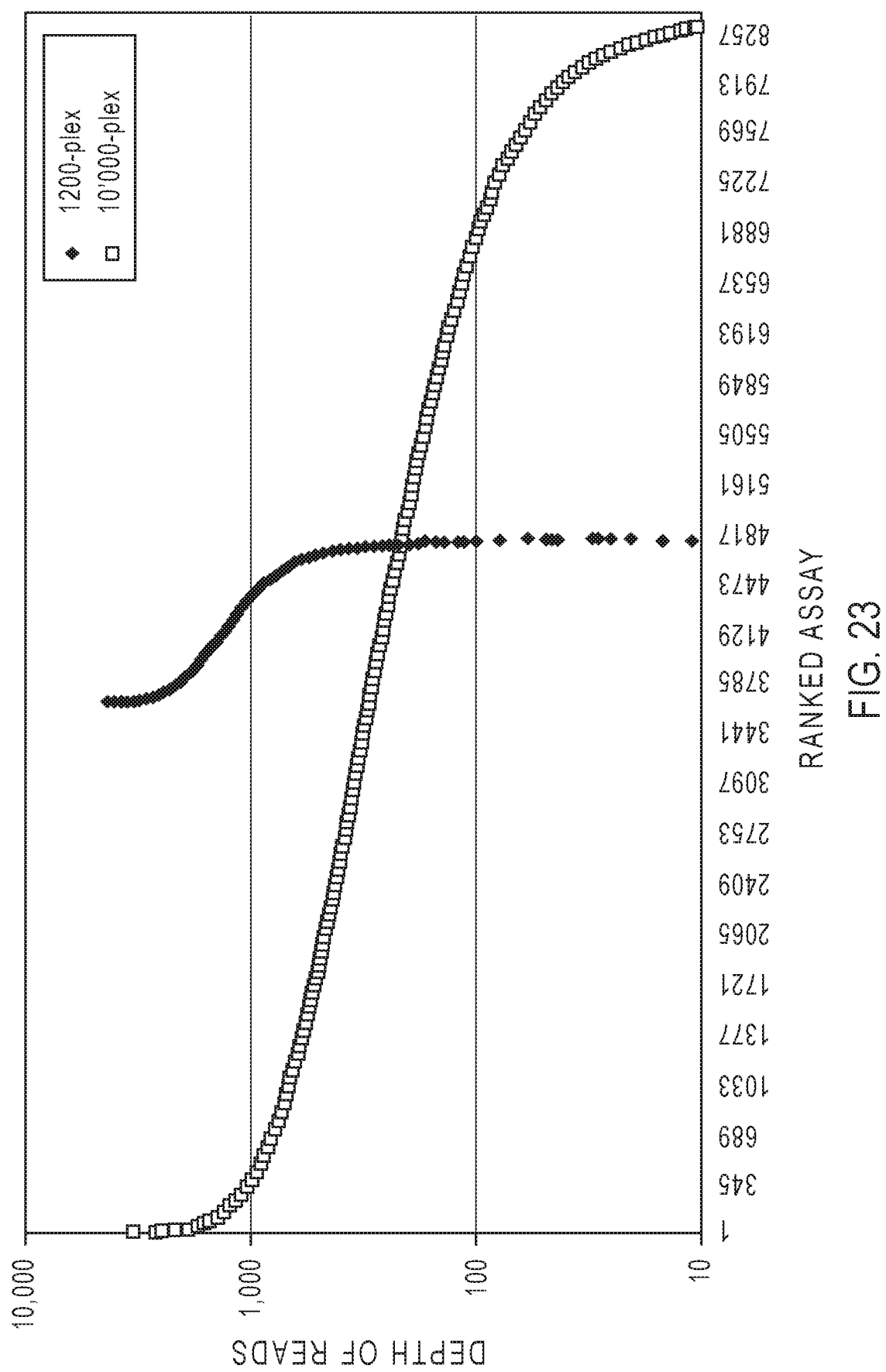
FIG. 23: Comparison of depth of read for 1,200-plex and 9,600-plex reactions.

FIG. 23 shows the depth of read of the 9,600-plex hemi-nesting approach along with the depth of read of the 1,200-plex semi-nested approach described in Example 7, though the number of SNPs with a depth of read greater than 100, greater than 200 and greater than 400 was significantly higher than in the 1,200-plex protocol. The number of reads at the $90^{th}$ percentile can be divided by the number of reads at the $10^{th}$ percentile to give a dimensionless metric that is indicative of the uniformity of the depth of read; the smaller the number, the more uniform (narrow) the depth of read. The average $90^{th}$ percentile/$10^{th}$ percentile ratio is 11.5 for the method run in Example 9, while it is 5.6 for the method run in Example 7. A narrower depth of read for a given protocol plexity is better for sequencing efficiency, as fewer sequence reads are necessary to ensure that a certain percentage of reads are above a read number threshold.

Example 10

In one experiment, four maternal plasma samples were prepared and amplified using a semi-nested 9,600-plex protocol. Details of Example 10 were very similar to Example 9, the exception being the nesting protocol, and including the identity of the four samples. The ploidy calls for all 28 chromosomes in the set were called correctly with confidences above 99.7%. 7.6 million (97%) of reads mapped to the genome, and 6.3 million (80%) of the reads mapped to the targeted SNPs. The average depth of read was 751, and the median depth of read was 396.

Example 11

In one experiment, three maternal plasma samples were split into five equal portions, and each portion was amplified using either 2,400 multiplexed primers (four portions) or 1,200 multiplexed primers (one portion) and amplified using a semi-nested protocol, for a total of 10,800 primers. After amplification, the portions were pooled together for sequencing. Details of Example 11 were very similar to Example 9, the exception being the nesting protocol, and the split and pool approach. The ploidy calls for all 21 chromosomes in the set were called correctly with confidences above 99.7%, except for one missed call where the confidence was 83%. 3.4 million reads mapped to targeted SNPs, the average depth of read was 404 and the median depth of read was 258.

Example 12

In one experiment, four maternal plasma samples were split into four equal portions, and each portion was amplified using 2,400 multiplexed primers and amplified using a semi-nested protocol, for a total of 9,600 primers. After amplification, the portions were pooled together for sequencing. Details of Example 12 were very similar to Example 9, the exception being the nesting protocol, and the split and pool approach. The ploidy calls for all 28 chromosomes in the set were called correctly with confidences above 97%, except for one missed call where the confidence was 78%. 4.5 million reads mapped to targeted SNPs, the average depth of read was 535 and the median depth of read was 412.

Example 13

In one experiment, four maternal plasma samples were prepared and amplified using a 9,600-plex triply hemi-nested protocol, for a total of 9,600 primers. Details of Example 12 were very similar to Example 9, the exception being the nesting protocol which involved three rounds of amplification; the three rounds involved 15, 10 and 15 STA cycles respectively. The ploidy calls for 27 of 28 chromosomes in the set were called correctly with confidences above 99.9%, except for one that was called correctly with 94.6%, and one missed call with a confidence of 80.8%. 3.5 million reads mapped to targeted SNPs, the average depth of read was 414 and the median depth of read was 249.

Example 14

In one Example 45 sets of cells were amplified using a 1,200-plex semi-nested protocol, sequenced, and ploidy determinations were made at three chromosomes. Note that this experiment is meant to simulate the conditions of performing pre-implantation genetic diagnosis on single-cell biopsies from day 3 embryos, or trophectoderm biopsies from day 5 embryos. 15 individual single cells and 30 sets of three cells were placed in 45 individual reaction tubes for a total of 45 reactions where each reaction contained cells from only one cell line, but the different reactions contained cells from different cell lines. The cells were prepared into 5 ul washing buffer and lysed the by adding 5 ul ARCTURUS PICOPURE lysis buffer (APPLIED BIOSYSTEMS) and incubating at 56° C. for 20 min, 95° C. for 10 min.

The DNA of the single/three cells was amplified with 25 cycles of STA (95° C. for 10 min for initial polymerase activation, then 25 cycles of 95° C. for 30 s; 72° C. for 10 s; 65° C. for 1 min; 60° C. for 8 min; 65° C. for 3 min and 72° C. for 30 s; and a final extension at 72° C. for 2 min) using 50 nM primer concentration of 1200 target-specific forward and tagged reverse primers.

The semi-nested PCR protocol involved three parallel second amplification of a dilution of the first STAs product for 20 cycles of STA (95° C. for 10 min for initial polymerase activation, then 15 cycles of 95° C. for 30 s; 65° C. for 1 min; 60° C. for 5 min; 65° C. for 5 min and 72° C. for 30 s; and a final extension at 72° C. for 2 min) using reverse tag specific primer concentration of 1000 nM, and a concentration of 60 nM for each of 400 target-specific nested forward primers. In the three parallel 400-plex reactions the total of 1200 targets amplified in the first STA were thus amplified.

An aliquot of the STA products was then amplified by standard PCR for 15 cycles with 1 uM of tag-specific forward and barcoded reverse primers to generate barcoded sequencing libraries. An aliquot of each library was mixed with libraries of different barcodes and purified using a spin column.

In this way, 1,200 primers were used in the single cell reactions; the primers were designed to target SNPs found on chromosomes 1, 21 and X. The amplicons were then sequenced using an ILLUMINA GAIIX sequencer. Per sample, approximately 3.9 million reads were generated by the sequencer, with 500,000 to 800,000 million reads mapping to the genome (74% to 94% of all reads per sample).

Relevant maternal and paternal genomic DNA samples from cell lines were analyzed using the same semi-nested 1200-plex assay pool with a similar protocol with fewer cycles and 1200-plex second STA, and sequenced.

The sequencing data was analyzed using informatics methods disclosed herein and the ploidy state was called at the three chromosomes for the samples.

Figure 24:
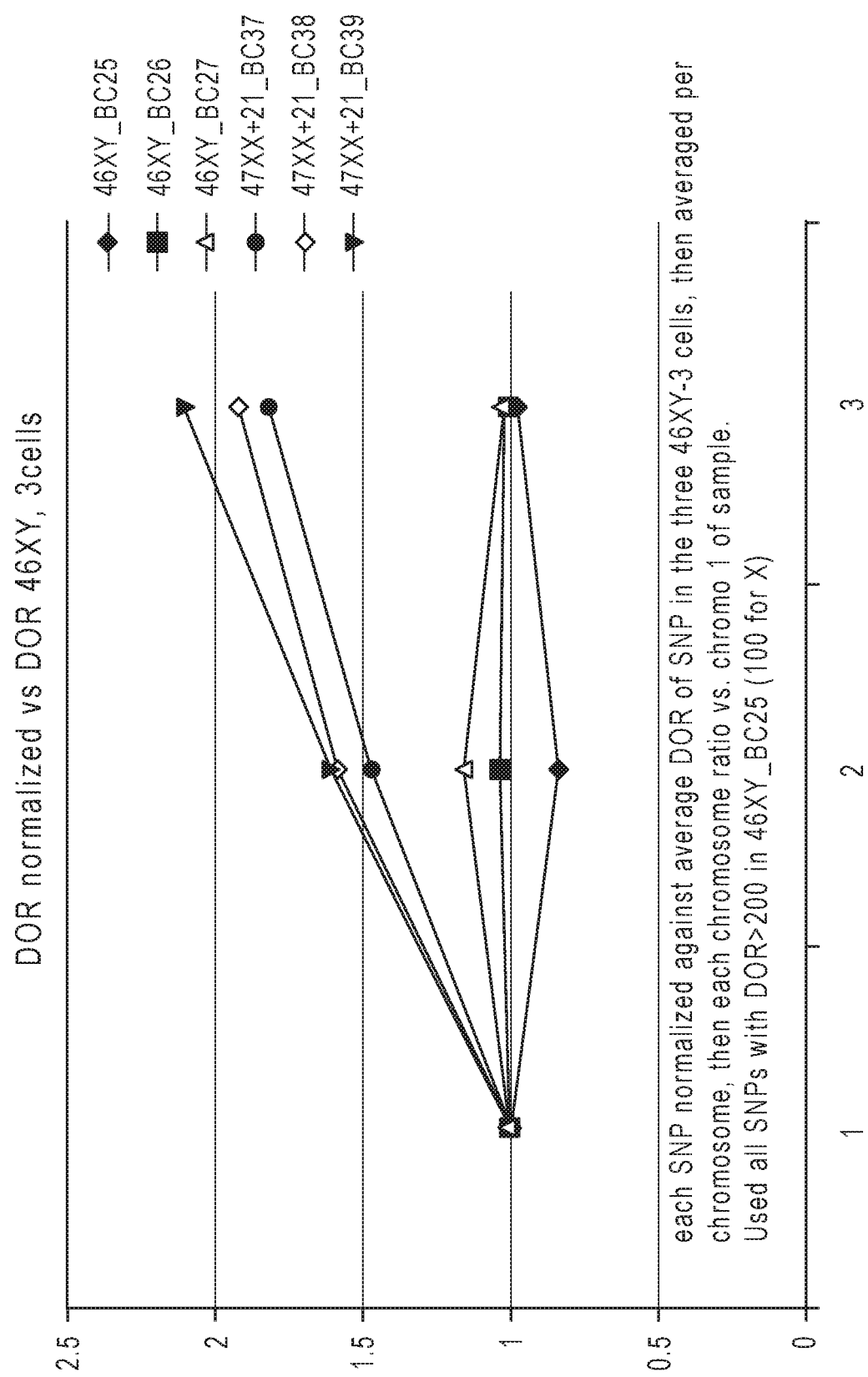
FIG. 24: Read count ratios for six cells at three chromosomes.

FIG. 24 shows normalized depth of read ratios (vertical axis) for six samples at three chromosomes (1=chrom 1; 2=chrom 21; 3=chrom X). The ratios were set to be equal to the number of reads mapping to that chromosome, normalized, and divided by the number of reads mapping to that chromosome averaged over three wells each comprising three 46XY cells. The three sets of data points corresponding to the 46XY reactions are expected to have ratios of 1:1. The three sets of data points corresponding to the 47XX+21 cells are expected to have ratios of 1:1 for chromosome 1, 1.5:1 for chromosome 21, and 2:1 for chromosome X.

Figure 25A:
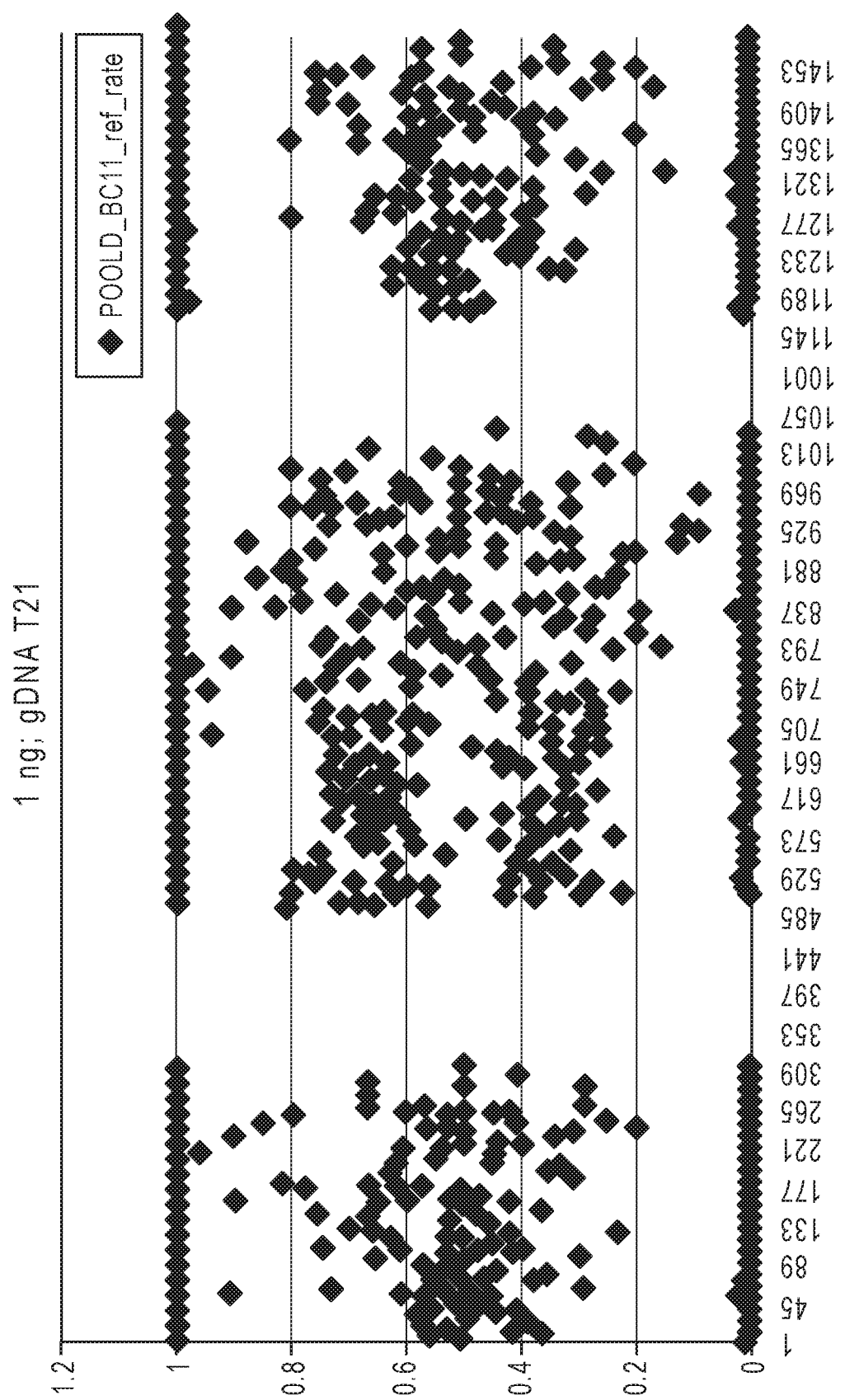
FIGS. 25A-25C: Allele ratios for two three-cell reactions (FIGS. 25B and 25C) and a third reaction run on 1 ng of genomic DNA at three chromosomes (FIG. 25A).
Figure 25B:
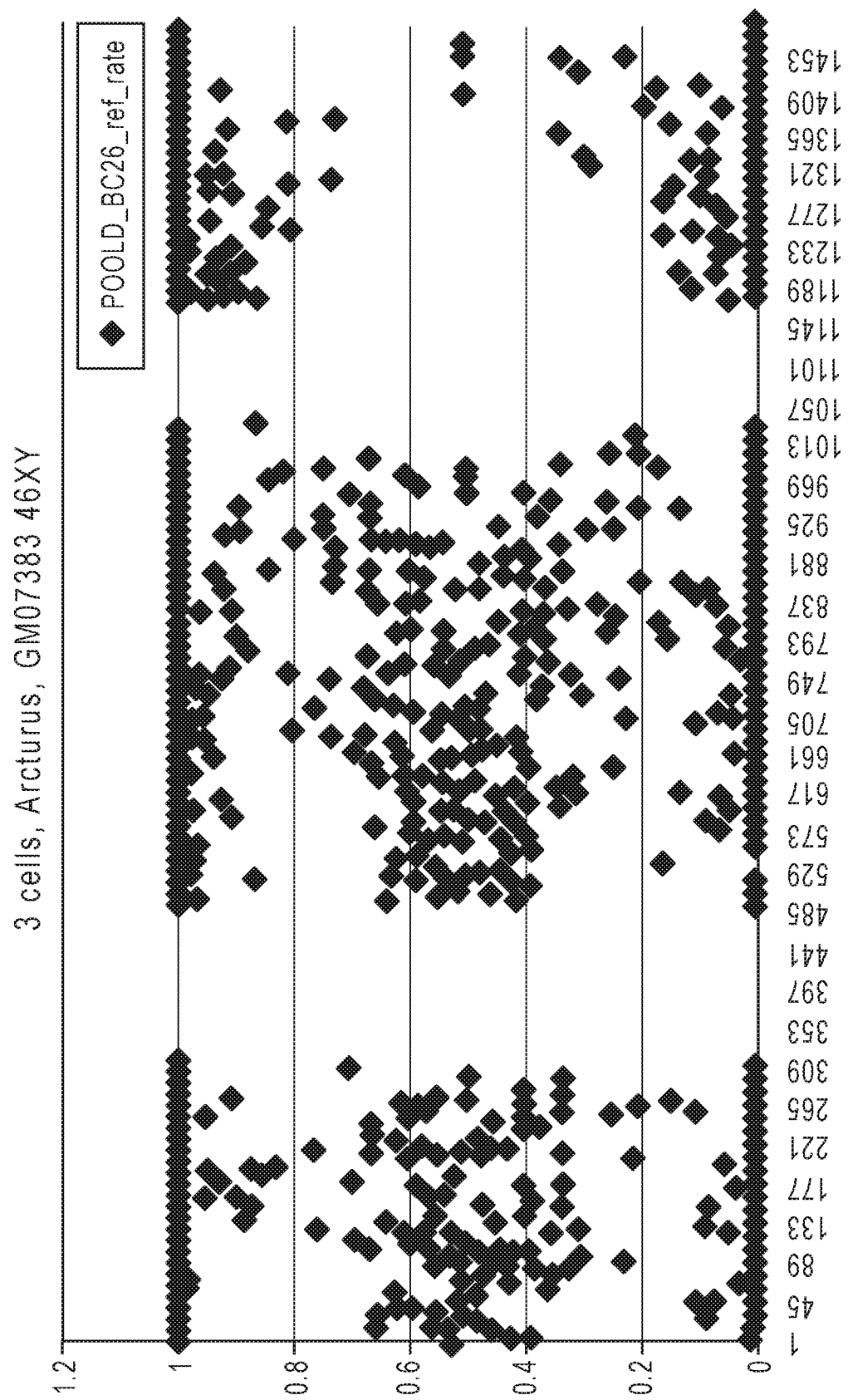
Figure 25C:
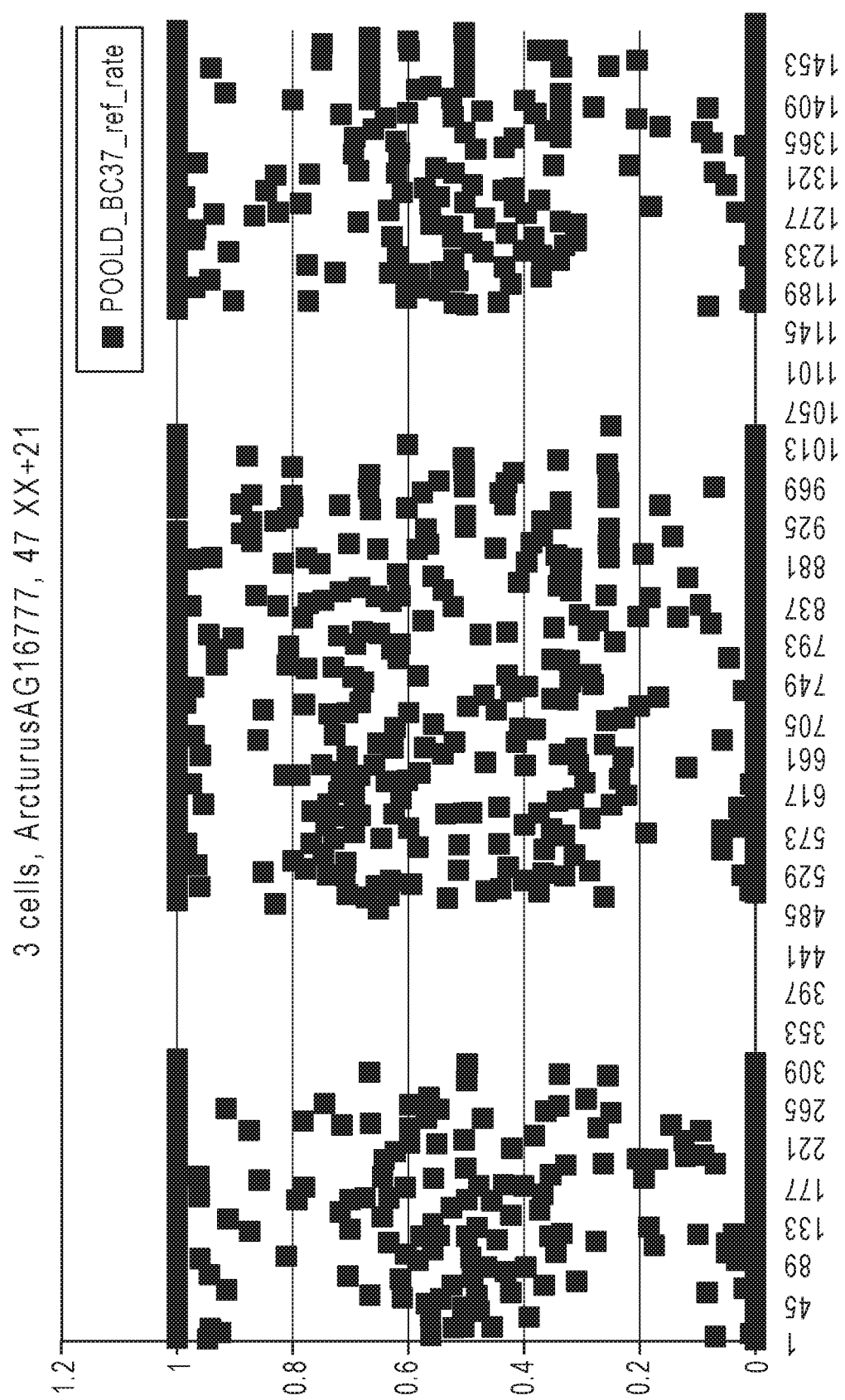
Figure 26A:
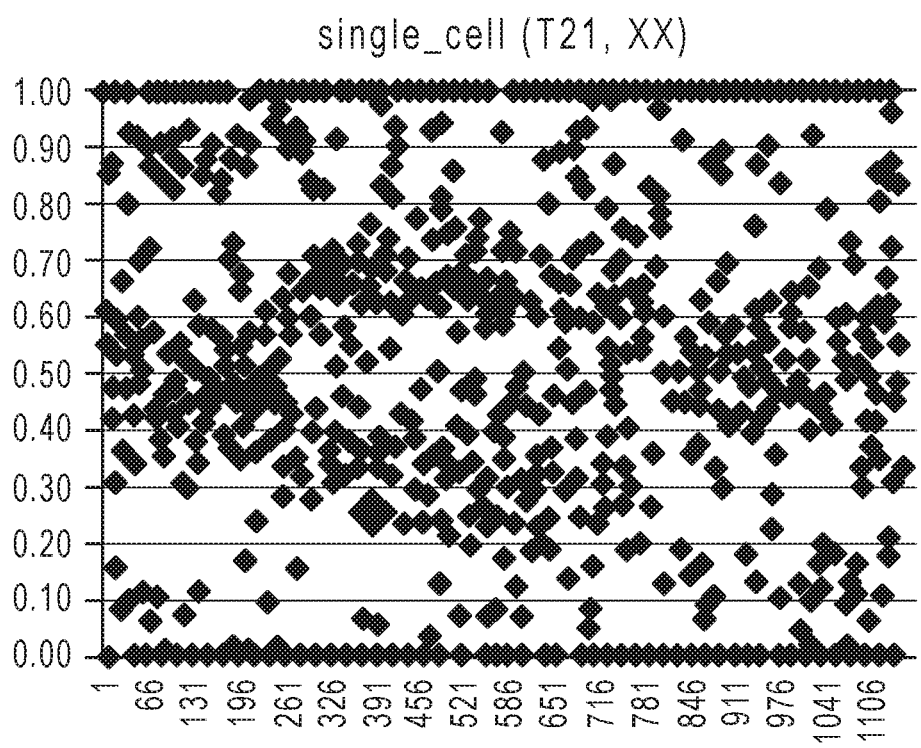
FIGS. 26A and 26B: Allele ratios for two single-cell reactions (FIGS. 26A and 26B) at three chromosomes.
Figure 26B:
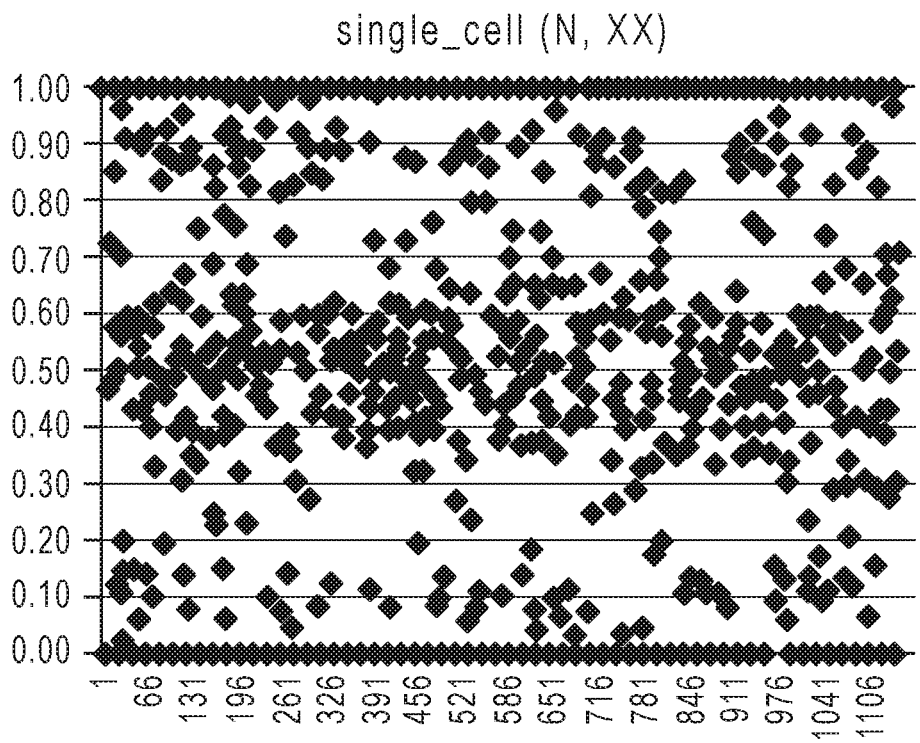

FIG. 25A-25C show allele ratios plotted for three chromosomes (1, 21, X) for three reaction. The reaction in the lower left shows a reaction on three 46XY cells (FIG. 25B). The left region are the allele ratios for chromosome 1, the middle region are the allele ratios for chromosome 21, and the right region are the allele ratios for chromosome X. For the 46XY cells, for chromosome 1 we expect to see ratios of 1, 0.5 and 0, corresponding to AA, AB and BB SNP genotypes. For the 46XY cells, for chromosome 21 we expect to see ratios of 1, 0.5 and 0, corresponding to AA, AB and BB SNP genotypes. For the 46XY cells, for chromosome X we expect to see ratios of 1 and 0, corresponding to A, and B SNP genotypes. The reaction in the lower right shows a reaction on three 47XX+21 cells (FIG. 25C). The allele ratios are segregated by chromosome as in the lower left graph. For the 47XX+21 cells, for chromosome 1 we expect to see ratios of 1, 0.5 and 0, corresponding to AA, AB and BB SNP genotypes. For the 47XX+21 cells, for chromosome 21 we expect to see ratios of 1, 0.67, 0.33 and 0, corresponding to AAA, AAB, ABB and BBB SNP genotypes. For the 47XX+21 cells, for chromosome X we expect to see ratios of 1, 0.5 and 0, corresponding to AA, AB, and BB SNP genotypes. The plot in the upper right was made on a reaction comprising 1 ng of genomic DNA from the 47XX+21 cell line (FIG. 25A). FIG. and 26B shows the same graphs as in FIG. 25A-25C, but for reactions performed on only one cell. The left graph was a reaction that contained a 47XX+21 cell (FIG. 26A), and the right graph was for a reaction that contained a 46XX cell (FIG. 26B).

From the graphs shown in FIGS. 25A-25C and FIGS. 26A and 26B, it is visually apparent that there are two clusters of dots for chromosomes where we expect to see ratios of 1 and 0; three clusters of dots for chromosomes where we expect to see ratios of 1, 0.5, and 0, and four clusters of dots for chromosomes where we expect to see ratios of 1, 0.67, 0.33 and 0. The parental support algorithm was able to make correct calls on all of the three chromosomes for all of the 45 reactions.

Example 15

In one experiment, maternal plasma samples were prepared and amplified using a hemi-nested 19,488-plex protocol. The samples were prepared in the following way: up to 20 mL of maternal blood were centrifuged to isolate the buffy coat and the plasma. The genomic DNA in the maternal sample was prepared from the buffy coat and paternal DNA was prepared from a blood sample or saliva sample. Cell-free DNA in the maternal plasma was isolated using the QIAGEN CIRCULATING NUCLEIC ACID kit and eluted in 50 uL TE buffer according to manufacturer's instructions. Universal ligation adapters were appended to the end of each molecule of 40 uL of purified plasma DNA and libraries were amplified for 9 cycles using adaptor specific primers. Libraries were purified with AGENCOURT AMPURE beads and eluted in 50 ul DNA suspension buffer.

6 ul of the DNA was amplified with 15 cycles of STAR 1 (95° C. for 10 min for initial polymerase activation, then 15 cycles of 96° C. for 30 s; 65° C. for 1 min; 58° C. for 6 min; 60° C. for 8 min; 65° C. for 4 min and 72° C. for 30 s; and a final extension at 72° C. for 2 min) using 7.5 nM primer concentration of 19,488 target-specific tagged reverse primers and one library adaptor specific forward primer at 500 nM.

The hemi-nested PCR protocol involved a second amplification of a dilution of the STAR 1 product for 15 cycles (STAR 2) (95° C. for 10 min for initial polymerase activation, then 15 cycles of 95° C. for 30 s; 65° C. for 1 min; 60° C. for 5 min; 65° C. for 5 min and 72° C. for 30 s; and a final extension at 72° C. for 2 min) using reverse tag concentration of 1000 nM, and a concentration of 20 nM for each of 19,488 target-specific forward primers.

An aliquot of the STAR 2 products was then amplified by standard PCR for 12 cycles with 1 uM of tag-specific forward and barcoded reverse primers to generate barcoded sequencing libraries. An aliquot of each library was mixed with libraries of different barcodes and purified using a spin column.

In this way, 19,488 primers were used in the single-well reactions; the primers were designed to target SNPs found on chromosomes 1, 2, 13, 18, 21, X and Y. The amplicons were then sequenced using an ILLUMINA GAIIX sequencer. For plasma samples, approximately 10 million reads were generated by the sequencer, with 9.4-9.6 million reads mapping to the genome (94-96%), and of those, 99.95% mapped to targeted SNPs with a mean depth of read of 460 and a median depth of read of 350. For comparison, a perfectly even distribution would be: 10M reads/19,488 targets=513 reads/target. For primer-dimers, 30,000 reads were from sequenced primer-dimers (0.3% of the reads generated by the sequencer). For genomic samples, 99.4-99.7% of the reads mapped to the genome, of those, 99.99% of the mapped to targeted SNPs, and 0.1% of the reads generated by the sequencer were primer-dimers.

For plasma samples with 10 million sequencing reads, typically at least 19,350 of the 19,488 targeted SNPs (99.3%) are amplified and sequenced. For DNA samples with 2M sequencing reads, typically at least 19,000 targeted SNPs (97.5%) are amplified and sequenced. The lower number may be due to sampling noise since the number of reads is lower and the sequencer misses some of the amplified products. If desired, the number of sequencing reads can be increased to increase the number of targeted SNPs that are amplified and sequenced.

Relevant maternal and paternal genomic DNA samples amplified using a semi-nested 19,488 outer forward primers and tagged reverse primers at 7.5 nM in the STAR 1. Thermocycling conditions and composition of STAR 2, and the barcoding PCR were the same as for the hemi-nested protocol.

The average fetal fraction for 407 samples was found to be 14.8%. The sequencing data was analyzed using informatics methods disclosed herein and the ploidy state was called at four chromosomes (13, 18, 21, Y) for the fetuses whose DNA was present in 378 of the 407 maternal plasma samples, and at chromosome X in 375 of the 407 maternal plasma samples. The ploidy calls for all 1,887 chromosomes in the set were called correctly with confidences above 90%. 1882 of the 1887 calls were above 95%; and 1,862 of the 1,887 calls were called with confidences above 99%.

A similar control experiment was performed using water instead of DNA extracted from plasma in the plasma PCR protocol. Based on six such trials of an experiment, 5-6% of the sequenced reads were primer-dimers. Other sequenced reads were due to background noise. This experiment demonstrates that even in the absence of a nucleic acid sample with target loci for the primers to hybridize to (rather than hybridizing to other primers and forming amplified primer dimers) few primer dimers are formed.

Example 16

The following Example illustrates an exemplary method for designing and selecting a library of primers that can be used in any of the multiplexed PCR methods of the invention. The goal is to select primers from an initial library of candidate primers that can be used to simultaneously amplify a large number of target loci (or a subset of target loci) in a single reaction. For an initial set of candidate target loci, primers did not have to be designed or selected for each target locus. Preferably, primers are designed and selected for a large portion of the most desirable target loci.

Step 1

A set of candidate target loci (such as SNPs) were selected based on publically available information about desired parameters for the target loci, such as frequency of the SNPs within a target population or heterozygosity rate of the SNPs (worldwide web at ncbi.nlm.nih.gov/projects/SNP/; Sherry S T, Ward M H, Kholodov M, et al. dbSNP: the NCBI database of genetic variation. Nucleic Acids Res. 2001 Jan. 1; 29(1):308-11, which are each incorporated by reference in its entirety). For each candidate locus, one or more PCR primer pairs were designed using the Primer3 program (the worldwide web at primer3.sourceforge.net; libprimer3 release 2.2.3, which is hereby incorporated by reference in its entirety). If there were no feasible designs for PCR primers for a particular target locus, then that target locus was eliminated from further consideration. If desired, a "target locus score" (higher score representing higher desirability) can be calculated for most or all of the target loci, such as a target locus score calculated based on a weighted average of various desired parameters for the target loci. The parameters may be assigned different weights based on their importance for the particular application that the primers will be used for. Exemplary parameters include the heterozygosity rate of the target locus, the disease prevalence associated with a sequence (e.g., a polymorphism) at the target locus, the disease penetrance associated with a sequence (e.g., a polymorphism) at the target locus, the specificity of the candidate primer(s) used to amplify the target locus, the size of the candidate primer(s) used to amply the target locus, and the size of the target amplicon. In some embodiments, the specificity of the candidate primer for the target locus includes the likelihood that the candidate primer will mis-prime by binding and amplifying a locus other than the target locus it was designed to amplify. In some embodiments, one or more or all the candidate primers that misprime are removed from the library.

Step 2

A thermodynamic interaction score was calculated between each primer and all primers for all other target loci from Step 1 (see, e.g., Allawi, H. T. & SantaLucia, J., Jr. (1998), "Thermodynamics of Internal C-T Mismatches in DNA", *Nucleic Acids Res.* 26, 2694-2701; Peyret, N., Seneviratne, P. A., Allawi, H. T. & SantaLucia, J., Jr. (1999), "Nearest-Neighbor Thermodynamics and NMR of DNA Sequences with Internal A-A, C-C, G-G, and T-T Mismatches", *Biochemistry* 38, 3468-3477; Allawi, H. T. & SantaLucia, J., Jr. (1998), "Nearest-Neighbor Thermodynamics of Internal A-C Mismatches in DNA: Sequence Dependence and pH Effects", *Biochemistry* 37, 9435-9444; Allawi, H. T. & SantaLucia, J., Jr. (1998), "Nearest Neighbor Thermodynamic Parameters for Internal G-A Mismatches in DNA", *Biochemistry* 37, 2170-2179; and Allawi, H. T. & SantaLucia, J., Jr. (1997), "Thermodynamics and NMR of Internal G-T Mismatches in DNA", *Biochemistry* 36, 10581-10594; MultiPLX 2.1 (Kaplinski L, Andreson R, Puurand T, Remm M. MultiPLX: automatic grouping and evaluation of PCR primers. Bioinformatics. 2005 Apr. 15; 21(8):1701-2, which are each hereby incorporated by reference in its entirety). This step resulted in a 2D matrix of interaction scores. The interaction score predicted the likelihood of primer-dimers involving the two interacting primers. The score was calculated as follows:

interaction score=max(-deltaG_2,0.8*(-deltaG_1))

where deltaG_2=Gibbs energy (energy required to break the dimer) for a dimer that is extensible by PCR on both ends, i.e., the 3' end of each primer anneals to the other primer; and deltaG_1=Gibbs energy for a dimer that is extensible by PCR on at least one end.

Step 3:

For each target locus, if there was more than one primer-pair design, then one design was selected using the following method:

For each primer-pair design for the locus, find the worst-case (highest) interaction score for the two primers in that design and all primers from all designs for all other target loci.

Pick the design with the best (lowest) worst-case interaction score.

Step 4

A graph was built such that each node represented one locus and its associated primer-pair design (e.g., a Maximal Clique problem). One edge was created between every pair of nodes. A weight was assigned to each edge equal to the worst-case (highest) interaction score between the primers associated with the two nodes connected by the edge.

Step 5

If desired, for every pair of designs for two different target loci where one of the primers from one design and one of the primers from the other design would anneal to overlapping target regions, an additional edge was added between the nodes for the two design. The weight of these edges was set equal to the highest weight assigned in Step 4. Thus, Step 5 prevents the library from having primers that would anneal to overlapping target regions, and thus interfere with each other during a multiplex PCR reaction.

Step 6

An initial interaction score threshold was calculated as follows:

weight_threshold=max(edge_weight)-0.05*(max(edge_weight)-min(edge_weight))

where max(edge_weight) is the maximum edge weight in the graph; and min(edge_weight) is the minimum edge weight in the graph.

The initial bounds for the threshold were set as follows:

max_weight_threshold=max(edge_weight)

min_weight_threshold=min(edge_weight)

Step 7

A new graph was constructed consisting of the same set of nodes as the graph from Step 5, only including edges with weights that exceed weight_threshold. Thus, step ignores interactions with scores equal to or below weight_threshold.

Step 8

Nodes (and all of the edges connected to the removed nodes) were removed from the graph of Step 7 until there were no edges left. Nodes were removed by applying the following procedure repeatedly:

Find the node with the highest degree (highest number of edges). If there is more than one then pick one arbitrarily.

Define the set of nodes consisting of the node picked above and all of the nodes connected to it, but excluding any nodes that have degree less than the node picked above.

Choose the node from the set that has the lowest target locus score (lower score representing lower desirability) from Step 1. Remove that node from the graph.

Step 9

If the number of nodes remaining in the graph satisfies the required number of target loci for the multiplexed PCR pool (within an acceptable tolerance), then the method was continued at Step 10.

If there were too many or too few nodes remaining in the graph, then a binary search was performed to determine what threshold values would result in the desired number of nodes remaining in the graphs. If there were too many nodes in the graph then, the weight threshold bounds were adjusted as follows:

max_weight_threshold=weight_threshold

Otherwise (if there are two few nodes in the graph), then the weight_threshold bounds were adjusted as follows:

min_weight_threshold=weight_threshold

Then, the weight_threshold was adjusted follows:

weight_threshold=(max_weight_threshold+ min_weight_threshold)/2

Steps 7-9 were repeated.
Step 10

The primer-pair designs associated with the nodes remaining in the graph were selected for the library of primers. This primer library can be used in any of the methods of the invention.

If desired, this method of designing and selecting primers can be performed for primer libraries in which only one primer (instead of a primer pair) is used for amplification of a target locus. In this case, a node presents one primer per target locus (rather than a primer pair).

Example 17

Figure 27:
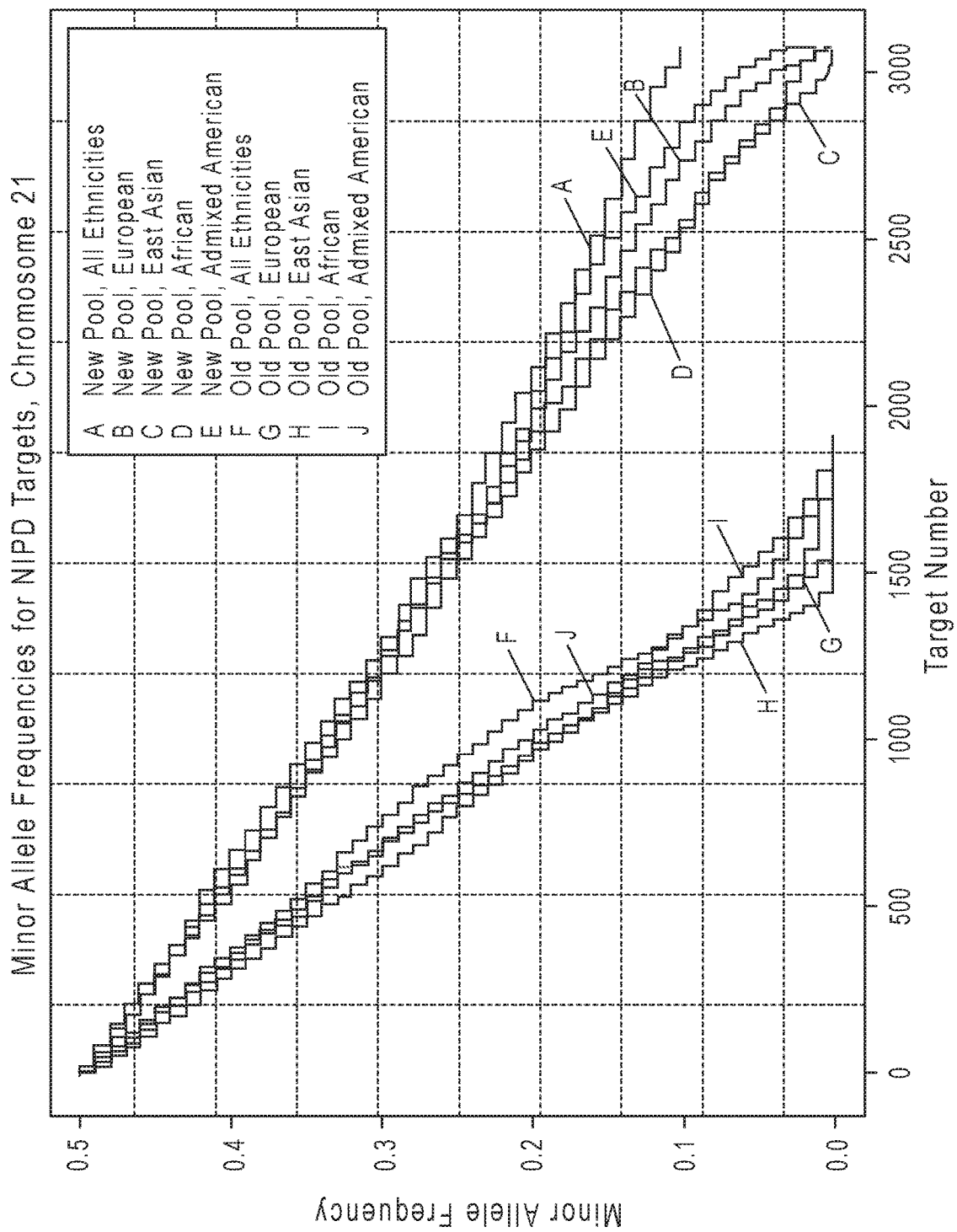
FIG. 27: Comparison of two primer libraries showing the number of loci with a particular minor allele frequency that are targeted by each primer library.
Figure 28A:
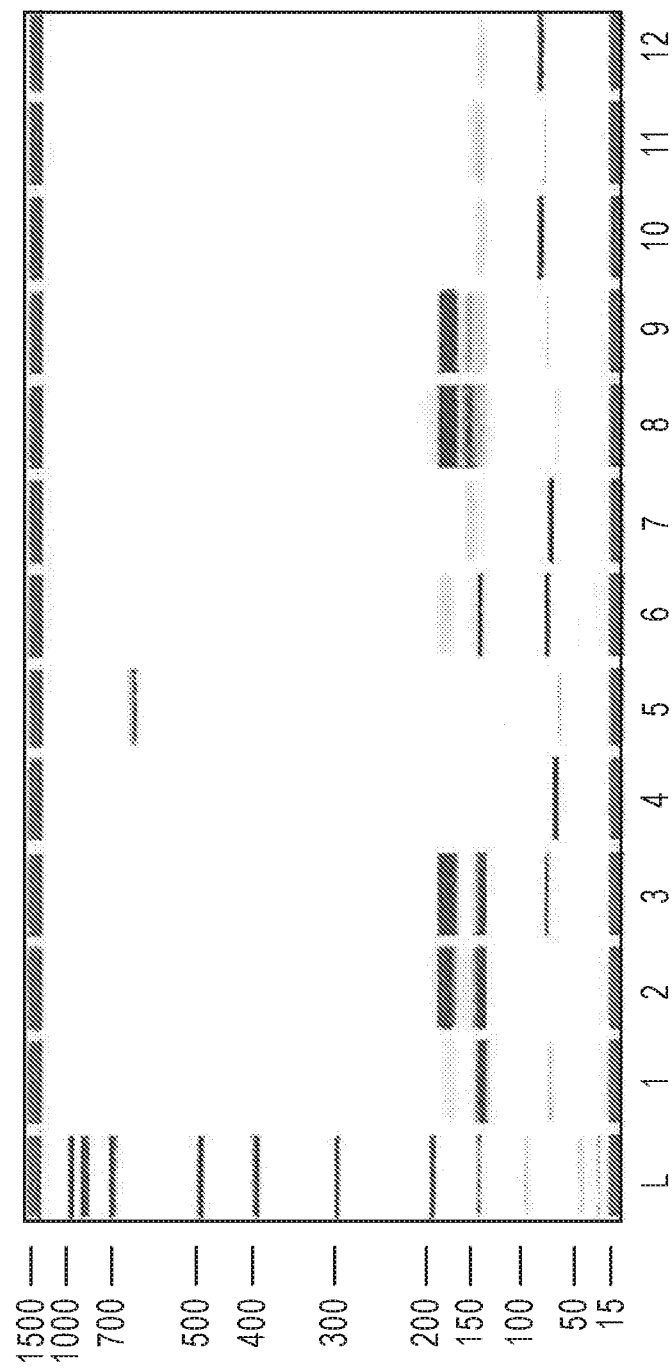
FIG. 28A: Graph of the electrophoresis of PCR products.
Figure 28C:
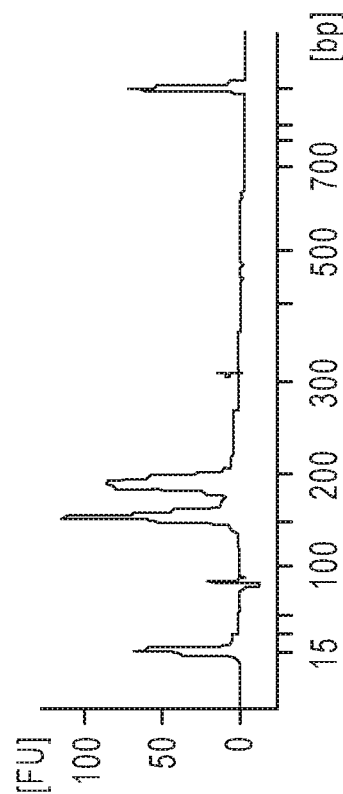
FIGS. 28B-28M are electropherograms of lanes 1-12, respectively, in FIG. 28A.
Figure 28E:
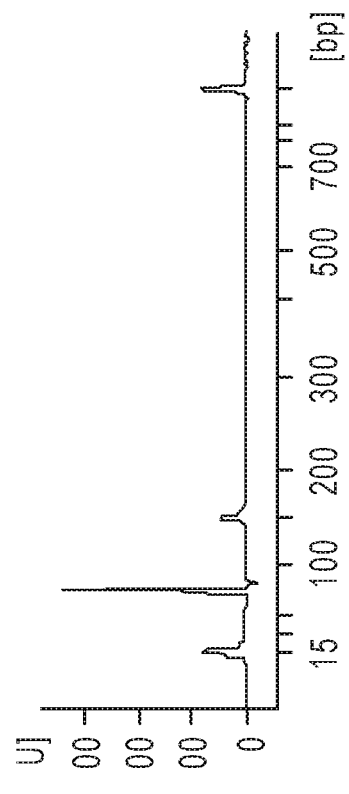
Figure 28B:
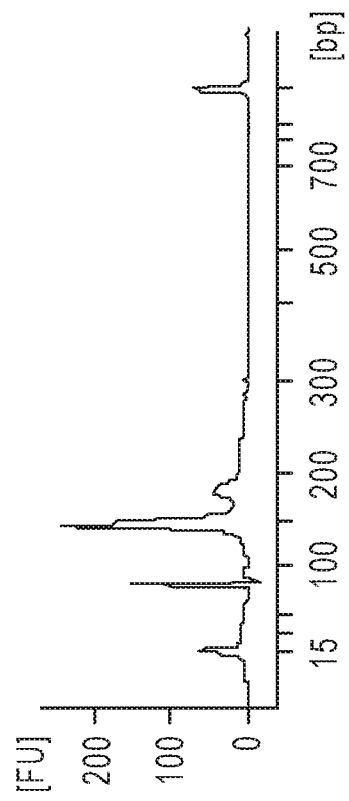
Figure 28D:
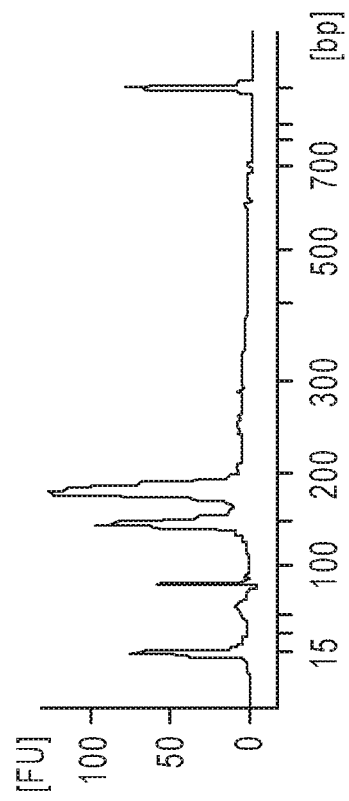
Figure 28F:
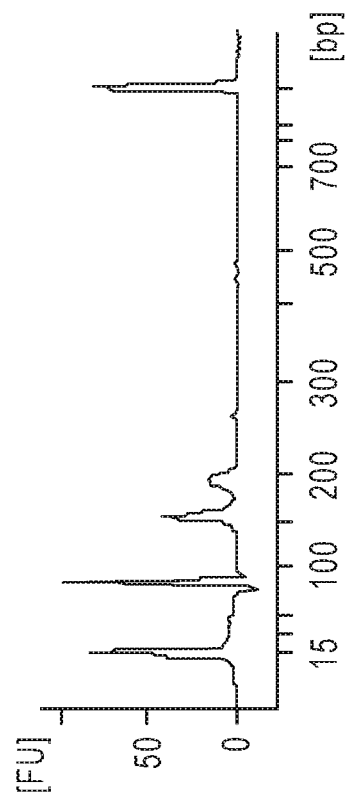
Figure 28G:
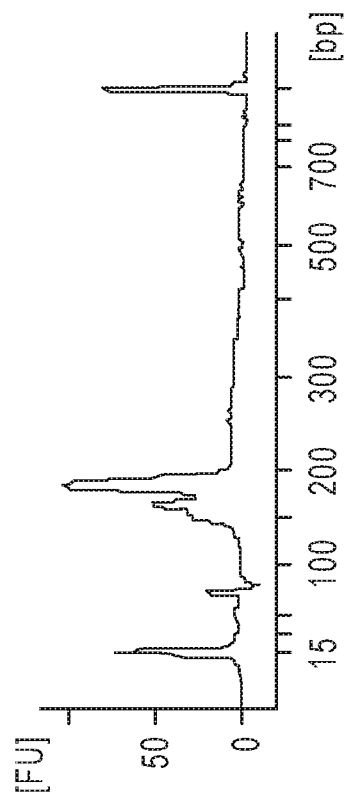
Figure 28H:
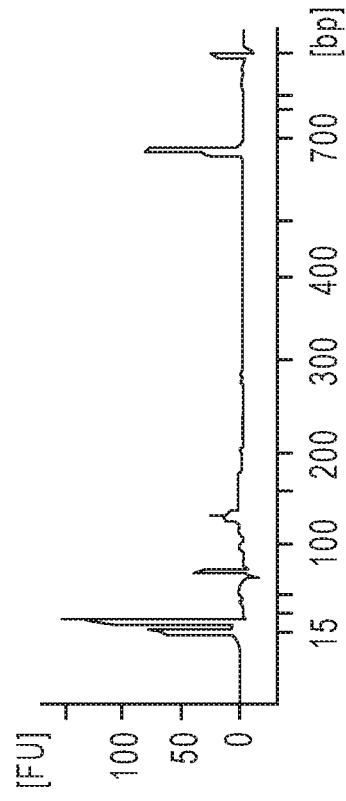
Figure 28I:
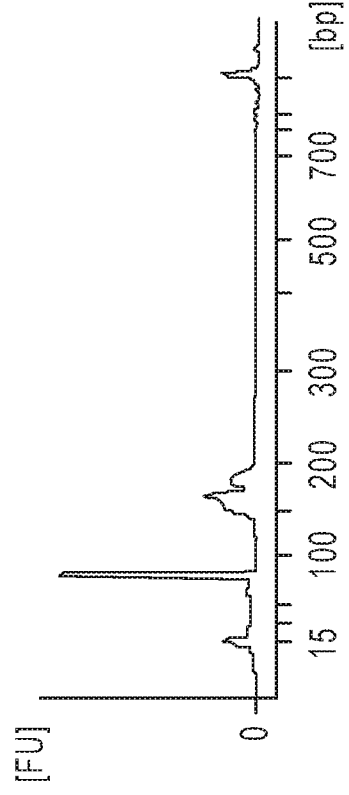
Figure 28K:
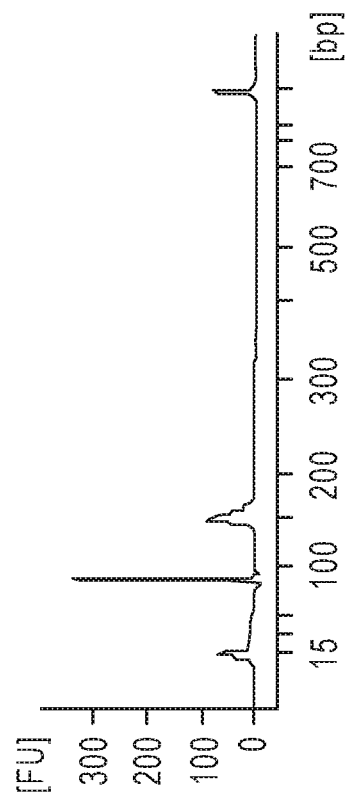
Figure 28M:
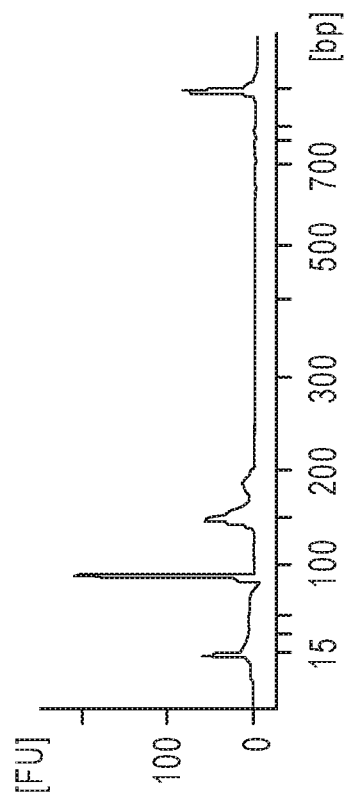
Figure 28J:
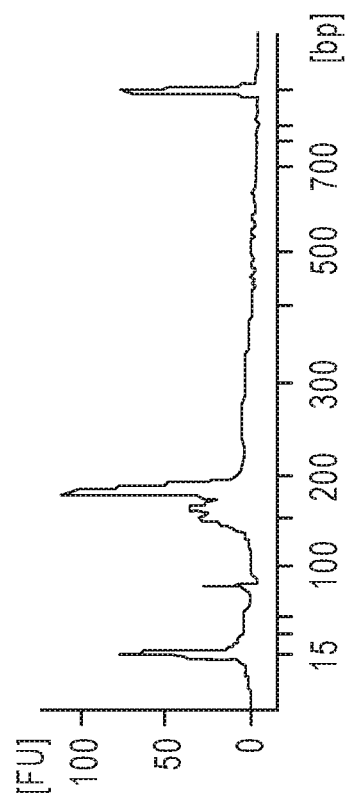
Figure 28L:
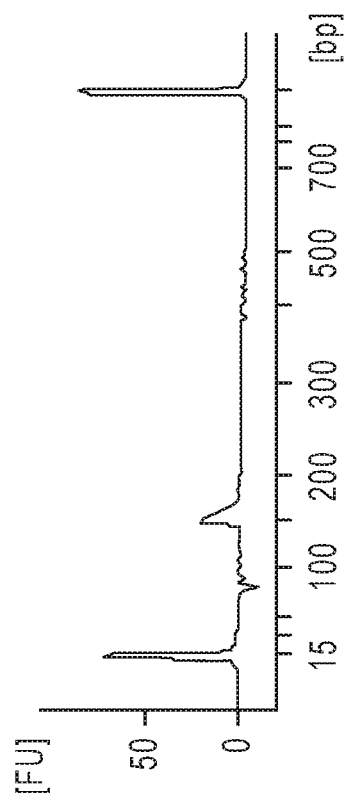

FIG. 27 is a graph comparing two primer libraries designed using the methods of the invention. This graph shows the number of loci with a particular minor allele frequency that are targeted by each primer library. During the selection of the "new pool" library, more primers were retained. This library enables the amplification of more target loci, especially target loci with relatively large minor allele frequencies (which are the more informative alleles for some method of the invention, such as for detecting fetal chromosomal abnormalities).

These primer libraries were used in the following multiplex PCR method. Blood (20-40 mL) was collected from each subject into two to four CELL-FREE™ DNA tubes (Streck). Plasma (a minimum of 7 mL) was isolated from each sample via a double centrifugation protocol of 2,000 g for 20 min, followed by 3,220 g for 30 min, with supernatant transfer following the first spin. cfDNA was isolated from 7-20 mL plasma using the QIAGEN QIAamp Circulating Nucleic Acid kit and eluted in 45 uL TE buffer. Pure maternal genomic DNA was isolated from the buffy coat obtained following the first centrifugation, and pure paternal genomic DNA was prepared similarly from a blood, saliva or buccal sample.

Maternal cfDNA, maternal genomic DNA, and paternal genomic DNA samples were pre-amplified for 15 cycles using 11,000 target-specific assays and an aliquot was transferred to a second PCR reaction of 15 cycles using nested primers. Finally, samples were prepared for sequencing by adding barcoded tags in a third 12-cycle round of PCR. Thus, 11,000 targets were amplified in a single reaction; the targets included SNPs found on chromosomes 13, 18, 21, X, and Y. The amplicons were then sequenced using an ILLUMINA GAIIx or HISEQ sequencer. Parental genotypes were sequenced at a lower read depth (~20% of cfDNA read depth) than the fetal genotypes.

Example 18

If desired, the size and quantity of the PCR products can be analyzed using standard methods, such as the use of the Agilent Technologies 2100 Bioanalyzer (FIG. 28A-M). For example, direct PCR methods described herein without nesting were used in 2,400-plex (FIGS. 28B-28G) and 19,488-plex experiments (FIGS. 28H to 28M). The amount of primer was 10 nM for FIGS. 28B-28D and 28H to 28J. The amount of primer was 1 nM for FIGS. 28E-28G and 28K to 28M. The amount of input DNA was 24 ng for FIGS. 28B, 28E, 28H, and 28K; 80 ng for FIGS. 28C, 28F, 28I, and 28L; and 250 ng for FIGS. 28D, 28G, 28J, and 28M. More input DNA resulted in a greater proportion of the desired 180 base pair product. The peak at 140 base pairs is a primer dimer product.

Example 19

Figure 29:
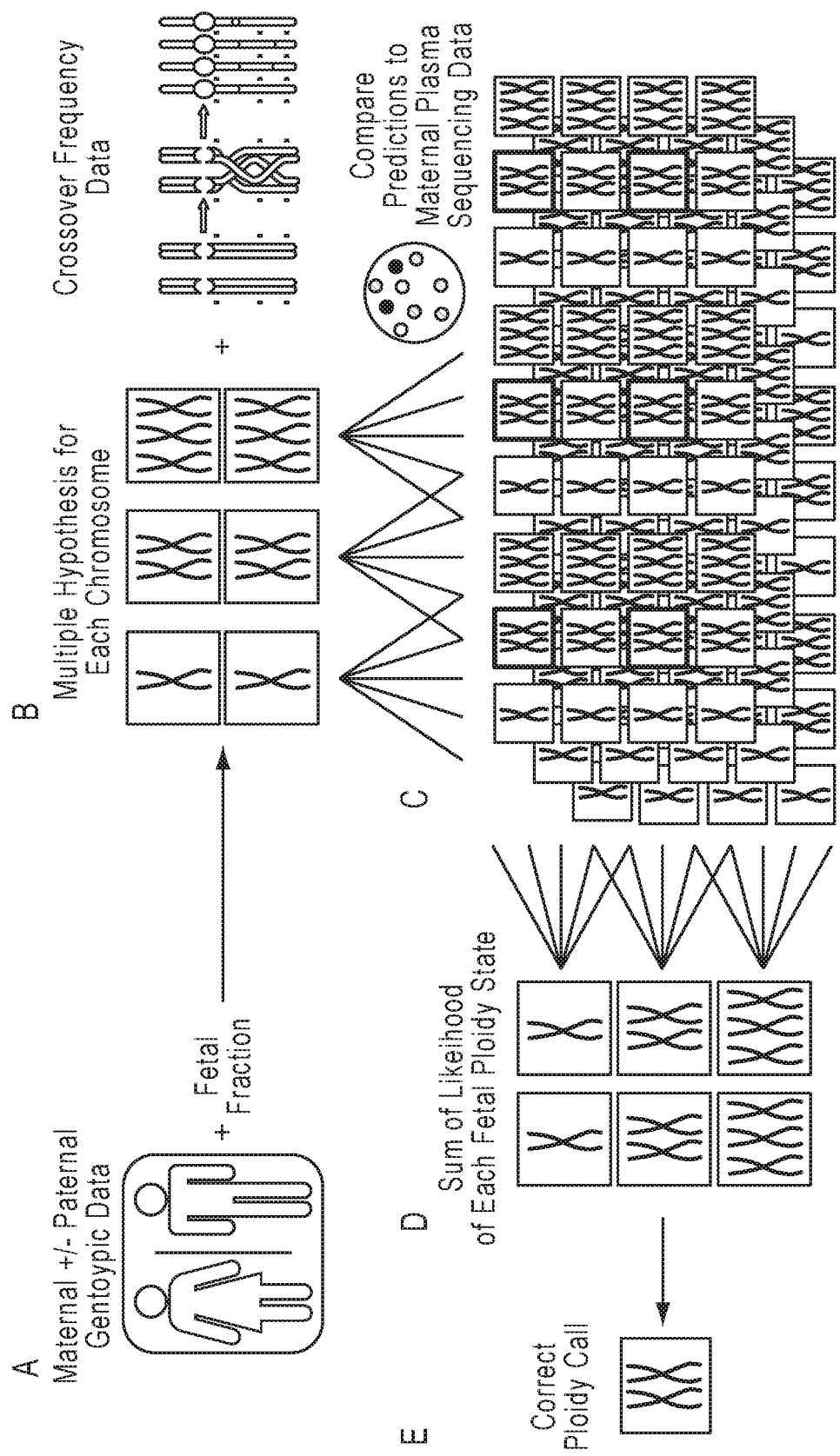
FIG. 29: Cartoon depiction of a method of the invention for the determination of a fetal aneuploidy (FIG. 29, step A). Maternal and paternal genotype data (from blood or buccal swabs) and crossover frequency data from the HapMap database are utilized to generate (FIG. 29, step B) multiple independent hypotheses for each potential fetal ploidy state in silico (FIG. 29, step C). Each of these hypotheses is expanded to include sub-hypotheses with take into consideration the different possible crossover points. The data model predicts what the sequencing data would look like (the expected allele distributions) given each hypothetical fetal genotype and at different fetal cfDNA fractions, and is compared to the actual sequencing data; the likelihood for each hypothesis is determined using Bayesian statistics. In this hypothetical example, the hypotheses with the highest likelihoods (euploidy) are determined (FIG. 29, step D). The individual likelihoods from FIG. 29, step C are summed for each copy number hypothesis family (monosomy, disomy, or triploidy). The hypothesis with the maximum likelihood is called as the ploidy state, reveals the fetal fraction, and represents the sample-specific calculated accuracy.

A proof-of-principle study demonstrated the detection of T13, T18, T21, 45,X, and 47,XXY with equally high accuracies across all chromosomes.
Patients Pregnant couples were enrolled at specific prenatal care centers under protocols approved by an Institutional Review Board pursuant to local laws. Inclusion criteria were at least 18 years of age, gestational age of at least nine weeks, singleton pregnancies, and signed informed consent. Blood samples were drawn from pregnant mothers, and a blood or buccal sample was collected from the father. Samples from 2 pregnancies with T13 (Patau Syndrome), 2 with T18 (Edwards Syndrome), 2 with T21 (Down's Syndrome), 2 with 45,X, 2 with 47,XXY, and 90 normal pregnancies were selected prior to testing from a cohort of ~500 women to test which chromosomal abnormalities the method detects. Normal fetal karyotype was confirmed by molecular karyotyping for the samples where post-birth child tissue was available. Euploid sample were drawn prior to invasive testing from low-risk women. Aneuploid samples were drawn at least 7 days after invasive testing and aneuploidy was confirmed via cytogenetic karyotyping or fluorescence in situ hybridization at independent laboratories.
Sample Preparation and Multiplex PCR For the data in FIGS. 30, 30D, 30E, 30G, and 30H, and 31A-31G, sample preparation and 19,488-plex-PCR were performed as described in Example 15. For the data in FIG. 30F, sample preparation and 11,000-plex-PCR were performed as described in Example 17.
Methodology and Data Analysis The algorithm considers parental genotypes and crossover frequency data (such as data from the HapMap database) to calculate expected allele distributions for 19,488 polymorphic loci for a very large number possible fetal ploidy states, and at various fetal cfDNA fractions. (FIG. 29). Unlike allele ratio based-methods, it also takes into account linkage disequilibrium, and uses non-Gaussian data models to describe the expected distribution of allele measurements at a SNP given observed platform characteristics and amplification biases. It then compares the various predicted allele distributions to the actual allelic distributions as measured in the cfDNA sample (FIG. 29 step C), and calculates the likelihood of each hypothesis (monosomy, disomy, or trisomy, for which there are numerous hypotheses based on the various potential crossovers) based on the sequencing data. The algorithm sums the likelihoods of each individual monosomy, disomy, or trisomy hypotheses (FIG. 29 step D), and calls the ploidy state with the maximum overall likelihood as the copy number and fetal fraction (FIG. 29 step E). Although laboratory researchers were not blinded to sample karyotype, the algorithm called the ploidy states without human intervention and was blind to the truth.

Data Interpretation
Graphical Representations of the Generated Data

To determine the ploidy state of a chromosome of interest, the algorithm considers the distribution of sequence counts from each of two possible alleles at 3,000 to 4,000 SNPs per chromosome. It is important to note that the algorithm makes ploidy calls using an approach that does not lend itself to visualization. Thus, for the purposes of illustration, the data is displayed here in a simplified fashion as ratios of the two most likely alleles, labeled as A and B, so that the relevant trends can be more readily visualized. This simplified illustration does not take into account some of the features of the algorithm. For example, two important aspects of the algorithm that are not possible to illustrate with a method of visualization that displays allele ratios are: 1) the ability to leverage linkage disequilibrium, i.e. the influence that a measurement at one SNP has on the likely identity of a neighboring SNP, and 2) the use of non-Gaussian data models that describe the expected distribution of allele measurements at a SNP given platform characteristics and amplification biases. Also note that the algorithm only considers the two most common alleles at each SNP, ignoring other possible alleles.

The graphical representations in FIGS. 30, 30D-30H include samples for which two, one, or three fetal chromosomes are present. Generally, these indicate euploidy (FIG. 30) monosomy (FIG. 30D), and trisomy (FIGS. 30E-30H), respectively. In all plots, each spot represents a single SNP, where the targeted SNPs are plotted sequentially from left to right for one chromosome along the horizontal axes. The vertical axes indicate the number of reads for the A allele as a fraction of the total number of reads for both the A and B alleles for that SNP. Note that the measurements are made on total cfDNA isolated from maternal blood, and the cfDNA includes both maternal and fetal cfDNA; thus, each spot represents the combination of the fetal and maternal DNA contribution for that SNP. Therefore, increasing the proportion of maternal cfDNA from 0% to 100% will gradually shift some spots up or down within the plots, depending on the maternal and fetal genotype. This is described in more detail below with the corresponding plots.

If desired to facilitate visualization, the spots may be color-coded according to maternal genotype, as maternal genotype contributes more to the localization of each spot and the majority of trisomies are maternally-inherited; this assists in visualizing ploidy states. Specifically, SNPs for which the maternal genotype is AA may be indicated in red, those for which the maternal genotype is AB may be indicated in green, and those for which the maternal genotype is BB may be indicated in blue.

In all cases, SNPs that are homozygous for the A allele (AA) in both the mother and the fetus are found tightly associated with the upper limit of the plots, as the fraction of A allele reads is high because there should be no B alleles present. Conversely, SNPs that are homozygous for the B allele in both the mother and the fetus are found tightly associated with the lower limit of the plots, as the fraction of A allele reads is low because there should be only B alleles. The spots that are not tightly associated with the upper and lower limits of the plots represent SNPs for which the mother, the fetus, or both are heterozygous; these spots are useful for identifying fetal ploidy, but can also be informative for determining paternal versus maternal inheritance. These spots segregate based on both maternal and fetal genotypes and fetal fraction, and as such the precise position of each individual spot along the y-axis depends on both stoichiometry and fetal fraction. For example, loci where the mother is AA and the fetus is AB are expected to have a different fraction of A allele reads, and thus different positioning along the y-axis, depending on the fetal fraction.

Two Chromosomes Present

Figure 30:
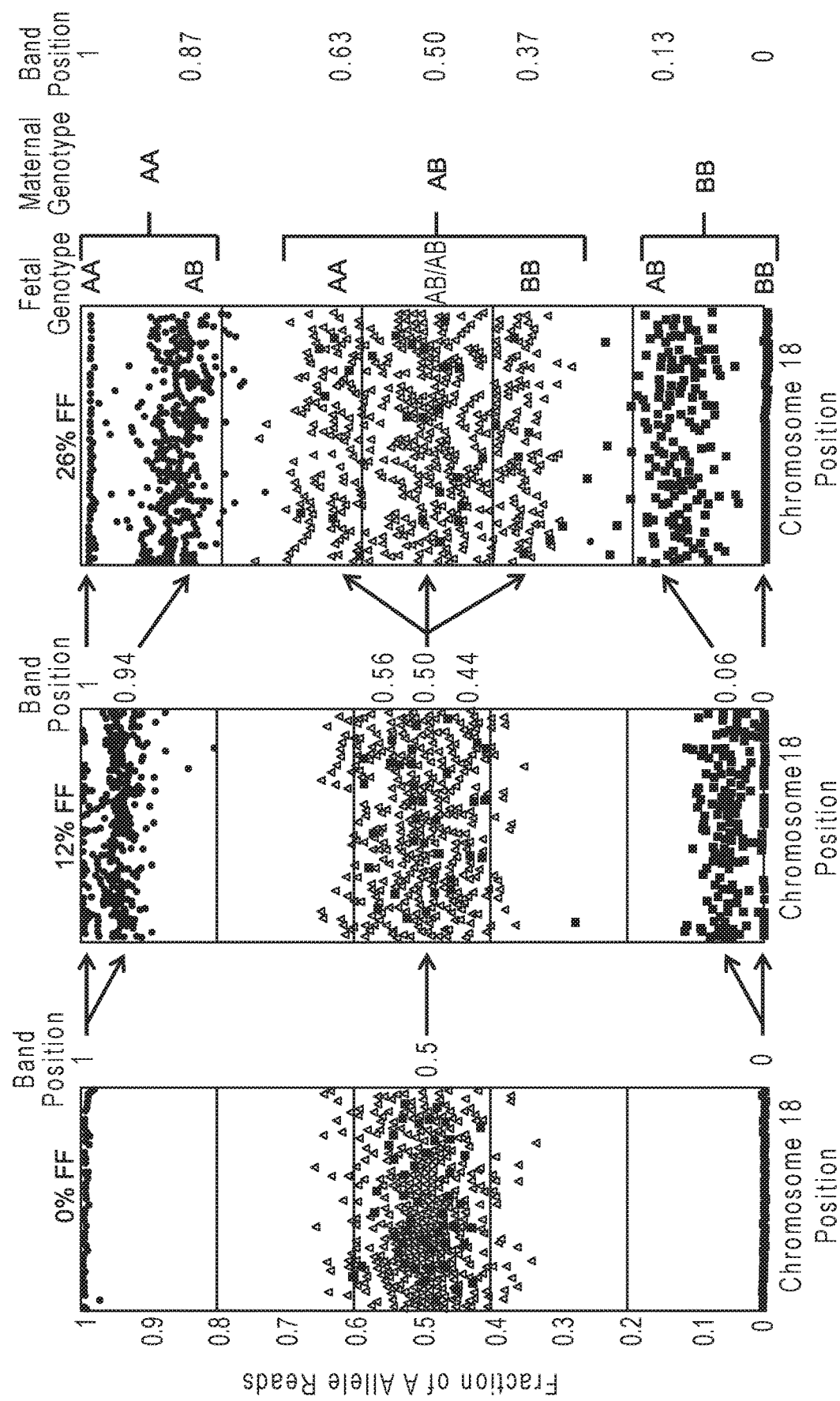
FIGS. 30, 30D-H: Typical graphical representations of euploidy (FIG. 30), monosomy (FIG. 30D), and trisomy (FIGS. 30E-30H). For all plots, the x-axis represents the linear position of the individual polymorphic loci along each chromosome (as indicated below the plots), and the y-axis represents the number of A allele reads as a fraction of the total (A+B) allele reads. Maternal and fetal genotypes, as well as the position on the y-axis around which the bands are centered, are indicated to the right of the plots. If desired to facilitate visualization, the plots may be color-coded according to maternal genotype, such that red (filled circles as shown in FIGS. 30, 30D-H) indicates a maternal genotype of AA, blue (filled squares as shown in FIGS. 30, 30D-H) indicates a maternal genotype of BB, and green (open triangles as shown in FIGS. 30, 30D-H) indicates a maternal genotype of AB. If desired, maternal allele contributions may be indicated in color in the "Fetal Genotype" column. Allele contributions are indicated as maternal|fetal, such that alleles for which the mother is AA and the fetus is AB are indicated as AA|AB.
Figure 30E:
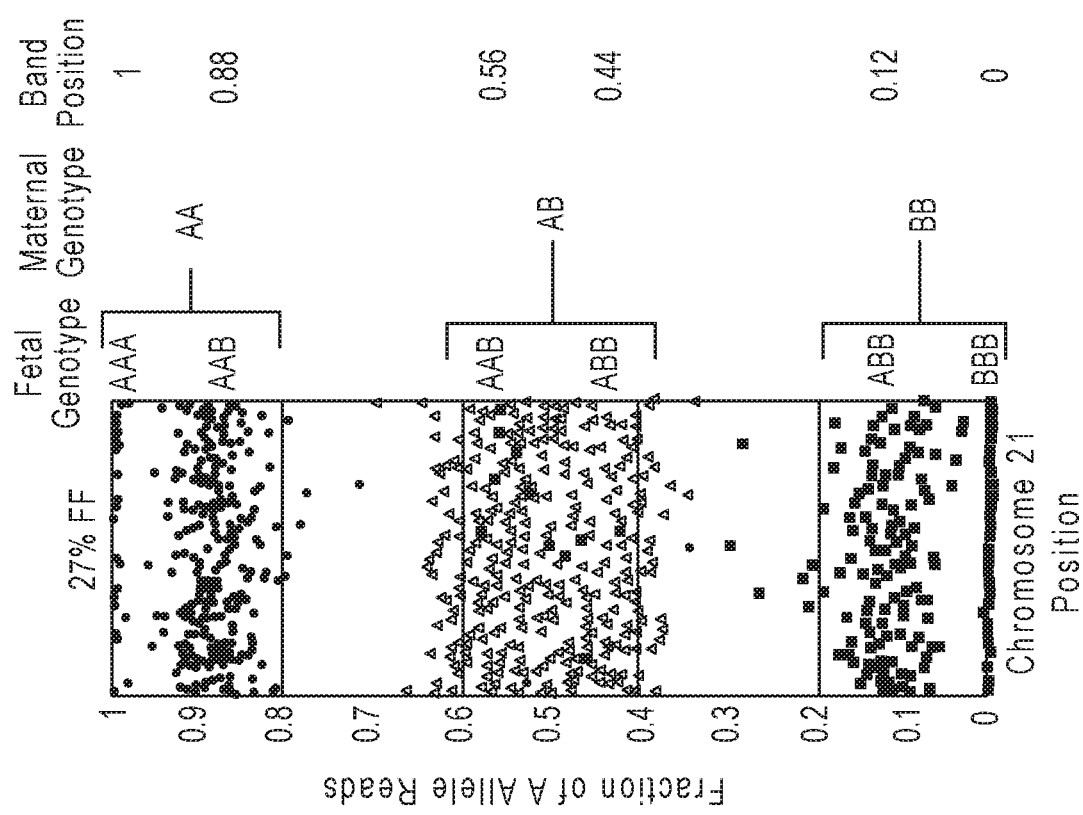

FIG. 30 depict data that indicate the presence of two chromosomes when the sample is entirely maternal (no fetal cfDNA present, FIG. 30 (0% FF plot)), contains a moderate fetal cfDNA fraction (FIG. 30 (12% FF plot)), or contains a high fetal cfDNA fraction (FIG. 30 (26% FF plot)).

FIG. 30, 0% FF plot, shows data obtained from cfDNA isolated from the blood of a non-pregnant woman. When there is no fetal cfDNA present and the sample contains only maternal cfDNA, the plots represent purely the euploid maternal genotype; the hallmark pattern includes "clusters" of spots: a filled circle cluster tightly associated with the top of the plot (SNPs where the maternal genotype is AA), a filled square cluster tightly associated with the bottom of the plot (SNPs where the maternal genotype is BB), and a single, centered open triangle cluster (SNPs where the maternal genotype is AB).

When fetal cfDNA is present, the location of the spots shifts such that the clusters segregate into discrete "bands". Note that for samples with a fetal fraction of 0%, groupings of spots are referred to as "clusters" (as in FIG. 30, 0% FF plot), and for all samples with a fetal fraction of >0%, the groupings of spots are referred to as "bands" (as in FIG. 30 (12% FF plot), 30 (26% FF plot), 30D-30J). If the fetal fraction is high enough, these discrete bands will be readily visible. Specifically, FIG. 30 12% and 26% FF plots demonstrate the characteristic pattern associated with two fetal chromosomes present at moderate and high fetal fractions, respectively. This pattern includes three central open triangle bands that correspond to SNPs that are heterozygous in the mother, and two "peripheral" bands each at both the top (filled circles) and bottom (filled square) of the plots that correspond to SNPs that are homozygous in the mother.

FIG. 30, 12% FF plot, shows data obtained from cfDNA isolated from a plasma sample from a woman carrying a euploid fetus and with a 12% fetal cfDNA fraction. Here, the clusters of spots tightly associated with the top and bottom of the plot segregate into two discrete bands each: one filled circles and one filled square external peripheral band that remains tightly associated with the upper or lower limit of the plots, and one filled circle and one filled square internal peripheral band that has separated from the limits of the plots. These internal peripheral bands, centered around 0.92 and 0.08, represent SNPs for which the maternal genotype is AA and the fetal genotype is AB (indicated in filled circles), and SNPs for which the maternal genotype is BB and the fetal genotype is AB (indicated in filled square), respectively. The center cluster of open triangle spots broadens, but at this fetal fraction the segregation into distinct bands is not readily visible.

At a high fetal cfDNA fraction, the typical pattern that indicates the presence of two chromosomes (a trio of open triangle bands as well as two filled circles and two filled square peripheral bands) is readily apparent. FIG. 30, 26% FF plot, displays data obtained from a plasma sample from a woman carrying a euploid fetus at a fetal cfDNA fraction of 26%. Here, the peripheral bands have separated such that the internal band has shifted towards the center of the plot due to the altered levels of B alleles from the increased fetal cfDNA fraction. Significantly, at higher fetal fractions, the separation of the center open triangle cluster into three distinct bands is now readily apparent. This central trio of bands, in this case clustering around 0.37, 0.50 and 0.63, corresponds to those SNPs where the maternal genotype is AB, and the fetal genotype is AA (top), AB (middle) and BB (bottom).

These hallmark patterns, namely three open triangle bands and four peripheral bands (two filled circles and two filled square), indicate the presence of two chromosomes, as in autosomal euploidy or for the X chromosome in a female (XX) fetus.

One Chromosome Present

Figure 30D:
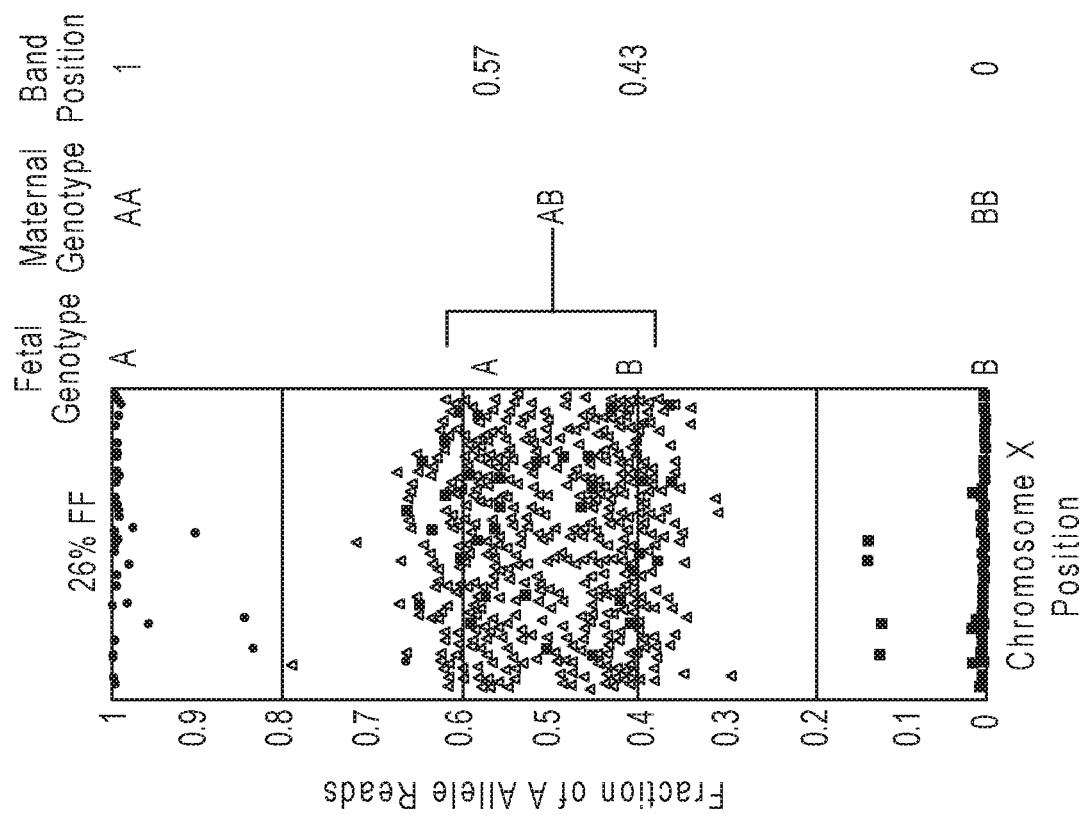
Figure 30G:
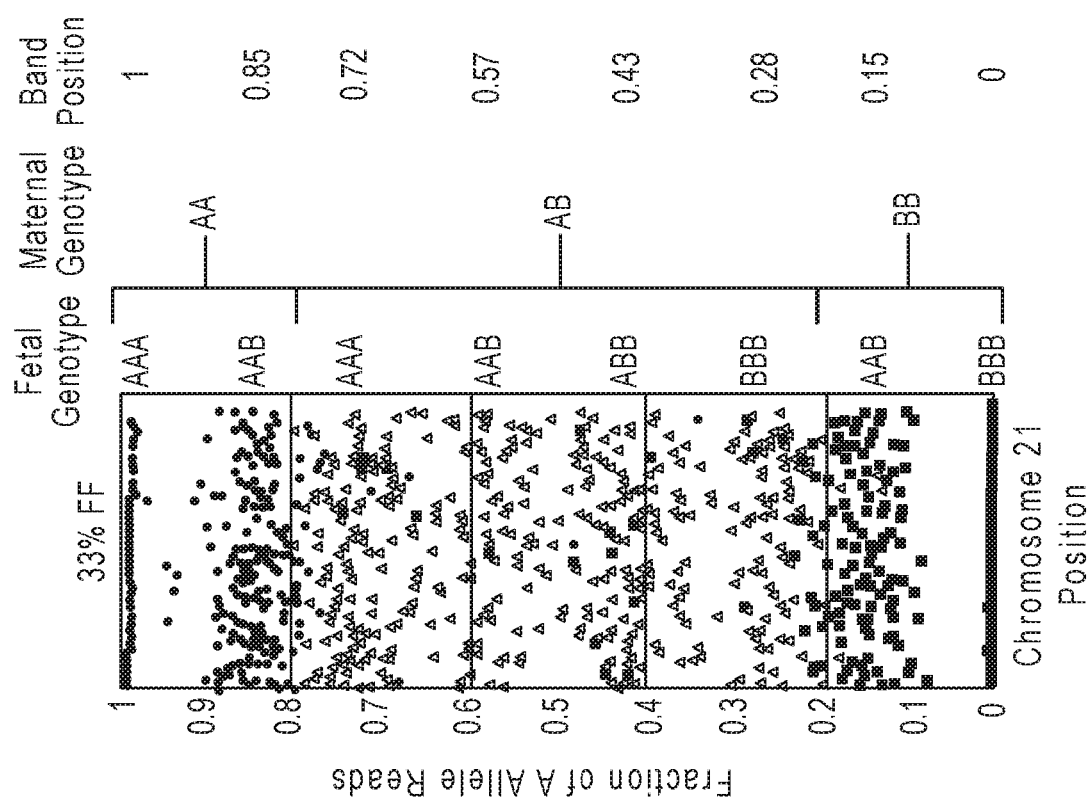
Figure 30F:
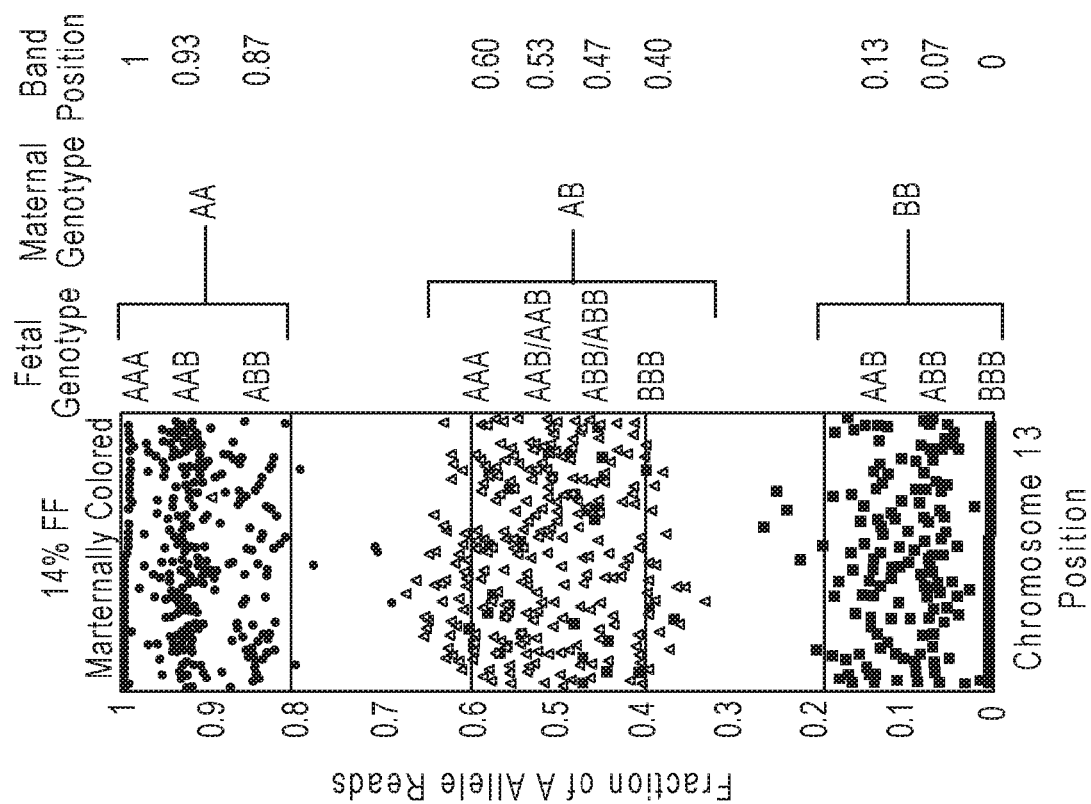
Figure 30H:
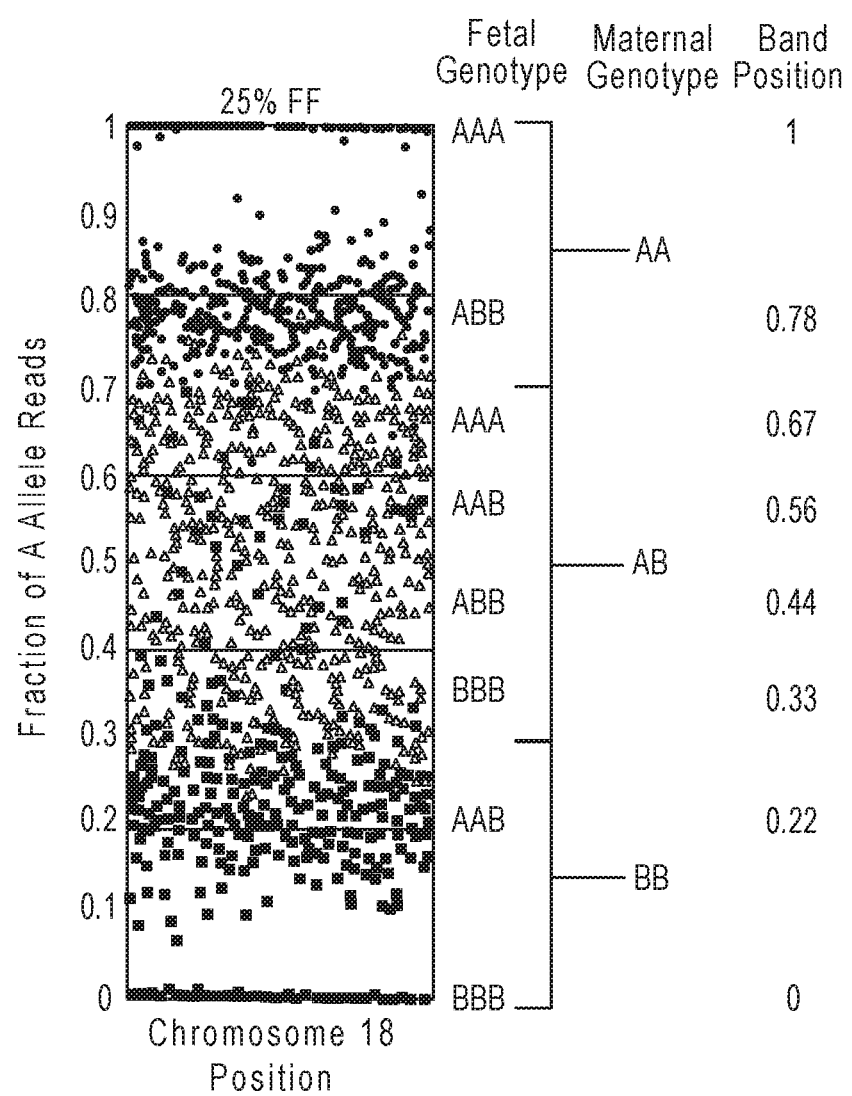

When the fetus only inherits a single chromosome, and thus only inherits a single allele, heterozygosity of the fetus is not possible. As such, the only possible fetal SNP identities are A or B. Thus, maternally-inherited monosomic chromosomes have a characteristic pattern of two central open triangle bands that represent SNPs for which the mother is heterozygous, and only have single peripheral filled circles and filled square bands that represent SNPs for which the mother is homozygous, and which remain tightly associated with the upper and lower limits of the plots (1 and 0), respectively (FIG. 30D). Note the absence of internal peripheral bands. This pattern indicates the presence of one chromosome, as in maternally-inherited autosomal monosomy, or for the X chromosome in a male (XY) fetus.

Three Chromosomes Present

Trisomic chromosomes have three characteristic patterns. The first pattern indicates maternally-inherited meiotic trisomy, a meiotic error where the fetus inherited two homologous, non-identical chromosomes from the mother (FIG. 30E); this pattern includes two central open triangle bands with two each of the peripheral filled circles and filled square bands. The second pattern indicates paternally-inherited meiotic trisomy, where the fetus inherited two homologous, non-identical chromosomes from the father (FIG. 30F); this pattern includes four central open triangle bands and three each of the peripheral filled circles and filled square bands. The third pattern indicates either maternally- (FIG. 30G) or paternally-inherited (FIG. 30H) mitotic trisomy, a mitotic error where the fetus inherited two identical chromosomes from either the mother or the father; this pattern includes four central open triangle bands with two each of the peripheral filled circles and filled square bands. Maternally- and paternally-inherited mitotic trisomies can be distinguished by the placement of the flanking filled circles and filled square bands, such that the filled circles and filled square internal peripheral bands (those not associated with the limits of the plots) are closer to the center in paternally-inherited mitotic trisomy. This is due to the paternal contribution of identical chromosomes. Note that our previous results indicate that at the blastomere stage, 66.7% of maternally-inherited trisomies are meiotic, and that only 10.2% of trisomies are paternally-inherited.

For the Y chromosome, the PS method considers a different set of hypotheses: zero, one, or two chromosomes present. As there is no maternal contribution to the sequence reads at each locus and because heterozygous loci are not possible (cases of two Y chromosomes necessarily involve two identical chromosomes), the bands remain tightly associated with the top (A alleles) or the bottom (B alleles) of the plot (data not shown), and analysis is greatly simplified, relying on quantitative allele count data. Note that since the method interrogates SNPs, it uses homologous non-recombinant SNPs from the Y chromosome, thus obtaining data on both X and Y for one probe pair.

Identifying Aneuploidies

Identification of autosomal aneuploidies using this plot-based visualization method is straightforward given a sufficient fetal fraction, and requires only identifying plots for which there are an abnormal number of chromosomes present, as described above. Combining the knowledge of copy number of the X and Y chromosomes identifies whether sex chromosome aneuploidies are present. Specifically, plots representing a fetus with a 47,XXX genotype will have a typical "three-chromosome" pattern, and plots representing a fetus with a 47,XXY genotype will have the typical "two-chromosome" pattern for the X chromosome, but will also have allele reads indicating the presence of one Y chromosome. The method is similarly able to call 47,XYY, where a "one chromosome" pattern indicates the presence of a single X chromosome, and allele reads indicate the presence of two Y chromosomes. A fetus with a 45,X genotype will have the typical "one-chromosome" pattern for the X chromosome, and data indicating zero Y chromosomes.

Effects of Fetal Fraction

As discussed above, the number of sequence reads from the fetus contributes to the precise location of each spot along the y-axis in the plots. As fetal fraction will affect the proportion of reads that originate from the fetus and the mother, it will also affect the positioning of each spot. At a high fraction of fetal cfDNA (generally above ~20%), as in FIGS. 30 (26% FF plot), 30D, 30E, 30G, and 30H, it is readily apparent that although the spots cluster based mainly on maternal genotype, the presence of fetal DNA from alleles whose genotype is distinct from the maternal genotype shift the clusters into multiple, distinct bands. However, as the fetal fraction decreases (as in FIGS. 30 (12% FF plot) and 30F), the spots regress towards the poles and center of the plot, resulting in tighter clusters. Specifically, the set of peripheral filled circles bands, where the maternal genotype is AA, regress towards the top of the plot; the set of peripheral filled square bands, where the maternal genotype is BB, regress towards the bottom; the set of central open triangle bands, where the mother is heterozygous, condense into a single cluster at the center of the plot (compare FIG. 30, 12% and 26% FF plots). Although aneuploidy is not readily apparent by eye using this visualization technique for low fetal fraction cases, the algorithm is able to identify ploidy states with a very low fetal fraction, such as 3% fetal fraction. It is able to do this because the statistical technique compares the observed data to very precise data models that predict the allele distributions for a given sample parameter set (including copy number, parental genotypes, and fetal fraction, for example). Data model precision is critical in low fetal fraction cases, as the differences between the allele distributions for different ploidy states are proportional to the fetal fraction. In addition, the algorithm is able to determine when a data set does not contain enough data to make a confident fetal ploidy determination.

Results

Figure 31G:
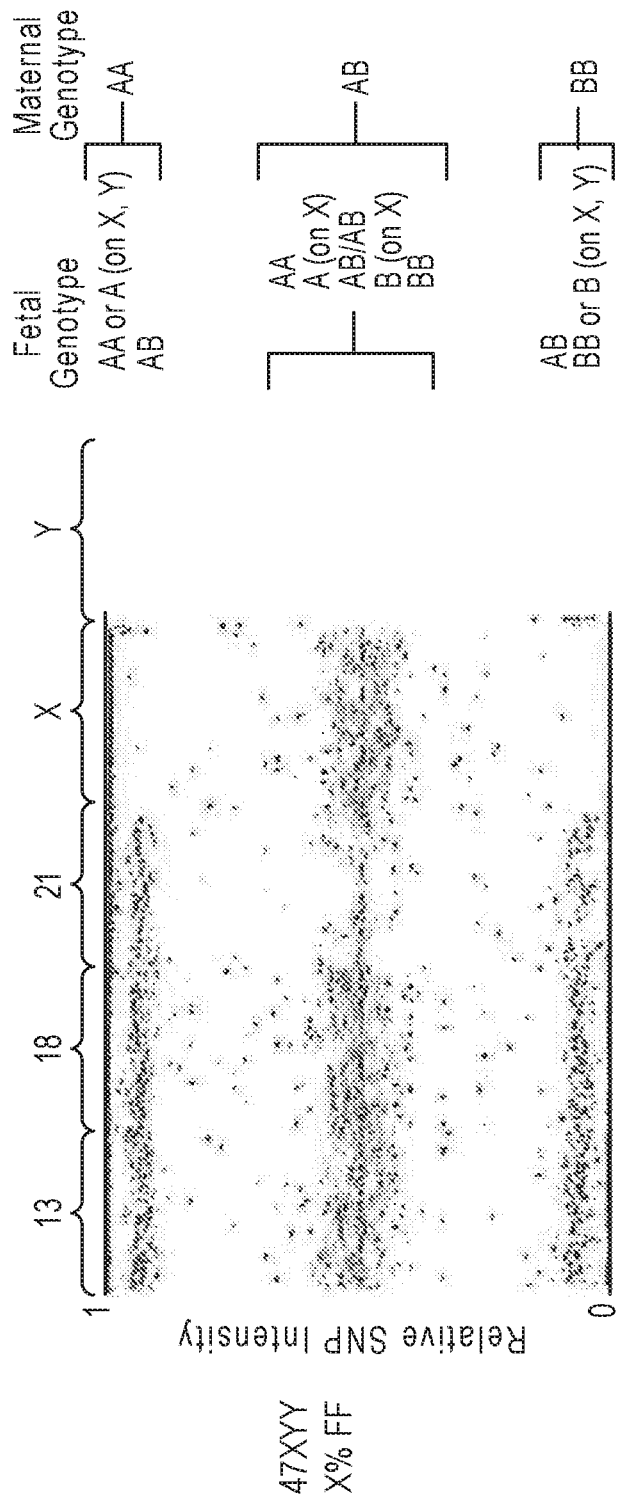

Sequencing reads that mapped to targeted SNPs were deemed to be informative and were used by the algorithm. More than 95% of targeted loci were observed in the sequencing results. The plots for visualizing key ploidy calls are depicted in FIG. 31A-31G. FIG. 31A indicates a euploid sample. Here, chromosomes 13, 18, and 21 have the typical "two chromosome" pattern (as described herein). This includes a trio of center open triangle bands, and two filled circles and two filled square peripheral bands. This, together with the two center open triangle bands for the X chromosome and the presence of Y chromosome bands along the plots' peripheries, indicate a euploid XY genotype.

The most prevalent autosomal trisomies, T13, T18, and T21, are indicated by the plots in FIGS. 31B, 31C, and 31D, respectively. Specifically, FIG. 31B depicts a T13 sample.

Here, chromosomes 18 and 21 display the typical "two chromosome" pattern, chromosome X displays the typical "one chromosome" pattern, and there are reads from the Y chromosome. Together, this indicates disomy at chromosomes 18 and 21, and identifies a fetal XY genotype. However, chromosome 13 depicts a typical "three chromosome" pattern—specifically. Similarly, FIG. 31C depicts a T18 sample, and FIG. 31D depicts a T21 sample.

The method is also able to detect sex chromosome aneuploidies, including 45,X (FIG. 31E), 47,XXY (FIG. 31F), and 47,XYY (FIG. 31G). Note that the method is calling copy number at chromosomes 13, 18, 21, X, and Y; the overall chromosome number is reported assuming disomy at the remaining chromosomes. The X chromosome regions of the plot depicting a 45,X sample reveals the presence of a single chromosome. However, the lack of reads from the Y chromosome, coupled with the "two chromosome" pattern for chromosomes 13, 18, and 21, indicate a 45,X genotype. Conversely, the 47,X×Y samples generate a plot revealing the presence of two X chromosomes. The data also revealed reads for alleles from the Y chromosome. Together with the presence of two copies of chromosomes 13, 18, and 21, this indicates a 47,XXY genotype. A 47,XYY genotype is indicated by the presence of a "one chromosome" pattern for the X chromosome, and reads indicating the presence of two Y chromosomes.

DISCUSSION

This method detected T13, T18, T21, 45,X, 47,XXY, and 47,XYY non-invasively from maternal blood. This method interrogates cfDNA from maternal plasma by targeted multiplex PCR amplification and high-throughput sequencing of 19,488 SNPs. This, coupled with the method's sophisticated informatics analyses that take into account parental genotypic information and numerous sample parameters, including fetal fraction and DNA quality, more robustly detects the fetal signal and makes highly accurate ploidy calls at all of the five chromosomes implicated in the seven most common types of at-birth aneuploidy (T13, T18, T21, 45,X, 47,XXX, 47,XXY, and 47,XYY). This method offers a number of clinical advantages over previous methods, including and most significantly greater clinical coverage and sample-specific calculated accuracies (analogous to a personalized risk score).

Increased Clinical Coverage

This method offers approximately a two-fold increase in aneuploidy coverage compared to clinically available NIPT methodologies, given its ability to accurately detect autosomal trisomies and sex chromosome aneuploidies. The method presented here is the only noninvasive test that calls ploidy at the sex chromosomes with high accuracy. Prior DNA mixing experiments and separate plasma samples analyzed in our experimental assays suggest that this method will detect a larger cohort of sex chromosome anomalies, including 47,XXX. The method presented here also detects aneuploidies at chromosomes 13, 18, and 21 with high sensitivities and specificities, and with appropriate primer design is expected to be able to detect copy number at the remaining chromosomes as well.

Sample-Specific Calculated Accuracies

Significantly, this method calculates a sample-specific accuracy for ploidy calls on each chromosome in each sample. Accuracies calculated by this method are expected to significantly lower the rate of incorrect calls by identifying and flagging individual samples that have poor quality DNA or low fetal fractions that are likely to result in a poor accuracy test result. By contrast, massively parallel shotgun sequencing (MPSS)-based methods produce a positive or negative call using a single-hypothesis rejection test, and their accuracy estimate is based on a published study cohort rather than on the characteristics of the individual sample, which are assumed to have the same accuracy as the cohort. However, individual accuracies for samples with parameters in the tail of the cohort distribution may differ significantly. This is exacerbated at low fetal fractions, as in early gestational age, or for samples with low DNA quality. These samples are generally not identified and flagged for follow-up, which can result in missed calls. The present method, however, takes into account many parameters, including fetal fraction and a number of DNA quality metrics, to make each chromosome copy number call, calculating a sample-specific accuracy for that call. This allows the method to identify individual samples with low accuracy and flag them for follow-up. This is expected to nearly eliminate missed calls, especially at the early stages of pregnancy when fetal fractions are typically low. The presumption is that a no call is much preferred to a missed call, since a no call simply requires a redraw and reanalysis.

Converting Calculated Accuracies to Traditional Risk Scores

This method can offer an adjusted risk of aneuploidy for high-risk pregnant women, where the adjusted risk takes into account an a priori risk (Benn P, Cuckle H, Pergament E. Non-invasive prenatal diagnosis for Down syndrome: the paradigm will shift, but slowly. Ultrasound Obstet Gynecol 2012; 39:127-130, which is hereby incorporated by reference in its entirety). Although the present method offers each patient a customized calculated accuracy, for clinical use these accuracies can be converted to traditional risk scores, which also denote the risk of an aneuploid pregnancy but are expressed as fractions. Traditional risk scores take into account various parameters, including maternal age-related risk and serum levels of biochemical markers, to offer a risk score above which a mother is considered high-risk and for whom follow-up invasive diagnostic procedures are recommended. This method significantly refines this risk score, thus reducing both the false positive and false negative rates, and offering a more accurate assessment of individual maternal risk. A calculated accuracy as used here is the likelihood that the ploidy call is correct, and is expressed as a percentage, but the calculated accuracies used in Experiment 19 do not include an age-related risk. Because calculation of a risk score typically includes an age-related risk, the calculated accuracies and traditional risk scores are not interchangeable; they must be combined to convert into a traditional risk score. The formula to combine the age-related risk with the calculated accuracy is:

$$\frac{R_1 R_2}{R_1 R_2 + [1 - R_1][1 - R_2]}$$

where $R_1$ is the risk score as calculated by the present method and $R_2$ is the risk score as calculated by first trimester screening.

SNP-Based Methods Negate Issues with Amplification Variation

An inherent drawback to the counting methods used by some other methods is that they determine fetal ploidy state by measuring the ratio of the number of reads mapping to the chromosome of interest (e.g., chromosome 21) to those mapping to a reference chromosome. Chromosomes with high or low GC content, including chromosomes 13, X, and Y, amplify with high variability. This can result in signal variation that is comparable in magnitude to the fetal cfDNA signal, which can confound copy number calls by altering the ratio of allele reads from the chromosome-of-interest to those from the reference chromosome. This can result in low accuracy for chromosomes 13, X, and Y. Significantly, this problem is exacerbated at low fetal cfDNA fractions, as tends to be the case at early gestational ages.

In contrast, SNP-based methods do not rely on consistent amplification levels between chromosomes, and are thus expected to provide results that are equally accurate across all chromosomes. Because the present method looks, in part, at relative counts of different alleles at polymorphic loci, which by definition differ only by a single nucleotide, it does not require the use of reference chromosomes, and this obviates the problems with chromosome-to-chromosome amplification variation that are inherent to methods that rely on quantitating read counts. Unlike quantitative methods that require reference chromosomes that are euploid, the present method is expected to be able to detect triploidy as well as copy-number neutral anomalies like uniparental disomy.

The Importance of Early Detection

Figure 32:
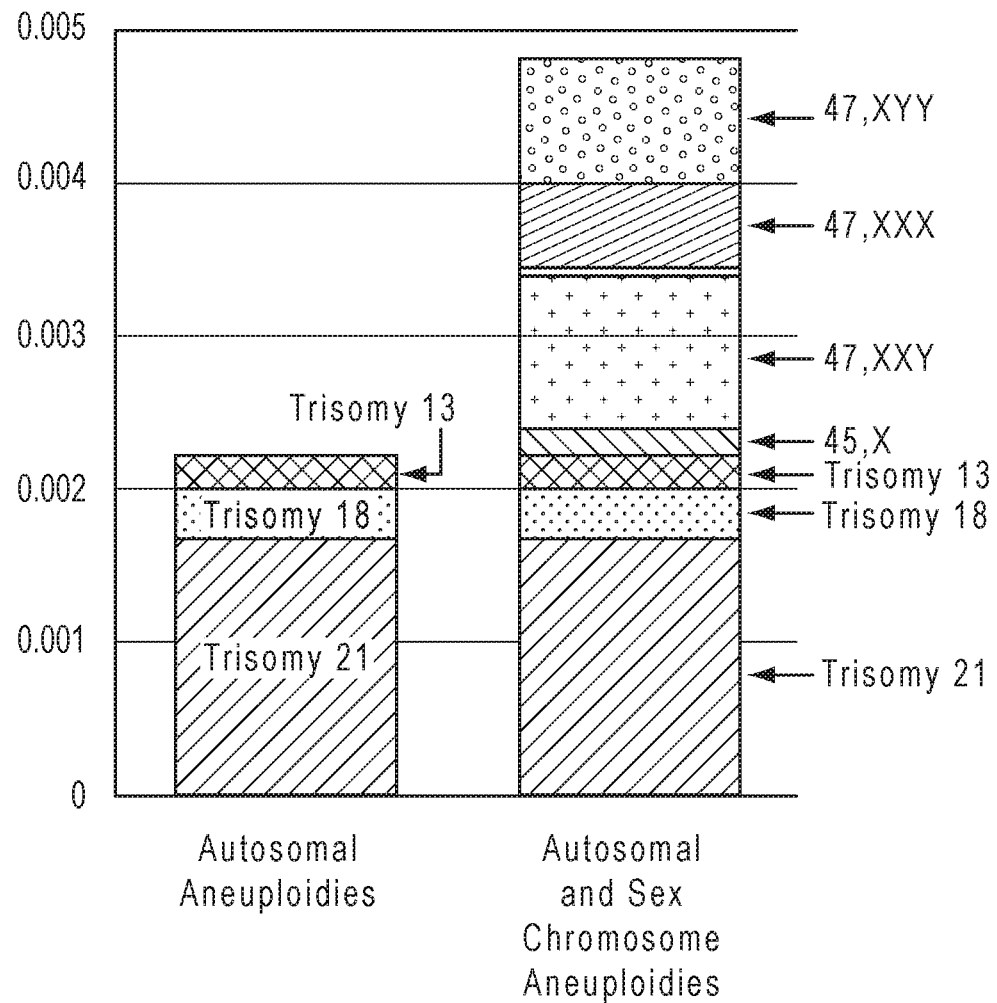
FIG. 32: The combined at-birth prevalence of sex chromosome aneuploidies is greater than that of autosomal aneuploidies.

Significantly, the combined at-birth prevalence of sex chromosome aneuploidies is higher than that of the most common autosomal aneuploidies (FIG. 32). However, there are currently no routine non-invasive screening methods that reliably detect sex chromosome abnormalities. Thus, sex chromosome anomalies are generally detected prenatally as a side-effect of routine testing for Down syndrome or other autosomal aneuploidies; a large proportion of cases are missed entirely. Early and accurate detection is crucial for many of these disorders where early therapeutic intervention improves clinical outcomes. For example, Turner syndrome is often not diagnosed until adolescence, although its overall at-birth prevalence is 1 in 2,500 females. Growth hormone therapy is known to prevent short stature that results from the disorder, but treatments are significantly more effective when initiated prior to the age of 4. Additionally, estrogen replacement therapy can stimulate secondary sexual characteristics in patients with Turner syndrome, but again therapy must be initiated in the pre-teen years, before the syndrome is usually detected. Together, this underscores the importance of early, routine, and safe detection of sex chromosome aneuploidies. This method offers the first approach with the potential to serve as a routine screen for sex chromosome anomalies.

Example 20

The following experiment illustrates an exemplary method for designing and selecting primers that can be used in any of the multiplexed PCR methods of the invention. In some embodiments, primers from an initial library of candidate primers are selected so that they can be used to simultaneously amplify a large number of target loci (or a subset of target loci) in a single reaction. In some embodiments, primers from an initial library of candidate primers are selected to form multiple primer pools such that each pool can be used to simultaneously amplify a subset of target loci in a single reaction. Preferably, primers are designed and selected for a large portion or all of the most desirable target loci. Preferably, the minimum number of pools needed to amplify the target loci are created.

Step 1

Calculate a first score for each primer pair design using one or more of the following parameters: number of SNPs within the primers, location of SNPs within the primers, distance from an end of the amplicon to the target bases within the amplicon, number of target loci in an amplicon, heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon.

Step 2

Compare each primer pair to every other primer pair, and calculate a second score for the pair using one or more of the following parameters: likelihood of dimer formation, amplicon overlap, number of primer designs for a particular target locus, and distance between amplicons. In some embodiments, the score is infinite if amplicons overlap so that two different primer pairs that generate overlapping amplicons are not included in the same primer pool.

Step 3

Aggregate the first score and the second score together (such as by using a weighted average of the scores).

Step 4

If desired, order all target loci into one contiguous list based upon their genomic location in ascending order.

Step 5

Build a minimum priority queue data structure that prioritizes the pairs of designs (in which each design is one primer pair so that a pair of designs includes two primer pairs with a total of 4 primers) based on their score (such as the aggregate score from step 3). In some embodiments, the score for a pair of designs is the worse score (such as the worse aggregate score from step 3) out of the scores for all 4 primers in the pair of designs. The pair of designs with the best (most desirable) score is first in the queue, and the pair of designs with the worst (least desirable) score is last in the queue. If desired, pairs of designs with a score above a threshold (least desirable) are removed from the library of candidate primers such that they are not included in the final pool(s) (for example, these primers may be omitted from the queue). In some embodiments, pairs of design with an interaction score above (worse than) 20, 18, 16, 14, 12, 10, 9, 8, 7, 6, 5, 4, 3, 2, or 1 kcal/mol are removed from the library of candidate primers. In some embodiments, pairs of design with a ΔG value below (worse than)−20, −18, −16, −14, −12, −10, −9, −8, −7, −6, −5, −4, −3, −2, or −1 kcal/mol are removed from the library of candidate primers.

Each design pair can be stored as a node of a doubly linked list with initial "next" and "previous" pointers set to NULL.

Step 6

Begin forming all pools simultaneously by doing the following steps. Take the design pair with the best (most desirable) score from the priority queue and add it to "the potential pools." Begin storing designs in N number of doubly linked list data structures with the design pairs. N represents the current number of different primer pools. Initially, N=1, since there is only one primer pool. In some embodiments, a second pool is only created if necessary to include the desired target loci or the desired level of coverage of target loci. Check to see if the design pair removed from the queue is "connected" to any other existing design pair. By "connected" for purposes of this step is meant that a single design in one pair is the same as a single design in another pair. If two pairs are connected, then assign the appropriate next and previous pointers to one another. If two pairs are not connected, then add them to the "potential pools" In some embodiments, a design pair is only placed in a particular pool if it would be connected to at most two other design pairs in that pool (otherwise it can be assigned to a different pool).

Check to see if (i) any linked list spans from the first target to the last target (such that all the desired target loci are included) or (ii) if a pool meets the cutoff for the desired minimum pool level. If it does, that list now forms a pool and can be added to the "final pools" list.

Step 7

If desired, check to see if the desired level of coverage (such as all the bases in the target loci being included in amplicons from 4 different primer pairs) that is desired for each location. Repeat step 6 until achieving the desired level of coverage.

The resulting primer pool(s) can be used in any of the methods of the invention.

Example 21

The following Example illustrates an exemplary method for designing and selecting primers that can be used in any of the multiplexed PCR methods of the invention. In some embodiments, the primers are divided into different pools (e.g., 2, 3, 4, 5, 6, or more different pools) such that each pool is used to amplify target loci in a different reaction volume. Each pool is used to simultaneously amplify a large number of target loci (or a subset of target loci) in a single reaction volume. Preferably, primers are designed and selected for a large portion of the most desirable target loci or for all of the target loci. A set of candidate target loci can be selected as described in Examples 16 or 20 based on the particular polymorphisms or mutations of interest. In some embodiments, one or more of the following type of target loci are included: SNPs, short indels, long indels, exons, and combinations thereof. In some embodiments for target loci that are short indels, the PCR primer or primer pair targets a sequence of adjacent base pairs; and the indel is completely covered by one sequencing read. In some embodiments for target loci that are large indels, two primer pairs are used to target a pair of breakpoints at the boundaries of the indel. In this case, the two primer pairs are designed such that when the deletion is present there is a PCR product and the two primer pairs are selected together for inclusion in the same pool (the four primers are treated by the algorithm as a single assay rather than two assays). In some embodiments for target loci that are exons, a set of primers pairs are designed to tile the full exon.

For each candidate locus, one or more PCR primer pairs are designed using the Primer3 program (available at the worldwide web at primer3.sourceforge.net; libprimer3 release 2.2.3, which is hereby incorporated by reference in its entirety). If there are no feasible designs for PCR primers for a particular target locus, then that target locus is eliminated from further consideration. In some embodiments, each target base is covered by at least two independent PCR assays (such as two independent primer pairs that will amplify the target base) and preferably by four assays, although not all of the available assays for a target must be used. In some embodiments, no targets are omitted. Desirably, the algorithm produces as few pools as possible but may produce more than one pool. In some embodiments, two different primer pairs that are in close proximity in the genome (such as within 2 kbases or 1 kbase) and whose forward primers are on the same strand are not be assigned to the same pool. This constraint avoids primer interference in the extension-and-ligation amplification method In some embodiments in which the PCR will be performed using a polymerase with low 5'→ 3' exonuclease and/or low strand displacement activity, different primer pairs that are in close proximity in the genome and whose forward primers are on the same strand can be assigned to the same pool since the with low 5'→ 3' exonuclease and/or low strand displacement activity of the polymerase will reduce or prevent primer interference and allow nearby or adjacent amplicons to be produced.

Step 1

Build an interaction graph. Each node represents one assay (such as one primer pair). Each edge represents a conflict between two assays. There are three types. Interaction edges represent a potential primer dimer and have a score indicating the interaction strength. Proximity edges represent physical proximity of the primer binding sites which may result in interference. Target edges represent redundant designs associated with the same target (a special case of a proximity edge).

Step 2

Select an initial value for the maximum interaction score (e.g., 95% of the maximum score).

Step 3

Compute a score such as a utility score for each assay as follows using steps 3A and 3B.

Step 3A

Calculate a score for each assay based on one or more of its intrinsic characteristics. For example, favor assays with amplicons close to the optimal length (such as 300 bp); favor assays with a shorter distance from the beginning of the amplicon to the target; and/or penalize assays with primers overlapping known SNPs. Any other parameter, such as the parameters disclosed herein can also be included.

Step 3B

Multiply the score for each assay by a factor that varies from 0 to 1 according to the current coverage of the assay's target bases. This factor gives lower weight to targets that are already covered by assays. At the beginning of the algorithm this factor is 1 for all assays because none have been covered. Calculate the factor as follows. For each base in the target, compute a coverage score as $1/(2^c)$ where c is the number of previously-selected assays (in other pools) that cover that base. For instance, if three assays cover the base then the coverage score is $1/(2^3)=0.125$. The factor for the target is the maximum value of the coverage score for all bases in the target. For instance, if the target contains 10 bases, 3 bases are covered by 1 target, and 7 bases are covered by 3 targets, then the factor is $MAX(1/(2^1), 1/(2^3))=0.5$. The score in step 3A is then multiplied by this factor.

Step 4

Use a single iteration of the algorithm in Example 16 to design a pool given the current maximum interaction score: Construct a new graph with the assays that have not been assigned to a pool yet and with the edges that have weights exceeding the maximum interaction score. Remove nodes (assays) according to the algorithm in Example 16 until there are no edges left. The assay utility scores come from step 3 in this Example rather than the calculation used for Example 16.

Step 5

Save the assays selected in step 4 as a new pool and remove them from consideration. Then repeat steps 3 and 4 with the remaining assays, and iterate until all targets have sufficient coverage.

Step 6

If desired, evaluate the result. If the total number of pools meets the design goal then reduce the maximum interaction score; otherwise increase the maximum interaction score. Then go back to step 3. Iterate, using a binary search strategy to find the lowest maximum interaction score that produces the desired number of pools.

Step 7

Output the pools from the final iteration. After the selection process, the primers remaining in the pools may be used in any of the methods of the invention.

Example 22

The following Example illustrates an exemplary method for designing and selecting primers that can be used in any of the multiplexed PCR methods of the invention. In some embodiments, the primers are divided into different pools (e.g., 2, 3, 4, 5, 6, or more different pools) such that each pool is used to amplify target loci in a different reaction volume. Any of the embodiments listed in Example 21 can be used for this Example as well.

This method uses a graph coloring algorithm.

Step 1

Select 2, 3 or 4 of the best assays (such as primer pairs) for each target locus from all of the available assays.

Step 2

Select an initial maximum interaction score.

Step 3

Build an interaction graph containing only edges that exceed the maximum interaction score.

Step 4

Color the graph such that no adjacent nodes have the same color (this is a standard problem with many heuristic solutions). Each color represents a different pool.

Step 5

Go back to step 3 and iterate, refining the maximum interaction score until the desired number of pools is achieved. In some embodiments, after the primers are selected in step 1, the algorithm assumes all assays must be included in a pool.

After the primers are divided into different pools, the pools may be used in any of the methods of the invention.

Example 23

This example illustrates there exemplary methods for calculating the limit of detection for any of the methods of the invention. These methods were used to calculate the limit of detection for single nucleotide variants (SNVs) in a tumor biopsy (FIG. 38) and a plasma sample (FIG. 39).

The first method (denoted "LOD-mr5" in FIGS. 38 and 39) calculates the limit of detection based on a minimum of 5 reads being chosen as the minimum number of times a SNV is observed in the sequencing data to have sufficient confidence the SNV is actually present. The limit of detection is based on whether the observed depth of read (DOR) is above this minimum of 5. The thin lines (LOD-z5.0) in FIGS. 38 and 39 indicate SNVs for which the limit of detection is limited by the DOR. In these cases, not enough reads were measured to reach the error limit of the assay. If desired, the limit of detection can be improved (resulting in a lower numerical value) for these SNVs by increasing the DOR.

The second method (denoted "LOD-zs5.0" in FIGS. 38 and 39) calculates the limit of detection based on the z-score. The Z-score is the number of standard deviations an observed error percentage is away from the background mean error. If desired, outliers can be removed and the z-score can be recalculated and this process can be repeated. The final weighted mean and the standard deviation of the error rate are used to calculate the z-score. The mean is weighted by the DOR since the accuracy is higher when the DOR is higher.

For the exemplary z-score calculation used for this example, the background mean error and standard deviation were calculated from all the other samples of the same sequencing run weighted by their depth of read, for each genomic loci and substitution type. Samples were not considered in the background distribution if they were 5 standard deviations away from the background mean. The dashed lines in FIGS. 38 and 39 indicate SNVs for which the limit of detection is limited by the error rate. For these SNV's enough reads were taken to reach the 5 read minimum, and the limit of detection was limited by the error rate. If desired, the limit of detection can be improved by optimizing the assay to reduce the error rate.

The third method (denoted "LOD-zs5.0-mr5" in FIGS. 38 and 39) calculates the limit of detection based on the maximum value of the above two metrics.

Figure 38:
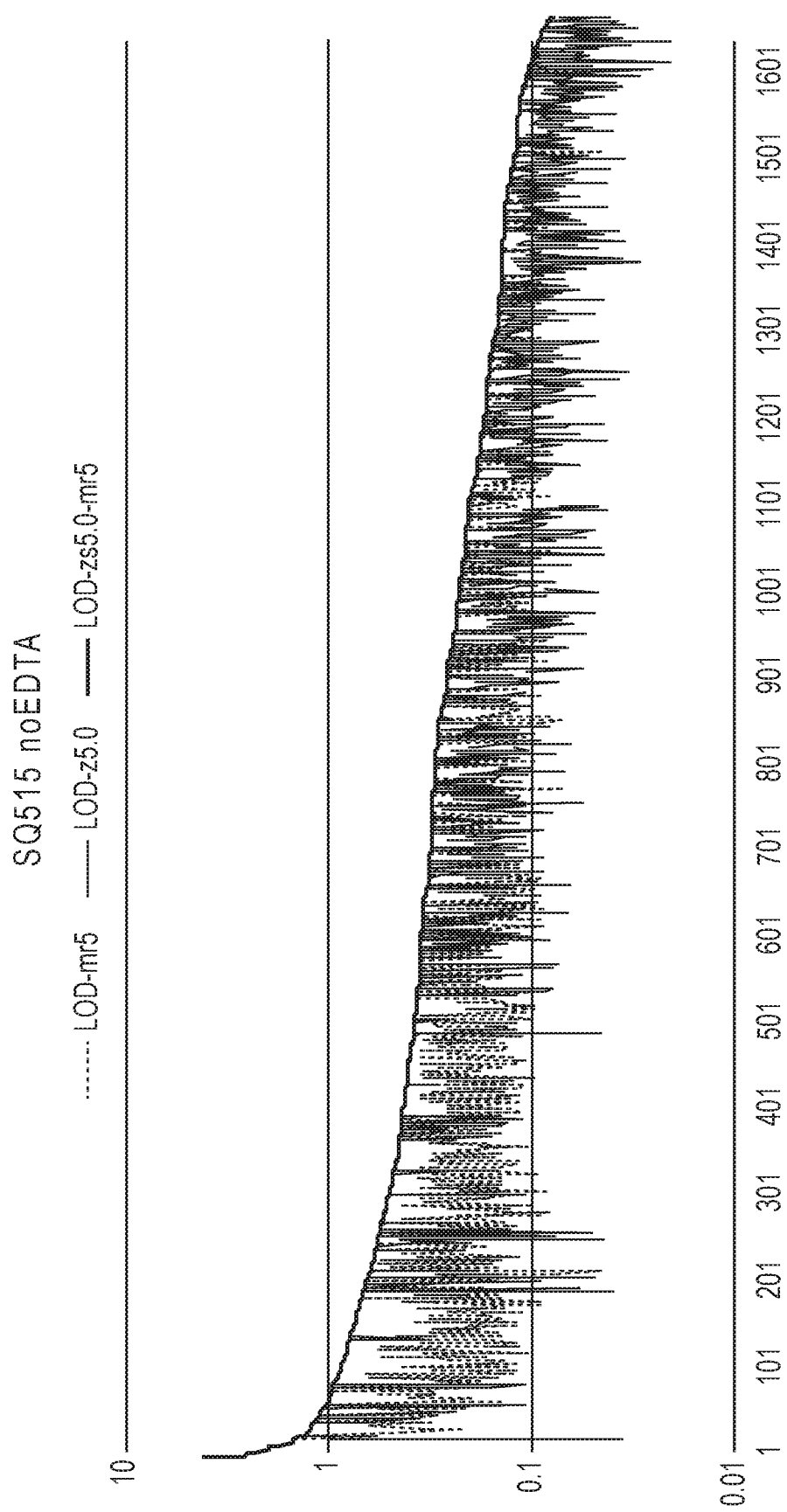
FIG. 38 is a graph showing the limit of detection for single nucleotide variants in a tumor biopsy using three different methods described in Example 23.
Figure 39:
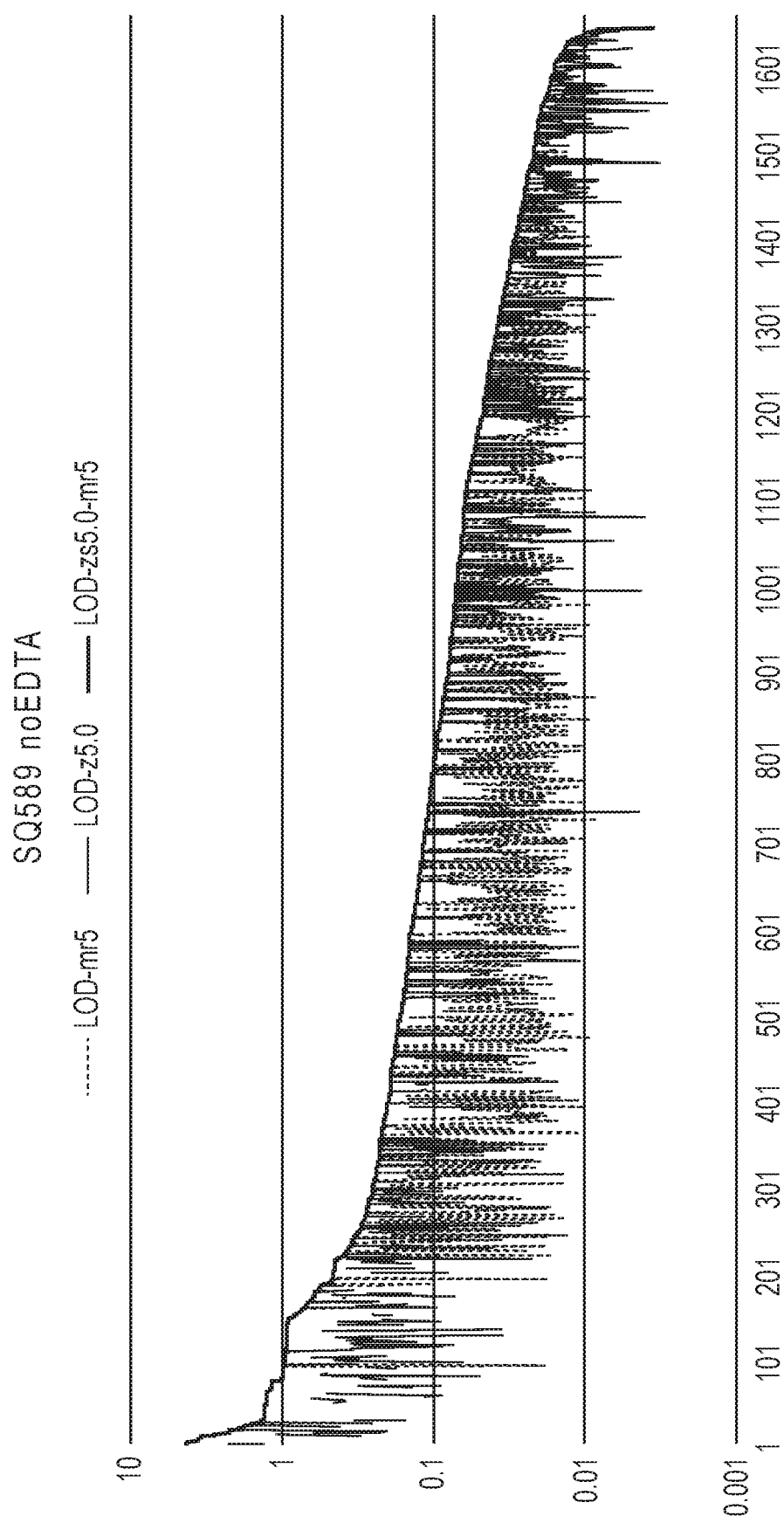
FIG. 39 is a graph showing the limit of detection for single nucleotide variants in a plasma sample using three different methods described in Example 23.

For the analysis of a tumor sample shown in FIG. 38, the mean limit of detection was 0.36%, and the median limit of detection was 0.28%. The number of DOR limited (thin lines) SNVs was 934. The number of error rate limited (dashed lines) SNVs was 738.

For the analysis of cDNA in a plasma sample shown in FIG. 39, the mean limit of detection was 0.24%, and the median limit of detection was 0.09%. The number of DOR limited (thin lines) SNVs was 732. The number of error rate limited (dashed lines) SNVs was 921.

Example 24

This example illustrates the detection of CNVs and SNVs from the same single cell. The following primer libraries were used a library of ~28,000 primers for detecting CNVs, a library of ~3,000 primers for detecting CNVs, and library of primers for detecting SNVs. For analysis of a single cell, cells were serial diluted until there were 3 or 4 cells per droplet. An individual cell was pipetted and placed into a PCR tube. The cell was lysed using Protease K, salt, and DTT using the following thermocycling conditions: 56° C. for 20 minutes, 95° C. for 10 minutes, and then a 4° C. hold. For analysis of genomic DNA, DNA from the same cell line as the analyzed single cell was either purchased or obtained by growing the cells and extracting the DNA.

For amplification with the library of ~28,000 primers, the following PCR conditions were used a 40 uL reaction volume, 7.5 nM of each primer, and 2× master mix (MM). In some embodiments QIAGEN Multiplex PCR Kit is used for the master mix (QIAGEN catalog No. 206143; see, e.g., information available at the world wide web at qiagen.com/products/catalog/assay-technologies/end-point-pcr-and-rt-pcr-reagents/qiagen-multiplex-pcr-kit, is which is hereby incorporated by reference in its entirety). The kit includes 2× QIAGEN Multiplex PCR Master Mix (providing a final concentration of 3 mM $MgCl_2$, 3×0.85 ml), 5× Q-Solution (1×2.0 ml), and RNase-Free Water (2×1.7 ml). The QIA- GEN Multiplex PCR Master Mix (MM) contains a combination of KCl and $(NH_4)_2SO_4$ as well as the PCR additive, Factor MP, which increases the local concentration of primers at the template. Factor MP stabilizes specifically bound primers, allowing efficient primer extension by, e.g., HotStarTaq DNA Polymerase. HotStarTaq DNA Polymerase is a modified form of Taq DNA polymerase and has no polymerase activity at ambient temperatures. The following thermocycling conditions were used for the first round of PCR: 95° C. for 10 minutes; 25 cycles of 96° C. for 30 seconds, 65° C. for 29 minutes, and 72° C. for 30 seconds; and then 72° C. for 2 minutes, and a 4° C. hold. For the second round of PCR a 10 ul reaction volume, 1×MM, and 5 nM of each primer was used. The following thermocycling conditions were used: 95° C. for 15 minutes; 25 cycles of 94° C. for 30 seconds, 65° C. for 1 minute, 60° C. for 5 minutes, 65° C. for 5 minutes, and 72° C. for 30 seconds; and then 72° C. for 2 minutes, and a 4° C. hold.

For the library of ~3,000 primers, exemplary reaction conditions include a 10 ul reaction volume, 2×MM, 70 mM TMAC, and 2 nM primer of each primer. For the library of primers for detecting SNVs, exemplary reaction conditions include a 10 ul reaction volume, 2×MM, 4 mM EDTA, and 7.5 nM primer of each primer. Exemplary thermocycling conditions include 95° C. for 15 minutes, 20 cycles of 94° C. for 30 seconds, 65° C. for 15 minutes, and 72° C. for 30 seconds; and then 72° C. for 2 minutes, and a 4° C. hold.

The amplified products were barcoded. One run of sequencing was performed with an approximately equal number of reads per sample.

Figure 40A:
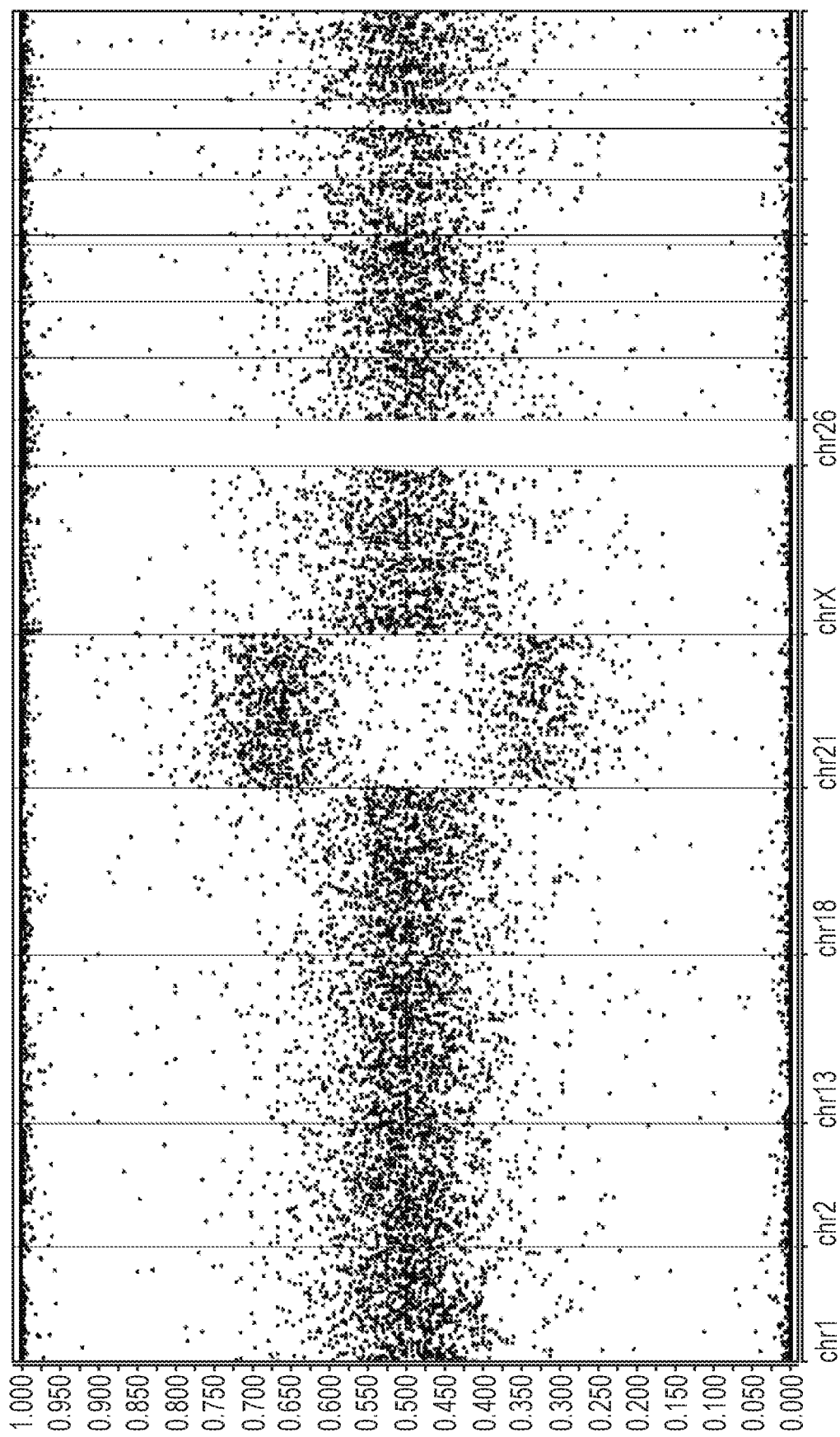
FIGS. 40A and 40B are graphs of the analysis of genomic DNA (FIG. 40A) or DNA from a single cell (FIG. 40B) using a library of approximately 28,000 primers designed to detect CNVs. The presence of two central bands instead of one central band indicates the presence of a CNV. The x-axis represents the linear position of the SNPs, and the y-axis indicates the fraction of A allele reads out of the total reads.
Figure 40B:
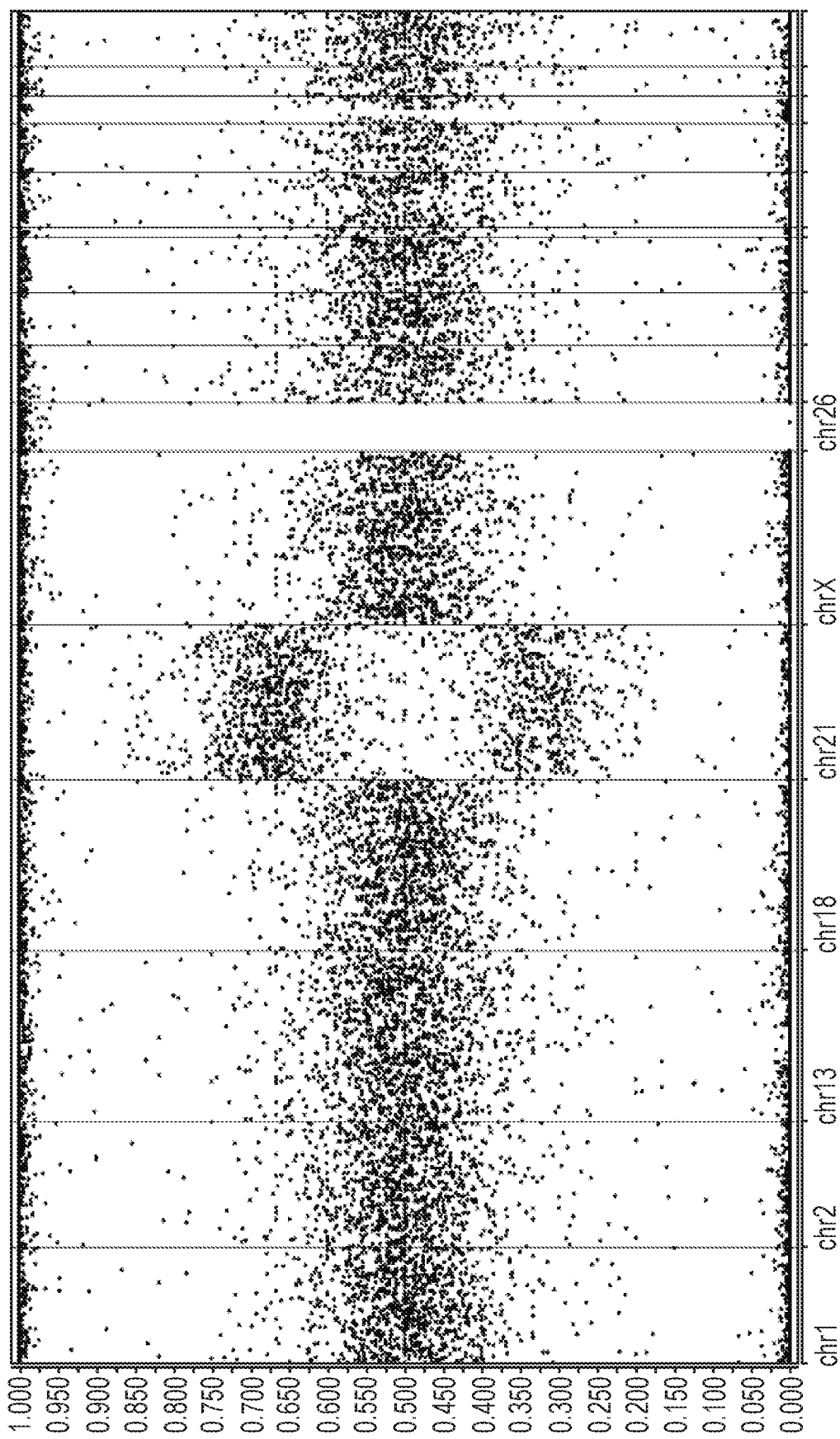

FIGS. 40A and 40B show results from analysis of genomic DNA (FIG. 40A) or DNA from a single cell (FIG. 40B) using a library of approximately 28,000 primers designed to detect CNVs. Approximately 4 million reads were measured per sample. The presence of two central bands instead of one central band indicates the presence of a CNV. For three samples of DNA from a single cell, the percent of mapped reads was 89.9%, 94.0%, and 93.4%, respectively. For two samples of genomic DNA the percent of mapped reads was 99.1% for each sample.

Figure 41A:
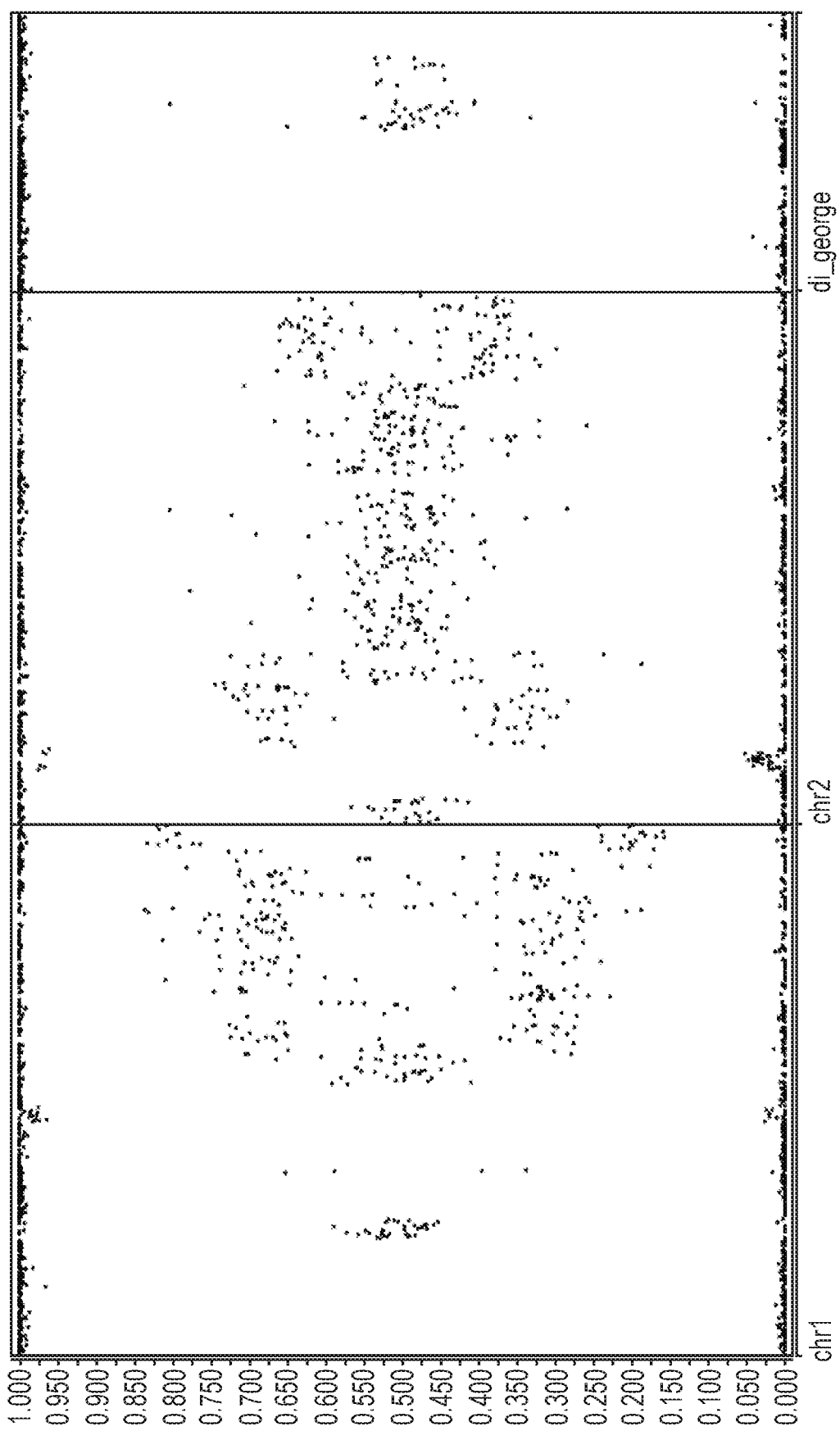
FIGS. 41A and 41B are graphs of the analysis of genomic DNA (FIG. 41A) or DNA from a single cell (FIG. 41B) using a library of approximately 3,000 primers designed to detect CNVs. The presence of two central bands instead of one central band indicates the presence of a CNV. The x-axis represents the linear position of the SNPs, and the y-axis indicates the fraction of A allele reads out of the total reads.
Figure 41B:
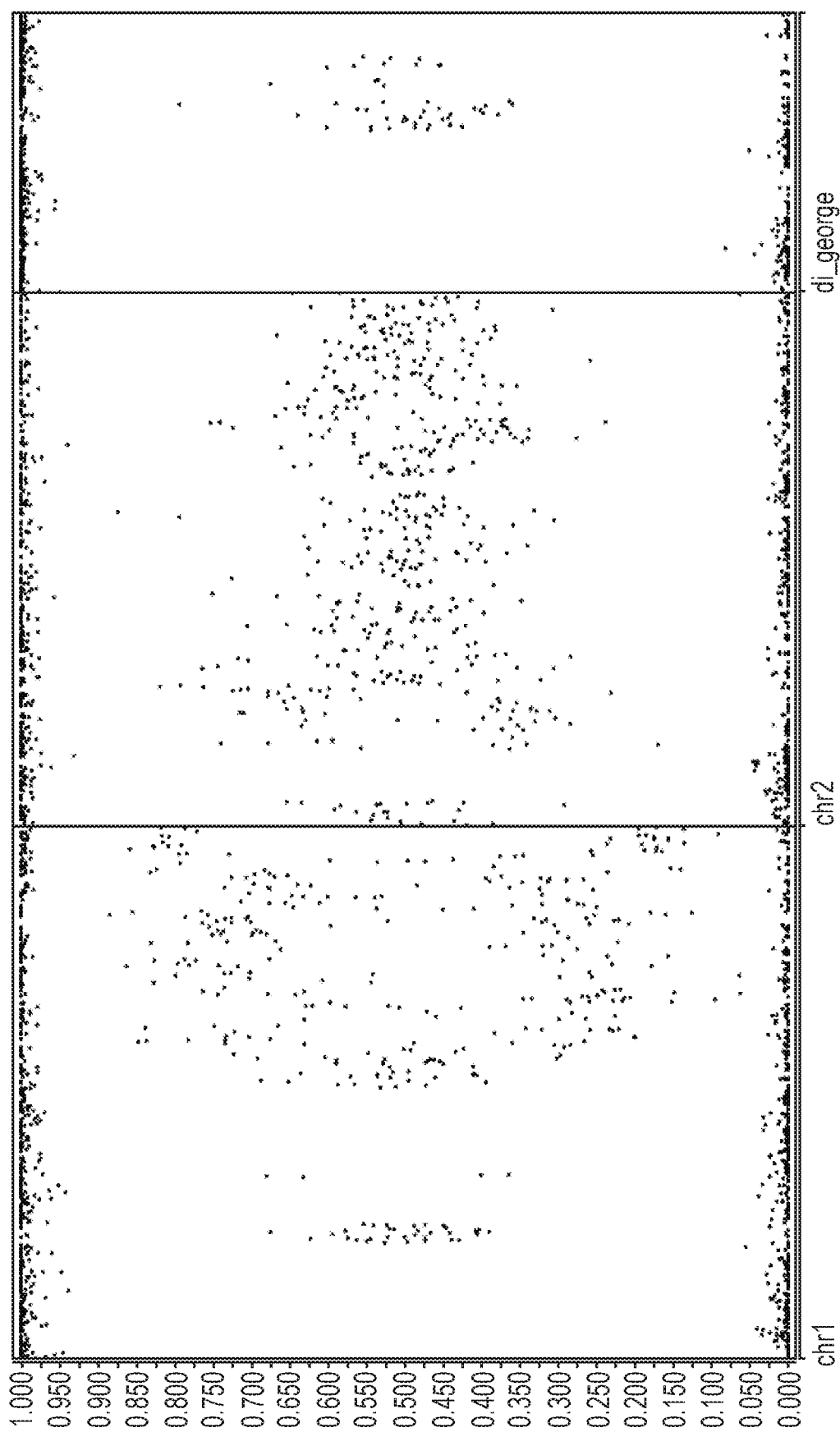
Figure 42:
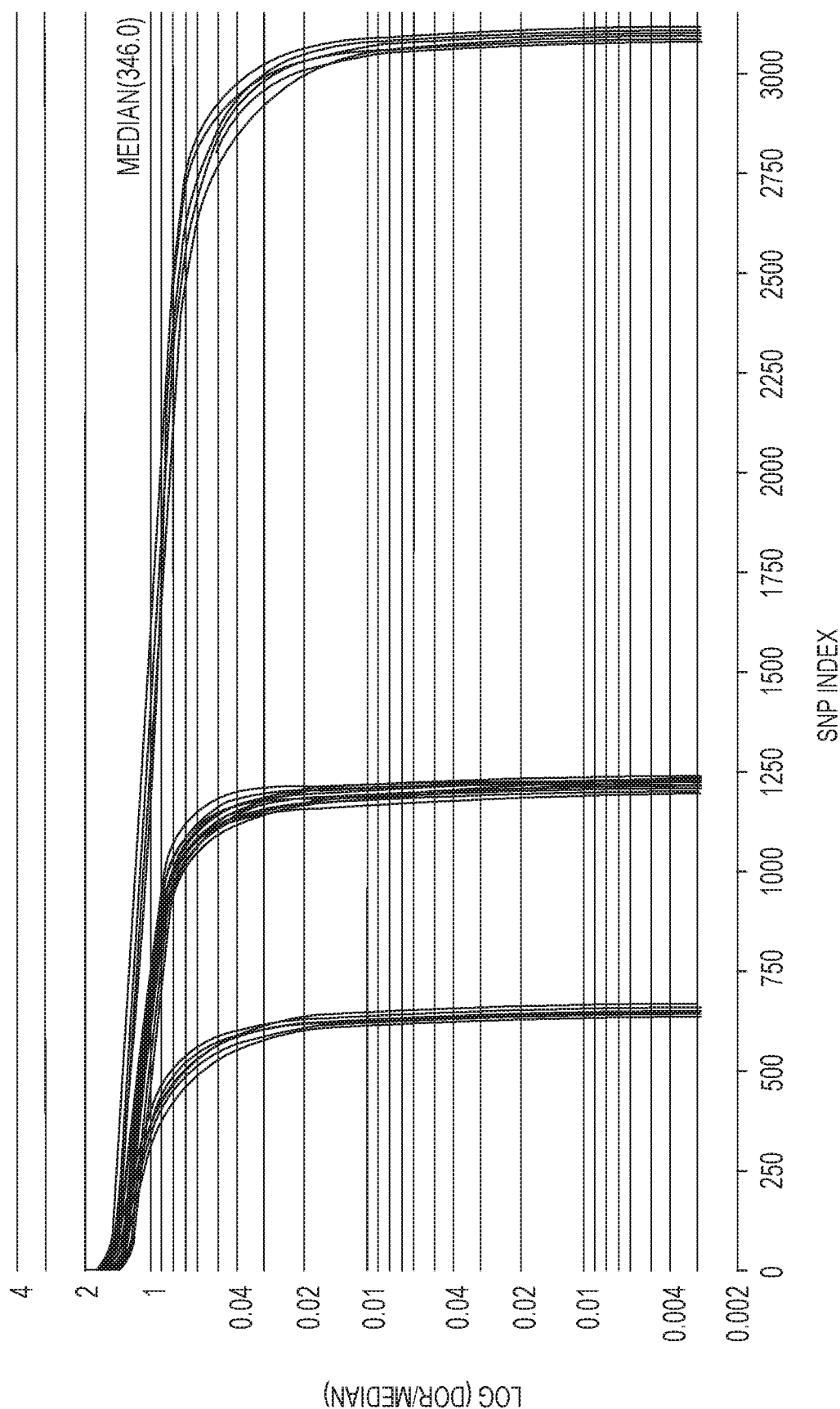
FIG. 42 is a graph illustrating the uniformity in depth of read (DOR) for these ~3,000 loci.

FIGS. 41A and 41B show results from analysis of genomic DNA (FIG. 41A) or DNA from a single cell (FIG. 41B) using a library of approximately 3,000 primers designed to detect CNVs. Approximately 1.2 million reads were measured per sample. The presence of two central bands instead of one central band indicates the presence of a CNV. For three samples of DNA from a single cell, the percent of mapped reads was 98.2%, 98.2%, and 97.9%, respectively. For two samples of genomic DNA the percent of mapped reads was 98.8% for each sample. FIG. 42 illustrates the uniformity in DOR for these ~3,000 loci.

Figures 43, 44:
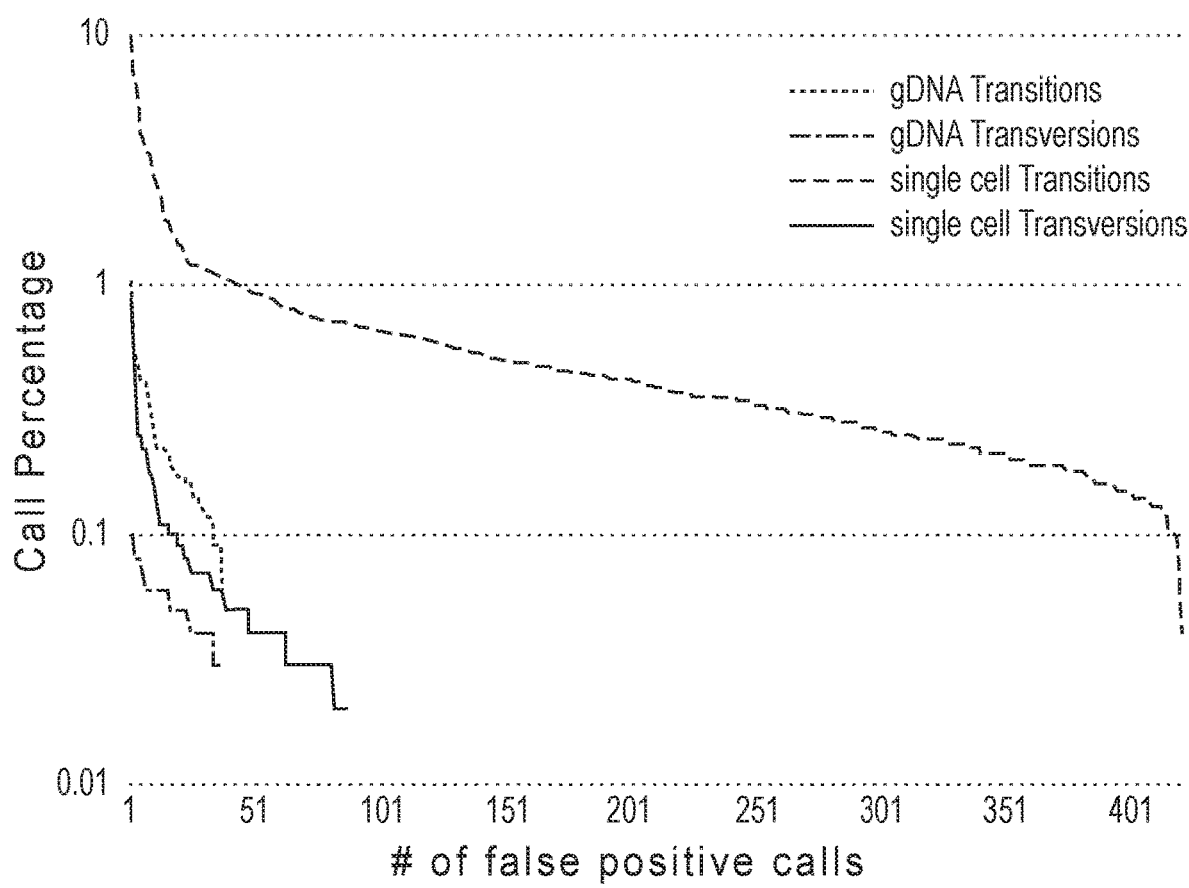
FIG. 43 is a table comparing error call metrics for genomic DNA and DNA from a single cell.
FIG. 44 is a graph of error rates for transition mutations and transversion mutations.

For calling SNVs, the call percent for true positive mutations was similar for DNA from a single cell and genomic DNA. A graph of call percent for true positive mutations for single cells on the y-axis versus that for genomic DNA on the x-axis yielded a curve fit of $y=1.0076x-0.3088$ with $R^2=0.9834$. FIG. 43 shows similar error call metrics for genomic DNA and DNA from a single cell. FIG. 44 shows that the error rate for detecting transition mutations was greater than for detecting transversion mutations, indicating it may be desirable to select transversion mutations for detection rather than transition mutations when possible. In some embodiments, at least 50, 60, 70, 80, 90, 95, 96, 98, 99, or 100% of the SNVs tested for are transversion mutations rather than transition mutations.

Example 25

The following is an example of multiplex PCR conditions in which the annealing temperature is significantly higher than the average or maximum melting ($T_m$) of the primers in the library. A 3,168-plex reaction was performed with 3,168 primer pairs to 3,168 different target loci. For the PCR amplification a 20 ul total volume was used with 2 nM of each primer (3,168 pairs of forward and reverse primers), 70 mM TMAC (tetra-methyl ammonium chloride), and 7 ul library DNA or genomic DNA. The following thermocycling conditions were used: 95° C. for 10 minutes and then 25 cycles of 96° C. for 30 seconds, 65° C. for 20 minutes (this annealing temperature is higher than the $T_m$ of the primers, listed above), and 72° C. for 30 seconds. Then, 72° C. for 2 minutes and a 4° C. hold were used.

The minimum $T_m$ (the lowest numerical value for the $T_m$ for any of the primers) for this primer library is 54.0° C. The maximum $T_m$ (the highest numerical value for the $T_m$ for any of the primers) for this primer library is 60.36° C. The average $T_m$ (average value of the $T_m$ values of the primers) for this primer library is 55.25° C. These $T_m$ values were calculated using the following exemplary method for calculating $T_m$ values. This method is used by the Primer3 program (the worldwide web at primer3.sourceforge.net, which is hereby incorporated by reference in its entirety) to calculate $T_m$ values. In some embodiments, one or more of the following conditions are assumed for this calculation: temperature: of 60.0° C., primer concentration of 100 nM, and/or salt concentration of 100 mM. In some embodiments, other conditions are assumed for this calculation, such as the conditions that will be used for multiplex PCR with the library.

$$Tm=\text{delta}H/(\text{delta}S+R*\ln(C/4))$$

Below is documentation from the Primer3 program for its Tm calculations; PRIMER_TM_FORMULA (int; default 0) specifies details of melting temperature calculation. This is new in version 1.1.0, and added by Maido Remm and Triinu Koressaar (the world wide web at primer3.ut.ee/primer3web_help.htm#PRIMER_TM_FORMULA, which is hereby incorporated by reference in its entirety). A value of 0 directs primer3 to a backward compatible calculation (in other words, the only calculation available in previous version of primer3). This backward compatible calculation uses the table of thermodynamic parameters in the paper (Breslauer K J et al. (1986) "Predicting DNA duplex stability from the base sequence" Proc Natl Acad Sci 83:4746-50, dx.doi.org/10.1073/pnas.83.11.3746, which is hereby incorporated by reference in its entirety), and the method in the paper (Rychlik W, Spencer W J and Rhoads R E (1990) "Optimization of the annealing temperature for DNA amplification in vitro", Nucleic Acids Res 18:6409-12, dx.doi.org/10.1093/nar/18.21.6409, which is hereby incorporated by reference in its entirety).

A value of 1 (which is recommended) directs primer3 to use the table of thermodynamic values and the method for melting temperature calculation suggested in the following paper (SantaLucia JR (1998) "A unified view of polymer, dumbbell and oligonucleotide DNA nearest-neighbor thermodynamics", Proc Natl Acad Sci 95:1460-65, dx.doi.org/10.1073/pnas.95.4.1460, which is hereby incorporated by reference in its entirety). The tag PRIMER_SALT_CORRECTIONS can be used to specify the salt correction method for melting temperature calculation.

The following is an example of calculating the melting temperature of an oligo with PRIMER_TM_FORMULA=1 and PRIMER_SALT_CORRECTIONS=1 recommended values for primer=CGTGACGTGACGGACT.

Using default salt and DNA concentrations gives $$Tm=\text{delta}H/(\text{delta}S+R*\ln(C/4))$$

where R is the gas constant (1.987 cal/K mol) and C is the DNA concentration.

$$deltaH(\text{predicted}) = dH(CG) + dH(GT) + dH(TG) + \ldots +$$
$$dH(CT) + dH(init.w.term.GC) + dH(init.w.term.AT) =$$
$$-10.6 + (-8.4) + (-8.5) + \ldots + (-7.8) + 0.1 + 2.3 = -128.8 \text{ kcal/mol}$$

where 'init.w.term GC' and 'init.w.term AT' are two initiation parameters for duplex formation: 'initiation with terminal GC' and 'initiation with terminal AT.'

$$deltaS(\text{predicted}) =$$
$$dS(CG) + dS(GT) + dS(TG) + \ldots + dS(CT) + dS(init.w.term.GC) +$$
$$dS(init.w.term.AT) = -27.2 + (-22.4) + (-22.7) +$$
$$\ldots + (-21.0) + (-2.8) + 4.1 = -345.2 \text{ cal/k*mol}$$
$$deltaS(\text{salt corrected}) = deltaS(\text{predicted}) +$$
$$0.368 * 15(NN \text{ pairs}) * \ln(0.05M \text{ monovalent cations}) = -361.736$$
$$Tm = -128.800 / (-361.736 + 1.987 * \ln((5*10^\wedge(-8))/4)) = 323.704 \text{ K}$$
$$Tm(C) = 323.704 - 273.15 = 50.554 \text{ C}$$

Additional Applications

Because this method utilizes targeted amplification, it is uniquely poised to detect submicroscopic anomalies, such as microdeletions and microduplications. Although non-targeted methods like MPSS have been shown to detect the DiGeorge microdeletion syndrome, this required a sufficiently high level of genomic coverage so as to make the approach unfeasible. This is because non-targeted amplification will be several orders of magnitude less efficient on submicroscopic regions, as very small fraction of the sequencing reads will be informative. Additionally, the fact that the currently available methods have trouble accurately identifying ploidy state for the sex chromosomes suggests that they will also encounter variable amplification problems on smaller chromosomal segments.

Similarly, SNP based methods can detect UPD disorders, which are copy number-neutral anomalies that will not be detected by either the current noninvasive methods that rely on counting or the traditional invasive methods like amniocentesis and CVS that rely on cytogenetic karyotyping and/or fluorescence in situ hybridization. This is because SNP-based methods are uniquely able to distinguish individual haplotypes, whereas the clinically available MPSS-based and targeted methods amplify non-polymorphic loci and are thus unable to determine, for example, whether the chromosomes-of-interest originate from the same parent. This means that these microdeletion/microduplication and UPD syndromes, including Prader-Willi, Angelman, and Beckwith-Wiedemann syndromes, are generally not diagnosed prenatally, and are often initially misdiagnosed postnatally. This significantly delays therapeutic intervention. Additionally, because this method targets SNPs, this method will also facilitate parental haplotype reconstruction, allowing for detection of fetal inheritance of individual disease-linked loci (Kitzman J O, Snyder M W, Ventura M, et al. Noninvasive whole-genome sequencing of a human fetus. Sci Transl Med 2012; 4:137ra76, which is hereby incorporated by reference in its entirety).

The results presented here confirm the expanded scope of this method for identifying prenatal aneuploidy. Specifically, by amplifying and sequencing 19,488 SNPs, this method is able to determine copy number at chromosomes 13, 18, 21, X, and Y, and is uniquely expected to detect other chromosomal abnormalities, such as triploidy and UPD, that are not detected by any other clinically available non-invasive method. The increased clinical coverage and powerful sample-specific calculated accuracies suggest that this method may offer a viable adjunct to invasive testing for detecting fetal chromosomal aneuploidies.

Example 26

This example describes an exemplary method for detection of copy number variations in breast cancer samples using SNP-targeted massively multiplexed PCR. Evaluation of CNV in tumor tissues typically involves SNP microarray or aCGH. These methods have high whole-genome resolution, but require large amounts of input material, have high fixed costs, and do not work well on formaldehyde fixed-paraffin embedded (FFPE) samples. For this example, 28,000-plex SNP-targeted PCR with next generation sequencing (NGS) was used to target 1p, 1q, 2p, 2q, 4p16, 5p15, 7q11, 15q, 17p, 22q11, 22q13 and chromosomes 13, 18, 21 and X for detection of CNVs in breast cancer samples. Accuracy was validated on 96 samples with aneuploidies or microdeletions. Single-molecule sensitivity was established by analyzing single cells. Of 17 breast cancer samples (15 fresh frozen and 2 FFPE tumor tissues, 5 pairs of matched tumor and normal cell lines) analyzed, 16 (including both FFPEs) were observed with full or partial CNVs in one to 15 targets (average: 7.8); evidence of tumor heterogeneity was observed. The three tissues with one CNV all had a 1 q duplication, the most frequent cytogenetic abnormality in breast carcinoma. The most frequent regions with CNVs were 1q, 7p, and 22q1. Only one tumor tissue (with 9 CNVs) had a region with LOH; this LOH was also detected in adjacent putatively normal tissue that lacked the other 8 CNVs. By contrast, 5 or more regions with LOH and a high total CNV incidence (average: 12.8) was detected in cell lines. Thus, massively multiplexed PCR offers an economical high-throughput approach to investigate CNVs in a targeted manner, and is applicable to difficult-to-analyze samples, such as FFPE tissues.

Example 27

This example further validates a massively multiplexed PCR methodology for chromosomal aneuploidy and CNV determination disclosed herein, sometimes referred to as CoNVERGe (Copy Number Variant Events Revealed Genotypically), in cancer diagnostics, and further illustrates the development and use of "PlasmArt" standards for PCR of ctDNA samples. PlasmArt standards include polynucleotides having sequence identity to regions of the genome known to exhibit CNV and a size distribution that reflects that of cfDNA fragments naturally found in plasma.

Sample Collection

Human breast cancer cell lines (HCC38, HCC1143, HCC1395, HCC1937, HCC1954, and HCC2218) and matched normal cell lines (HCC38BL, HCC1143BL, HCC1395BL, HCC1937BL, HCC1954BL, and HCC2218BL) were obtained from the American Type Culture Collection (ATCC). Trisomy 21 B-lymphocyte (ΔG16777) and paired father/child DiGeorge Syndrome (DGS) cell lines (GM10383 and GM10382, respectively)

were from the Coriell Cell Repository (Camden, N.J.). GM10382 cells only have the paternal 22q11.2 region.

We procured tumour tissues from 16 breast cancer patients, including 11 fresh frozen (FF) samples from Geneticist (Glendale, Calif.) and five formalin-fixed paraffin-embedded (FFPE) samples from North Shore-LIJ (Manhasset, N.Y.). We acquired matched buffy coat samples for eight patients and matched plasma samples for nine patients. FF tumour tissues and matched buffy coat and plasma samples from five ovarian cancer patients were from North Shore-LIJ. For eight breast tumour FF samples, tissue subsections were resected for analysis. Institutional review board approvals from Northshore/LIJ IRB and Kharkiv National Medical University Ethics Committee were obtained for sample collection and informed consent was obtained from all subjects.

Blood samples were collected into EDTA tubes. Circulating cell free DNA (containing ctDNA) was isolated from 1 mL plasma using the QIAamp Circulating Nucleic Acid Kit (Qiagen, Valencia, Calif.). Genomic DNA (gDNA) from FF tumor tissues, blood, and buccal samples was extracted using the DNeasy Blood and Tissue Kit (Qiagen).

To make the PlasmArt standards according to one exemplary method, first, $9 \times 10^6$ cells were lysed with hypotonic lysis buffer (20 mM Tris-Cl (pH 7.5), 10 mM NaCl, and 3 mM $MgCl_2$) for 15 min on ice. Then, 10% IGEPAL CA-630 (Sigma, St. Louis, Mo.) was added to a final concentration of 0.5%. After centrifugation at 3,000 g for 10 min at 4° C., pelleted nuclei were resuspended in 1× micrococcal nuclease (MNase) Buffer (New England BioLabs, Ipswich, Mass.) before adding 1000 U of MNase (New England BioLabs), and then incubated for 5 min at 37° C. Reactions were stopped by adding EDTA to a final concentration of 15 mM. Undigested chromatin was removed by centrifugation at 2,000 g for 1 min. Fragmented DNA was purified with the DNA Clean & Concentrator™-500 kit (Zymo Research, Irvine, Calif.). Mononucleosomal DNA produced by MNase digestion was also purified and size-selected using AMPure XP magnetic beads (Beckman Coulter, Brea, Calif.). DNA fragments were sized and quantified with a Bioanalyzer DNA 1000 chip (Agilent, Santa Clara, Calif.).

To model ctDNA at different concentrations, different fractions of PlasmArts from HCC1954 and HCC2218 cancer cells were mixed with those from the corresponding matched normal cell line (HCC1954BL and HCC2218BL, respectively). Three samples at each concentration were analyzed. Similarly, to model allelic imbalances in plasma DNA in a focal 3.5 Mb region, we generated PlasmArts from DNA mixtures containing different ratios of DNA from a child with a maternal 22q11.2 deletion and DNA from the father. Samples containing only the father's DNA were used as negative controls. Eight samples at each concentration were analyzed.

Massively Multiplexed PCR and DNA Sequencing

Massively multiplex PCR and DNA sequencing methods below were used to determine allele counts at a plurality of polymorphic loci with 3-6 million (M) reads/sample for cell lines, 1.5-7 M reads/sample for tumour tissues, 18 M reads/sample for FFPE-LCM samples, 6-7 M reads/sample for germline controls, and 18-25 M reads/sample for plasma. For two representative exemplary runs using the 3,168 SNP primer pair pool, an average of 20 million reads were used to obtain allele counts for plasma DNA libraries and 6 million reads were used to obtain allele counts for genomic DNA libraries from fresh-frozen human tumors. The percent of mapped reads (i.e. mapped to the human genome) on these two exemplary runs were 98% and 95%, respectively.

The fraction of sequencing reads at a given locus with a particular allele (allele fraction) was the fractional abundance of the allele in a sample. These counts provided observed allele frequencies that were used by the data analysis methods provided immediately below in this Example to determine the ploidy state of a chromosome or chromosome segment of interest and/or to determine the average allelic imbalance of the sample.

Libraries were generated from the samples above. Adapters were ligated to DNA fragments and the fragments were amplified using the following protocol: 95° C., 2 min; 15×[95° C., 20 sec, 55° C., 20 sec, 68° C., 20 sec], 68° C. 2 min, 4° C. hold.

Multiplexed PCR allows simultaneous amplification of many targets in a single reaction. In this study, we targeted 3,168 SNPs, which were distributed across five chromosome arms as follows: 646 on 1p, 602 on 1q, 541 on 2p, 707 on 2q, and 672 on the 22q11.2 focal region. These genomic regions were selected for convenience from SNP panels available in our laboratory. Target SNPs had at least 10% population minor allele frequency (1000 Genomes Project data; Apr. 30, 2012 release) to ensure that a sufficient fraction would be heterozygous in any given patient. For each SNP, multiple primers were designed to have a maximum amplicon length of 75 bp and a melting temperature between 54.0-60.5° C. To minimize the likelihood of primer dimer product formation, primer interaction scores for all possible combinations of primers were calculated, and primers with high scores were eliminated. The 3,186 SNP primer pair pool all had $\Delta G$ values greater than −4 Kcal/mol. Candidate PCR assays were ranked and 3,168 assays were selected on the basis of target SNP minor-allele frequency, observed heterozygosity rate (from dbSNP), presence in HapMap, and amplicon length.

For PCR amplifications, 3,168 SNPs were amplified in a multiplex PCR reaction using one primer pair for each SNP, during 25 cycles, and sequencing barcodes were added in 12 additional cycles. Prior to sequencing, the barcoded products were pooled, purified with the QIAquick PCR Purification Kit (Qiagen), and quantified using the Qubit™ dsDNA BR Assay Kit (Life Technologies). Amplicons were sequenced using an Illumina HiSeq 2500 sequencer with 1.5-7 M reads/sample for tumor tissue DNA and 18-25 M reads/sample for plasma cfDNA.

For the 3,168 SNP multiplex PCR reaction, approximately 7 ul (approx. 1200 ng) of library DNA, such as DNA from a DNA library generated from plasma of a target individual, was used. The master mix included the following: 2× (twice manufacturer's recommended concentration) Qiagen master mix, 70 mM TMAC (tetramethylammonium chloride, Sigma), 2 nM each primer, and 7 ul nucleic acid library (~1200 ng total library input) (20 ul total volume). The cycling conditions for the 3,168 SNP multiplex PCR reaction were as follows: 95° C., 15 min; 25×[96° C., 30 sec; 65° C., 20 min; 72° C., 30 sec]; 72° C., 2 min; 4° C. hold.

For the barcoding reaction, a 1× master mix was prepared that included the following: 1 uM forward primer (containing Illumina sequencing tag), 1 uM reverse primer (containing Illumina sequencing tag as well as internally-designed sequencing barcode), 1 ul of mmPCR product, diluted 1:2,000, and 1× Qiagen master mix. Barcoding cycling conditions were as follows: 95° C., 10 min; 12×[95° C., 30 sec; 70° C., 10 sec, 60° C., 30 sec; 65° C., 15 sec, 72° C., 15 sec]; 72° C., 2 min; 4° C. hold.

Data Analysis of Tumor Tissue Genomic DNA

For tumor tissue samples, CNVs were delineated by transitions between allele frequency distributions. Regions with at least 100 SNPs that had an allele ratio statistically different from 0.50 were considered to be of interest. More specifically, the analysis focused on regions with average allele ratios of ≤0.45 or ≥0.55 for loci that are heterozygous in the germline. A segmentation algorithm was used to exhaustively search DNA sequences in five chromosome arms as follows: 646 on 1p, 602 on 1q, 541 on 2p, 707 on 2q, and 672 on the 22q11.2 for such regions, and iteratively selected them starting from the longest one until a region of 100 SNPs was reached. Once a ≥100 SNP region was determined to contain a CNV, it was further segmented by average allelic ratios with a minimum segment size of 50 SNPs if needed.

Fresh frozen tissue samples from three patients with breast cancer were also analyzed using Illumina CytoSNP-12 microarrays as previously described (Levy, B. et al. Genomic imbalance in products of conception: single-nucleotide polymorphism chromosomal microarray analysis. Obstetrics and gynecology 124, 202-209 (2014)).

Data Analysis of Circulating Tumor DNA

CNVs were identified by a maximum likelihood algorithm that searched for plasma CNVs in regions where the tumor sample from the same individual also had CNVs, using haplotype information deduced from the tumor sample. This algorithm modeled expected allelic frequencies across a set of average allelic imbalances at 0.025% intervals for three sets of hypotheses: (1) all cells are normal (no allelic imbalance), (2) some/all cells have a homolog 1 deletion or homolog 2 amplification, or (3) some/all cells have a homolog 2 deletion or homolog 1 amplification. For at least some of the analysis, modeling was performed up to 15% average allelic imbalance, although for the vast majority of samples AAI was less than or equal to 5%. The likelihood of each hypothesis was determined at each SNP using a Bayesian classifier based on a beta binomial model of expected and observed allele frequencies at all heterozygous SNPs, and then the joint likelihood across multiple SNPs was calculated taking linkage of the SNP loci into consideration. The maximum likelihood hypothesis from the comparison of expected to observed allele frequencies was then selected.

This algorithm also calculates the confidence of each CNV call by comparing the likelihoods of different hypotheses. A confidence threshold of 99.9% was used in plasma samples to minimize false positive results.

For dimorphic SNPs that have alleles arbitrarily designated 'A' and 'B', the allele ratio of the A allele is $n_A/(n_A+n_B)$, where $n_A$ and $n_B$ are the number of sequencing reads for alleles A and B, respectively. Allelic imbalance is the difference between the allele ratios of A and B for loci that are heterozygous in the germline. This definition is analogous to that for SNVs, where the proportion of abnormal DNA is typically measured using mutant allele frequency, or $n_m/(n_m+n_r)$, where $n_m$ and $n_r$ are the number of sequencing reads for the mutant allele and the reference allele, respectively.

Allele frequency data was corrected for errors before it was used to generate individual probabilities. Errors that were corrected included allele amplification bias, ambient contamination, genotype contamination, and sequencing error. Ambient contamination refers to the contamination error across all SNPs in addition to sequencing errors, and genotype contamination refers to the additional contamination at some SNPs due to contamination from another sample. Ambient contamination and genotype contamination were determined on the same run as the on-test sample analysis by analyzing homozygous alleles in the sample. The ploidy status of a chromosomal segment was estimated using heterozygous loci for a test individual.

Best hypothesis was defined to be the one with the highest likelihood across all polymorphic loci. Likelihood at each locus was calculated using a beta binomial model of observed allele frequencies at each of the polymorphic loci, and the likelihood across a set of polymorphic loci was computed using the phase information deduced from the corresponding tumor sample.

A linear regression model was used to compare either expected AAI or tumor input DNA percentage and observed AAI determined by the CNV detection algorithm. P<0.05 was considered statistically significant. SigmaPlot 12.5 (Systat Software, San Jose, Calif.) and Matlab 7.12.0 R2011.a (MathWorks, Natick, Mass.) were used.

Accordingly, to evaluate the sensitivity and reproducibility of CoNVERGe, especially when the proportion of abnormal DNA for a CNV, or average allelic imbalance (AAI), is low, we used it to detect CNVs in DNA mixtures comprised of a previously characterized abnormal sample titrated into a matched normal sample. The mixtures consisted of artificial cfDNA, termed "PlasmArt", with fragment size distribution approximating natural cfDNA (see above). In the first pair, a son's tumor DNA sample having a 3 Mb Focal CNV deletion of the 22q11.2 region was titrated into a matched normal sample from the father at between 0-1.5% total cfDNA. CoNVERGe reproducibly identified CNVs corresponding to the known abnormality with estimated AAI of >0.35% in mixtures of ≥0.5%+/−0.2% AAI, failed to detect the CNV in 6/8 replicates at 0.25% abnormal DNA, and reported a value of ≤0.05% for all eight negative control samples. The AAI values estimated by CoNVERGe showed high linearity (R2=0.940) and reproducibility (error variance=0.087). The assay was sensitive to different levels of amplification within the same sample. Based on these data a conservative detection threshold of 0.45% AAI could be used for subsequent analyses.

Two additional PlasmArt titrations, prepared from pairs of matched tumor and normal cell line samples and having CNVs on chromosome 1 or chromosome 2, were also evaluated. Among negative controls, all values were <0.45%, and high linearity (R2=0.952 for HCC1954 1p, R2=0.993 for HCC1954 1q, R2=0.977 for HCC2218 2p, R2=0.967 for HCC2218 2q) and reproducibility (error variance=0.190 for HCC1954 1p, 0.029 for HCC1954 1q, 0.250 for HCC2218 2p, and 0.350 for HCC2218 2q) were observed between the known input DNA amount and that calculated by CoNVERGe. The difference in the slopes of the regressions for regions 1p and 1q of one sample pair correlates with the relative difference in copy number observed in the B-allelic frequencies (BAFs) of regions 1p and 1q of the same sample, demonstrating the relative precision of the AAI estimate calculated by CoNVERGe.

CoNVERGe has application to a variety of sample sources including FFPE, Fresh Frozen, Single Cell, Germline control and cfDNA. We applied CoNVERGe to six human breast cancer cell lines and matched normal cell lines to assess whether it can detect somatic CNVs. Arm-level and focal CNVs were present in all six tumour cell lines, but were absent from their matched normal cell lines, with the exception of chromosome 2 in HCC1143 in which the normal cell line exhibits a deviation from the 1:1 homolog ratio. To validate these results on a different platform, we performed CytoSNP-12 microarray analyses, which produced consistent results for all samples. Moreover, the maximum homolog ratios for CNVs identified by CoN- VERGe and CytoSNP-12 microarrays exhibited a strong linear correlation ($R2=0.987$, $P<0.001$).

We next applied CoNVERGe to fresh-frozen (FF) and formalin-fixed, paraffin-embedded (FFPE) breast tumour tissue samples. In both sample types, several arm-level and focal CNVs were present; however, no CNVs were detected in DNA from matched buffy coat samples. CoNVERGe results were highly correlated with those from microarray analyses of the same samples ($R2=0.909$, $P<0.001$ for CytoSNP-12 on FF; $R2=0.992$, $P<0.001$ for OncoScan on FFPE). CoNVERGe also produces consistent results on small quantities of DNA extracted from laser capture microdis section (LCM) samples, for which microarray methods are not suitable.

Detection of CNVs in Single Cells with CoNVERGe

To test the limits of the applicability of this mmPCR approach, we isolated single cells from the six aforementioned cancer cell lines and from a B-lymphocyte cell line that had no CNVs in the target regions. The CNV profiles from these single-cell experiments were consistent between three replicates and with those from genomic DNA (gDNA) extracted from a bulk sample of about 20,000 cells. On the basis of the number of SNPs with no sequencing reads, the average assay drop-out rate for bulk samples was 0.48% (range: 0.41-0.60%), which is attributable to either synthesis or assay design failure. For single cells, the additional average assay drop-out rate observed was 0.39% (range: 0.19-0.67%). For single cell assays that did not fail (i.e. no assay drop-out occurred), the average single ADO rate calculated using heterozygous SNPs only was 0.05% (range: 0.00-0.43%). Additionally, the percentage of SNPs with high confidence genotypes (i.e. SNP genotypes determined with at least 98% confidence) was similar for both single cell and bulk samples and the genotype in the single cell samples matched those in the bulk sample (average 99.52%, range: 92.63-100.00%).

In single cells, allele frequencies are expected to directly reflect chromosome copy numbers, unlike in tumour samples where this may be confounded by TH and non-tumour cell contamination. BAFs of $1/n$ and $(n-1)/n$ indicate n chromosome copies in a region. Chromosome copy numbers are indicated on the allele frequency plots for both single cells and matched gDNA samples.

Application of CoNVERGe to Plasma Samples

To investigate the ability of CoNVERGe to detect CNVs in real plasma samples, we applied our approach to cfDNA paired with a matched tumour biopsy from each of two stage II breast cancer patients and five late-stage ovarian cancer. In all seven patients, CNVs were detected in both FF tumour tissues and in the corresponding plasma samples. A total of 32 CNVs, at a level of ≥0.45% AAI, were detected in the seven plasma samples (range: 0.48-12.99% AAI) over the five regions assayed, which represent about 20% of the genome. Note that the presence of CNVs in plasma cannot be confirmed due to the lack of alternative orthogonal methods.

Although AAI estimates may appear correlated with BAFs in tumour, direct proportionality should not necessarily be expected due to tumour heterogeneity. For example, in sample BC5, regions that have BAFs compatible with $N=11$ were detecting; combining this with the AAI calculation from the plasma sample leads to estimates for c of 2.33% and 2.67% for the two regions. Estimating c using the other regions in the sample give values between 4.46% and 9.53%, which clearly demonstrates the presence of tumor heterogeneity.

Further CNV Analyses of Tumor Tissue Samples

We applied our mmPCR-NGS method described herein to plasma samples from four stage II breast cancer patients (BC1-BC4), and analyzed the concordance between CNVs detected in plasma and those detected in multiple tumor samples from each corresponding patient. Thus, we analyzed 4-6 tissue subsections from a tumor from each of four patients with breast cancer using mmPCR-NGS. All subsections for each patient had a CNV detected in at least one of the five targeted genomic regions (1p, 1q, 2p, 2q, and 22q11.2). A CNV was identified in at least one tumor subsection in 18/20 (90%) genomic regions. Among these 18 CNV-positive regions, 11 (61%) had a CNV detected in that particular region in all subsections.

Interestingly, different patterns of AAIs across these five chromosomal regions were observed among different tumor subsections. In patient BC1, for instance, a similar pattern of CNVs was observed for regions 2p, 2q, and 22q11.2 in all four subsections, suggesting that these CNVs are clonal mutations. In contrast, only two of the four subsections had CNVs observed in the 1p region, and three of the four subsections had CNVs observed in the 1q region, suggesting that those CNVs were subclonal mutations. Similar patterns of possible clonal and subclonal CNVs were observed in patients BC3 and BC4, whereas BC2 appeared to be more homogenous.

In addition, even when a CNV was detected in all subsections for a particular patient, such as in the 1q region for patient BC3, the AAI often varied between subsections. Overall AAI patterns also differed between patients. Taken together, these findings suggest that mmPCR-NGS can be used to elucidate both intra- and inter-tumor clonal heterogeneity.

Concordance of CNVs in Tumors and Plasma cfDNA

To quantify the amount of overlap between CNVs detected in plasma cfDNA and those detected in tumor tissue gDNA, we used mmPCR-NGS to interrogate CNVs in tumor tissue samples and matching plasma samples from patients BC1-BC4. Seven of the 18 (39%) CNV-positive genomic regions identified in tumor subsections were also detected in the plasma (0.77%-5.80% AAI). Considering only the 11 clonal CNVs—those that were detected in all tumor subsections—a CNV was detected in four (36%) of the patient-matched plasma samples (estimated AAI: 0.77%-5.80%).

Among the seven subclonal CNVs—those that were not observed in all subsections—we detected a CNV in 3/7 (43%) of the regions (estimated AAI: 1.24%-3.36%) in the corresponding cfDNA. Of note, in these three regions (BC1, chromosome 1p; BC1, chromosome 1q; and BC4, chromosome 2p), a CNV was detected in 10/14 (71%) of the matched tumor subsections. In contrast, in the other four genomic regions that did not have a CNV detected in the corresponding plasma samples (BC3, chromosomal regions 1p, 2p, 2q, and 22q11.2), we only detected a CNV in 7/24 (29%) of the tissue subsections. These data suggest that the more prevalent a subclonal CNV is within a tumor, the more likely it is to be observed in cfDNA.

In the 150 genomic regions assayed in 30 negative controls, there were no CNVs with AAIs >0.45% and confidence >99.9%, which suggests that mmPCR-NGS has a low false-positive rate.

These data demonstrate that CNVs can be detected in plasma in a substantial fraction of samples, and suggest that the more prevalent a CNV is within a tumour, the more likely it is to be observed in cfDNA. Furthermore, CoNVERGe detected CNVs from a liquid biopsy that may have otherwise gone unobserved in a traditional tumour biopsy.

Example 28

This example provides details regarding certain exemplary sample preparation methods used for analysis of different types of samples. The sample preparation methods disclosed in this example, were used in other Examples provided herein, to generate nucleic acid templates spanning a plurality of SNP sites for next generation sequencing reactions. From these NGS reactions, allele counts were generated at a plurality of polymorphic loci. These counts were then used by the analytical methods provided herein, to determine the ploidy state of a chromosome or chromosome segment of interest and/or to determine the average allelic imbalance of a sample.

Single Cell CNV Protocol for 28,000-plex PCR

Multiplexed PCR allows simultaneous amplification of many targets in a single reaction. Target SNPs were identified in each genomic region with 10% minimum population minor allele frequency (1000 Genomes Project data; Apr. 30, 2012 release). For each SNP, multiple primers, semi-nested, were designed to have an amplicon length of a maximum length of 75 bp and a melting temperature between 54-60.5° C. Primer interaction scores for all possible combinations of primers were calculated; primers with high scores were eliminated to reduce the likelihood of primer dimer product formation. Candidate PCR assays were ranked and selected on the basis of target SNP minor allele frequency, observed heterozygosity rate (from dbSNP), presence in HapMap, and amplicon length.

In certain experiments, single cell samples were prepared and amplified using a mmPCR 28,000-plex protocol. The samples were prepared in the following way: For analysis of a single cell, cells were serial diluted until there were 3 or 4 cells per droplet. An individual cell was pipetted and placed into a PCR tube. The cell was lysed using Protease K, salt, and DTT using the following conditions: 56° C. for 20 minutes, 95° C. for 10 minutes, and then a 4° C. hold. For analysis of genomic DNA, DNA from the same cell line as the analyzed single cell was either purchased or obtained by growing the cells and extracting the DNA. The DNA was amplified in a 40 uL reaction volume containing Qiagen mp-PCR master mix (2×MM final conc), 7.5 nM primer conc. for 28K primer pairs having hemi-nested Rev primers under the following conditions: 95 C 10 min, 25×[96 C 30 sec, 65 C 29 min, 72 C 30 sec], 72 C 2 min, 4 C hold. The amplification product was diluted 1:200 in water and 2 ul added to STAR 2 (10 ul reaction volume) 1×MM, 5 nM primer conc. and PCR was performed using hemi-nested inner Fwd primer and tag specific Rev primer: 95 C 15 min, 25×[94 C 30 sec, 65 C 1 min, 60 C 5 min, 65 C 5 min, 72 C 30 sec], 72 C 2 min, 4 C hold.

Full sequence tags and barcodes were attached to the amplification products and amplified for 9 cycles using adaptor specific primers. Prior to sequencing, the barcoded library product were pooled, purified with the QIAquick PCR Purification Kit (Qiagen), and quantified using the Qubit ☐dsDNA BR Assay Kit (Life Technologies). Amplicons were sequenced using an Illumina HiSeq 2500 sequencer.

Extraction of DNA from a Blood/Plasma Sample

Blood samples were collected into EDTA tubes. The whole blood sample was centrifuged and separated into three layers: the upper layer, 55% of the blood sample, was plasma and contains cell-free DNA (cfDNA); the buffy coat middle layer contained leucocytes having DNA, <1% of total; and the bottom layer, 45% of the collected blood sample, contained erythrocytes, no DNA was present in this fraction as erythrocytes are enucleated. Circulating tumor DNA was isolated from at least 1 mL plasma using the QIAamp Circulating Nucleic Acid Kit, Qia-Amp (Qiagen, Valencia, Calif.), according to the manufacture's protocol. In certain experiments genomic DNA (gDNA) from FF tumor tissues, blood, and buccal samples was extracted using the DNeasy Blood and Tissue Kit (Qiagen).

Plasma CNV Protocol for 3,168-plex for Chromosomes 1p, 1q, 2p, 2q, and 22q11

Plasma DNA libraries were prepared and amplified using a mmPCR 3,168-plex protocol. The samples were prepared in the following way: Up to 20 mL of blood was centrifuged to isolate the buffy coat and the plasma. Plasma extraction of cfDNA and library preparation was performed. DNA was eluted in 50 uL TE buffer. The input for mmPCR was 6.7 uL of amplified and purified Natera plasma library at an input amount of approximately 1200 ng. The plasma DNA was amplified in a 20 uL reaction volume containing Qiagen mp-PCR master mix (2×MM final conc), 2 nM tagged primer conc. (total 12.7 uM) in 3,168-plex primer pools and PCR amplified: 95 C 10 min, 25×[96 C 30 sec, 65 C 20 min, 72 C 30 sec], 72 C 2 min, 4 C hold. The amplification product was diluted 1:2,000 in water and 1 ul added to the Barcoding-PCR in a 10 uL reaction volume. The barcodes were attached to the amplification products via PCR amplification for 12 cycles using tag specific primers. Products of multiple samples were pooled and then purified with QIAquick PCR Purification Kit (Qiagen) and eluted in 50 ul DNA suspension buffer. Samples were sequenced by NGS as described for the Single Cell CNV Protocol for 28,000-plex PCR.

Breast Cancer Feasibility SNV Panel from Plasma cfDNA from breast cancer patient blood samples was prepared and amplified using 336 primer pairs that were distributed into four 84-plex pools. Natera plasma libraries were prepared as described for Plasma CNV Protocol for 3,168-plex for Chromosomes 1p, 1q, 2p, 2q, and 22q11. DNA was eluted in 50 uL TE buffer. The input for mPCR was 2.5 uL of amplified and purified Natera plasma library at an input amount of approximately 600 ng. SNPs were selected from the 1000 Genomes map for Humans, Group 19 and dbSNP to pick targets, but only SNPs from the 1000 Genomes were used to screen for minor allele frequencies. The plasma DNA was amplified in four parallel reactions of 84-plex primer pools, a 10 uL reaction volume containing Qiagen mp-PCR master mix (2×MM final conc.), 4 mM EDTA, 7.5 nM primer concentration (total 1.26 uM) and PCR amplified: 95 C 15 min, 25×[94 C 30 sec, 65 C 15 min, 72 C 30 sec], 72 C 2 min, 4 C hold. The amplification product of the 4 subpools were each diluted 1:200 in water and 1 ul added to the Barcoding-PCR reaction in a 10 uL reaction volume containing Q5 HS HF master mix (1×final), and 1 uM each barcoding primer and each of the pools were amplified in the following reaction: 98 C 1 min, 25×[98 C 10 sec, 70 C 10 sec, 60 C 30 sec, 65 C 15 sec, 72 C 15 sec], 72 C 2 min, 4 C hold. Libraries were purified with QIAquick PCR Purification Kit (Qiagen) and eluted in 50 ul DNA suspension buffer. Samples were sequenced by paired end sequencing.

Example 29

This example demonstrates that by using low primer concentrations such that primer amount is the limiting reactant in multiplex PCR in a workflow that is followed by next generation sequencing, uniformity of density of reads, and therefore limits of detection, across a pool of amplification reactions is improved. Some experiments were carried out for plasma CNV using the 3,168-plex panel according to Example 28 above except that the total reaction volume was 10 uL instead of 20 uL. Furthermore, PCR was carried out for 15, 20, or 25 cycles. Other experiments were carried out using the four 84-plex pools on breast cancer samples according to the protocol of Example 28 except that primer concentrations were 2 nM and PCR amplification was carried out for 15, 20, or 25 cycles.

Not to be limited by theory, it is believed that primer limited multiplex PCR provides improved depth of read uniformity for multiplex PCR before multi-read sequencing, such as high throughput or massively parallel sequencing, such as sequencing on an Illumina HiSeq or MiSeq system or an Ion Torrent PGM or Proton system, based on the following considerations: If some of the amplifications in a multiplex PCR have lower efficiencies than others, then with normal multiplex PCR we will end up with a wide range of depth of read ("DOW") values. However, if the amount of primer is limited, and the multiplex PCR is cycled more times than what it takes to exhaust the primers, then the more efficient amplifications will stop doubling (because they have no more primers to use) and the less efficient ones will continue to double; this will result in a more similar amount of amplification product for all of the amplification products. This will translate into a much more uniform distribution of the DOR.

The following calculations are used to determine the number of cycles that would exact a given amount of primer and starting nucleic acid template:
- assume a given starting DNA input level: 100 k copies of each target ($10^5$; this is easily achieved with using amplified library)
- assume we use 2 nM of each primer as an exemplary concentration, although other concentrations such as, for example, 0.2, 0.5, 1, 1.5, 2, 2.5, 5, or 10 nM could work too.
- calculate the number of primer molecules for each primer: $2*10^{-9}$ (molar concentration, 2 nM)$\times 10*10^{-6}$ (reaction volume, 10 ul)$\times 6*10^{23}$ (number of molecules per mole, Avogadro's number)$=12*10^9$
- calculate the amplification fold needed to consume all primers: $12*10^9$ (number of primer molecules)/$10^5$ (number of copies of each target)$=12*10^4$
- calculate the number of cycles needed to achieve this amplification fold, assuming 100% efficiency at each cycle: $\log 2(12*10^{^4})=17$ cycles. (this is log 2 because at each cycle, the number of copies doubles).

So for these conditions (100 k copies input, 2 nM primers, 10 ul reaction volume, assuming 100% PCR efficiency at each cycle), the primers would be consumed after 17 PCR cycles.

However, the key assumption is that some of the products DO NOT have 100% efficiency, so without measuring their efficiencies (which is only practicable for a small number of them anyway), it would take more than 17 cycles to consume them.

For each of four 84-plex SNV PCR primer pools we observed improved DOR efficiency with increasing cycles from 15 to 20 to 25. Similar results were obtained for experiments using the 3,168-plex panel. The limit of detection decreased (i.e. SNV sensitivity increased) with increasing depth of read. Furthermore, the sensitivity was consistently better when detecting transversion mutations than transition mutations. It is likely that additional increases in DOR efficiency can be obtained with additional cycles when using primer-limiting multiplex PCR before multi-read sequencing.

Accordingly, in one aspect provided herein is a method of amplifying a plurality of target loci in a nucleic acid sample that includes (i) contacting the nucleic acid sample with a library of primers and other primer extension reaction components to provide a reaction mixture, wherein the relative amount of each primer in the reaction mixture compared to the other primer extension reaction components creates a reaction wherein the primers are present at a limiting concentration, and wherein the primers hybridize to a plurality of different target loci; and (ii) subjecting the reaction mixture to primer extension reaction conditions for sufficient number of cycles to consume or exhaust the primers in the library of primers, to produce amplified products that include target amplicons. For example, the plurality of different target loci can include at least 2, 3, 5, 10, 25, 50, 100, 200, 250, 500, 1,000; 2,000; 5,000; 7,500; 10,000; 20,000; 25,000; 30,000; 40,000; 50,000; 75,000; or 100,000 different target loci, and at most, 50, 100, 200, 250, 500, 1,000; 2,000; 5,000; 7,500; 10,000; 20,000; 25,000; 30,000; 40,000; 50,000; 75,000; 100,000, 200,000, 250,000, 500,000, and 1,000,000 different target loci to produce a reaction mixture.

The method in illustrative embodiments, includes determining an amount of primer that will be a rate limiting amount. This calculation typically includes estimating and/or determining the number of target molecules and involves analyzing and/or determining the number of amplification cycles performed. For example, in illustrative embodiments, the concentration of each primer is less than 100, 75, 50, 25, 10, 5, 2, 1, 0.5, 0.25, 0.2 or 0.1 nM. In various embodiments, the GC content of the primers is between 30 to 80%, such as between 40 to 70% or 50 to 60%, inclusive. In some embodiments, the range of GC content (e.g., the maximum GC content minus minimum GC content, such as 80%-60%=a range of 20%) of the primers is less than 30, 20, 10, or 5%. In some embodiments, the melting temperature ($T_m$) of the primers is between 40 to 80° C., such as 50 to 70° C., 55 to 65° C., or 57 to 60.5° C., inclusive. In some embodiments, the range of melting temperatures of the primers is less than 20, 15, 10, 5, 3, or 1° C. In some embodiments, the length of the primers is between 15 to 100 nucleotides, such as between 15 to 75 nucleotides, 15 to 40 nucleotides, 17 to 35 nucleotides, 18 to 30 nucleotides, 20 to 65 nucleotides, inclusive. In some embodiments, the primers include a tag that is not target specific, such as a tag that forms an internal loop structure. In some embodiments, the tag is between two DNA binding regions. In various embodiments, the primers include a 5' region that is specific for a target locus, an internal region that is not specific for the target locus and forms a loop structure, and a 3' region that is specific for the target locus. In various embodiments, the length of the 3' region is at least 7 nucleotides. In some embodiments, the length of the 3' region is between 7 and 20 nucleotides, such as between 7 to 15 nucleotides, or 7 to 10 nucleotides, inclusive. In various embodiments, the test primers include a 5' region that is not specific for a target locus (such as a tag or a universal primer binding site) followed by a region that is specific for a target locus, an internal region that is not specific for the target locus and forms a loop structure, and a 3' region that is specific for the target locus. In some embodiments, the range of the length of the primers is less than 50, 40, 30, 20, 10, or 5 nucleotides. In some embodiments, the length of the target amplicons is between 50 and 100 nucleotides, such as between 60 and 80 nucleotides, or 60 to 75 nucleotides, inclusive. In some embodiments, the range of the length of the target amplicons is less than 100, 75, 50, 25, 15, 10, or 5 nucleotides.

In various embodiments of any of the aspects of the invention, the primer extension reaction conditions are polymerase chain reaction conditions (PCR). In various embodiments, the length of the annealing step is greater than 3, 5, 8, 10, or 15 minutes but less than 240, 120, 60, or 30 minutes. In various embodiments, the length of the extension step is greater than 3, 5, 8, 10, or 15 minutes but less than 240, 120, 60 or 30 minutes.

All patents, patent applications, and published references cited herein are hereby incorporated by reference in their entirety. While the methods of the present disclosure have been described in connection with the specific embodiments thereof, it will be understood that it is capable of further modification. Furthermore, this application is intended to cover any variations, uses, or adaptations of the methods of the present disclosure, including such departures from the present disclosure as come within known or customary practice in the art to which the methods of the present disclosure pertain, and as fall within the scope of the appended claims. For example, any of the methods disclosed herein for DNA can be readily adapted for RNA by including a reverse transcription step to convert the RNA into DNA. Examples that use polymorphic loci for illustration can be readily adapted for the amplification of nonpolymorphic loci if desired. Any of the methods disclosed herein can be used with a low level of multiplexing if desired (such as with less than 1,000, 750, 500, 250, 100, 75, 50, 25, or 10 different primers or different primer pairs to different target loci).

SEQUENCE LISTING (44624 sequences)

SEQ ID NO: 1 - DNA, 22 bp, Artificial Sequence
  Synthetic Construct
ggcacaacatttgggagacaaa

SEQ ID NO: 2 - DNA, 26 bp, Artificial Sequence
  Synthetic Construct
cctggaacctgaaagcttgcaaaaag

SEQ ID NO: 3 - DNA, 20 bp, Artificial Sequence
  Synthetic Construct
acagggtgctctcctcttga

SEQ ID NO: 4 - DNA, 25 bp, Artificial Sequence
  Synthetic Construct
ggaagcaaacaggtagagcctggta

SEQ ID NO: 5 - DNA, 23 bp, Artificial Sequence
  Synthetic Construct
ctacaacaacagagctccaggat

SEQ ID NO: 6 - DNA, 23 bp, Artificial Sequence
  Synthetic Construct
tgtccttggtcgtatgtgagaga

SEQ ID NO: 7 - DNA, 20 bp, Artificial Sequence
  Synthetic Construct
gcaggaactggcttgccttt

SEQ ID NO: 8 - DNA, 23 bp, Artificial Sequence
  Synthetic Construct
aggtttcggctttagttgtgtga

SEQ ID NO: 9 - DNA, 21 bp, Artificial Sequence
  Synthetic Construct
tgtctgcttctgccggcattc

SEQ ID NO: 10 - DNA, 25 bp, Artificial Sequence
  Synthetic Construct
gtccctcacacctttctaccagaag

SEQ ID NO: 11 - DNA, 25 bp, Artificial Sequence
  Synthetic Construct
ggctgcaggagtagaggtctaaatg

SEQ ID NO: 12 - DNA, 25 bp, Artificial Sequence
  Synthetic Construct
ggcaagaagaaaactggagccaaga

SEQ ID NO: 13 - DNA, 24 bp, Artificial Sequence
  Synthetic Construct
gagcctgagttcttgatcactaca

SEQ ID NO: 14 - DNA, 21 bp, Artificial Sequence
  Synthetic Construct
cctggaaaaagccccggtaga

SEQ ID NO: 15 - DNA, 21 bp, Artificial Sequence
  Synthetic Construct
gcaatggtcccagtgagagtt

SEQ ID NO: 16 - DNA, 20 bp, Artificial Sequence
  Synthetic Construct
gccctttggaacctgaccaa

SEQ ID NO: 17 - DNA, 24 bp, Artificial Sequence
  Synthetic Construct
ggccttgatttgacccttcttttc

SEQ ID NO: 18 - DNA, 22 bp, Artificial Sequence
  Synthetic Construct
ccacccgcttctgaaacacatc

SEQ ID NO: 19 - DNA, 18 bp, Artificial Sequence
  Synthetic Construct
tggcgctaaagcccaaca

SEQ ID NO: 20 - DNA, 24 bp, Artificial Sequence
  Synthetic Construct
ccttccccgcttctggatatgaaa

SEQ ID NO: 21 - DNA, 23 bp, Artificial Sequence
  Synthetic Construct
gtcagcgtttacggctattgagt

SEQ ID NO: 22 - DNA, 20 bp, Artificial Sequence
  Synthetic Construct
gcatctccagtgccctctgt

SEQ ID NO: 23 - DNA, 24 bp, Artificial Sequence
  Synthetic Construct
catcttcctagacatgcacacaac

SEQ ID NO: 24 - DNA, 21 bp, Artificial Sequence
  Synthetic Construct
gtcccaagtcaactgccatct

SEQ ID NO: 25 - DNA, 20 bp, Artificial Sequence
  Synthetic Construct
gcgtcagcacagctaacaca

SEQ ID NO: 26 - DNA, 23 bp, Artificial Sequence
  Synthetic Construct
tcacaatgggagggaacattcaa

SEQ ID NO: 27 - DNA, 27 bp, Artificial Sequence
  Synthetic Construct
ggtaaaggctggttgtaaagtccacat

SEQ ID NO: 28 - DNA, 24 bp, Artificial Sequence
  Synthetic Construct
ccgactcaatggggaactcctact

SEQ ID NO: 29 - DNA, 22 bp, Artificial Sequence
  Synthetic Construct
tccttacaccttggggcgtcta

SEQ ID NO: 30 - DNA, 26 bp, Artificial Sequence
  Synthetic Construct
gggcatttctaagacacttggacagt

SEQ ID NO: 31 - DNA, 25 bp, Artificial Sequence
  Synthetic Construct
cactgtatctcaaagggcaaaacaa

SEQ ID NO: 32 - DNA, 23 bp, Artificial Sequence
  Synthetic Construct
acttgtctctgcagacagtttca

SEQ ID NO: 33 - DNA, 20 bp, Artificial Sequence
  Synthetic Construct
ggcctcttggtgcctctgtt

SEQ ID NO: 34 - DNA, 29 bp, Artificial Sequence
  Synthetic Construct
gctagagaaacaagacaacatccaagttc

SEQ ID NO: 35 - DNA, 22 bp, Artificial Sequence
  Synthetic Construct
gcgggcatagagagaaggaaat

SEQ ID NO: 36 - DNA, 23 bp, Artificial Sequence
  Synthetic Construct
ggcttcagtccttcacctctttc

SEQ ID NO: 37 - DNA, 20 bp, Artificial Sequence
  Synthetic Construct
tcagagtcctaggccagcat

SEQ ID NO: 38 - DNA, 24 bp, Artificial Sequence
  Synthetic Construct
ggttcctcatggaagactggtttg

SEQ ID NO: 39 - DNA, 26 bp, Artificial Sequence
  Synthetic Construct
gttgagaagggagtaagatcagacaa

SEQ ID NO: 40 - DNA, 23 bp, Artificial Sequence
  Synthetic Construct
ctcccgcctctaaatgaatggat

SEQ ID NO: 41 - DNA, 23 bp, Artificial Sequence
  Synthetic Construct
cattccctcccctaccctggaaa

SEQ ID NO: 42 - DNA, 22 bp, Artificial Sequence
  Synthetic Construct
gagactcaatcctggcacttgt

SEQ ID NO: 43 - DNA, 22 bp, Artificial Sequence
  Synthetic Construct
cccggctgccatttaagaccat

SEQ ID NO: 44 - DNA, 23 bp, Artificial Sequence
  Synthetic Construct
gatgagggctgagtatggtcaag

SEQ ID NO: 45 - DNA, 22 bp, Artificial Sequence
  Synthetic Construct
ccctttcctgaaccccttcatt

SEQ ID NO: 46 - DNA, 22 bp, Artificial Sequence
  Synthetic Construct
ggggcaccaaagaaaagacaag

SEQ ID NO: 47 - DNA, 26 bp, Artificial Sequence
  Synthetic Construct
catcagtaccccacataggtttaact

SEQ ID NO: 48 - DNA, 26 bp, Artificial Sequence
  Synthetic Construct
ggagctcagtatgagtagaggggaaa

SEQ ID NO: 49 - DNA, 20 bp, Artificial Sequence
  Synthetic Construct
ttgtgcacgacgctggaatg

SEQ ID NO: 50 - DNA, 22 bp, Artificial Sequence
  Synthetic Construct
tcgctaggccattcctcctgtt

SEQ ID NO: 51 - DNA, 26 bp, Artificial Sequence
  Synthetic Construct
cacgacacccttagataatgttggat

SEQ ID NO: 52 - DNA, 19 bp, Artificial Sequence
  Synthetic Construct
tggcacaagcccaggtcat

SEQ ID NO: 53 - DNA, 24 bp, Artificial Sequence
  Synthetic Construct
gcctcctctgcatctctgaaccaa

SEQ ID NO: 54 - DNA, 20 bp, Artificial Sequence
  Synthetic Construct
tgcagcgatcccttcacctt

SEQ ID NO: 55 - DNA, 22 bp, Artificial Sequence
  Synthetic Construct
tggtagtcaggcctagtgactt

SEQ ID NO: 56 - DNA, 24 bp, Artificial Sequence
  Synthetic Construct
gaggtcttccaaaggctattcaga

SEQ ID NO: 57 - DNA, 23 bp, Artificial Sequence
  Synthetic Construct
cctgagcctgtcacactatttct

SEQ ID NO: 58 - DNA, 20 bp, Artificial Sequence
  Synthetic Construct
gagagcaacaggcgttgaga

SEQ ID NO: 59 - DNA, 23 bp, Artificial Sequence
  Synthetic Construct
agccctacaaggtcaagttttca

SEQ ID NO: 60 - DNA, 21 bp, Artificial Sequence
  Synthetic Construct
ggaggcacttcactcctccta

SEQ ID NO: 61 - DNA, 23 bp, Artificial Sequence
  Synthetic Construct
gttggggtcaactttccctgaag

SEQ ID NO: 62 - DNA, 22 bp, Artificial Sequence
  Synthetic Construct
gaggtttggctccatcatcaga

SEQ ID NO: 63 - DNA, 25 bp, Artificial Sequence
  Synthetic Construct
gaggctcatgtctcttcagccttag

SEQ ID NO: 64 - DNA, 22 bp, Artificial Sequence
  Synthetic Construct
gttgcttcccgttatcctcact

SEQ ID NO: 65 - DNA, 24 bp, Artificial Sequence
  Synthetic Construct
gggcctgttcttgttgatagtgtt

SEQ ID NO: 66 - DNA, 26 bp, Artificial Sequence
  Synthetic Construct
gtttgctgttactgaatcccgaatct

SEQ ID NO: 67 - DNA, 26 bp, Artificial Sequence
  Synthetic Construct
gcacatgtaaaaatcctccctactgt

SEQ ID NO: 68 - DNA, 25 bp, Artificial Sequence
  Synthetic Construct
cctctggtaatagcacccaggatac

SEQ ID NO: 69 - DNA, 25 bp, Artificial Sequence
  Synthetic Construct
ctgaggtccagaatccagatgttct

SEQ ID NO: 70 - DNA, 21 bp, Artificial Sequence
  Synthetic Construct
ggacaacaggatcggggatga

SEQ ID NO: 71 - DNA, 22 bp, Artificial Sequence
  Synthetic Construct
ccatgtgtaggaagccctgtga

SEQ ID NO: 72 - DNA, 22 bp, Artificial Sequence
  Synthetic Construct
gcgacctcacttttccagtcat

SEQ ID NO: 73 - DNA, 25 bp, Artificial Sequence
  Synthetic Construct
gtgctattgtggctctgtaggttga

SEQ ID NO: 74 - DNA, 21 bp, Artificial Sequence
  Synthetic Construct
gtttcagcctgagaggcaaga

SEQ ID NO: 75 - DNA, 23 bp, Artificial Sequence
  Synthetic Construct
gagatgaagcgtgtgacccaagt

SEQ ID NO: 76 - DNA, 22 bp, Artificial Sequence
  Synthetic Construct
tgcctcatctctgcccctcttt

SEQ ID NO: 77 - DNA, 22 bp, Artificial Sequence
  Synthetic Construct
tctcagtgcgtttggaaggaaa

SEQ ID NO: 78 - DNA, 22 bp, Artificial Sequence
  Synthetic Construct
aggtttccctggacacacattc

SEQ ID NO: 79 - DNA, 23 bp, Artificial Sequence
  Synthetic Construct
aggagacagggacagtttcaatg

SEQ ID NO: 80 - DNA, 22 bp, Artificial Sequence
  Synthetic Construct
tgggttggaaacacgtccttta

SEQ ID NO: 81 - DNA, 20 bp, Artificial Sequence
  Synthetic Construct
gcccttagcaacagctgcat

SEQ ID NO: 82 - DNA, 21 bp, Artificial Sequence
  Synthetic Construct
gcagacacgcctctggcaaat

SEQ ID NO: 83 - DNA, 21 bp, Artificial Sequence
  Synthetic Construct
gccaaaagtgacagcaacaca

SEQ ID NO: 84 - DNA, 26 bp, Artificial Sequence
  Synthetic Construct
gcacacatccaatccttcagtaaatc

SEQ ID NO: 85 - DNA, 22 bp, Artificial Sequence
  Synthetic Construct
tcctcatccaagctccttctct

SEQ ID NO: 86 - DNA, 24 bp, Artificial Sequence
  Synthetic Construct
ggcactttccacccagaacttaac

SEQ ID NO: 87 - DNA, 20 bp, Artificial Sequence
  Synthetic Construct
aagcccacgttgtgctcttg

SEQ ID NO: 88 - DNA, 26 bp, Artificial Sequence
  Synthetic Construct
ctcagtagggtgaaaaggatggaagt

SEQ ID NO: 89 - DNA, 24 bp, Artificial Sequence
  Synthetic Construct
gctggatctacagaaaccagcaaa

SEQ ID NO: 90 - DNA, 19 bp, Artificial Sequence
  Synthetic Construct
tggctgcagatgcttgtca

SEQ ID NO: 91 - DNA, 22 bp, Artificial Sequence
  Synthetic Construct
gcctctcagcctcacgttctta

SEQ ID NO: 92 - DNA, 20 bp, Artificial Sequence
  Synthetic Construct
tccttgactcacgcctctga

SEQ ID NO: 93 - DNA, 22 bp, Artificial Sequence
  Synthetic Construct
ggaggacatggtgtttgaggat

SEQ ID NO: 94 - DNA, 24 bp, Artificial Sequence
  Synthetic Construct
ctacagttagagtcacacgtcaca

SEQ ID NO: 95 - DNA, 20 bp, Artificial Sequence
  Synthetic Construct
catgcggagggacttagcaa

SEQ ID NO: 96 - DNA, 23 bp, Artificial Sequence
  Synthetic Construct
gctttccagagtagaggcgtttc

SEQ ID NO: 97 - DNA, 24 bp, Artificial Sequence
  Synthetic Construct
tgatggtgcagaattgctacgata

SEQ ID NO: 98 - DNA, 21 bp, Artificial Sequence
  Synthetic Construct
gctgaaatggacccacagaga

SEQ ID NO: 99 - DNA, 20 bp, Artificial Sequence
  Synthetic Construct
tgctccaacgatggctcttc

SEQ ID NO: 100 - DNA, 23 bp, Artificial Sequence
  Synthetic Construct
aggtgaaagcgatgtctgcttag

SEQ ID NO: 101 - DNA, 21 bp, Artificial Sequence
  Synthetic Construct
gccctgacctcaccattggaa

SEQ ID NO: 102 - DNA, 19 bp, Artificial Sequence
  Synthetic Construct
tggggcaattgcgggtatt

SEQ ID NO: 103 - DNA, 25 bp, Artificial Sequence
  Synthetic Construct
gcattacaggagagtgaagatggat

SEQ ID NO: 104 - DNA, 23 bp, Artificial Sequence
  Synthetic Construct
ggaggagaaaggtggtacacttg

SEQ ID NO: 105 - DNA, 24 bp, Artificial Sequence
  Synthetic Construct
ggagacaatacaggttgggtggtt

SEQ ID NO: 106 - DNA, 24 bp, Artificial Sequence
  Synthetic Construct
gcggatcttccttacctagtctga

SEQ ID NO: 107 - DNA, 25 bp, Artificial Sequence
  Synthetic Construct
ggatactgtgtaggaaggcaataca

SEQ ID NO: 108 - DNA, 22 bp, Artificial Sequence
  Synthetic Construct
caactccaaccccagccttttg

SEQ ID NO: 109 - DNA, 24 bp, Artificial Sequence
  Synthetic Construct
caggccaagaatgacatacgactt

SEQ ID NO: 110 - DNA, 22 bp, Artificial Sequence
  Synthetic Construct
ggcgaaaatgagcactgtggaa

SEQ ID NO: 111 - DNA, 23 bp, Artificial Sequence
  Synthetic Construct
ggaaggcagtacaagagcttact

SEQ ID NO: 112 - DNA, 25 bp, Artificial Sequence
  Synthetic Construct
ggcgattcctgacatttgattgcat

SEQ ID NO: 113 - DNA, 21 bp, Artificial Sequence
  Synthetic Construct
ggggtttgtttgggtcagaga

SEQ ID NO: 114 - DNA, 25 bp, Artificial Sequence
  Synthetic Construct
ctgcaatattggccatttctcttca

SEQ ID NO: 115 - DNA, 20 bp, Artificial Sequence
  Synthetic Construct
agtgtgcacgcctggttgaa

SEQ ID NO: 116 - DNA, 22 bp, Artificial Sequence
  Synthetic Construct
ccccagctccttcacaaagact

SEQ ID NO: 117 - DNA, 22 bp, Artificial Sequence
  Synthetic Construct
tggagctgaggaggaaagaaca

SEQ ID NO: 118 - DNA, 27 bp, Artificial Sequence
  Synthetic Construct
tgggtcataaagtgactctgtaacatc

SEQ ID NO: 119 - DNA, 24 bp, Artificial Sequence
  Synthetic Construct
gctgtgaatgttacatggcaggat

SEQ ID NO: 120 - DNA, 22 bp, Artificial Sequence
  Synthetic Construct
cgtcccttaccggagcaacttt

SEQ ID NO: 121 - DNA, 24 bp, Artificial Sequence
  Synthetic Construct
agtgagctagaggctaggacttac

SEQ ID NO: 122 - DNA, 22 bp, Artificial Sequence
  Synthetic Construct
tcctttcctctcatcgcctttg

SEQ ID NO: 123 - DNA, 22 bp, Artificial Sequence
  Synthetic Construct
gggcacagaagggtgttccaaa

SEQ ID NO: 124 - DNA, 21 bp, Artificial Sequence
  Synthetic Construct
ggccctcattgcagtcagcat

SEQ ID NO: 125 - DNA, 24 bp, Artificial Sequence
  Synthetic Construct
tcctgagatgggaaagagtgaaga

SEQ ID NO: 126 - DNA, 25 bp, Artificial Sequence
  Synthetic Construct
gaaactgcacaaacttcctctccta

SEQ ID NO: 127 - DNA, 22 bp, Artificial Sequence
  Synthetic Construct
cgcctgtggttgttgatgaaag

SEQ ID NO: 128 - DNA, 22 bp, Artificial Sequence
  Synthetic Construct
tccccaagagcacagactcaac

SEQ ID NO: 129 - DNA, 22 bp, Artificial Sequence
  Synthetic Construct
cctcttcgcagaccttgaggat

SEQ ID NO: 130 - DNA, 24 bp, Artificial Sequence
  Synthetic Construct
tccacactctaccatttgctgaat

SEQ ID NO: 131 - DNA, 25 bp, Artificial Sequence
  Synthetic Construct
tgaattgtgcagtgaggctatatct

SEQ ID NO: 132 - DNA, 26 bp, Artificial Sequence
  Synthetic Construct
tgtgagtaggatctaggcatgttagt

SEQ ID NO: 133 - DNA, 24 bp, Artificial Sequence
  Synthetic Construct
ggtcacacagagttaatggagaca

SEQ ID NO: 134 - DNA, 21 bp, Artificial Sequence
  Synthetic Construct
ggacccaagaggctgagaaag

SEQ ID NO: 135 - DNA, 22 bp, Artificial Sequence
  Synthetic Construct
ctcgtgggtgtgatggaacaga

SEQ ID NO: 136 - DNA, 20 bp, Artificial Sequence
  Synthetic Construct
tgttgagcgtggaccagtga

SEQ ID NO: 137 - DNA, 21 bp, Artificial Sequence
  Synthetic Construct
ggctgaggctgtagccttgat

SEQ ID NO: 138 - DNA, 24 bp, Artificial Sequence
  Synthetic Construct
gatgggctcaagtcagaggttaag

SEQ ID NO: 139 - DNA, 22 bp, Artificial Sequence
  Synthetic Construct
gacagctgcttctcggctacaa

SEQ ID NO: 140 - DNA, 19 bp, Artificial Sequence
  Synthetic Construct
atcgcacgtactgccatgt

SEQ ID NO: 141 - DNA, 23 bp, Artificial Sequence
  Synthetic Construct
ccagaccatgcatccatccacat

SEQ ID NO: 142 - DNA, 25 bp, Artificial Sequence
  Synthetic Construct
gcaaagaaccatcagggtagacatc

SEQ ID NO: 143 - DNA, 22 bp, Artificial Sequence
  Synthetic Construct
aagggaggccttccactgtcat

SEQ ID NO: 144 - DNA, 22 bp, Artificial Sequence
  Synthetic Construct
aagaggccattgccatagttca

SEQ ID NO: 145 - DNA, 19 bp, Artificial Sequence
  Synthetic Construct
tggggttcaaccggacagt

SEQ ID NO: 146 - DNA, 21 bp, Artificial Sequence
  Synthetic Construct
cgtgccttaagcccaggtatt

SEQ ID NO: 147 - DNA, 22 bp, Artificial Sequence
  Synthetic Construct
ggtctcaggaatccacctccaa

SEQ ID NO: 148 - DNA, 23 bp, Artificial Sequence
  Synthetic Construct
acacagggaacgctctgtaaatg

SEQ ID NO: 149 - DNA, 24 bp, Artificial Sequence
  Synthetic Construct
cctgtccctctttggttgaaggtt

SEQ ID NO: 150 - DNA, 28 bp, Artificial Sequence
  Synthetic Construct
caggcattatctacatgtctgcttgtct

SEQ ID NO: 151 - DNA, 22 bp, Artificial Sequence
  Synthetic Construct
cgtccaagcctcagctgtgtaa

SEQ ID NO: 152 - DNA, 24 bp, Artificial Sequence
  Synthetic Construct
ctagccaaaagccattctggtagt

SEQ ID NO: 153 - DNA, 24 bp, Artificial Sequence
  Synthetic Construct
tgttatctgccttctcccaacaaa

SEQ ID NO: 154 - DNA, 26 bp, Artificial Sequence
  Synthetic Construct
cctcactgccaaatctgatacagaca

SEQ ID NO: 155 - DNA, 29 bp, Artificial Sequence
  Synthetic Construct
cgagaattacacccatctgatcctctttc

SEQ ID NO: 156 - DNA, 22 bp, Artificial Sequence
  Synthetic Construct
ggcaagggctaagacgtttgaa

SEQ ID NO: 157 - DNA, 26 bp, Artificial Sequence
  Synthetic Construct
tcctaactcctacctcatacctcaac

SEQ ID NO: 158 - DNA, 21 bp, Artificial Sequence
  Synthetic Construct
ccgggactagggtggaagtca

SEQ ID NO: 159 - DNA, 22 bp, Artificial Sequence
  Synthetic Construct
tgctacacactagctcctcaca

SEQ ID NO: 160 - DNA, 22 bp, Artificial Sequence
  Synthetic Construct
gcacagacatccagaactgctt

SEQ ID NO: 161 - DNA, 22 bp, Artificial Sequence
  Synthetic Construct
gtgtgcccacagagacttggaa

SEQ ID NO: 162 - DNA, 24 bp, Artificial Sequence
  Synthetic Construct
aagccgcctaataatggaaaccta

SEQ ID NO: 163 - DNA, 24 bp, Artificial Sequence
  Synthetic Construct
atgttctgtagtcgttaggcttgt

SEQ ID NO: 164 - DNA, 23 bp, Artificial Sequence
  Synthetic Construct
tgaaagaggcaggaaaaggttgt

SEQ ID NO: 165 - DNA, 22 bp, Artificial Sequence
  Synthetic Construct
agccagataccgtgagccaaga

SEQ ID NO: 166 - DNA, 27 bp, Artificial Sequence
  Synthetic Construct
cagaagtgggattcaaatccacagaga

SEQ ID NO: 167 - DNA, 22 bp, Artificial Sequence
  Synthetic Construct
ggcccaaagtgctttgagaaca

SEQ ID NO: 168 - DNA, 23 bp, Artificial Sequence
  Synthetic Construct
gtcacggaagaactggtggatca

SEQ ID NO: 169 - DNA, 22 bp, Artificial Sequence
  Synthetic Construct
gcttaataggcgccaaccattt

SEQ ID NO: 170 - DNA, 24 bp, Artificial Sequence
  Synthetic Construct
cagcttccctgtggaattgtcttc

SEQ ID NO: 171 - DNA, 21 bp, Artificial Sequence
  Synthetic Construct
tgaaggctcaccagccagaga

SEQ ID NO: 172 - DNA, 22 bp, Artificial Sequence
  Synthetic Construct
gctgcctcctagagccactaca

SEQ ID NO: 173 - DNA, 20 bp, Artificial Sequence
  Synthetic Construct
tttacgggcctcccaagtca

SEQ ID NO: 174 - DNA, 25 bp, Artificial Sequence
  Synthetic Construct
cgtcagccgataatagctgttgctt

SEQ ID NO: 175 - DNA, 23 bp, Artificial Sequence
  Synthetic Construct
tcttccctaccctgagcctgatg

SEQ ID NO: 176 - DNA, 23 bp, Artificial Sequence
  Synthetic Construct
gccatgtttcacctgctgcttac

SEQ ID NO: 177 - DNA, 23 bp, Artificial Sequence
  Synthetic Construct
cagggctttgtgacctagacaga

SEQ ID NO: 178 - DNA, 19 bp, Artificial Sequence
  Synthetic Construct
tcttgcgcgacaggagaga

SEQ ID NO: 179 - DNA, 22 bp, Artificial Sequence
  Synthetic Construct
ccttccctccttcgtgtcttct

SEQ ID NO: 180 - DNA, 24 bp, Artificial Sequence
  Synthetic Construct
gcacttgaggtaggattggaggaa

SEQ ID NO: 181 - DNA, 21 bp, Artificial Sequence
  Synthetic Construct
gttgtcttggttgccgtgttc

SEQ ID NO: 182 - DNA, 21 bp, Artificial Sequence
  Synthetic Construct
tgcttctgtctggctgagaag

SEQ ID NO: 183 - DNA, 24 bp, Artificial Sequence
  Synthetic Construct
ctccttcgtgtatatgagcagctt

SEQ ID NO: 184 - DNA, 25 bp, Artificial Sequence
  Synthetic Construct
gcccttttccttaaaagcaggaaga

SEQ ID NO: 185 - DNA, 22 bp, Artificial Sequence
  Synthetic Construct
gcgcaggaagagcagtttgatg

SEQ ID NO: 186 - DNA, 23 bp, Artificial Sequence
  Synthetic Construct
ggttccccagattggctcaaaag

SEQ ID NO: 187 - DNA, 19 bp, Artificial Sequence
  Synthetic Construct
atccgccagccgcccaata

SEQ ID NO: 188 - DNA, 25 bp, Artificial Sequence
  Synthetic Construct
ccaagtctcaggtgtgaggagttac

SEQ ID NO: 189 - DNA, 24 bp, Artificial Sequence
  Synthetic Construct
cacactgggttttctggtttcagt

SEQ ID NO: 190 - DNA, 22 bp, Artificial Sequence
  Synthetic Construct
cagggcaactcaacggcaaaag

SEQ ID NO: 191 - DNA, 22 bp, Artificial Sequence
  Synthetic Construct
agctggtcactgtgggagaaga

SEQ ID NO: 192 - DNA, 20 bp, Artificial Sequence
  Synthetic Construct
aggctcagctctggggattg

SEQ ID NO: 193 - DNA, 22 bp, Artificial Sequence
  Synthetic Construct
ggctggctccatcgtttgagat

SEQ ID NO: 194 - DNA, 25 bp, Artificial Sequence
  Synthetic Construct
cagggaagctttgacagaagagata

SEQ ID NO: 195 - DNA, 25 bp, Artificial Sequence
  Synthetic Construct
aggatacaggttggaaagcaagatt

SEQ ID NO: 196 - DNA, 24 bp, Artificial Sequence
  Synthetic Construct
gtgcggctgtcatcaacattcaac

SEQ ID NO: 197 - DNA, 22 bp, Artificial Sequence
  Synthetic Construct
ggaacgggagtcaggtcaaaca

SEQ ID NO: 198 - DNA, 22 bp, Artificial Sequence
  Synthetic Construct
tccctctgtcagtctgggtcta

SEQ ID NO: 199 - DNA, 18 bp, Artificial Sequence
  Synthetic Construct
acgcgcagtccacaaaca

SEQ ID NO: 200 - DNA, 22 bp, Artificial Sequence
  Synthetic Construct
tgcatattgtccaaggctgctt

SEQ ID NO: 201 - DNA, 20 bp, Artificial Sequence
  Synthetic Construct
gccctctgcatctagccaat

SEQ ID NO: 202 - DNA, 22 bp, Artificial Sequence
  Synthetic Construct
tggtccatccaaatcaggcaat

SEQ ID NO: 203 - DNA, 27 bp, Artificial Sequence
  Synthetic Construct
gccgctcctctttctgttccttaaaaa

SEQ ID NO: 204 - DNA, 23 bp, Artificial Sequence
  Synthetic Construct
gcaaaccaggcttttcttgcata

SEQ ID NO: 205 - DNA, 23 bp, Artificial Sequence
  Synthetic Construct
ccatctggctatgtgacggatgt

SEQ ID NO: 206 - DNA, 26 bp, Artificial Sequence
  Synthetic Construct
cagtaaaggaagctttgcaggtttgt

SEQ ID NO: 207 - DNA, 23 bp, Artificial Sequence
  Synthetic Construct
ttaaatactcccatgcccggaaa

SEQ ID NO: 208 - DNA, 23 bp, Artificial Sequence
  Synthetic Construct
ggttgtggagacaaggcttccta

SEQ ID NO: 209 - DNA, 23 bp, Artificial Sequence
  Synthetic Construct
gctgtctctccctaggtcaggtt

SEQ ID NO: 210 - DNA, 24 bp, Artificial Sequence
  Synthetic Construct
atgtgttcctgagagtccctttac

SEQ ID NO: 211 - DNA, 22 bp, Artificial Sequence
  Synthetic Construct
gggacatagcacaggactggat

SEQ ID NO: 212 - DNA, 26 bp, Artificial Sequence
  Synthetic Construct
cagctctacaaattgttgccatcttc

SEQ ID NO: 213 - DNA, 21 bp, Artificial Sequence
  Synthetic Construct
ggctctggaagttgccagtca

SEQ ID NO: 214 - DNA, 24 bp, Artificial Sequence
  Synthetic Construct
ccaagatttggaagagctgaggat

SEQ ID NO: 215 - DNA, 22 bp, Artificial Sequence
  Synthetic Construct
ggctgaagctgtaatccacaca

SEQ ID NO: 216 - DNA, 22 bp, Artificial Sequence
  Synthetic Construct
caaccaggatcgccctagaaaa

SEQ ID NO: 217 - DNA, 22 bp, Artificial Sequence
  Synthetic Construct
aacccagctacggagaggatga

SEQ ID NO: 218 - DNA, 25 bp, Artificial Sequence
  Synthetic Construct
acccagcttaatggttccaaatagt

SEQ ID NO: 219 - DNA, 23 bp, Artificial Sequence
  Synthetic Construct
tgctctgctttcttccagtttca

SEQ ID NO: 220 - DNA, 25 bp, Artificial Sequence
  Synthetic Construct
ccttccaaaagggagggatgttttc

SEQ ID NO: 221 - DNA, 25 bp, Artificial Sequence
  Synthetic Construct
gcattgaaacacctggtttacttca

SEQ ID NO: 222 - DNA, 23 bp, Artificial Sequence
  Synthetic Construct
tgcttgacagctctgttgattgt

SEQ ID NO: 223 - DNA, 25 bp, Artificial Sequence
  Synthetic Construct
gccagctagaaccctatacccagaa

SEQ ID NO: 224 - DNA, 24 bp, Artificial Sequence
  Synthetic Construct
gtgaaatgtcttgcccttgtcatc

SEQ ID NO: 225 - DNA, 20 bp, Artificial Sequence
  Synthetic Construct
caccagctacccaagctcaa

SEQ ID NO: 226 - DNA, 22 bp, Artificial Sequence
  Synthetic Construct
gatgactggaccgcatgtctct

SEQ ID NO: 227 - DNA, 22 bp, Artificial Sequence
  Synthetic Construct
ctcgttcctgctgtgcttgtag

SEQ ID NO: 228 - DNA, 22 bp, Artificial Sequence
  Synthetic Construct
tgcctttggtccctcacacaag

SEQ ID NO: 229 - DNA, 22 bp, Artificial Sequence
  Synthetic Construct
gagaaccacggagagaggaagt

SEQ ID NO: 230 - DNA, 26 bp, Artificial Sequence
  Synthetic Construct
cccacagttagtacatggcagagttt

SEQ ID NO: 231 - DNA, 22 bp, Artificial Sequence
  Synthetic Construct
cctgggagccatgtctgaaact

SEQ ID NO: 232 - DNA, 22 bp, Artificial Sequence
  Synthetic Construct
gggcaccttcacattgctgaga

SEQ ID NO: 233 - DNA, 24 bp, Artificial Sequence
  Synthetic Construct
ggaccctggtctttagttccgatt

SEQ ID NO: 234 - DNA, 22 bp, Artificial Sequence
  Synthetic Construct
agcaccaagggctgaaggaaag

SEQ ID NO: 235 - DNA, 23 bp, Artificial Sequence
  Synthetic Construct
gcaacacagatccactgaagaca

SEQ ID NO: 236 - DNA, 24 bp, Artificial Sequence
  Synthetic Construct
ggctctccataaccagatgctgta

SEQ ID NO: 237 - DNA, 20 bp, Artificial Sequence
  Synthetic Construct
ttccactggcccactgtact

SEQ ID NO: 238 - DNA, 21 bp, Artificial Sequence
  Synthetic Construct
gcccatcagtctcccctgcta

SEQ ID NO: 239 - DNA, 19 bp, Artificial Sequence
  Synthetic Construct
ccagtcatccggggcactt

SEQ ID NO: 240 - DNA, 25 bp, Artificial Sequence
  Synthetic Construct
gtggaatccaatcactcagccttca

SEQ ID NO: 241 - DNA, 24 bp, Artificial Sequence
  Synthetic Construct
cgcccactgctatctctaccattc

SEQ ID NO: 242 - DNA, 21 bp, Artificial Sequence
  Synthetic Construct
agtgcctggccatctgctgta

SEQ ID NO: 243 - DNA, 23 bp, Artificial Sequence
  Synthetic Construct
gtgttcatccatcagggccaatg

SEQ ID NO: 244 - DNA, 21 bp, Artificial Sequence
  Synthetic Construct
gctaaccttggcactgtggat

SEQ ID NO: 245 - DNA, 22 bp, Artificial Sequence
  Synthetic Construct
gctgtcatccatggtccagaca

SEQ ID NO: 246 - DNA, 23 bp, Artificial Sequence
  Synthetic Construct
ccatggaagagggagatggaagt

SEQ ID NO: 247 - DNA, 19 bp, Artificial Sequence
  Synthetic Construct
ccacctcttgggccctttg

SEQ ID NO: 248 - DNA, 27 bp, Artificial Sequence
  Synthetic Construct
cacagaatatgggctgagaatccaaga

SEQ ID NO: 249 - DNA, 20 bp, Artificial Sequence
  Synthetic Construct
gagtccccaccagcaagaag

SEQ ID NO: 250 - DNA, 22 bp, Artificial Sequence
  Synthetic Construct
gtgatgtggctactgcttcact

SEQ ID NO: 251 - DNA, 20 bp, Artificial Sequence
  Synthetic Construct
gcttccctcttccagtgctt

SEQ ID NO: 252 - DNA, 23 bp, Artificial Sequence
  Synthetic Construct
ctgcactgtgattctggcatagt

SEQ ID NO: 253 - DNA, 22 bp, Artificial Sequence
  Synthetic Construct
cccctccactaacggtgcatta

SEQ ID NO: 254 - DNA, 26 bp, Artificial Sequence
  Synthetic Construct
cagggatgaaagacagagagcatttg

SEQ ID NO: 255 - DNA, 22 bp, Artificial Sequence
  Synthetic Construct
cccctcgaggctgttttagtga

SEQ ID NO: 256 - DNA, 20 bp, Artificial Sequence
  Synthetic Construct
ccagtgtcagggccgagtag

SEQ ID NO: 257 - DNA, 20 bp, Artificial Sequence
  Synthetic Construct
tgctgctttacgcccagtga

SEQ ID NO: 258 - DNA, 20 bp, Artificial Sequence
  Synthetic Construct
gaccaatggggtgtcagctt

SEQ ID NO: 259 - DNA, 21 bp, Artificial Sequence
  Synthetic Construct
aggctatgggaggtgggaaca

SEQ ID NO: 260 - DNA, 25 bp, Artificial Sequence
  Synthetic Construct
ctgtgtatgtgggtctgaagctcaa

SEQ ID NO: 261 - DNA, 20 bp, Artificial Sequence
  Synthetic Construct
ggggctcagatcccttggtt

SEQ ID NO: 262 - DNA, 22 bp, Artificial Sequence
  Synthetic Construct
agcatccgtggaggcttttaat

SEQ ID NO: 263 - DNA, 24 bp, Artificial Sequence
  Synthetic Construct
acgatttctgaagcagtcttggta

SEQ ID NO: 264 - DNA, 21 bp, Artificial Sequence
  Synthetic Construct
gggcattagctggccttcaca

SEQ ID NO: 265 - DNA, 21 bp, Artificial Sequence
  Synthetic Construct
tcccacttacaggcccgttct

SEQ ID NO: 266 - DNA, 23 bp, Artificial Sequence
  Synthetic Construct
tttcagaagtgctggaaccaaga

SEQ ID NO: 267 - DNA, 22 bp, Artificial Sequence
  Synthetic Construct
catgaaagcactggggttctct

SEQ ID NO: 268 - DNA, 25 bp, Artificial Sequence
  Synthetic Construct
cgagagaggaagacactggagtgaa

SEQ ID NO: 269 - DNA, 27 bp, Artificial Sequence
  Synthetic Construct
ccttcctccacactaagtgactggaaa

SEQ ID NO: 270 - DNA, 19 bp, Artificial Sequence
  Synthetic Construct
cagcccatcctgggcatct

SEQ ID NO: 271 - DNA, 20 bp, Artificial Sequence
  Synthetic Construct
aggctggcaaatgggctcaa

SEQ ID NO: 272 - DNA, 18 bp, Artificial Sequence
  Synthetic Construct
gctgagcccagcagtgtt

SEQ ID NO: 273 - DNA, 24 bp, Artificial Sequence
  Synthetic Construct
cctggctgggctacatcttacctt

SEQ ID NO: 274 - DNA, 22 bp, Artificial Sequence
  Synthetic Construct
gcatggggacctgagactttct

SEQ ID NO: 275 - DNA, 21 bp, Artificial Sequence
  Synthetic Construct
gggccgatgagcaagtcagtt

SEQ ID NO: 276 - DNA, 24 bp, Artificial Sequence
  Synthetic Construct
cctccccgaaaggaaacagagcat

SEQ ID NO: 277 - DNA, 22 bp, Artificial Sequence
  Synthetic Construct
tggatggtgagaagagccaatg

SEQ ID NO: 278 - DNA, 20 bp, Artificial Sequence
  Synthetic Construct
gcctggtcaccatccgcttt

SEQ ID NO: 279 - DNA, 22 bp, Artificial Sequence
  Synthetic Construct
gacactcacaggctcagagaac

SEQ ID NO: 280 - DNA, 20 bp, Artificial Sequence
  Synthetic Construct
tgagcactcctgggtcaaga

SEQ ID NO: 281 - DNA, 21 bp, Artificial Sequence
  Synthetic Construct
cttggctcgattggtccaaca

SEQ ID NO: 282 - DNA, 20 bp, Artificial Sequence
  Synthetic Construct
ccagagcagccaggtcttca

SEQ ID NO: 283 - DNA, 20 bp, Artificial Sequence
  Synthetic Construct
tctcctcgcccaagatcaga

SEQ ID NO: 284 - DNA, 24 bp, Artificial Sequence
  Synthetic Construct
cctcagcccaggactcacttttag

SEQ ID NO: 285 - DNA, 19 bp, Artificial Sequence
  Synthetic Construct
tccatgacgggcagctgta

SEQ ID NO: 286 - DNA, 22 bp, Artificial Sequence
  Synthetic Construct
caccctgggatcaagtccaagt

SEQ ID NO: 287 - DNA, 20 bp, Artificial Sequence
  Synthetic Construct
tgcatgctgggacacagaga

SEQ ID NO: 288 - DNA, 20 bp, Artificial Sequence
  Synthetic Construct
aggggctgctggggcttgta

SEQ ID NO: 289 - DNA, 22 bp, Artificial Sequence
  Synthetic Construct
gcgctgcctagtgacattggtt

SEQ ID NO: 290 - DNA, 22 bp, Artificial Sequence
  Synthetic Construct
tggtggtggtccccagtaatgt

SEQ ID NO: 291 - DNA, 21 bp, Artificial Sequence
  Synthetic Construct
ccctggtgggttttgagtgaa

SEQ ID NO: 292 - DNA, 21 bp, Artificial Sequence
  Synthetic Construct
cccacttagagccccaggaaa

SEQ ID NO: 293 - DNA, 20 bp, Artificial Sequence
  Synthetic Construct
cgatcggctttgcaggcttt

SEQ ID NO: 294 - DNA, 22 bp, Artificial Sequence
  Synthetic Construct
aaccagatcgtgtctccctagt

SEQ ID NO: 295 - DNA, 21 bp, Artificial Sequence
  Synthetic Construct
ccaacagcgtgaggcttctga

SEQ ID NO: 296 - DNA, 23 bp, Artificial Sequence
  Synthetic Construct
gcctggaacacactgtactctga

SEQ ID NO: 297 - DNA, 18 bp, Artificial Sequence
  Synthetic Construct
tcctgcccgtctgctcaa

SEQ ID NO: 298 - DNA, 24 bp, Artificial Sequence
  Synthetic Construct
tgaaaccagaagctttcacctcat

SEQ ID NO: 299 - DNA, 22 bp, Artificial Sequence
  Synthetic Construct
agtcagggtgtctcttccatga

SEQ ID NO: 300 - DNA, 24 bp, Artificial Sequence
  Synthetic Construct
gagcaaaagagctgttccagagaa

SEQ ID NO: 301 - DNA, 24 bp, Artificial Sequence
  Synthetic Construct
ccttctacacaggatgggatgagt

SEQ ID NO: 302 - DNA, 21 bp, Artificial Sequence
  Synthetic Construct
tgaagggttcccctccaaagt

SEQ ID NO: 303 - DNA, 23 bp, Artificial Sequence
  Synthetic Construct
gcctacatgtctatcccctgaag

SEQ ID NO: 304 - DNA, 21 bp, Artificial Sequence
  Synthetic Construct
gctggaaaccatggcggagtt

SEQ ID NO: 305 - DNA, 20 bp, Artificial Sequence
  Synthetic Construct
gggccagtacccaggaggaa

SEQ ID NO: 306 - DNA, 21 bp, Artificial Sequence
  Synthetic Construct
cacagggatgagcaccaccat

SEQ ID NO: 307 - DNA, 23 bp, Artificial Sequence
  Synthetic Construct
tggcagagttgtcaggatttcaa

SEQ ID NO: 308 - DNA, 20 bp, Artificial Sequence
  Synthetic Construct
aggcgagtgtcccaagacaa

SEQ ID NO: 309 - DNA, 24 bp, Artificial Sequence
  Synthetic Construct
gtgaaccagggacatctggacaag

SEQ ID NO: 310 - DNA, 21 bp, Artificial Sequence
  Synthetic Construct
tcaggcacaggccaggtatag

SEQ ID NO: 311 - DNA, 21 bp, Artificial Sequence
  Synthetic Construct
ccggacgcagacggaattact

SEQ ID NO: 312 - DNA, 20 bp, Artificial Sequence
  Synthetic Construct
ggcagtttggggagctgtgt

SEQ ID NO: 313 - DNA, 20 bp, Artificial Sequence
  Synthetic Construct
ctgacatttgcgggctgttg

SEQ ID NO: 314 - DNA, 22 bp, Artificial Sequence
  Synthetic Construct
cttcatgggacccaagcctatg

SEQ ID NO: 315 - DNA, 20 bp, Artificial Sequence
  Synthetic Construct
ctggctggacccttcctgat

SEQ ID NO: 316 - DNA, 18 bp, Artificial Sequence
  Synthetic Construct
ggcccttggctgtgtgaa

SEQ ID NO: 317 - DNA, 22 bp, Artificial Sequence
  Synthetic Construct
ttcctcgtggaccctactgtgt

SEQ ID NO: 318 - DNA, 22 bp, Artificial Sequence
  Synthetic Construct
cgttggctcctaaagtcagcta

SEQ ID NO: 319 - DNA, 22 bp, Artificial Sequence
  Synthetic Construct
gtgtaagggcggctctaactga

SEQ ID NO: 320 - DNA, 20 bp, Artificial Sequence
  Synthetic Construct
atcagaggagggcggaccaa

SEQ ID NO: 321 - DNA, 23 bp, Artificial Sequence
  Synthetic Construct
ggagaccatgggaacccttcaac

SEQ ID NO: 322 - DNA, 22 bp, Artificial Sequence
  Synthetic Construct
ggtcctgtcgttgaggtagtca

SEQ ID NO: 323 - DNA, 20 bp, Artificial Sequence
  Synthetic Construct
gggctagcaaacacccaagt

SEQ ID NO: 324 - DNA, 22 bp, Artificial Sequence
  Synthetic Construct
gccaaatgaacctggccctgta

SEQ ID NO: 325 - DNA, 21 bp, Artificial Sequence
  Synthetic Construct
gccacaaaggcccactacaga

SEQ ID NO: 326 - DNA, 22 bp, Artificial Sequence
  Synthetic Construct
gtcttccaggtcagcaatccaa

SEQ ID NO: 327 - DNA, 23 bp, Artificial Sequence
  Synthetic Construct
catgcccagcaattgtcccttag

SEQ ID NO: 328 - DNA, 22 bp, Artificial Sequence
  Synthetic Construct
gcagtcttggcagagctttact

SEQ ID NO: 329 - DNA, 22 bp, Artificial Sequence
  Synthetic Construct
gaagagtcagtggccttgaaga

SEQ ID NO: 330 - DNA, 25 bp, Artificial Sequence
  Synthetic Construct
gtggtgtatgttgtagtcccagcta

SEQ ID NO: 331 - DNA, 24 bp, Artificial Sequence
  Synthetic Construct
gtggggtagtggtaaagtaagcat

SEQ ID NO: 332 - DNA, 22 bp, Artificial Sequence
  Synthetic Construct
gggtccctgctccatctcattt

SEQ ID NO: 333 - DNA, 20 bp, Artificial Sequence
  Synthetic Construct
agggccctcccgcaattaga

SEQ ID NO: 334 - DNA, 22 bp, Artificial Sequence
  Synthetic Construct
cctgaggtcttggcccacaata

SEQ ID NO: 335 - DNA, 20 bp, Artificial Sequence
  Synthetic Construct
ttcagcgggaaccaccatgt

SEQ ID NO: 336 - DNA, 29 bp, Artificial Sequence
  Synthetic Construct
ctgacttcctagtcttcccttctatgaaa

SEQ ID NO: 337 - DNA, 23 bp, Artificial Sequence
  Synthetic Construct
ggtttacaggttagggcatggat

SEQ ID NO: 338 - DNA, 22 bp, Artificial Sequence
  Synthetic Construct
aggaccggaggactgctctatt

SEQ ID NO: 339 - DNA, 22 bp, Artificial Sequence
  Synthetic Construct
aagggcagcgtatccctctaca

SEQ ID NO: 340 - DNA, 23 bp, Artificial Sequence
  Synthetic Construct
gtggcccagtttttgctcagaga

SEQ ID NO: 341 - DNA, 26 bp, Artificial Sequence
  Synthetic Construct
ggtgcaggatttttctcgacctcttt

SEQ ID NO: 342 - DNA, 22 bp, Artificial Sequence
  Synthetic Construct
tctctgtgtctcctcaccagtt

SEQ ID NO: 343 - DNA, 22 bp, Artificial Sequence
  Synthetic Construct
ccaactggtccctgcattcttg

SEQ ID NO: 344 - DNA, 23 bp, Artificial Sequence
  Synthetic Construct
gtgtgaggatcctgcagcattta

SEQ ID NO: 345 - DNA, 21 bp, Artificial Sequence
  Synthetic Construct
agtccctcagctcagcccata

SEQ ID NO: 346 - DNA, 23 bp, Artificial Sequence
  Synthetic Construct
gccaaggggtaaccctaaaggta

SEQ ID NO: 347 - DNA, 20 bp, Artificial Sequence
  Synthetic Construct
ggttggaaggtgacgctaca

SEQ ID NO: 348 - DNA, 19 bp, Artificial Sequence
  Synthetic Construct
cctgcacttgcccggttct

SEQ ID NO: 349 - DNA, 23 bp, Artificial Sequence
  Synthetic Construct
gctccaagaagtgcatccaggtt

SEQ ID NO: 350 - DNA, 21 bp, Artificial Sequence
  Synthetic Construct
gtgctgggtcacactcaaact

SEQ ID NO: 351 - DNA, 21 bp, Artificial Sequence
  Synthetic Construct
tgtcgtccccactgtggaact

SEQ ID NO: 352 - DNA, 21 bp, Artificial Sequence
  Synthetic Construct
ccccaggcaactcacttcaca

SEQ ID NO: 353 - DNA, 20 bp, Artificial Sequence
  Synthetic Construct
agagtagacgcgccctggaa

SEQ ID NO: 354 - DNA, 21 bp, Artificial Sequence
  Synthetic Construct
gctagcaggacttgggcaaca

SEQ ID NO: 355 - DNA, 23 bp, Artificial Sequence
  Synthetic Construct
ctgaaccagctcggacagagaag

SEQ ID NO: 356 - DNA, 22 bp, Artificial Sequence
  Synthetic Construct
caccacgttgatgcagagtttc

SEQ ID NO: 357 - DNA, 23 bp, Artificial Sequence
  Synthetic Construct
ccaagtgcagaagctggaaaaca

SEQ ID NO: 358 - DNA, 24 bp, Artificial Sequence
  Synthetic Construct
gaccaggccctttgattgttctgt

SEQ ID NO: 359 - DNA, 22 bp, Artificial Sequence
  Synthetic Construct
taagtccccgtgctcacagcat

SEQ ID NO: 360 - DNA, 25 bp, Artificial Sequence
  Synthetic Construct
gctccatcctgtgaatgaagtaagt

SEQ ID NO: 361 - DNA, 24 bp, Artificial Sequence
  Synthetic Construct
gggatccatcaccgttccaaacat

SEQ ID NO: 362 - DNA, 19 bp, Artificial Sequence
  Synthetic Construct
ggagagtccagggcgtctt

SEQ ID NO: 363 - DNA, 22 bp, Artificial Sequence
  Synthetic Construct
cttcacagtgcctgggacattt

SEQ ID NO: 364 - DNA, 23 bp, Artificial Sequence
  Synthetic Construct
tccaggatggggaaggacctaag

SEQ ID NO: 365 - DNA, 24 bp, Artificial Sequence
  Synthetic Construct
ctaagctcaaagtcaagggacaga

SEQ ID NO: 366 - DNA, 25 bp, Artificial Sequence
  Synthetic Construct
gagaagaaagtcgccctgaaaatac

SEQ ID NO: 367 - DNA, 20 bp, Artificial Sequence
  Synthetic Construct
gtgctttcccacagcgaatc

SEQ ID NO: 368 - DNA, 20 bp, Artificial Sequence
  Synthetic Construct
ggtgctgcagagggtggaaa

SEQ ID NO: 369 - DNA, 20 bp, Artificial Sequence
  Synthetic Construct
aactaccctcccacccaaca

SEQ ID NO: 370 - DNA, 28 bp, Artificial Sequence
  Synthetic Construct
gttgggtggacagtctttttcatctttg

SEQ ID NO: 371 - DNA, 23 bp, Artificial Sequence
  Synthetic Construct
gtgctctcccttgaaatgaggat

SEQ ID NO: 372 - DNA, 21 bp, Artificial Sequence
  Synthetic Construct
gatggtggaaaccgaccaact

SEQ ID NO: 373 - DNA, 18 bp, Artificial Sequence
  Synthetic Construct
tgcagggtggcagcatga

SEQ ID NO: 374 - DNA, 24 bp, Artificial Sequence
  Synthetic Construct
gccctctgacttcactgacctact

SEQ ID NO: 375 - DNA, 21 bp, Artificial Sequence
  Synthetic Construct
tggggttgaggtccccttatg

SEQ ID NO: 376 - DNA, 22 bp, Artificial Sequence
  Synthetic Construct
ccccttcatctgccctggtagt

SEQ ID NO: 377 - DNA, 22 bp, Artificial Sequence
  Synthetic Construct
cctctgcaccttggcctacatt

SEQ ID NO: 378 - DNA, 21 bp, Artificial Sequence
  Synthetic Construct
ggcggaaaccaaaccctcaga

SEQ ID NO: 379 - DNA, 20 bp, Artificial Sequence
  Synthetic Construct
gggcccctcccacatacaca

SEQ ID NO: 380 - DNA, 22 bp, Artificial Sequence
  Synthetic Construct
gcccatgctgaggactaacctt

SEQ ID NO: 381 - DNA, 21 bp, Artificial Sequence
  Synthetic Construct
ccctaaggttgggtcgagttg

SEQ ID NO: 382 - DNA, 21 bp, Artificial Sequence
  Synthetic Construct
cagggtcccaacgggtttcta

SEQ ID NO: 383 - DNA, 21 bp, Artificial Sequence
  Synthetic Construct
gccccagcattcacactgcat

SEQ ID NO: 384 - DNA, 21 bp, Artificial Sequence
  Synthetic Construct
gcaagtagctgggccttgtca

SEQ ID NO: 385 - DNA, 22 bp, Artificial Sequence
  Synthetic Construct
gcaccatcaggagatgcagact

SEQ ID NO: 386 - DNA, 25 bp, Artificial Sequence
  Synthetic Construct
ctctgtcagtttctgagtgggatga

SEQ ID NO: 387 - DNA, 21 bp, Artificial Sequence
  Synthetic Construct
gaggcctcactctccccttat

SEQ ID NO: 388 - DNA, 23 bp, Artificial Sequence
  Synthetic Construct
tcatgctgcttgggtaatgttct

SEQ ID NO: 389 - DNA, 19 bp, Artificial Sequence
  Synthetic Construct
ctgggccatcctcctgtct

SEQ ID NO: 390 - DNA, 20 bp, Artificial Sequence
  Synthetic Construct
tggagagtggggaggagctt

SEQ ID NO: 391 - DNA, 21 bp, Artificial Sequence
  Synthetic Construct
ggagcatgccgccttgttact

SEQ ID NO: 392 - DNA, 24 bp, Artificial Sequence
  Synthetic Construct
gtctcttccctgaagtagggttgt

SEQ ID NO: 393 - DNA, 24 bp, Artificial Sequence
  Synthetic Construct
tcactcacatcatcatggttggat

SEQ ID NO: 394 - DNA, 20 bp, Artificial Sequence
  Synthetic Construct
ggagcagcattgccttcgtt

SEQ ID NO: 395 - DNA, 20 bp, Artificial Sequence
  Synthetic Construct
gcctcgcatcacgcagtttt

SEQ ID NO: 396 - DNA, 26 bp, Artificial Sequence
  Synthetic Construct
cccgtttgaagaaatgatagctcgaa

SEQ ID NO: 397 - DNA, 20 bp, Artificial Sequence
  Synthetic Construct
gggtgctgttctggctttga

SEQ ID NO: 398 - DNA, 21 bp, Artificial Sequence
  Synthetic Construct
ggctgtggttgttgacagagt

SEQ ID NO: 399 - DNA, 23 bp, Artificial Sequence
  Synthetic Construct
ccctgtggaacaaagtgggaact

SEQ ID NO: 400 - DNA, 22 bp, Artificial Sequence
  Synthetic Construct
gcaaaggcttgtctgacagtga

SEQ ID NO: 401 - DNA, 24 bp, Artificial Sequence
  Synthetic Construct
caagaggaccttcggaaactttga

SEQ ID NO: 402 - DNA, 20 bp, Artificial Sequence
  Synthetic Construct
aggcacacgcaggtctcatc

SEQ ID NO: 403 - DNA, 25 bp, Artificial Sequence
  Synthetic Construct
gtgtagaggggcaactcctatcttg

SEQ ID NO: 404 - DNA, 27 bp, Artificial Sequence
  Synthetic Construct
cagactacaaaggtgtttgctgtttgt

SEQ ID NO: 405 - DNA, 20 bp, Artificial Sequence
  Synthetic Construct
ctgcgttgtgcctactctgt

SEQ ID NO: 406 - DNA, 20 bp, Artificial Sequence
  Synthetic Construct
ggtgtccccgcacttagcat

SEQ ID NO: 407 - DNA, 23 bp, Artificial Sequence
  Synthetic Construct
gtgaagccagacagcagtaatca

SEQ ID NO: 408 - DNA, 23 bp, Artificial Sequence
  Synthetic Construct
ggagggtgaacaaggcaaagatg

SEQ ID NO: 409 - DNA, 22 bp, Artificial Sequence
  Synthetic Construct
acctgcaggagctagttagaga

SEQ ID NO: 410 - DNA, 21 bp, Artificial Sequence
  Synthetic Construct
gctttcagtccccacttgtga

SEQ ID NO: 411 - DNA, 22 bp, Artificial Sequence
  Synthetic Construct
gtgaggcaggaaggatgagttt

SEQ ID NO: 412 - DNA, 24 bp, Artificial Sequence
  Synthetic Construct
gagctttggagacagtggggtaac

SEQ ID NO: 413 - DNA, 22 bp, Artificial Sequence
  Synthetic Construct
ccagcatcaggtcacaatgaac

SEQ ID NO: 414 - DNA, 20 bp, Artificial Sequence
  Synthetic Construct
actgagggcggcattgctta

SEQ ID NO: 415 - DNA, 20 bp, Artificial Sequence
  Synthetic Construct
gcggcaaggagggtttctaa

SEQ ID NO: 416 - DNA, 25 bp, Artificial Sequence
  Synthetic Construct
tcagagttctgtcctaatggaggaa

SEQ ID NO: 417 - DNA, 26 bp, Artificial Sequence
  Synthetic Construct
cactagtctggaaaaaccagcaccaa

SEQ ID NO: 418 - DNA, 24 bp, Artificial Sequence
  Synthetic Construct
aatcctggaacactcttgcctaaa

SEQ ID NO: 419 - DNA, 26 bp, Artificial Sequence
  Synthetic Construct
gtgtgagctagttccttctgctcttc

SEQ ID NO: 420 - DNA, 22 bp, Artificial Sequence
  Synthetic Construct
caactgcagcgtgctgatttta

SEQ ID NO: 421 - DNA, 21 bp, Artificial Sequence
  Synthetic Construct
aatcggccacagccccagaga

SEQ ID NO: 422 - DNA, 24 bp, Artificial Sequence
  Synthetic Construct
ggatcttctgaacaccacatcctt

SEQ ID NO: 423 - DNA, 22 bp, Artificial Sequence
  Synthetic Construct
atccagttccctgggtgactct

SEQ ID NO: 424 - DNA, 25 bp, Artificial Sequence
  Synthetic Construct
gttttctccaccaacacacctttct

SEQ ID NO: 425 - DNA, 21 bp, Artificial Sequence
  Synthetic Construct
aaggggactcggaggacaaga

SEQ ID NO: 426 - DNA, 22 bp, Artificial Sequence
  Synthetic Construct
gggccaatgtgtcctggtttgt

SEQ ID NO: 427 - DNA, 21 bp, Artificial Sequence
  Synthetic Construct
tgccatggcctttgcctatac

SEQ ID NO: 428 - DNA, 24 bp, Artificial Sequence
  Synthetic Construct
gctctcagggaaatcatccatttg

SEQ ID NO: 429 - DNA, 24 bp, Artificial Sequence
  Synthetic Construct
cctgggatttaccatgtcccataa

SEQ ID NO: 430 - DNA, 21 bp, Artificial Sequence
  Synthetic Construct
cgtgctccactttcctgacaa

SEQ ID NO: 431 - DNA, 22 bp, Artificial Sequence
  Synthetic Construct
cagggatgagccgctgtttcta

SEQ ID NO: 432 - DNA, 21 bp, Artificial Sequence
  Synthetic Construct
agatcttcggggctccagaca

SEQ ID NO: 433 - DNA, 27 bp, Artificial Sequence
  Synthetic Construct
gcatagtccacagtaggaaaaatgcaa

SEQ ID NO: 434 - DNA, 21 bp, Artificial Sequence
  Synthetic Construct
ggcagctgcaacagtatgtct

SEQ ID NO: 435 - DNA, 24 bp, Artificial Sequence
  Synthetic Construct
ggtctgtctgattccagctgatac

SEQ ID NO: 436 - DNA, 27 bp, Artificial Sequence
  Synthetic Construct
ctcagtgggcttagaataaacctgaat

SEQ ID NO: 437 - DNA, 20 bp, Artificial Sequence
  Synthetic Construct
ggaggtttggctgggtcttt

SEQ ID NO: 438 - DNA, 20 bp, Artificial Sequence
  Synthetic Construct
aggcgggtccccaggaaaca

SEQ ID NO: 439 - DNA, 21 bp, Artificial Sequence
  Synthetic Construct
acaaggggcctgactcagctt

SEQ ID NO: 440 - DNA, 21 bp, Artificial Sequence
  Synthetic Construct
cctggtgtgctctgccttgaa

SEQ ID NO: 441 - DNA, 22 bp, Artificial Sequence
  Synthetic Construct
cctcggtggacacttggtcttg

SEQ ID NO: 442 - DNA, 27 bp, Artificial Sequence
  Synthetic Construct
ggagataggaaaagtcatggagggtaa

SEQ ID NO: 443 - DNA, 20 bp, Artificial Sequence
  Synthetic Construct
agtctcatggcaggctgctt

SEQ ID NO: 444 - DNA, 22 bp, Artificial Sequence
  Synthetic Construct
agaacccctgcaccctctttct

SEQ ID NO: 445 - DNA, 26 bp, Artificial Sequence
  Synthetic Construct
ggccttaattgacaccgctaatcttg

SEQ ID NO: 446 - DNA, 22 bp, Artificial Sequence
  Synthetic Construct
ggagaggctaaggggaaacaga

SEQ ID NO: 447 - DNA, 20 bp, Artificial Sequence
  Synthetic Construct
atggtggtggctgtgcgatt

SEQ ID NO: 448 - DNA, 22 bp, Artificial Sequence
  Synthetic Construct
ttgggtcatagggccgagaatg

SEQ ID NO: 449 - DNA, 20 bp, Artificial Sequence
  Synthetic Construct
acacgaaagcggcgtcagaa

SEQ ID NO: 450 - DNA, 22 bp, Artificial Sequence
  Synthetic Construct
tgggcttctgggttctagatgt

SEQ ID NO: 451 - DNA, 25 bp, Artificial Sequence
  Synthetic Construct
ggaaaccatcccatgtctactgtgt

SEQ ID NO: 452 - DNA, 22 bp, Artificial Sequence
  Synthetic Construct
tcccacttactacgctccaaga

SEQ ID NO: 453 - DNA, 21 bp, Artificial Sequence
  Synthetic Construct
tcctgccctagctgtggcttt

SEQ ID NO: 454 - DNA, 20 bp, Artificial Sequence
  Synthetic Construct
ccgcaaatagccccagaact

SEQ ID NO: 455 - DNA, 20 bp, Artificial Sequence
  Synthetic Construct
tttggttagcggggctctct

SEQ ID NO: 456 - DNA, 25 bp, Artificial Sequence
  Synthetic Construct
ccaggataagaatgttggcctcctt

SEQ ID NO: 457 - DNA, 23 bp, Artificial Sequence
  Synthetic Construct
ctgttgcccgtgggattaaaatg

SEQ ID NO: 458 - DNA, 22 bp, Artificial Sequence
  Synthetic Construct
tgtgctacctggagagggtttc

SEQ ID NO: 459 - DNA, 22 bp, Artificial Sequence
  Synthetic Construct
cccttctgcagcatgtgcattt

SEQ ID NO: 460 - DNA, 25 bp, Artificial Sequence
  Synthetic Construct
gctaggaatgggaacattggcatct

SEQ ID NO: 461 - DNA, 24 bp, Artificial Sequence
  Synthetic Construct
gtctttacaagcaggccccatttg

SEQ ID NO: 462 - DNA, 21 bp, Artificial Sequence
  Synthetic Construct
agaccacctgcctaagaccaa

SEQ ID NO: 463 - DNA, 19 bp, Artificial Sequence
  Synthetic Construct
accccatccccaccagctt

SEQ ID NO: 464 - DNA, 22 bp, Artificial Sequence
  Synthetic Construct
gattggctcctgtgctctgagt

SEQ ID NO: 465 - DNA, 22 bp, Artificial Sequence
  Synthetic Construct
cctgcagggaaaacctgcaact

SEQ ID NO: 466 - DNA, 23 bp, Artificial Sequence
  Synthetic Construct
ctttacagcattgcctcctccta

SEQ ID NO: 467 - DNA, 21 bp, Artificial Sequence
  Synthetic Construct
ggccactagtctgggacaaag

SEQ ID NO: 468 - DNA, 26 bp, Artificial Sequence
  Synthetic Construct
gtaatgtcagtgcgtctaggtaaaga

SEQ ID NO: 469 - DNA, 20 bp, Artificial Sequence
  Synthetic Construct
ggagagggaatgctgcgaat

SEQ ID NO: 470 - DNA, 19 bp, Artificial Sequence
  Synthetic Construct
ggaggcacagcaggtctga

SEQ ID NO: 471 - DNA, 23 bp, Artificial Sequence
  Synthetic Construct
ggacaccaacgatgacacaaaat

SEQ ID NO: 472 - DNA, 19 bp, Artificial Sequence
  Synthetic Construct
agggagccggcatcctttg

SEQ ID NO: 473 - DNA, 21 bp, Artificial Sequence
  Synthetic Construct
tgccaagaggcttctcagttc

SEQ ID NO: 474 - DNA, 22 bp, Artificial Sequence
  Synthetic Construct
cctgggcagtaagctagcaatg

SEQ ID NO: 475 - DNA, 20 bp, Artificial Sequence
  Synthetic Construct
tcacccctcacctgcactct

SEQ ID NO: 476 - DNA, 23 bp, Artificial Sequence
  Synthetic Construct
gctgagaatccagagactgtgtt

SEQ ID NO: 477 - DNA, 23 bp, Artificial Sequence
  Synthetic Construct
ccacaccatacaagggatctcaa

SEQ ID NO: 478 - DNA, 25 bp, Artificial Sequence
  Synthetic Construct
agtggatgagaactatcatggcaaa

SEQ ID NO: 479 - DNA, 21 bp, Artificial Sequence
  Synthetic Construct
cttgaggcagttccgacttca

SEQ ID NO: 480 - DNA, 22 bp, Artificial Sequence
  Synthetic Construct
gccaagaacacgtcaggtctca

SEQ ID NO: 481 - DNA, 25 bp, Artificial Sequence
  Synthetic Construct
tttccactctcccttatttctgcaa

SEQ ID NO: 482 - DNA, 24 bp, Artificial Sequence
  Synthetic Construct
ccacagatgcaaagagagcacttc

SEQ ID NO: 483 - DNA, 22 bp, Artificial Sequence
  Synthetic Construct
gggagtgtctgtggtccagaat

SEQ ID NO: 484 - DNA, 21 bp, Artificial Sequence
  Synthetic Construct
ccaaagctgtttgcggctaga

SEQ ID NO: 485 - DNA, 19 bp, Artificial Sequence
  Synthetic Construct
gctgcggaggccagaaagt

SEQ ID NO: 486 - DNA, 23 bp, Artificial Sequence
  Synthetic Construct
ttgtagacaatggggccactaag

SEQ ID NO: 487 - DNA, 23 bp, Artificial Sequence
  Synthetic Construct
tgtgccagtgtgtaccttcattt

SEQ ID NO: 488 - DNA, 26 bp, Artificial Sequence
  Synthetic Construct
gggttcaggccagtagaatgacctat

SEQ ID NO: 489 - DNA, 26 bp, Artificial Sequence
  Synthetic Construct
ttgaggacaatagagaaggtctgttc

SEQ ID NO: 490 - DNA, 25 bp, Artificial Sequence
  Synthetic Construct
gctggatcctaagacaacactgtat

SEQ ID NO: 491 - DNA, 20 bp, Artificial Sequence
  Synthetic Construct
aggctggcatgttggagtca

SEQ ID NO: 492 - DNA, 21 bp, Artificial Sequence
  Synthetic Construct
tgtgagctgttcttgccatgt

SEQ ID NO: 493 - DNA, 22 bp, Artificial Sequence
  Synthetic Construct
gtgttacctggcgcctgaatgt

SEQ ID NO: 494 - DNA, 22 bp, Artificial Sequence
  Synthetic Construct
agctaagttttccaggcgatgt

SEQ ID NO: 495 - DNA, 24 bp, Artificial Sequence
  Synthetic Construct
gtgaaagagccatgataggtctga

SEQ ID NO: 496 - DNA, 19 bp, Artificial Sequence
  Synthetic Construct
gatgcccgcacctgctaga

SEQ ID NO: 497 - DNA, 20 bp, Artificial Sequence
  Synthetic Construct
tcgcccttgtggatccaagt

SEQ ID NO: 498 - DNA, 19 bp, Artificial Sequence
  Synthetic Construct
aggggacgtctcccaggtt

SEQ ID NO: 499 - DNA, 18 bp, Artificial Sequence
  Synthetic Construct
accctgcatcgggtctca

SEQ ID NO: 500 - DNA, 21 bp, Artificial Sequence
  Synthetic Construct
gtcctgttcccgcaaggttga

SEQ ID NO: 501 - DNA, 24 bp, Artificial Sequence
  Synthetic Construct
gtgttgttcctcttcccaaggaat

SEQ ID NO: 502 - DNA, 24 bp, Artificial Sequence
  Synthetic Construct
gtctcagagattccacagcctaca

SEQ ID NO: 503 - DNA, 23 bp, Artificial Sequence
  Synthetic Construct
acagatgccagatgcagaagaaa

SEQ ID NO: 504 - DNA, 24 bp, Artificial Sequence
  Synthetic Construct
ggctctgaggtcatctctgtatca

SEQ ID NO: 505 - DNA, 20 bp, Artificial Sequence
  Synthetic Construct
caagtccctcccagcaacaa

SEQ ID NO: 506 - DNA, 22 bp, Artificial Sequence
  Synthetic Construct
cgcctctgtcctctgtcacttt

SEQ ID NO: 507 - DNA, 20 bp, Artificial Sequence
  Synthetic Construct
ggataccaaccccgccagaa

SEQ ID NO: 508 - DNA, 25 bp, Artificial Sequence
  Synthetic Construct
ccatcatctggttatgctacagtct

SEQ ID NO: 509 - DNA, 24 bp, Artificial Sequence
  Synthetic Construct
cttgatgactccacttctccatca

SEQ ID NO: 510 - DNA, 22 bp, Artificial Sequence
  Synthetic Construct
gccaaggagtgaaccaggtttg

SEQ ID NO: 511 - DNA, 22 bp, Artificial Sequence
  Synthetic Construct
cgacctgtgttaggggttcagt

SEQ ID NO: 512 - DNA, 19 bp, Artificial Sequence
  Synthetic Construct
gtggcccagaaggctgctt

SEQ ID NO: 513 - DNA, 25 bp, Artificial Sequence
  Synthetic Construct
cacaggaggtcattaaggttcaaca

SEQ ID NO: 514 - DNA, 24 bp, Artificial Sequence
  Synthetic Construct
gcagacattgtatgtcggtgaaca

SEQ ID NO: 515 - DNA, 18 bp, Artificial Sequence
  Synthetic Construct
tgggttcgcacggctgtt

SEQ ID NO: 516 - DNA, 22 bp, Artificial Sequence
  Synthetic Construct
accaccacacctagctgcaaag

SEQ ID NO: 517 - DNA, 19 bp, Artificial Sequence
  Synthetic Construct
tgtccctggggccactgaa

SEQ ID NO: 518 - DNA, 22 bp, Artificial Sequence
  Synthetic Construct
gtggggtaacagccacaggtat

SEQ ID NO: 519 - DNA, 22 bp, Artificial Sequence
  Synthetic Construct
ctgccggagactatgctcagta

SEQ ID NO: 520 - DNA, 22 bp, Artificial Sequence
  Synthetic Construct
gtcacccaggccatgtgaactt

SEQ ID NO: 521 - DNA, 22 bp, Artificial Sequence
  Synthetic Construct
gggccatgtcattgctctgtag

SEQ ID NO: 522 - DNA, 23 bp, Artificial Sequence
  Synthetic Construct
ccccaagatgtctgccatagttc

SEQ ID NO: 523 - DNA, 29 bp, Artificial Sequence
  Synthetic Construct
gcagttggtaaaggcaaagcttaacgaaa

SEQ ID NO: 524 - DNA, 21 bp, Artificial Sequence
  Synthetic Construct
agactaggcagggtacacaca

SEQ ID NO: 525 - DNA, 27 bp, Artificial Sequence
  Synthetic Construct
gtgagcacaaatttggatcgagtgaga

SEQ ID NO: 526 - DNA, 23 bp, Artificial Sequence
  Synthetic Construct
gagtggctagctctcaagacaca

SEQ ID NO: 527 - DNA, 23 bp, Artificial Sequence
  Synthetic Construct
gtgtgggaaggaggattccatgt

SEQ ID NO: 528 - DNA, 22 bp, Artificial Sequence
  Synthetic Construct
atggtaggtcagacccagaagt

SEQ ID NO: 529 - DNA, 25 bp, Artificial Sequence
  Synthetic Construct
cgtccaggagacagttaacctcttg

SEQ ID NO: 530 - DNA, 23 bp, Artificial Sequence
  Synthetic Construct
ttccaagagcattcaggtgtctt

SEQ ID NO: 531 - DNA, 23 bp, Artificial Sequence
  Synthetic Construct
agcagctcaaactatgccaaaga

SEQ ID NO: 532 - DNA, 21 bp, Artificial Sequence
  Synthetic Construct
agtgccagagcccgctagaaa

SEQ ID NO: 533 - DNA, 22 bp, Artificial Sequence
  Synthetic Construct
acccctgtgcctaagctgaagt

SEQ ID NO: 534 - DNA, 20 bp, Artificial Sequence
  Synthetic Construct
ctgtgctggctgctgtttca

SEQ ID NO: 535 - DNA, 21 bp, Artificial Sequence
  Synthetic Construct
gatgggtgttgcaaggcaaag

SEQ ID NO: 536 - DNA, 25 bp, Artificial Sequence
  Synthetic Construct
ggcccatttaccctttctatcatgt

SEQ ID NO: 537 - DNA, 23 bp, Artificial Sequence
  Synthetic Construct
caagtggattgtgggtggacact

SEQ ID NO: 538 - DNA, 23 bp, Artificial Sequence
  Synthetic Construct
tgtgtgacattcctggtgctaaa

SEQ ID NO: 539 - DNA, 20 bp, Artificial Sequence
  Synthetic Construct
aggcaggcgatgagccaaat

SEQ ID NO: 540 - DNA, 24 bp, Artificial Sequence
  Synthetic Construct
gttccaatcacaggacaggggtat

SEQ ID NO: 541 - DNA, 21 bp, Artificial Sequence
  Synthetic Construct
ggagatgcaatcggcccataa

SEQ ID NO: 542 - DNA, 20 bp, Artificial Sequence
  Synthetic Construct
tgttggccaggggttaggtt

SEQ ID NO: 543 - DNA, 22 bp, Artificial Sequence
  Synthetic Construct
gtcatggggacctggattgcta

SEQ ID NO: 544 - DNA, 22 bp, Artificial Sequence
  Synthetic Construct
gccacatggacacctcacactt

SEQ ID NO: 545 - DNA, 28 bp, Artificial Sequence
  Synthetic Construct
ggttttcctatcggtgtttgaggtctac

SEQ ID NO: 546 - DNA, 24 bp, Artificial Sequence
  Synthetic Construct
cagggtgataagtccacagcattc

SEQ ID NO: 547 - DNA, 20 bp, Artificial Sequence
  Synthetic Construct
cagcacccagagagcagctt

SEQ ID NO: 548 - DNA, 19 bp, Artificial Sequence
  Synthetic Construct
gcgcaggcgcagcattatt

SEQ ID NO: 549 - DNA, 20 bp, Artificial Sequence
  Synthetic Construct
cacgacaccacacgcattca

SEQ ID NO: 550 - DNA, 22 bp, Artificial Sequence
  Synthetic Construct
tcccatcagcaccagtggaaac

SEQ ID NO: 551 - DNA, 26 bp, Artificial Sequence
  Synthetic Construct
gggagatcatacacagagaggaggtt

SEQ ID NO: 552 - DNA, 25 bp, Artificial Sequence
  Synthetic Construct
tcaggctaaagacattgctgtagaa

SEQ ID NO: 553 - DNA, 22 bp, Artificial Sequence
  Synthetic Construct
ccctgctcttccatgctgctaa

SEQ ID NO: 554 - DNA, 23 bp, Artificial Sequence
  Synthetic Construct
cctaggagggtaaaggcggagtt

SEQ ID NO: 555 - DNA, 20 bp, Artificial Sequence
  Synthetic Construct
ttgccagctctgccctgcta

SEQ ID NO: 556 - DNA, 22 bp, Artificial Sequence
  Synthetic Construct
gcaccaggagtgtgctgaagtt

SEQ ID NO: 557 - DNA, 26 bp, Artificial Sequence
  Synthetic Construct
gtctctgacaatacattcagccacta

SEQ ID NO: 558 - DNA, 20 bp, Artificial Sequence
  Synthetic Construct
aaggctcgcctgagggtgaa

SEQ ID NO: 559 - DNA, 24 bp, Artificial Sequence
  Synthetic Construct
cgtgattaagtacggctgcctgtt

SEQ ID NO: 560 - DNA, 24 bp, Artificial Sequence
  Synthetic Construct
gaccacagaaattggaaggagcta

SEQ ID NO: 561 - DNA, 20 bp, Artificial Sequence
  Synthetic Construct
ggcagcttcccttcgctctt

SEQ ID NO: 562 - DNA, 24 bp, Artificial Sequence
  Synthetic Construct
gcctgctgttgggtgaattactgt

SEQ ID NO: 563 - DNA, 20 bp, Artificial Sequence
  Synthetic Construct
gtgatgctgctacggaggaa

SEQ ID NO: 564 - DNA, 19 bp, Artificial Sequence
  Synthetic Construct
cccgcaatgcccagtgaca

SEQ ID NO: 565 - DNA, 22 bp, Artificial Sequence
  Synthetic Construct
aggggctgagtgctttttcttc

SEQ ID NO: 566 - DNA, 22 bp, Artificial Sequence
  Synthetic Construct
gcatcagagcagtgggcttaca

SEQ ID NO: 567 - DNA, 19 bp, Artificial Sequence
  Synthetic Construct
tggagggagggagctgttc

SEQ ID NO: 568 - DNA, 21 bp, Artificial Sequence
  Synthetic Construct
tgggagggccagagactcatt

SEQ ID NO: 569 - DNA, 23 bp, Artificial Sequence
  Synthetic Construct
gaagaaagccaggcctccaaaac

SEQ ID NO: 570 - DNA, 19 bp, Artificial Sequence
  Synthetic Construct
acagttggggcaagcacat

SEQ ID NO: 571 - DNA, 19 bp, Artificial Sequence
  Synthetic Construct
tgcaacgcgagggtgagtt

SEQ ID NO: 572 - DNA, 22 bp, Artificial Sequence
  Synthetic Construct
ggagagatgcgtccatcacaga

SEQ ID NO: 573 - DNA, 20 bp, Artificial Sequence
  Synthetic Construct
ggatggcttcaggcagttga

SEQ ID NO: 574 - DNA, 20 bp, Artificial Sequence
  Synthetic Construct
cacttctggggcacttgtgt

SEQ ID NO: 575 - DNA, 25 bp, Artificial Sequence
  Synthetic Construct
ctcttgcaaatcgaggaacgagaga

SEQ ID NO: 576 - DNA, 21 bp, Artificial Sequence
  Synthetic Construct
accttcagggccaccagtgtt

SEQ ID NO: 577 - DNA, 22 bp, Artificial Sequence
  Synthetic Construct
tgcactcactcagggcagaagt

SEQ ID NO: 578 - DNA, 21 bp, Artificial Sequence
  Synthetic Construct
gcagtgcgtgttcttgcatca

SEQ ID NO: 579 - DNA, 21 bp, Artificial Sequence
  Synthetic Construct
tcaggcagggctcagaactgt

SEQ ID NO: 580 - DNA, 20 bp, Artificial Sequence
  Synthetic Construct
tcctctgccttcagcactgt

SEQ ID NO: 581 - DNA, 22 bp, Artificial Sequence
  Synthetic Construct
ggagaagactgcggaacacaca

SEQ ID NO: 582 - DNA, 28 bp, Artificial Sequence
  Synthetic Construct
cacccctaagtttgagatctgttgattc

SEQ ID NO: 583 - DNA, 22 bp, Artificial Sequence
  Synthetic Construct
tgccccttccaatcctgtgtga

SEQ ID NO: 584 - DNA, 27 bp, Artificial Sequence
  Synthetic Construct
gccacaggggatgaataaaaagcagta

SEQ ID NO: 585 - DNA, 24 bp, Artificial Sequence
  Synthetic Construct
caaagatgggtcaagttcctctca

SEQ ID NO: 586 - DNA, 19 bp, Artificial Sequence
  Synthetic Construct
ggtgggcccagaacaaact

SEQ ID NO: 587 - DNA, 20 bp, Artificial Sequence
  Synthetic Construct
aaggctgccctggtcaaaca

SEQ ID NO: 588 - DNA, 23 bp, Artificial Sequence
  Synthetic Construct
gttttaggacagccagtcgagaa

SEQ ID NO: 589 - DNA, 25 bp, Artificial Sequence
  Synthetic Construct
acagttgaagtccaggcttatttga

SEQ ID NO: 590 - DNA, 23 bp, Artificial Sequence
  Synthetic Construct
cagtggacccagatggtgacttc

SEQ ID NO: 591 - DNA, 23 bp, Artificial Sequence
  Synthetic Construct
tgctttagggagcatggagtaca

SEQ ID NO: 592 - DNA, 23 bp, Artificial Sequence
  Synthetic Construct
cctcagtcttagcctgggctctt

SEQ ID NO: 593 - DNA, 20 bp, Artificial Sequence
  Synthetic Construct
acagacccaggacgctgaag

SEQ ID NO: 594 - DNA, 22 bp, Artificial Sequence
  Synthetic Construct
cgaggggctttgtaccagtgtt

SEQ ID NO: 595 - DNA, 21 bp, Artificial Sequence
  Synthetic Construct
ccatctggagcaggggagaag

SEQ ID NO: 596 - DNA, 26 bp, Artificial Sequence
  Synthetic Construct
ggttaccccattccatcttctctgta

SEQ ID NO: 597 - DNA, 19 bp, Artificial Sequence
  Synthetic Construct
gggagagagctggcgttca

SEQ ID NO: 598 - DNA, 22 bp, Artificial Sequence
  Synthetic Construct
cctgcatgtctctggtctcttg

SEQ ID NO: 599 - DNA, 24 bp, Artificial Sequence
  Synthetic Construct
ccgcacaacttactattgctgttg

SEQ ID NO: 600 - DNA, 26 bp, Artificial Sequence
  Synthetic Construct
aggagtgaatcaaaggatggaagtag

SEQ ID NO: 601 - DNA, 24 bp, Artificial Sequence
  Synthetic Construct
gtcttctgcaggggtgaaaacagt

SEQ ID NO: 602 - DNA, 20 bp, Artificial Sequence
  Synthetic Construct
aggccctgaagttgctggaa

SEQ ID NO: 603 - DNA, 26 bp, Artificial Sequence
  Synthetic Construct
gtgagtaagtcaacagtgatgaggaa

SEQ ID NO: 604 - DNA, 21 bp, Artificial Sequence
  Synthetic Construct
ccagcacagaaccgacacgtt

SEQ ID NO: 605 - DNA, 20 bp, Artificial Sequence
  Synthetic Construct
agctgccgcatcttgctttc

SEQ ID NO: 606 - DNA, 22 bp, Artificial Sequence
  Synthetic Construct
gatggtcccaaggagccaatgt

SEQ ID NO: 607 - DNA, 24 bp, Artificial Sequence
  Synthetic Construct
cgtgcagacctcacattactcttg

SEQ ID NO: 608 - DNA, 22 bp, Artificial Sequence
  Synthetic Construct
gcctgagtgtccatgaacttgt

SEQ ID NO: 609 - DNA, 24 bp, Artificial Sequence
  Synthetic Construct
tggatagctacatgcttgcttctt

SEQ ID NO: 610 - DNA, 22 bp, Artificial Sequence
  Synthetic Construct
cggagccactttactcccacaa

SEQ ID NO: 611 - DNA, 24 bp, Artificial Sequence
  Synthetic Construct
cttagcaaagagccttctgactgt

SEQ ID NO: 612 - DNA, 22 bp, Artificial Sequence
  Synthetic Construct
acaagggaaagctgagggttct

SEQ ID NO: 613 - DNA, 23 bp, Artificial Sequence
  Synthetic Construct
caaagcaccaatcctctgtgtga

SEQ ID NO: 614 - DNA, 24 bp, Artificial Sequence
  Synthetic Construct
gggcaaaagaatactctggtcagt

SEQ ID NO: 615 - DNA, 20 bp, Artificial Sequence
  Synthetic Construct
cacttcccaccctccctaca

SEQ ID NO: 616 - DNA, 21 bp, Artificial Sequence
  Synthetic Construct
gcactttgcgtggactgtttc

SEQ ID NO: 617 - DNA, 23 bp, Artificial Sequence
  Synthetic Construct
ctccgccacaaactgaaatctct

SEQ ID NO: 618 - DNA, 20 bp, Artificial Sequence
  Synthetic Construct
tgggcaagagtgtggagtca

SEQ ID NO: 619 - DNA, 26 bp, Artificial Sequence
  Synthetic Construct
ccgaaatcattgaacgagcaggctat

SEQ ID NO: 620 - DNA, 23 bp, Artificial Sequence
  Synthetic Construct
ccacctaagccctaggatcatct

SEQ ID NO: 621 - DNA, 20 bp, Artificial Sequence
  Synthetic Construct
cagcaggaaggggtgagttc

SEQ ID NO: 622 - DNA, 22 bp, Artificial Sequence
  Synthetic Construct
cgcctggagcctcaaattggtt

SEQ ID NO: 623 - DNA, 25 bp, Artificial Sequence
  Synthetic Construct
gtctggaaccaacagaattgtcact

SEQ ID NO: 624 - DNA, 22 bp, Artificial Sequence
  Synthetic Construct
caagaccctggacgctcaagaa

SEQ ID NO: 625 - DNA, 23 bp, Artificial Sequence
  Synthetic Construct
gtcagcaaaggaaggagtaccat

SEQ ID NO: 626 - DNA, 23 bp, Artificial Sequence
  Synthetic Construct
cagaagtcattgctgaggaggaa

SEQ ID NO: 627 - DNA, 24 bp, Artificial Sequence
  Synthetic Construct
ctggagaaagatgcagtcgaccat

SEQ ID NO: 628 - DNA, 25 bp, Artificial Sequence
  Synthetic Construct
agctctacttcacagaaaggagttg

SEQ ID NO: 629 - DNA, 19 bp, Artificial Sequence
  Synthetic Construct
cctgctcctgtggccctta

SEQ ID NO: 630 - DNA, 22 bp, Artificial Sequence
  Synthetic Construct
ccagccttgcttccccttcaat

SEQ ID NO: 631 - DNA, 22 bp, Artificial Sequence
  Synthetic Construct
ggggcagggaatacaggaattt

SEQ ID NO: 632 - DNA, 25 bp, Artificial Sequence
  Synthetic Construct
gaaatactcacaatgccctcagcat

SEQ ID NO: 633 - DNA, 24 bp, Artificial Sequence
  Synthetic Construct
gtgaggtgtggaaacgaaggtttg

SEQ ID NO: 634 - DNA, 21 bp, Artificial Sequence
  Synthetic Construct
ttgattgagcgggagcaaaga

SEQ ID NO: 635 - DNA, 27 bp, Artificial Sequence
  Synthetic Construct
caacccgaagaatctttgttcctcaag

SEQ ID NO: 636 - DNA, 25 bp, Artificial Sequence
  Synthetic Construct
ggcatgggaataaatgccaggtgaa

SEQ ID NO: 637 - DNA, 25 bp, Artificial Sequence
  Synthetic Construct
ggagacttggagggtaaaggcaact

SEQ ID NO: 638 - DNA, 26 bp, Artificial Sequence
  Synthetic Construct
gcagttttgaaggcctagttatgttc

SEQ ID NO: 639 - DNA, 22 bp, Artificial Sequence
  Synthetic Construct
gcaaggtctgagtggagaggat

SEQ ID NO: 640 - DNA, 23 bp, Artificial Sequence
  Synthetic Construct
attgcagctccaggctccgagat

SEQ ID NO: 641 - DNA, 22 bp, Artificial Sequence
  Synthetic Construct
cagccctctcctgttcagtgtt

SEQ ID NO: 642 - DNA, 22 bp, Artificial Sequence
  Synthetic Construct
cgagggtcgttggcacttcaat

SEQ ID NO: 643 - DNA, 22 bp, Artificial Sequence
  Synthetic Construct
tgggaaagagcgagatccaaaa

SEQ ID NO: 644 - DNA, 20 bp, Artificial Sequence
  Synthetic Construct
tctgcccagccgatggagta

SEQ ID NO: 645 - DNA, 23 bp, Artificial Sequence
  Synthetic Construct
gtcagtccctctgttctctgtca

SEQ ID NO: 646 - DNA, 24 bp, Artificial Sequence
  Synthetic Construct
tgacacaagaatcaggttggttga

SEQ ID NO: 647 - DNA, 23 bp, Artificial Sequence
  Synthetic Construct
tttattggctaccccaggtccta

SEQ ID NO: 648 - DNA, 24 bp, Artificial Sequence
  Synthetic Construct
gatgtcttccctgaacagtcagaa

SEQ ID NO: 649 - DNA, 21 bp, Artificial Sequence
  Synthetic Construct
gctgggctggttagggaaaca

SEQ ID NO: 650 - DNA, 24 bp, Artificial Sequence
  Synthetic Construct
caacactgtgctgtatgggaaaat

SEQ ID NO: 651 - DNA, 21 bp, Artificial Sequence
  Synthetic Construct
caacccaggaagacacaccaa

SEQ ID NO: 652 - DNA, 24 bp, Artificial Sequence
  Synthetic Construct
agaaggtagttcacctgaccgtta

SEQ ID NO: 653 - DNA, 24 bp, Artificial Sequence
  Synthetic Construct
gggctggcacatatgtagtagaag

SEQ ID NO: 654 - DNA, 22 bp, Artificial Sequence
  Synthetic Construct
ggcgacaacattgccaggatct

SEQ ID NO: 655 - DNA, 25 bp, Artificial Sequence
  Synthetic Construct
ctcagctcaggtatttgtgctgtta

SEQ ID NO: 656 - DNA, 24 bp, Artificial Sequence
  Synthetic Construct
gctgcactgcatacatacatggaa

SEQ ID NO: 657 - DNA, 22 bp, Artificial Sequence
  Synthetic Construct
ggcaaagtgatggtggcagctt

SEQ ID NO: 658 - DNA, 23 bp, Artificial Sequence
  Synthetic Construct
ggaaatctgagcatgtggagtga

SEQ ID NO: 659 - DNA, 24 bp, Artificial Sequence
  Synthetic Construct
cgatacccaggtaccatgttgaga

SEQ ID NO: 660 - DNA, 22 bp, Artificial Sequence
  Synthetic Construct
ggaaggccatttggcaagaatc

SEQ ID NO: 661 - DNA, 24 bp, Artificial Sequence
  Synthetic Construct
cttggtctgtccccaggttgttag

SEQ ID NO: 662 - DNA, 25 bp, Artificial Sequence
  Synthetic Construct
tcgagagaaagatggggtagaaagt

SEQ ID NO: 663 - DNA, 24 bp, Artificial Sequence
  Synthetic Construct
ccctgcctaacccaacatctgtgt

SEQ ID NO: 664 - DNA, 21 bp, Artificial Sequence
  Synthetic Construct
gtggaaaaggcgtcagactgt

SEQ ID NO: 665 - DNA, 21 bp, Artificial Sequence
  Synthetic Construct
cctgcgagttcctggagcaat

SEQ ID NO: 666 - DNA, 20 bp, Artificial Sequence
  Synthetic Construct
ggactaggtggttggtgcaa

SEQ ID NO: 667 - DNA, 23 bp, Artificial Sequence
  Synthetic Construct
agggcttttcatgtgagtgttgt

SEQ ID NO: 668 - DNA, 22 bp, Artificial Sequence
  Synthetic Construct
agcatctggctcccaagtgcta

SEQ ID NO: 669 - DNA, 24 bp, Artificial Sequence
  Synthetic Construct
ggcaagagacgaagtggaagcatt

SEQ ID NO: 670 - DNA, 27 bp, Artificial Sequence
  Synthetic Construct
gcaagctgggtgaagttatcttgtttc

SEQ ID NO: 671 - DNA, 21 bp, Artificial Sequence
  Synthetic Construct
gccagttgagggaagccatct

SEQ ID NO: 672 - DNA, 20 bp, Artificial Sequence
  Synthetic Construct
gcctccttagtgggcaggtt

SEQ ID NO: 673 - DNA, 26 bp, Artificial Sequence
  Synthetic Construct
cggaaacaaaacaactcttcccagat

SEQ ID NO: 674 - DNA, 19 bp, Artificial Sequence
  Synthetic Construct
tgagccttgctggctgtca

SEQ ID NO: 675 - DNA, 22 bp, Artificial Sequence
  Synthetic Construct
tgggaggcatagtccctgtgat

SEQ ID NO: 676 - DNA, 22 bp, Artificial Sequence
  Synthetic Construct
ttctgtggggcacttgtacttt

SEQ ID NO: 677 - DNA, 26 bp, Artificial Sequence
  Synthetic Construct
caaaggaggttcaaagaccagtttgt

SEQ ID NO: 678 - DNA, 26 bp, Artificial Sequence
  Synthetic Construct
ccttagtcctactttttcccttgcat

SEQ ID NO: 679 - DNA, 21 bp, Artificial Sequence
  Synthetic Construct
gaccttgcaagaacggagtca

SEQ ID NO: 680 - DNA, 23 bp, Artificial Sequence
  Synthetic Construct
gactgccatctggcattgagaac

SEQ ID NO: 681 - DNA, 19 bp, Artificial Sequence
  Synthetic Construct
agccgctcctgctttttga

SEQ ID NO: 682 - DNA, 25 bp, Artificial Sequence
  Synthetic Construct
gccaaaagtgcagagttatttcagt

SEQ ID NO: 683 - DNA, 19 bp, Artificial Sequence
  Synthetic Construct
tattggccgccagcactgt

SEQ ID NO: 684 - DNA, 22 bp, Artificial Sequence
  Synthetic Construct
gagcgcctagtcagtactttgt

SEQ ID NO: 685 - DNA, 21 bp, Artificial Sequence
  Synthetic Construct
gaagccaagttggtggaggat

SEQ ID NO: 686 - DNA, 24 bp, Artificial Sequence
  Synthetic Construct
gagaagggagagatgcatgggttt

SEQ ID NO: 687 - DNA, 21 bp, Artificial Sequence
  Synthetic Construct
ggccacccctgtgcatcttta

SEQ ID NO: 688 - DNA, 21 bp, Artificial Sequence
  Synthetic Construct
tgaatggtggccgaattgtgt

SEQ ID NO: 689 - DNA, 27 bp, Artificial Sequence
  Synthetic Construct
gccctttctggaggtacttgagcttat

SEQ ID NO: 690 - DNA, 22 bp, Artificial Sequence
  Synthetic Construct
gcagtctccagtgctgttcttc

SEQ ID NO: 691 - DNA, 22 bp, Artificial Sequence
  Synthetic Construct
cttcacccacagccagaaatgt

SEQ ID NO: 692 - DNA, 25 bp, Artificial Sequence
  Synthetic Construct
ctggcttggaacagaaaccatgact

SEQ ID NO: 693 - DNA, 20 bp, Artificial Sequence
  Synthetic Construct
aaggcttgagacgtgcttgt

SEQ ID NO: 694 - DNA, 18 bp, Artificial Sequence
  Synthetic Construct
gctgcagtgagccacgat

SEQ ID NO: 695 - DNA, 20 bp, Artificial Sequence
  Synthetic Construct
tggctggagcagagtgaaca

SEQ ID NO: 696 - DNA, 22 bp, Artificial Sequence
  Synthetic Construct
ccgccatcaggggttgatgtaa

SEQ ID NO: 697 - DNA, 20 bp, Artificial Sequence
  Synthetic Construct
agggatcagggccatcttca

SEQ ID NO: 698 - DNA, 21 bp, Artificial Sequence
  Synthetic Construct
agtcagcaggctggaaaaact

SEQ ID NO: 699 - DNA, 22 bp, Artificial Sequence
  Synthetic Construct
ctgtgcaggaagcaaggtagat

SEQ ID NO: 700 - DNA, 25 bp, Artificial Sequence
  Synthetic Construct
tgagtcaaggtgatacttgcttctt

SEQ ID NO: 701 - DNA, 26 bp, Artificial Sequence
  Synthetic Construct
acctataacaaaggggaagtcaggat

SEQ ID NO: 702 - DNA, 22 bp, Artificial Sequence
  Synthetic Construct
accttccccaccatgttctaca

SEQ ID NO: 703 - DNA, 24 bp, Artificial Sequence
  Synthetic Construct
cacatgcccagtaaatggaacaaa

SEQ ID NO: 704 - DNA, 22 bp, Artificial Sequence
  Synthetic Construct
cacctggaagctgaagccaaag

SEQ ID NO: 705 - DNA, 20 bp, Artificial Sequence
  Synthetic Construct
agtgggcgagcgccccttat

SEQ ID NO: 706 - DNA, 19 bp, Artificial Sequence
  Synthetic Construct
agccctgctgcgtggacaa

SEQ ID NO: 707 - DNA, 25 bp, Artificial Sequence
  Synthetic Construct
cttgggaaactaagtgagggcaaag

SEQ ID NO: 708 - DNA, 22 bp, Artificial Sequence
  Synthetic Construct
gcagcttttcctggtgtctttc

SEQ ID NO: 709 - DNA, 25 bp, Artificial Sequence
  Synthetic Construct
ggggtggttaagtatgggctagcaa

SEQ ID NO: 710 - DNA, 25 bp, Artificial Sequence
  Synthetic Construct
agtgagcatacagcttctcagaaat

SEQ ID NO: 711 - DNA, 25 bp, Artificial Sequence
  Synthetic Construct
ggatctaagcagtgcatctctgtgt

SEQ ID NO: 712 - DNA, 21 bp, Artificial Sequence
  Synthetic Construct
ggtgactgtgcacgcgttaat

SEQ ID NO: 713 - DNA, 22 bp, Artificial Sequence
  Synthetic Construct
gctcaagtactccctggcttct

SEQ ID NO: 714 - DNA, 27 bp, Artificial Sequence
  Synthetic Construct
caggatcttctttgtttgaaggagctt

SEQ ID NO: 715 - DNA, 21 bp, Artificial Sequence
  Synthetic Construct
ggcagacaaatcagcccagtt

SEQ ID NO: 716 - DNA, 21 bp, Artificial Sequence
  Synthetic Construct
gtcattgaactgcgcttgcat

SEQ ID NO: 717 - DNA, 24 bp, Artificial Sequence
  Synthetic Construct
gggactacagataagcaccactgt

SEQ ID NO: 718 - DNA, 22 bp, Artificial Sequence
  Synthetic Construct
caaagaggccctcatgctcagt

SEQ ID NO: 719 - DNA, 22 bp, Artificial Sequence
  Synthetic Construct
ttggtcctacaaccaagcaagt

SEQ ID NO: 720 - DNA, 25 bp, Artificial Sequence
  Synthetic Construct
gccagagatgaatggtttgcgaatg

SEQ ID NO: 721 - DNA, 24 bp, Artificial Sequence
  Synthetic Construct
cctgtgctatagaatcagcactct

SEQ ID NO: 722 - DNA, 22 bp, Artificial Sequence
  Synthetic Construct
tgtgtgttgtggagagggagat

SEQ ID NO: 723 - DNA, 26 bp, Artificial Sequence
  Synthetic Construct
gaagctccttacattagtgccaggtt

SEQ ID NO: 724 - DNA, 25 bp, Artificial Sequence
  Synthetic Construct
tgcactcagaggagaagttaaaaca

SEQ ID NO: 725 - DNA, 27 bp, Artificial Sequence
  Synthetic Construct
ggatcaaagttcaaggagttagtgtga

SEQ ID NO: 726 - DNA, 22 bp, Artificial Sequence
  Synthetic Construct
cgccaccagcatttgagtcttg

SEQ ID NO: 727 - DNA, 19 bp, Artificial Sequence
  Synthetic Construct
ccggccaagaaggtagcaa

SEQ ID NO: 728 - DNA, 21 bp, Artificial Sequence
  Synthetic Construct
gggctttctggccgagatgaa

SEQ ID NO: 729 - DNA, 20 bp, Artificial Sequence
  Synthetic Construct
gccacaggttggaggcaaga

SEQ ID NO: 730 - DNA, 21 bp, Artificial Sequence
  Synthetic Construct
agtgccctgctcaaccaatac

SEQ ID NO: 731 - DNA, 24 bp, Artificial Sequence
  Synthetic Construct
tccctcttgtttccaggtttttgt

SEQ ID NO: 732 - DNA, 20 bp, Artificial Sequence
  Synthetic Construct
ggaggctccatccacagtca

SEQ ID NO: 733 - DNA, 24 bp, Artificial Sequence
  Synthetic Construct
gggcaaatctgtgtcctccagata

SEQ ID NO: 734 - DNA, 24 bp, Artificial Sequence
  Synthetic Construct
gggttacaggttgactctgggatt

SEQ ID NO: 735 - DNA, 21 bp, Artificial Sequence
  Synthetic Construct
cctagcctacaagcgcactct

SEQ ID NO: 736 - DNA, 23 bp, Artificial Sequence
  Synthetic Construct
gagtactgaggcagggaaggttt

SEQ ID NO: 737 - DNA, 26 bp, Artificial Sequence
  Synthetic Construct
ccaatgagttgtagagctcagattgt

SEQ ID NO: 738 - DNA, 22 bp, Artificial Sequence
  Synthetic Construct
gaggggtgctagtcaactgtgt

SEQ ID NO: 739 - DNA, 20 bp, Artificial Sequence
  Synthetic Construct
aatgccaagccaccctggaa

SEQ ID NO: 740 - DNA, 22 bp, Artificial Sequence
  Synthetic Construct
aggaacccacagcggtaactga

SEQ ID NO: 741 - DNA, 19 bp, Artificial Sequence
  Synthetic Construct
tgcgagctgagtgcagcat

SEQ ID NO: 742 - DNA, 26 bp, Artificial Sequence
  Synthetic Construct
ctccaagtccaggatatatgaagcaa

SEQ ID NO: 743 - DNA, 24 bp, Artificial Sequence
  Synthetic Construct
gcacagaaataatcgtgcaggaaa

SEQ ID NO: 744 - DNA, 24 bp, Artificial Sequence
  Synthetic Construct
gggagcaaacctcttaggaagaca

SEQ ID NO: 745 - DNA, 24 bp, Artificial Sequence
  Synthetic Construct
tttggggttttgggatgaggataa

SEQ ID NO: 746 - DNA, 21 bp, Artificial Sequence
  Synthetic Construct
ttcctccgcccaaccgtcttt

SEQ ID NO: 747 - DNA, 23 bp, Artificial Sequence
  Synthetic Construct
gctaccctgaagtgctgatggat

SEQ ID NO: 748 - DNA, 26 bp, Artificial Sequence
  Synthetic Construct
cttgatctgtcaagggagaagagaga

SEQ ID NO: 749 - DNA, 23 bp, Artificial Sequence
  Synthetic Construct
gcaaagggagtgatgggagatga

SEQ ID NO: 750 - DNA, 20 bp, Artificial Sequence
  Synthetic Construct
ccgactcttggtgggttgaa

SEQ ID NO: 751 - DNA, 24 bp, Artificial Sequence
  Synthetic Construct
tgtgttcctagagactctggcttt

SEQ ID NO: 752 - DNA, 22 bp, Artificial Sequence
  Synthetic Construct
accagctgtgtgagctaagttg

SEQ ID NO: 753 - DNA, 22 bp, Artificial Sequence
  Synthetic Construct
ttgcctttccctgtctttggaa

SEQ ID NO: 754 - DNA, 22 bp, Artificial Sequence
  Synthetic Construct
gcaggactaacaatggctcaga

SEQ ID NO: 755 - DNA, 19 bp, Artificial Sequence
  Synthetic Construct
caggagccacctgggaact

SEQ ID NO: 756 - DNA, 24 bp, Artificial Sequence
  Synthetic Construct
tggagaagagcaaatccatgttgt

SEQ ID NO: 757 - DNA, 24 bp, Artificial Sequence
  Synthetic Construct
ccaggacccagaagtactccctat

SEQ ID NO: 758 - DNA, 22 bp, Artificial Sequence
  Synthetic Construct
cctaccatatgcaaggcaccat

SEQ ID NO: 759 - DNA, 22 bp, Artificial Sequence
  Synthetic Construct
agaagtccaggcttcccacttg

SEQ ID NO: 760 - DNA, 26 bp, Artificial Sequence
  Synthetic Construct
gggcttgttaaatgaacccgagaagt

SEQ ID NO: 761 - DNA, 25 bp, Artificial Sequence
  Synthetic Construct
gccacagtaaaacaaagtacacagt

SEQ ID NO: 762 - DNA, 23 bp, Artificial Sequence
  Synthetic Construct
tgtgcagtgaatgcagagactat

SEQ ID NO: 763 - DNA, 24 bp, Artificial Sequence
  Synthetic Construct
ctcacaagcctagaagggtatgtt

SEQ ID NO: 764 - DNA, 22 bp, Artificial Sequence
  Synthetic Construct
atgggacacctccctgctgagt

SEQ ID NO: 765 - DNA, 25 bp, Artificial Sequence
  Synthetic Construct
ggtgtagcagggagagagattggtt

SEQ ID NO: 766 - DNA, 22 bp, Artificial Sequence
  Synthetic Construct
ggccttgttgcctctccactta

SEQ ID NO: 767 - DNA, 25 bp, Artificial Sequence
  Synthetic Construct
cacttcatagtgtcaccctggttgt

SEQ ID NO: 768 - DNA, 22 bp, Artificial Sequence
  Synthetic Construct
agaagctgctttctgcttgtca

SEQ ID NO: 769 - DNA, 25 bp, Artificial Sequence
  Synthetic Construct
gattgtttgtgctccagaaagaaga

SEQ ID NO: 770 - DNA, 22 bp, Artificial Sequence
  Synthetic Construct
gaacagttggcgataggctgaa

SEQ ID NO: 771 - DNA, 22 bp, Artificial Sequence
  Synthetic Construct
ggccctatactgccttcagaga

SEQ ID NO: 772 - DNA, 26 bp, Artificial Sequence
  Synthetic Construct
cacaggtgatagcaacaacctaccat

SEQ ID NO: 773 - DNA, 24 bp, Artificial Sequence
  Synthetic Construct
ccttgggtggaacctgtgattcaa

SEQ ID NO: 774 - DNA, 21 bp, Artificial Sequence
  Synthetic Construct
aggcaccatgctcagctccta

SEQ ID NO: 775 - DNA, 22 bp, Artificial Sequence
  Synthetic Construct
gctcaaagccttggggttctac

SEQ ID NO: 776 - DNA, 21 bp, Artificial Sequence
  Synthetic Construct
gctccaatgtcagtcccttca

SEQ ID NO: 777 - DNA, 22 bp, Artificial Sequence
  Synthetic Construct
gctggagttccaggttggactt

SEQ ID NO: 778 - DNA, 19 bp, Artificial Sequence
  Synthetic Construct
gggcaccccaccattggaa

SEQ ID NO: 779 - DNA, 22 bp, Artificial Sequence
  Synthetic Construct
gccagtctgtggtgttcattgt

SEQ ID NO: 780 - DNA, 21 bp, Artificial Sequence
  Synthetic Construct
caccctgggaagctgactgta

SEQ ID NO: 781 - DNA, 22 bp, Artificial Sequence
  Synthetic Construct
gtggcatctgaggtgagctttg

SEQ ID NO: 782 - DNA, 24 bp, Artificial Sequence
  Synthetic Construct
gccggtagttgtgacaataggaaa

SEQ ID NO: 783 - DNA, 25 bp, Artificial Sequence
  Synthetic Construct
gggcgtacttcctttttcattctac

SEQ ID NO: 784 - DNA, 22 bp, Artificial Sequence
  Synthetic Construct
tctaggctggactggacaccaa

SEQ ID NO: 785 - DNA, 26 bp, Artificial Sequence
  Synthetic Construct
gagtttcctgttctgggtatgggttt

SEQ ID NO: 786 - DNA, 22 bp, Artificial Sequence
  Synthetic Construct
gagacacctggaaggacgaaca

SEQ ID NO: 787 - DNA, 23 bp, Artificial Sequence
  Synthetic Construct
gcttgcctgagaaatgcctgtga

SEQ ID NO: 788 - DNA, 20 bp, Artificial Sequence
  Synthetic Construct
cccacacacaactgctcaca

SEQ ID NO: 789 - DNA, 19 bp, Artificial Sequence
  Synthetic Construct
tggcaggacaaggggtttg

SEQ ID NO: 790 - DNA, 24 bp, Artificial Sequence
  Synthetic Construct
cctattcccatggagccattgttg

SEQ ID NO: 791 - DNA, 20 bp, Artificial Sequence
  Synthetic Construct
accttgctgagggagcagta

SEQ ID NO: 792 - DNA, 23 bp, Artificial Sequence
  Synthetic Construct
caaggcagatgggagaagagcaa

SEQ ID NO: 793 - DNA, 19 bp, Artificial Sequence
  Synthetic Construct
ccaccttccagccccttga

SEQ ID NO: 794 - DNA, 20 bp, Artificial Sequence
  Synthetic Construct
gcaacatcctggggcacaga

SEQ ID NO: 795 - DNA, 20 bp, Artificial Sequence
  Synthetic Construct
tcccaacacaggtggctaga

SEQ ID NO: 796 - DNA, 26 bp, Artificial Sequence
  Synthetic Construct
ggagtggatgcagaagtgtttctttc

SEQ ID NO: 797 - DNA, 24 bp, Artificial Sequence
  Synthetic Construct
gtacactagcaagtaccggtgaga

SEQ ID NO: 798 - DNA, 20 bp, Artificial Sequence
  Synthetic Construct
tgaggcttgtttccgcatgt

SEQ ID NO: 799 - DNA, 26 bp, Artificial Sequence
  Synthetic Construct
actggactacactggactactttgat

SEQ ID NO: 800 - DNA, 22 bp, Artificial Sequence
  Synthetic Construct
ccaagagcccacctgattctct

SEQ ID NO: 801 - DNA, 22 bp, Artificial Sequence
  Synthetic Construct
tgataggcaaacagcagacagt

SEQ ID NO: 802 - DNA, 20 bp, Artificial Sequence
  Synthetic Construct
cccgcgttacaatgcaactt

SEQ ID NO: 803 - DNA, 24 bp, Artificial Sequence
  Synthetic Construct
cacttccaaaaggcagctacaatc

SEQ ID NO: 804 - DNA, 20 bp, Artificial Sequence
  Synthetic Construct
tgcctggtgatcctccatca

SEQ ID NO: 805 - DNA, 23 bp, Artificial Sequence
  Synthetic Construct
gctgcaaacgagaagtaaagcat

SEQ ID NO: 806 - DNA, 21 bp, Artificial Sequence
  Synthetic Construct
gccctatgcacattggcttgt

SEQ ID NO: 807 - DNA, 21 bp, Artificial Sequence
  Synthetic Construct
aaggactgagcaatggctgtt

SEQ ID NO: 808 - DNA, 20 bp, Artificial Sequence
  Synthetic Construct
ggccgcagagcctcaacttt

SEQ ID NO: 809 - DNA, 26 bp, Artificial Sequence
  Synthetic Construct
ggagtctgcagtttgaggtttatatg

SEQ ID NO: 810 - DNA, 24 bp, Artificial Sequence
  Synthetic Construct
cctgtttcaggattaagggcttct

SEQ ID NO: 811 - DNA, 21 bp, Artificial Sequence
  Synthetic Construct
agctttggggtccctcagtat

SEQ ID NO: 812 - DNA, 23 bp, Artificial Sequence
  Synthetic Construct
agatcaaatcaccccagctttgt

SEQ ID NO: 813 - DNA, 21 bp, Artificial Sequence
  Synthetic Construct
cacacatgtccctgcagtttg

SEQ ID NO: 814 - DNA, 21 bp, Artificial Sequence
  Synthetic Construct
gcgtctgactcatgtcctgtt

SEQ ID NO: 815 - DNA, 22 bp, Artificial Sequence
  Synthetic Construct
ccggcttctttaccccacttag

SEQ ID NO: 816 - DNA, 19 bp, Artificial Sequence
  Synthetic Construct
caccccagaccccaagttc

SEQ ID NO: 817 - DNA, 20 bp, Artificial Sequence
  Synthetic Construct
agcctgtctgccacctgaaa

SEQ ID NO: 818 - DNA, 19 bp, Artificial Sequence
  Synthetic Construct
ggagcagagcgaccgtcat

SEQ ID NO: 819 - DNA, 24 bp, Artificial Sequence
  Synthetic Construct
gcactggactagtattcgggagat

SEQ ID NO: 820 - DNA, 23 bp, Artificial Sequence
  Synthetic Construct
ctcttctggcacaaggtgtgtct

SEQ ID NO: 821 - DNA, 23 bp, Artificial Sequence
  Synthetic Construct
caccagcaaagagggaagttaga

SEQ ID NO: 822 - DNA, 24 bp, Artificial Sequence
  Synthetic Construct
gatgtcaacgtactgactccaaca

SEQ ID NO: 823 - DNA, 21 bp, Artificial Sequence
  Synthetic Construct
ccaccagcttcattggtctct

SEQ ID NO: 824 - DNA, 24 bp, Artificial Sequence
  Synthetic Construct
gggatggttatcatgcccctcttc

SEQ ID NO: 825 - DNA, 23 bp, Artificial Sequence
  Synthetic Construct
ggttctagatcccgctctcttct

SEQ ID NO: 826 - DNA, 24 bp, Artificial Sequence
  Synthetic Construct
ctctggtacctgaaccttcccatt

SEQ ID NO: 827 - DNA, 21 bp, Artificial Sequence
  Synthetic Construct
tgcttcgaggagaggtagtga

SEQ ID NO: 828 - DNA, 21 bp, Artificial Sequence
  Synthetic Construct
gcacttgactcacagggagaa

SEQ ID NO: 829 - DNA, 22 bp, Artificial Sequence
  Synthetic Construct
gttatggcagctgacaccagta

SEQ ID NO: 830 - DNA, 23 bp, Artificial Sequence
  Synthetic Construct
gtcacagattcagggagaagcaa

SEQ ID NO: 831 - DNA, 22 bp, Artificial Sequence
  Synthetic Construct
cagccttttccctaggcaatgt

SEQ ID NO: 832 - DNA, 25 bp, Artificial Sequence
  Synthetic Construct
gctctggctactgctattggtgtga

SEQ ID NO: 833 - DNA, 23 bp, Artificial Sequence
  Synthetic Construct
acacaaagagttcgatggccttt

SEQ ID NO: 834 - DNA, 23 bp, Artificial Sequence
  Synthetic Construct
tgtttccagacaagccaacaagt

SEQ ID NO: 835 - DNA, 23 bp, Artificial Sequence
  Synthetic Construct
ggcagagcagcttctttccatct

SEQ ID NO: 836 - DNA, 19 bp, Artificial Sequence
  Synthetic Construct
gtccagcctcggagcaaaa

SEQ ID NO: 837 - DNA, 24 bp, Artificial Sequence
  Synthetic Construct
tcactatgaaccctaccaccacta

SEQ ID NO: 838 - DNA, 21 bp, Artificial Sequence
  Synthetic Construct
cccctgccttcctggtagtaa

SEQ ID NO: 839 - DNA, 19 bp, Artificial Sequence
  Synthetic Construct
aaggcgaccctccggaaca

SEQ ID NO: 840 - DNA, 20 bp, Artificial Sequence
  Synthetic Construct
aggcggagctctaagcacta

SEQ ID NO: 841 - DNA, 24 bp, Artificial Sequence
  Synthetic Construct
atgagctctgcagtcattgaattg

SEQ ID NO: 842 - DNA, 20 bp, Artificial Sequence
  Synthetic Construct
ctggctgctatgcactcaga

SEQ ID NO: 843 - DNA, 23 bp, Artificial Sequence
  Synthetic Construct
gcttcgtgcttttacctgactgt

SEQ ID NO: 844 - DNA, 22 bp, Artificial Sequence
  Synthetic Construct
ccaaggacagacctcccagaga

SEQ ID NO: 845 - DNA, 27 bp, Artificial Sequence
  Synthetic Construct
ggggttacttaccggtcagacaaattc

SEQ ID NO: 846 - DNA, 24 bp, Artificial Sequence
  Synthetic Construct
gcagaagcatcactgcgtaatatc

SEQ ID NO: 847 - DNA, 23 bp, Artificial Sequence
  Synthetic Construct
accatcctccccatctcagtaaa

SEQ ID NO: 848 - DNA, 26 bp, Artificial Sequence
  Synthetic Construct
cgtctccatttctgtatccctctcaa

SEQ ID NO: 849 - DNA, 23 bp, Artificial Sequence
  Synthetic Construct
gtggggtaacggtttaggagttg

SEQ ID NO: 850 - DNA, 25 bp, Artificial Sequence
  Synthetic Construct
ccttaattactgccgattgcctgtt

SEQ ID NO: 851 - DNA, 23 bp, Artificial Sequence
  Synthetic Construct
agcctggagaacaaaaggtgaaa

SEQ ID NO: 852 - DNA, 20 bp, Artificial Sequence
  Synthetic Construct
cgaggcaatttcccctgcaa

SEQ ID NO: 853 - DNA, 22 bp, Artificial Sequence
  Synthetic Construct
gaggtgacatgcctgttgtcat

SEQ ID NO: 854 - DNA, 26 bp, Artificial Sequence
  Synthetic Construct
gcccttctagtgaatgtttgggttca

SEQ ID NO: 855 - DNA, 23 bp, Artificial Sequence
  Synthetic Construct
ccaacaatctctgtgcctctact

SEQ ID NO: 856 - DNA, 23 bp, Artificial Sequence
  Synthetic Construct
ccctgcctaaaggtctccaaaac

SEQ ID NO: 857 - DNA, 21 bp, Artificial Sequence
  Synthetic Construct
tgagggctatcctcgaccttt

SEQ ID NO: 858 - DNA, 25 bp, Artificial Sequence
  Synthetic Construct
gtggtagctactgaatcagccctat

SEQ ID NO: 859 - DNA, 21 bp, Artificial Sequence
  Synthetic Construct
tccaggtgaaagcaggtcaag

SEQ ID NO: 860 - DNA, 24 bp, Artificial Sequence
  Synthetic Construct
gcagataaagcaaaagggtgactt

SEQ ID NO: 861 - DNA, 22 bp, Artificial Sequence
  Synthetic Construct
tccaggtcactgcctcatagat

SEQ ID NO: 862 - DNA, 21 bp, Artificial Sequence
  Synthetic Construct
tgtgggaggagaggtcaccat

SEQ ID NO: 863 - DNA, 20 bp, Artificial Sequence
  Synthetic Construct
agggcctagcggtcaacatt

SEQ ID NO: 864 - DNA, 25 bp, Artificial Sequence
  Synthetic Construct
gggcaacagaagtaacatccattag

SEQ ID NO: 865 - DNA, 22 bp, Artificial Sequence
  Synthetic Construct
tctgctacagtctttgcgttca

SEQ ID NO: 866 - DNA, 22 bp, Artificial Sequence
  Synthetic Construct
tgaccttttcagcttccgttgt

SEQ ID NO: 867 - DNA, 20 bp, Artificial Sequence
  Synthetic Construct
tggaggaccaaagccctcat

SEQ ID NO: 868 - DNA, 23 bp, Artificial Sequence
  Synthetic Construct
gtgacacctctgcctttgcatgt

SEQ ID NO: 869 - DNA, 23 bp, Artificial Sequence
  Synthetic Construct
tctgggatttgagcatggaactt

SEQ ID NO: 870 - DNA, 24 bp, Artificial Sequence
  Synthetic Construct
gaccgtctactaacagcaccaagt

SEQ ID NO: 871 - DNA, 23 bp, Artificial Sequence
  Synthetic Construct
ggtgtaagactaggctccctcta

SEQ ID NO: 872 - DNA, 22 bp, Artificial Sequence
  Synthetic Construct
ggggcgtagtgaatctccaatg

SEQ ID NO: 873 - DNA, 21 bp, Artificial Sequence
  Synthetic Construct
accaccacactccccttctct

SEQ ID NO: 874 - DNA, 27 bp, Artificial Sequence
  Synthetic Construct
gagaggtcaaagacaggagactgaatc

SEQ ID NO: 875 - DNA, 23 bp, Artificial Sequence
  Synthetic Construct
ggcataggtgacatgccatcaga

SEQ ID NO: 876 - DNA, 24 bp, Artificial Sequence
  Synthetic Construct
cagacaatggaactacgcctgcat

SEQ ID NO: 877 - DNA, 25 bp, Artificial Sequence
  Synthetic Construct
cgcctgagcttagacttcacctaca

SEQ ID NO: 878 - DNA, 21 bp, Artificial Sequence
  Synthetic Construct
tccccacctggagcccaaaat

SEQ ID NO: 879 - DNA, 22 bp, Artificial Sequence
  Synthetic Construct
ctgtccagacttgtccccaaga

SEQ ID NO: 880 - DNA, 22 bp, Artificial Sequence
  Synthetic Construct
aggagacagtgcaagcttttgt

SEQ ID NO: 881 - DNA, 23 bp, Artificial Sequence
  Synthetic Construct
tggactcactgttctccaagtga

SEQ ID NO: 882 - DNA, 22 bp, Artificial Sequence
  Synthetic Construct
gccctggtgaatgcacattttg

SEQ ID NO: 883 - DNA, 20 bp, Artificial Sequence
  Synthetic Construct
tggcatcgaggatggcatga

SEQ ID NO: 884 - DNA, 24 bp, Artificial Sequence
  Synthetic Construct
tcctgtttgttatgggaaccaagt

SEQ ID NO: 885 - DNA, 22 bp, Artificial Sequence
  Synthetic Construct
gcatccagcccaaatcctcact

SEQ ID NO: 886 - DNA, 21 bp, Artificial Sequence
  Synthetic Construct
tcctccctgagaccacagctt

SEQ ID NO: 887 - DNA, 24 bp, Artificial Sequence
  Synthetic Construct
ccatcacccatttacccctacttg

SEQ ID NO: 888 - DNA, 20 bp, Artificial Sequence
  Synthetic Construct
actggctgtcaggcttgctt

SEQ ID NO: 889 - DNA, 25 bp, Artificial Sequence
  Synthetic Construct
gcacgagatgaactaagacaccatt

SEQ ID NO: 890 - DNA, 25 bp, Artificial Sequence
  Synthetic Construct
gagggaatggtacctggattagcaa

SEQ ID NO: 891 - DNA, 24 bp, Artificial Sequence
  Synthetic Construct
tgccacttcacccatactgaattt

SEQ ID NO: 892 - DNA, 22 bp, Artificial Sequence
  Synthetic Construct
cacactgccacctgcttgagta

SEQ ID NO: 893 - DNA, 22 bp, Artificial Sequence
  Synthetic Construct
tgatgagtggaagcccatgttg

SEQ ID NO: 894 - DNA, 23 bp, Artificial Sequence
  Synthetic Construct
tgctcatcatggctatgctttct

SEQ ID NO: 895 - DNA, 22 bp, Artificial Sequence
  Synthetic Construct
gctgatccagagatggacacaa

SEQ ID NO: 896 - DNA, 21 bp, Artificial Sequence
  Synthetic Construct
gcagtgctgtctatgccaatg

SEQ ID NO: 897 - DNA, 24 bp, Artificial Sequence
  Synthetic Construct
gccagatgtggagttaacaagtca

SEQ ID NO: 898 - DNA, 25 bp, Artificial Sequence
  Synthetic Construct
tgacttaacaggtgacctagacaca

SEQ ID NO: 899 - DNA, 19 bp, Artificial Sequence
  Synthetic Construct
ccttggaggccagcaacaa

SEQ ID NO: 900 - DNA, 26 bp, Artificial Sequence
  Synthetic Construct
gaggcactgattcattcaacaggatt

SEQ ID NO: 901 - DNA, 24 bp, Artificial Sequence
  Synthetic Construct
cccatgggtaaactgctgtaagta

SEQ ID NO: 902 - DNA, 22 bp, Artificial Sequence
  Synthetic Construct
caggcctcaaaacacgaagaag

SEQ ID NO: 903 - DNA, 23 bp, Artificial Sequence
  Synthetic Construct
ggggagaagtgtcaccagattca

SEQ ID NO: 904 - DNA, 24 bp, Artificial Sequence
  Synthetic Construct
gcgggttaggaagattccctgaag

SEQ ID NO: 905 - DNA, 24 bp, Artificial Sequence
  Synthetic Construct
cttcctcacccgtccttaataaca

SEQ ID NO: 906 - DNA, 23 bp, Artificial Sequence
  Synthetic Construct
ggtgctttcctttccaccgaagt

SEQ ID NO: 907 - DNA, 23 bp, Artificial Sequence
  Synthetic Construct
gggaggaacagtgatctgagcat

SEQ ID NO: 908 - DNA, 27 bp, Artificial Sequence
  Synthetic Construct
gagaattaaacagggctttgagggatt

SEQ ID NO: 909 - DNA, 22 bp, Artificial Sequence
  Synthetic Construct
caccgagcactcgggtgaataa

SEQ ID NO: 910 - DNA, 24 bp, Artificial Sequence
  Synthetic Construct
ttgatggctcccatgtaagtttga

SEQ ID NO: 911 - DNA, 23 bp, Artificial Sequence
  Synthetic Construct
cgaagaagcaagaccgcagtaac

SEQ ID NO: 912 - DNA, 23 bp, Artificial Sequence
  Synthetic Construct
ctctggggaatgcctaacaatga

SEQ ID NO: 913 - DNA, 22 bp, Artificial Sequence
  Synthetic Construct
cagcaatgaggccagcgtagtt

SEQ ID NO: 914 - DNA, 28 bp, Artificial Sequence
  Synthetic Construct
ccctatccagaaagaaaaagccaagtga

SEQ ID NO: 915 - DNA, 23 bp, Artificial Sequence
  Synthetic Construct
ccttcctgcaagtcaaggactca

SEQ ID NO: 916 - DNA, 22 bp, Artificial Sequence
  Synthetic Construct
gccgtaggtagttccatgctaa

SEQ ID NO: 917 - DNA, 22 bp, Artificial Sequence
  Synthetic Construct
catcctcttgccgtgtgtgact

SEQ ID NO: 918 - DNA, 22 bp, Artificial Sequence
  Synthetic Construct
caagtagcgttcatcccaggaa

SEQ ID NO: 919 - DNA, 22 bp, Artificial Sequence
  Synthetic Construct
gcccctgaaattggaagcaaat

SEQ ID NO: 920 - DNA, 21 bp, Artificial Sequence
  Synthetic Construct
gccacaggtcgccttctgaac

SEQ ID NO: 921 - DNA, 26 bp, Artificial Sequence
  Synthetic Construct
ggcaacactctgtacaactccttact

SEQ ID NO: 922 - DNA, 23 bp, Artificial Sequence
  Synthetic Construct
aggcccttcaagaagttgaaaca

SEQ ID NO: 923 - DNA, 23 bp, Artificial Sequence
  Synthetic Construct
cccgtgtagccaagagactgaag

SEQ ID NO: 924 - DNA, 21 bp, Artificial Sequence
  Synthetic Construct
tgtgtggtacaggcccgatct

SEQ ID NO: 925 - DNA, 22 bp, Artificial Sequence
  Synthetic Construct
gctctcaaggactttgcagtct

SEQ ID NO: 926 - DNA, 22 bp, Artificial Sequence
  Synthetic Construct
gagggaggtgctttgctgtcaa

SEQ ID NO: 927 - DNA, 23 bp, Artificial Sequence
  Synthetic Construct
ggctctgtgaggatggagagagt

SEQ ID NO: 928 - DNA, 22 bp, Artificial Sequence
  Synthetic Construct
gccaggggaagtggtgtttaag

SEQ ID NO: 929 - DNA, 24 bp, Artificial Sequence
  Synthetic Construct
gtagactccacaccttcctacctt

SEQ ID NO: 930 - DNA, 25 bp, Artificial Sequence
  Synthetic Construct
tctcctggaaatgtgaacaggattg

SEQ ID NO: 931 - DNA, 20 bp, Artificial Sequence
  Synthetic Construct
ctcgctgcatctgagtgagt

SEQ ID NO: 932 - DNA, 21 bp, Artificial Sequence
  Synthetic Construct
tcggatgcttcctgggcaaag

SEQ ID NO: 933 - DNA, 19 bp, Artificial Sequence
  Synthetic Construct
caaccgctcaggctgtgaa

SEQ ID NO: 934 - DNA, 24 bp, Artificial Sequence
  Synthetic Construct
gatgataagcctgtccctgagatg

SEQ ID NO: 935 - DNA, 24 bp, Artificial Sequence
  Synthetic Construct
caggagggagaaagctttggaaga

SEQ ID NO: 936 - DNA, 27 bp, Artificial Sequence
  Synthetic Construct
catccgtctcttcactagctgttaaat

SEQ ID NO: 937 - DNA, 21 bp, Artificial Sequence
  Synthetic Construct
gtccctctgcttcctgccata

SEQ ID NO: 938 - DNA, 22 bp, Artificial Sequence
  Synthetic Construct
gctgtactcctgggtgacattc

SEQ ID NO: 939 - DNA, 22 bp, Artificial Sequence
  Synthetic Construct
agccctctgattccaggtaaga

SEQ ID NO: 940 - DNA, 22 bp, Artificial Sequence
  Synthetic Construct
tcgatggcagagacaaatgaca

SEQ ID NO: 941 - DNA, 22 bp, Artificial Sequence
  Synthetic Construct
cagggtcacacactcgggtatt

SEQ ID NO: 942 - DNA, 22 bp, Artificial Sequence
  Synthetic Construct
ctccagcagacagcatgcaaac

SEQ ID NO: 943 - DNA, 24 bp, Artificial Sequence
  Synthetic Construct
gcacacctgaaggtcaaacgaaca

SEQ ID NO: 944 - DNA, 24 bp, Artificial Sequence
  Synthetic Construct
gttgatggtcgcattccagatgta

SEQ ID NO: 945 - DNA, 20 bp, Artificial Sequence
  Synthetic Construct
tgtggcctggctcagacata

SEQ ID NO: 946 - DNA, 20 bp, Artificial Sequence
  Synthetic Construct
ttgcggccactgtcactact

SEQ ID NO: 947 - DNA, 25 bp, Artificial Sequence
  Synthetic Construct
caaatcctttgtgggtgttaagtgt

SEQ ID NO: 948 - DNA, 21 bp, Artificial Sequence
  Synthetic Construct
tgccctgatggataggtggat

SEQ ID NO: 949 - DNA, 22 bp, Artificial Sequence
  Synthetic Construct
agagctccaggctcatccctat

SEQ ID NO: 950 - DNA, 24 bp, Artificial Sequence
  Synthetic Construct
cagagtcccttggatctgttctca

SEQ ID NO: 951 - DNA, 19 bp, Artificial Sequence
  Synthetic Construct
ctggggcaggaccaggaaa

SEQ ID NO: 952 - DNA, 22 bp, Artificial Sequence
  Synthetic Construct
cagtggagcttgctggttgact

SEQ ID NO: 953 - DNA, 26 bp, Artificial Sequence
  Synthetic Construct
gggtaccttctctcaaagcagcatct

SEQ ID NO: 954 - DNA, 20 bp, Artificial Sequence
  Synthetic Construct
catccagcaccatggcatct

SEQ ID NO: 955 - DNA, 19 bp, Artificial Sequence
  Synthetic Construct
tggcagagactggcaggaa

SEQ ID NO: 956 - DNA, 23 bp, Artificial Sequence
  Synthetic Construct
ttcctgaagggttgtaccagttg

SEQ ID NO: 957 - DNA, 21 bp, Artificial Sequence
  Synthetic Construct
agggccctgctgaacactgaa

SEQ ID NO: 958 - DNA, 21 bp, Artificial Sequence
  Synthetic Construct
catctccagacggtggtgttc

SEQ ID NO: 959 - DNA, 22 bp, Artificial Sequence
  Synthetic Construct
cttggcttgggactgtctctct

SEQ ID NO: 960 - DNA, 19 bp, Artificial Sequence
  Synthetic Construct
actggcacagcccaggatt

SEQ ID NO: 961 - DNA, 23 bp, Artificial Sequence
  Synthetic Construct
caggacttctggaaacccactgt

SEQ ID NO: 962 - DNA, 22 bp, Artificial Sequence
  Synthetic Construct
catccctgcgcctaactctaag

SEQ ID NO: 963 - DNA, 19 bp, Artificial Sequence
  Synthetic Construct
tgcacatggcggctaaaca

SEQ ID NO: 964 - DNA, 24 bp, Artificial Sequence
  Synthetic Construct
ggagttcgcatggtacctccctta

SEQ ID NO: 965 - DNA, 20 bp, Artificial Sequence
  Synthetic Construct
agccatgccgattgcctctt

SEQ ID NO: 966 - DNA, 22 bp, Artificial Sequence
  Synthetic Construct
ttggtcttcaggtccggaggtt

SEQ ID NO: 967 - DNA, 22 bp, Artificial Sequence
  Synthetic Construct
ggcttttgttggaagcacagaa

SEQ ID NO: 968 - DNA, 19 bp, Artificial Sequence
  Synthetic Construct
ttgagtcgtggggctctct

SEQ ID NO: 969 - DNA, 20 bp, Artificial Sequence
  Synthetic Construct
tgtggatggccaggatgtgt

SEQ ID NO: 970 - DNA, 22 bp, Artificial Sequence
  Synthetic Construct
ccatgacagacacccagcatct

SEQ ID NO: 971 - DNA, 24 bp, Artificial Sequence
  Synthetic Construct
cctgcctcaaacagaggaactcta

SEQ ID NO: 972 - DNA, 23 bp, Artificial Sequence
  Synthetic Construct
cactgagcaatcatggcatttgt

SEQ ID NO: 973 - DNA, 22 bp, Artificial Sequence
  Synthetic Construct
tccatccctgtcccagctccta

SEQ ID NO: 974 - DNA, 22 bp, Artificial Sequence
  Synthetic Construct
ggaacagcagcctaagtcatgt

SEQ ID NO: 975 - DNA, 22 bp, Artificial Sequence
  Synthetic Construct
gtaagaaggaggcgtcggaatc

SEQ ID NO: 976 - DNA, 20 bp, Artificial Sequence
  Synthetic Construct
tgctgggtcttgcccaacat

SEQ ID NO: 977 - DNA, 21 bp, Artificial Sequence
  Synthetic Construct
gcctggagatcaagctgcaaa

SEQ ID NO: 978 - DNA, 25 bp, Artificial Sequence
  Synthetic Construct
caccagggtaggtatccaatactgt

SEQ ID NO: 979 - DNA, 22 bp, Artificial Sequence
  Synthetic Construct
gcaactgaatgcacgtgtgtga

SEQ ID NO: 980 - DNA, 23 bp, Artificial Sequence
  Synthetic Construct
ggaccttagagcaatgaccttca

SEQ ID NO: 981 - DNA, 26 bp, Artificial Sequence
  Synthetic Construct
ggagtaggtggaaacaaactgcttct

SEQ ID NO: 982 - DNA, 22 bp, Artificial Sequence
  Synthetic Construct
gaagcagtcagcagtgctcaga

SEQ ID NO: 983 - DNA, 22 bp, Artificial Sequence
  Synthetic Construct
gcagtctctcctcctccagcaa

SEQ ID NO: 984 - DNA, 25 bp, Artificial Sequence
  Synthetic Construct
gagctctacccaactcttggtccta

SEQ ID NO: 985 - DNA, 24 bp, Artificial Sequence
  Synthetic Construct
ccctgaagagctgaatcacagaca

SEQ ID NO: 986 - DNA, 25 bp, Artificial Sequence
  Synthetic Construct
aggaaggtgtaggaactgcaaatac

SEQ ID NO: 987 - DNA, 22 bp, Artificial Sequence
  Synthetic Construct
cctcaacatacgggctaccaaa

SEQ ID NO: 988 - DNA, 21 bp, Artificial Sequence
  Synthetic Construct
ggcaaggagttctgggagctt

SEQ ID NO: 989 - DNA, 21 bp, Artificial Sequence
  Synthetic Construct
ggtggagggtttggtgctatg

SEQ ID NO: 990 - DNA, 25 bp, Artificial Sequence
  Synthetic Construct
caaagcaaagaacctctacccatga

SEQ ID NO: 991 - DNA, 20 bp, Artificial Sequence
  Synthetic Construct
gccaaacagctctgcactga

SEQ ID NO: 992 - DNA, 23 bp, Artificial Sequence
  Synthetic Construct
gcagccaagaatgcacctgaaag

SEQ ID NO: 993 - DNA, 20 bp, Artificial Sequence
  Synthetic Construct
gggaaggagctctcgaccta

SEQ ID NO: 994 - DNA, 22 bp, Artificial Sequence
  Synthetic Construct
ctcccaagtcacctgcgtttgt

SEQ ID NO: 995 - DNA, 20 bp, Artificial Sequence
  Synthetic Construct
gccgtacaactgacgccaaa

SEQ ID NO: 996 - DNA, 21 bp, Artificial Sequence
  Synthetic Construct
gctcctcctccagctcaattt

SEQ ID NO: 997 - DNA, 20 bp, Artificial Sequence
  Synthetic Construct
ctcgggtgcttggattgtgt

SEQ ID NO: 998 - DNA, 22 bp, Artificial Sequence
  Synthetic Construct
tggttcctccgctccattctct

SEQ ID NO: 999 - DNA, 22 bp, Artificial Sequence
  Synthetic Construct
ctgtgtgtctggctgctgacat

SEQ ID NO: 1000 - DNA, 22 bp, Artificial Sequence
  Synthetic Construct
gttagcgtgggtggctctgaat

SEQ ID NO: 1001 - DNA, 20 bp, Artificial Sequence
  Synthetic Construct
gggcacttctgagtgcttga

SEQ ID NO: 1002 - DNA, 21 bp, Artificial Sequence
  Synthetic Construct
ctctctgttcccacccaccta

SEQ ID NO: 1003 - DNA, 24 bp, Artificial Sequence
  Synthetic Construct
gtctgaggagataaaccccacact

SEQ ID NO: 1004 - DNA, 27 bp, Artificial Sequence
  Synthetic Construct
ggaatgcatgggcataaattctgtctt

SEQ ID NO: 1005 - DNA, 28 bp, Artificial Sequence
  Synthetic Construct
gcaaggagcctattgttactaagagaga

SEQ ID NO: 1006 - DNA, 22 bp, Artificial Sequence
  Synthetic Construct
gggttgtgtggcaaatggaagt

SEQ ID NO: 1007 - DNA, 28 bp, Artificial Sequence
  Synthetic Construct
caggagcaggaggaggtagaattaatga

SEQ ID NO: 1008 - DNA, 24 bp, Artificial Sequence
  Synthetic Construct
ggccccagtgatgttttaggttca

SEQ ID NO: 1009 - DNA, 25 bp, Artificial Sequence
  Synthetic Construct
tgatttttccatcgtgatggtgttg

SEQ ID NO: 1010 - DNA, 22 bp, Artificial Sequence
  Synthetic Construct
gggagagcagtcacttggaaga

SEQ ID NO: 1011 - DNA, 24 bp, Artificial Sequence
  Synthetic Construct
cgtggctagggttgtactgtcgtt

SEQ ID NO: 1012 - DNA, 22 bp, Artificial Sequence
  Synthetic Construct
ccatgcgtgcaggggagaatta

SEQ ID NO: 1013 - DNA, 24 bp, Artificial Sequence
  Synthetic Construct
tgtgctcagtaagtgcttgttaga

SEQ ID NO: 1014 - DNA, 21 bp, Artificial Sequence
  Synthetic Construct
tggtgaaggccctgactcgat

SEQ ID NO: 1015 - DNA, 23 bp, Artificial Sequence
  Synthetic Construct
gggtccctctctaggccactttt

SEQ ID NO: 1016 - DNA, 27 bp, Artificial Sequence
  Synthetic Construct
ggaccttagattcgggagaaaatcact

SEQ ID NO: 1017 - DNA, 22 bp, Artificial Sequence
  Synthetic Construct
cctgaccatcctagctgcaagt

SEQ ID NO: 1018 - DNA, 21 bp, Artificial Sequence
  Synthetic Construct
ggcaggcagggtgtggatttt

SEQ ID NO: 1019 - DNA, 21 bp, Artificial Sequence
  Synthetic Construct
ctgtgccagtgacgaaagaca

SEQ ID NO: 1020 - DNA, 25 bp, Artificial Sequence
  Synthetic Construct
gatgtgaaggtgcaatgaagttaca

SEQ ID NO: 1021 - DNA, 20 bp, Artificial Sequence
  Synthetic Construct
ccccagtttggtgcttctca

SEQ ID NO: 1022 - DNA, 21 bp, Artificial Sequence
  Synthetic Construct
ggacaggaagcagctctcaca

SEQ ID NO: 1023 - DNA, 23 bp, Artificial Sequence
  Synthetic Construct
cggctcctgaactggaaggagat

SEQ ID NO: 1024 - DNA, 20 bp, Artificial Sequence
  Synthetic Construct
actcacggccctgaagcaaa

SEQ ID NO: 1025 - DNA, 24 bp, Artificial Sequence
  Synthetic Construct
caggagcaccaagactggtagatg

SEQ ID NO: 1026 - DNA, 22 bp, Artificial Sequence
  Synthetic Construct
ccctccaagtgtcaccaagcaa

SEQ ID NO: 1027 - DNA, 24 bp, Artificial Sequence
  Synthetic Construct
cagtgccatgtcagtttaccattg

SEQ ID NO: 1028 - DNA, 22 bp, Artificial Sequence
  Synthetic Construct
aaggactggacccacccactga

SEQ ID NO: 1029 - DNA, 23 bp, Artificial Sequence
  Synthetic Construct
cagagaaaagccccactcgttac

SEQ ID NO: 1030 - DNA, 22 bp, Artificial Sequence
  Synthetic Construct
cacatctgcctgatgcctgcta

SEQ ID NO: 1031 - DNA, 19 bp, Artificial Sequence
  Synthetic Construct
gggttatggtgggcagcaa

SEQ ID NO: 1032 - DNA, 24 bp, Artificial Sequence
  Synthetic Construct
acagagaaaatgaccctccaggaa

SEQ ID NO: 1033 - DNA, 24 bp, Artificial Sequence
  Synthetic Construct
ctggtgccctggttataggaagaa

SEQ ID NO: 1034 - DNA, 25 bp, Artificial Sequence
  Synthetic Construct
cctttcagcctatggcattggattt

SEQ ID NO: 1035 - DNA, 22 bp, Artificial Sequence
  Synthetic Construct
cagaggcagtttggaccctaca

SEQ ID NO: 1036 - DNA, 23 bp, Artificial Sequence
  Synthetic Construct
agcaaaaatagcctctgggacaa

SEQ ID NO: 1037 - DNA, 22 bp, Artificial Sequence
  Synthetic Construct
gcatttggagggctagggacaa

SEQ ID NO: 1038 - DNA, 23 bp, Artificial Sequence
  Synthetic Construct
gcaagggcaggtagggagaaaat

SEQ ID NO: 1039 - DNA, 23 bp, Artificial Sequence
  Synthetic Construct
cctcccagtggagtctgtgtttc

SEQ ID NO: 1040 - DNA, 19 bp, Artificial Sequence
  Synthetic Construct
gctgtcagccccacagatg

SEQ ID NO: 1041 - DNA, 22 bp, Artificial Sequence
  Synthetic Construct
gaggacgcatatggacccgaat

SEQ ID NO: 1042 - DNA, 26 bp, Artificial Sequence
  Synthetic Construct
gtctagaagctgtatccccagagtca

SEQ ID NO: 1043 - DNA, 21 bp, Artificial Sequence
  Synthetic Construct
cgcttccgtaagggagcatct

SEQ ID NO: 1044 - DNA, 22 bp, Artificial Sequence
  Synthetic Construct
cacggtcacaatgtttgtgcat

SEQ ID NO: 1045 - DNA, 24 bp, Artificial Sequence
  Synthetic Construct
gcccttggctacatttgaggttgt

SEQ ID NO: 1046 - DNA, 23 bp, Artificial Sequence
  Synthetic Construct
ggattggggtgttcagagcaaga

SEQ ID NO: 1047 - DNA, 20 bp, Artificial Sequence
  Synthetic Construct
aggagcgtgcgtgaatgtgt

SEQ ID NO: 1048 - DNA, 21 bp, Artificial Sequence
  Synthetic Construct
ggcactgagggactggaactt

SEQ ID NO: 1049 - DNA, 22 bp, Artificial Sequence
  Synthetic Construct
gagactttgaggcagactgtca

SEQ ID NO: 1050 - DNA, 26 bp, Artificial Sequence
  Synthetic Construct
ctggaagtcaggaaagtacagttcta

SEQ ID NO: 1051 - DNA, 22 bp, Artificial Sequence
  Synthetic Construct
ggttgtcctggttcgcagagtt

SEQ ID NO: 1052 - DNA, 23 bp, Artificial Sequence
  Synthetic Construct
gcctgatgggagaatcagaaact

SEQ ID NO: 1053 - DNA, 23 bp, Artificial Sequence
  Synthetic Construct
ggcaaatcaaagcctgccttttc

SEQ ID NO: 1054 - DNA, 22 bp, Artificial Sequence
  Synthetic Construct
agtgtgggccctacctgtgatt

SEQ ID NO: 1055 - DNA, 19 bp, Artificial Sequence
  Synthetic Construct
ttttgccgctgcccctgat

SEQ ID NO: 1056 - DNA, 22 bp, Artificial Sequence
  Synthetic Construct
ggactgtgttgggtgcaataac

SEQ ID NO: 1057 - DNA, 18 bp, Artificial Sequence
  Synthetic Construct
acccgatgccccatgact

SEQ ID NO: 1058 - DNA, 22 bp, Artificial Sequence
  Synthetic Construct
cccagtgaagccccacctttag

SEQ ID NO: 1059 - DNA, 22 bp, Artificial Sequence
  Synthetic Construct
gtggcagacaaggacagtgagt

SEQ ID NO: 1060 - DNA, 23 bp, Artificial Sequence
  Synthetic Construct
ccatggcaactccatgcttccaa

SEQ ID NO: 1061 - DNA, 24 bp, Artificial Sequence
  Synthetic Construct
gcttcccaggatacccacccatta

SEQ ID NO: 1062 - DNA, 21 bp, Artificial Sequence
  Synthetic Construct
gctgtctcggtcctcgttagt

SEQ ID NO: 1063 - DNA, 27 bp, Artificial Sequence
  Synthetic Construct
gagccgattttatatccatgcctgtag

SEQ ID NO: 1064 - DNA, 22 bp, Artificial Sequence
  Synthetic Construct
cccagaaacgagccatggaaag

SEQ ID NO: 1065 - DNA, 20 bp, Artificial Sequence
  Synthetic Construct
aggtcgccagagtgctgtga

SEQ ID NO: 1066 - DNA, 25 bp, Artificial Sequence
  Synthetic Construct
ccaaacccaattgcagctgtgtaac

SEQ ID NO: 1067 - DNA, 24 bp, Artificial Sequence
  Synthetic Construct
gctgccttcttgagctcctgattt

SEQ ID NO: 1068 - DNA, 23 bp, Artificial Sequence
  Synthetic Construct
cagcctagaggcagcaaaactgt

SEQ ID NO: 1069 - DNA, 24 bp, Artificial Sequence
  Synthetic Construct
gcaagtgtcaggtccctctagtca

SEQ ID NO: 1070 - DNA, 20 bp, Artificial Sequence
  Synthetic Construct
agccaactgagccaggaaca

SEQ ID NO: 1071 - DNA, 24 bp, Artificial Sequence
  Synthetic Construct
cctgcatgcttgggttaattcttg

SEQ ID NO: 1072 - DNA, 20 bp, Artificial Sequence
  Synthetic Construct
aaggggagctgtgtgtcctt

SEQ ID NO: 1073 - DNA, 22 bp, Artificial Sequence
  Synthetic Construct
ccaatcctacgacgggaccaaa

SEQ ID NO: 1074 - DNA, 21 bp, Artificial Sequence
  Synthetic Construct
tgctgattgcctgtgttgcta

SEQ ID NO: 1075 - DNA, 22 bp, Artificial Sequence
  Synthetic Construct
gggacactgacctgcaccaaaa

SEQ ID NO: 1076 - DNA, 25 bp, Artificial Sequence
  Synthetic Construct
ggacccttctaagccactgatctct

SEQ ID NO: 1077 - DNA, 22 bp, Artificial Sequence
  Synthetic Construct
ctaaccccagctcaacctcttg

SEQ ID NO: 1078 - DNA, 22 bp, Artificial Sequence
  Synthetic Construct
gtgacacaggctgcttctcatc

SEQ ID NO: 1079 - DNA, 21 bp, Artificial Sequence
  Synthetic Construct
ttggtgtagggagcaggagat

SEQ ID NO: 1080 - DNA, 26 bp, Artificial Sequence
  Synthetic Construct
cctcttacacccactgttccactaag

SEQ ID NO: 1081 - DNA, 23 bp, Artificial Sequence
  Synthetic Construct
gaagcattctgggctgagagaga

SEQ ID NO: 1082 - DNA, 22 bp, Artificial Sequence
  Synthetic Construct
ggaaacctggtccaaaccacaa

SEQ ID NO: 1083 - DNA, 21 bp, Artificial Sequence
  Synthetic Construct
aggcacctgtttgcccgaatg

SEQ ID NO: 1084 - DNA, 23 bp, Artificial Sequence
  Synthetic Construct
gctgtcagaaccagcctgagtat

SEQ ID NO: 1085 - DNA, 24 bp, Artificial Sequence
  Synthetic Construct
gcggtaggatgttaaaggcagctt

SEQ ID NO: 1086 - DNA, 22 bp, Artificial Sequence
  Synthetic Construct
ggttcaatctcaggctcacact

SEQ ID NO: 1087 - DNA, 21 bp, Artificial Sequence
  Synthetic Construct
gcatggatctgcgtggagaca

SEQ ID NO: 1088 - DNA, 23 bp, Artificial Sequence
  Synthetic Construct
cagaactgggtggtgtcgttttg

SEQ ID NO: 1089 - DNA, 21 bp, Artificial Sequence
  Synthetic Construct
cagaccacttgagagcaggtt

SEQ ID NO: 1090 - DNA, 22 bp, Artificial Sequence
  Synthetic Construct
gctaccaagggaggtctcttct

SEQ ID NO: 1091 - DNA, 22 bp, Artificial Sequence
  Synthetic Construct
gaggtgggtaacagacccatca

SEQ ID NO: 1092 - DNA, 23 bp, Artificial Sequence
  Synthetic Construct
ggaagcaagcacatactcaccat

SEQ ID NO: 1093 - DNA, 20 bp, Artificial Sequence
  Synthetic Construct
actgcgtaagcggtggcata

SEQ ID NO: 1094 - DNA, 25 bp, Artificial Sequence
  Synthetic Construct
ggtatcagcagtgtgggttaaggat

SEQ ID NO: 1095 - DNA, 24 bp, Artificial Sequence
  Synthetic Construct
ctcggaagtcccagcagatctttc

SEQ ID NO: 1096 - DNA, 23 bp, Artificial Sequence
  Synthetic Construct
ggtgaggttcacaccctcctttc

SEQ ID NO: 1097 - DNA, 20 bp, Artificial Sequence
  Synthetic Construct
ctgcagtcatggctgtggaa

SEQ ID NO: 1098 - DNA, 23 bp, Artificial Sequence
  Synthetic Construct
cccctgcctgtggaccttatatt

SEQ ID NO: 1099 - DNA, 20 bp, Artificial Sequence
  Synthetic Construct
gggcattgccacaatggttt

SEQ ID NO: 1100 - DNA, 20 bp, Artificial Sequence
  Synthetic Construct
gtggcaacaggacagggatt

SEQ ID NO: 1101 - DNA, 22 bp, Artificial Sequence
  Synthetic Construct
tctaggaccaggagccatcaga

SEQ ID NO: 1102 - DNA, 23 bp, Artificial Sequence
  Synthetic Construct
cgaggggtctttgaggcaaactt

SEQ ID NO: 1103 - DNA, 26 bp, Artificial Sequence
  Synthetic Construct
tccccacctctctttctttagagtat

SEQ ID NO: 1104 - DNA, 21 bp, Artificial Sequence
  Synthetic Construct
ccaggaaagccaccaatgcaa

SEQ ID NO: 1105 - DNA, 26 bp, Artificial Sequence
  Synthetic Construct
gggctgatataatggaggcagcttag

SEQ ID NO: 1106 - DNA, 22 bp, Artificial Sequence
  Synthetic Construct
gccctgtcctgactgacattct

SEQ ID NO: 1107 - DNA, 26 bp, Artificial Sequence
  Synthetic Construct
tctttggccacacagatttactctac

SEQ ID NO: 1108 - DNA, 22 bp, Artificial Sequence
  Synthetic Construct
cagagtaggtgtgccgtaggaa

SEQ ID NO: 1109 - DNA, 23 bp, Artificial Sequence
  Synthetic Construct
cgctgtctctccatccaagtgtt

SEQ ID NO: 1110 - DNA, 24 bp, Artificial Sequence
  Synthetic Construct
cggagccttggagctaggtgatta

SEQ ID NO: 1111 - DNA, 25 bp, Artificial Sequence
  Synthetic Construct
cagggttcctagctctttcctgttc

SEQ ID NO: 1112 - DNA, 24 bp, Artificial Sequence
  Synthetic Construct
cattcccaaatggatgtggctaga

SEQ ID NO: 1113 - DNA, 21 bp, Artificial Sequence
  Synthetic Construct
gctccactttcgccctcactt

SEQ ID NO: 1114 - DNA, 24 bp, Artificial Sequence
  Synthetic Construct
ctttgctcttgtctgcactgagta

SEQ ID NO: 1115 - DNA, 19 bp, Artificial Sequence
  Synthetic Construct
ttgagctgtgcaggcttgt

SEQ ID NO: 1116 - DNA, 23 bp, Artificial Sequence
  Synthetic Construct
tgtggctactttcccacagtttg

SEQ ID NO: 1117 - DNA, 24 bp, Artificial Sequence
  Synthetic Construct
caaaggacaatcacagagctgttc

SEQ ID NO: 1118 - DNA, 25 bp, Artificial Sequence
  Synthetic Construct
ggaatggaccaagtttgtcttgatt

SEQ ID NO: 1119 - DNA, 20 bp, Artificial Sequence
  Synthetic Construct
tggatgtggcccgcatttgt

SEQ ID NO: 1120 - DNA, 23 bp, Artificial Sequence
  Synthetic Construct
cccctgccccaaatagcatttta

SEQ ID NO: 1121 - DNA, 22 bp, Artificial Sequence
  Synthetic Construct
accaagcactggggaaactaaa

SEQ ID NO: 1122 - DNA, 19 bp, Artificial Sequence
  Synthetic Construct
ggcatgctccgcaccaaga

SEQ ID NO: 1123 - DNA, 22 bp, Artificial Sequence
  Synthetic Construct
caggccatgtaaacgactctca

SEQ ID NO: 1124 - DNA, 23 bp, Artificial Sequence
  Synthetic Construct
tgctgaatggtttgctcagtttg

SEQ ID NO: 1125 - DNA, 24 bp, Artificial Sequence
  Synthetic Construct
tcgagtcacttacctgctcaaatg

SEQ ID NO: 1126 - DNA, 20 bp, Artificial Sequence
  Synthetic Construct
agcaagcgacggtcctccat

SEQ ID NO: 1127 - DNA, 22 bp, Artificial Sequence
  Synthetic Construct
acctgcagaactgaggctctct

SEQ ID NO: 1128 - DNA, 21 bp, Artificial Sequence
  Synthetic Construct
agtgtcaggaggggaaacgaa

SEQ ID NO: 1129 - DNA, 25 bp, Artificial Sequence
  Synthetic Construct
ccactccttcccttatacccttgta

SEQ ID NO: 1130 - DNA, 21 bp, Artificial Sequence
  Synthetic Construct
gcaaagattgctgcccgttca

SEQ ID NO: 1131 - DNA, 24 bp, Artificial Sequence
  Synthetic Construct
tggacaagaatggagaaagacgtt

SEQ ID NO: 1132 - DNA, 22 bp, Artificial Sequence
  Synthetic Construct
gcctttcccaggactcaacagt

SEQ ID NO: 1133 - DNA, 24 bp, Artificial Sequence
  Synthetic Construct
ctgctttgaggcagataggagctt

SEQ ID NO: 1134 - DNA, 22 bp, Artificial Sequence
  Synthetic Construct
cctgcacaaagtggctgtcaac

SEQ ID NO: 1135 - DNA, 25 bp, Artificial Sequence
  Synthetic Construct
gcaggaaaccacaaaacatcaccta

SEQ ID NO: 1136 - DNA, 26 bp, Artificial Sequence
  Synthetic Construct
gctttctctcccctaggacatacagt

SEQ ID NO: 1137 - DNA, 20 bp, Artificial Sequence
  Synthetic Construct
agcctggctccctacacatt

SEQ ID NO: 1138 - DNA, 21 bp, Artificial Sequence
  Synthetic Construct
tgctattggggcattggtgtt

SEQ ID NO: 1139 - DNA, 20 bp, Artificial Sequence
  Synthetic Construct
tgcatcccgttgctgtcaag

SEQ ID NO: 1140 - DNA, 23 bp, Artificial Sequence
  Synthetic Construct
gacctgtgtccctttgtccttag

SEQ ID NO: 1141 - DNA, 24 bp, Artificial Sequence
  Synthetic Construct
cctttgcccttccagagtctcctt

SEQ ID NO: 1142 - DNA, 23 bp, Artificial Sequence
  Synthetic Construct
gcctggtactctcccagttttag

SEQ ID NO: 1143 - DNA, 24 bp, Artificial Sequence
  Synthetic Construct
gggaccagtcaactttgccagatt

SEQ ID NO: 1144 - DNA, 24 bp, Artificial Sequence
  Synthetic Construct
attcccattcctaaaagccgtgta

SEQ ID NO: 1145 - DNA, 20 bp, Artificial Sequence
  Synthetic Construct
tccaggcacgcacctctgat

SEQ ID NO: 1146 - DNA, 22 bp, Artificial Sequence
  Synthetic Construct
ggcaggcatctgtgcagtcatt

SEQ ID NO: 1147 - DNA, 21 bp, Artificial Sequence
  Synthetic Construct
tgccgacataaccccttcctt

SEQ ID NO: 1148 - DNA, 22 bp, Artificial Sequence
  Synthetic Construct
cgccaatctcagtggttggaat

SEQ ID NO: 1149 - DNA, 25 bp, Artificial Sequence
  Synthetic Construct
cggagcaacttggcatgttaataca

SEQ ID NO: 1150 - DNA, 22 bp, Artificial Sequence
  Synthetic Construct
gtggcagcctttctgtagttga

SEQ ID NO: 1151 - DNA, 25 bp, Artificial Sequence
  Synthetic Construct
gctcgttaagaattagccccacatc

SEQ ID NO: 1152 - DNA, 23 bp, Artificial Sequence
  Synthetic Construct
caccagctagaacctcctgtagt

SEQ ID NO: 1153 - DNA, 18 bp, Artificial Sequence
  Synthetic Construct
gctgctttgcgggacctt

SEQ ID NO: 1154 - DNA, 24 bp, Artificial Sequence
  Synthetic Construct
ggcaggagtcagtgacaagtggta

SEQ ID NO: 1155 - DNA, 25 bp, Artificial Sequence
  Synthetic Construct
tgtgtcaagcagatttgaagctaac

SEQ ID NO: 1156 - DNA, 22 bp, Artificial Sequence
  Synthetic Construct
tgcacattccttccttggtgat

SEQ ID NO: 1157 - DNA, 19 bp, Artificial Sequence
  Synthetic Construct
cctgcattgcaagccgttt

SEQ ID NO: 1158 - DNA, 21 bp, Artificial Sequence
  Synthetic Construct
acctgcctgtgtggtatggaa

SEQ ID NO: 1159 - DNA, 25 bp, Artificial Sequence
  Synthetic Construct
gagccgaatgttcacttatggagtt

SEQ ID NO: 1160 - DNA, 24 bp, Artificial Sequence
  Synthetic Construct
ctgaagcctaatggggatccagaa

SEQ ID NO: 1161 - DNA, 24 bp, Artificial Sequence
  Synthetic Construct
aaatagctgtcccattctggttgt

SEQ ID NO: 1162 - DNA, 21 bp, Artificial Sequence
  Synthetic Construct
tccccggatttccacagtagt

SEQ ID NO: 1163 - DNA, 27 bp, Artificial Sequence
  Synthetic Construct
gggtaggatgcatgagaagaactggat

SEQ ID NO: 1164 - DNA, 25 bp, Artificial Sequence
  Synthetic Construct
gccagctgaggaactattagacact

SEQ ID NO: 1165 - DNA, 23 bp, Artificial Sequence
  Synthetic Construct
ctgcagatctagccaatgaggtt

SEQ ID NO: 1166 - DNA, 25 bp, Artificial Sequence
  Synthetic Construct
ggccaagattttggtgttcaagtag

SEQ ID NO: 1167 - DNA, 20 bp, Artificial Sequence
  Synthetic Construct
acagctgcgaatggcctaat

SEQ ID NO: 1168 - DNA, 24 bp, Artificial Sequence
  Synthetic Construct
gatctcatggctacggagatcaag

SEQ ID NO: 1169 - DNA, 25 bp, Artificial Sequence
  Synthetic Construct
cctcctgggaaactggcaagtaaag

SEQ ID NO: 1170 - DNA, 24 bp, Artificial Sequence
  Synthetic Construct
gtacatggttatggctaccaggaa

SEQ ID NO: 1171 - DNA, 20 bp, Artificial Sequence
  Synthetic Construct
tggtcagtgctcccagagtt

SEQ ID NO: 1172 - DNA, 20 bp, Artificial Sequence
  Synthetic Construct
cgcacatgtctcgtgtcact

SEQ ID NO: 1173 - DNA, 21 bp, Artificial Sequence
  Synthetic Construct
accactgacaaacctgtgcat

SEQ ID NO: 1174 - DNA, 26 bp, Artificial Sequence
  Synthetic Construct
cagggatgaataagcctcatgaaaga

SEQ ID NO: 1175 - DNA, 24 bp, Artificial Sequence
  Synthetic Construct
actgcaacactgtgattgtcttca

SEQ ID NO: 1176 - DNA, 20 bp, Artificial Sequence
  Synthetic Construct
ttggctccccagagtgttgt

SEQ ID NO: 1177 - DNA, 24 bp, Artificial Sequence
  Synthetic Construct
cagtcgaaagagtggaaaggatga

SEQ ID NO: 1178 - DNA, 21 bp, Artificial Sequence
  Synthetic Construct
tgaagcatctggcctgtctga

SEQ ID NO: 1179 - DNA, 20 bp, Artificial Sequence
  Synthetic Construct
ttcggggtgcatcctcacat

SEQ ID NO: 1180 - DNA, 22 bp, Artificial Sequence
  Synthetic Construct
catccacagctgtctccgtgta

SEQ ID NO: 1181 - DNA, 25 bp, Artificial Sequence
  Synthetic Construct
ttccaggttgttttctgcaaagtag

SEQ ID NO: 1182 - DNA, 26 bp, Artificial Sequence
  Synthetic Construct
tcccagagacacagctagttaaaaac

SEQ ID NO: 1183 - DNA, 21 bp, Artificial Sequence
  Synthetic Construct
tgctgctcgtacagtggaaag

SEQ ID NO: 1184 - DNA, 25 bp, Artificial Sequence
  Synthetic Construct
ggagcagtatcattttggtgcattg

SEQ ID NO: 1185 - DNA, 22 bp, Artificial Sequence
  Synthetic Construct
cggtggtgcctttgttttaact

SEQ ID NO: 1186 - DNA, 25 bp, Artificial Sequence
  Synthetic Construct
ggagaaggaatgtcaggaagcaaac

SEQ ID NO: 1187 - DNA, 21 bp, Artificial Sequence
  Synthetic Construct
agtaggtgtgatggccaggat

SEQ ID NO: 1188 - DNA, 23 bp, Artificial Sequence
  Synthetic Construct
tgtcttcctagcctcatctctca

SEQ ID NO: 1189 - DNA, 24 bp, Artificial Sequence
  Synthetic Construct
gctaggggatactgagtcctgcat

SEQ ID NO: 1190 - DNA, 22 bp, Artificial Sequence
  Synthetic Construct
cccaaagagtccccatctggtt

SEQ ID NO: 1191 - DNA, 20 bp, Artificial Sequence
  Synthetic Construct
agacctaggcggcaaacaaa

SEQ ID NO: 1192 - DNA, 25 bp, Artificial Sequence
  Synthetic Construct
agtttcctggaagccagctattaaa

SEQ ID NO: 1193 - DNA, 22 bp, Artificial Sequence
  Synthetic Construct
cgtaagcataggggctgcagta

SEQ ID NO: 1194 - DNA, 25 bp, Artificial Sequence
  Synthetic Construct
gcagttgagggagttcaactaaaga

SEQ ID NO: 1195 - DNA, 23 bp, Artificial Sequence
  Synthetic Construct
cctaggctagaagcccagaaaac

SEQ ID NO: 1196 - DNA, 23 bp, Artificial Sequence
  Synthetic Construct
ccttccctttgtcacaccacatc

SEQ ID NO: 1197 - DNA, 24 bp, Artificial Sequence
  Synthetic Construct
cctgtgttcaggaagaatgaggat

SEQ ID NO: 1198 - DNA, 26 bp, Artificial Sequence
  Synthetic Construct
gaaggaaactgactttgcagcttaac

SEQ ID NO: 1199 - DNA, 24 bp, Artificial Sequence
  Synthetic Construct
agggagaaaatcacactcttgcat

SEQ ID NO: 1200 - DNA, 21 bp, Artificial Sequence
  Synthetic Construct
ggggacgaagtcaaggtgtag

SEQ ID NO: 1201 - DNA, 26 bp, Artificial Sequence
  Synthetic Construct
ctcactaaacttttccccagaactca

SEQ ID NO: 1202 - DNA, 24 bp, Artificial Sequence
  Synthetic Construct
cctctgaagggagactgaaacaac

SEQ ID NO: 1203 - DNA, 20 bp, Artificial Sequence
  Synthetic Construct
gcaagaatgcttggctgcaa

SEQ ID NO: 1204 - DNA, 21 bp, Artificial Sequence
  Synthetic Construct
gtggcatttcactgccctttg

SEQ ID NO: 1205 - DNA, 23 bp, Artificial Sequence
  Synthetic Construct
gcagcttgttcaattgtggttca

SEQ ID NO: 1206 - DNA, 26 bp, Artificial Sequence
  Synthetic Construct
gtgaggatgagttttcagtggctatc

SEQ ID NO: 1207 - DNA, 27 bp, Artificial Sequence
  Synthetic Construct
ccctggacaaaatgtaacagccaaagt

SEQ ID NO: 1208 - DNA, 24 bp, Artificial Sequence
  Synthetic Construct
acctagctatccttccagcatttc

SEQ ID NO: 1209 - DNA, 23 bp, Artificial Sequence
  Synthetic Construct
gctggacaaactactgcctcttc

SEQ ID NO: 1210 - DNA, 22 bp, Artificial Sequence
  Synthetic Construct
gccaatagctgcttgatgcaat

SEQ ID NO: 1211 - DNA, 22 bp, Artificial Sequence
  Synthetic Construct
tagttgcccgggattcccaaga

SEQ ID NO: 1212 - DNA, 20 bp, Artificial Sequence
  Synthetic Construct
gggagaggctggtcctgagt

SEQ ID NO: 1213 - DNA, 25 bp, Artificial Sequence
  Synthetic Construct
gtttgtgaaaggtcaatgtgaggaa

SEQ ID NO: 1214 - DNA, 22 bp, Artificial Sequence
  Synthetic Construct
tcctcgggagctcacaacctta

SEQ ID NO: 1215 - DNA, 20 bp, Artificial Sequence
  Synthetic Construct
tcccactgatgccagaccaa

SEQ ID NO: 1216 - DNA, 27 bp, Artificial Sequence
  Synthetic Construct
cccagcttaagcaaaatagggcaagta

SEQ ID NO: 1217 - DNA, 26 bp, Artificial Sequence
  Synthetic Construct
tggccagtagtaagttgagaagacta

SEQ ID NO: 1218 - DNA, 20 bp, Artificial Sequence
  Synthetic Construct
ccggaagcttcacgttctgt

SEQ ID NO: 1219 - DNA, 22 bp, Artificial Sequence
  Synthetic Construct
ggagggagagctccatctctga

SEQ ID NO: 1220 - DNA, 20 bp, Artificial Sequence
  Synthetic Construct
ccggcaataggactcagcaa

SEQ ID NO: 1221 - DNA, 21 bp, Artificial Sequence
  Synthetic Construct
tagggcaggtgtcctctgcat

SEQ ID NO: 1222 - DNA, 28 bp, Artificial Sequence
  Synthetic Construct
gtgaaccaagctatactacctgcttttc

SEQ ID NO: 1223 - DNA, 25 bp, Artificial Sequence
  Synthetic Construct
ggcttctgtgctcatagttcacact

SEQ ID NO: 1224 - DNA, 22 bp, Artificial Sequence
  Synthetic Construct
gggcacacggaggtgaaaaagt

SEQ ID NO: 1225 - DNA, 23 bp, Artificial Sequence
  Synthetic Construct
cgggagccgttataccagcttag

SEQ ID NO: 1226 - DNA, 23 bp, Artificial Sequence
  Synthetic Construct
gcttcctatgaccaagtcccttt

SEQ ID NO: 1227 - DNA, 20 bp, Artificial Sequence
  Synthetic Construct
gtgttggccagacccactgt

SEQ ID NO: 1228 - DNA, 23 bp, Artificial Sequence
  Synthetic Construct
gggcacttttgagttgggctttg

SEQ ID NO: 1229 - DNA, 21 bp, Artificial Sequence
  Synthetic Construct
gcagctcggtgcctaatggtt

SEQ ID NO: 1230 - DNA, 24 bp, Artificial Sequence
  Synthetic Construct
cagacctggcaggatcagaatagt

SEQ ID NO: 1231 - DNA, 22 bp, Artificial Sequence
  Synthetic Construct
tgcaatgcagaggagaaaggtt

SEQ ID NO: 1232 - DNA, 25 bp, Artificial Sequence
  Synthetic Construct
agtcacaggtatcctgactctcata

SEQ ID NO: 1233 - DNA, 22 bp, Artificial Sequence
  Synthetic Construct
ggagcaatcagccttgcagaga

SEQ ID NO: 1234 - DNA, 18 bp, Artificial Sequence
  Synthetic Construct
tggcgcccggaaaaccat

SEQ ID NO: 1235 - DNA, 22 bp, Artificial Sequence
  Synthetic Construct
ttcaagagcatccttgcgctat

SEQ ID NO: 1236 - DNA, 24 bp, Artificial Sequence
  Synthetic Construct
accttgagaaggtggtatttgtgt

SEQ ID NO: 1237 - DNA, 24 bp, Artificial Sequence
  Synthetic Construct
agaaagaccccaggtaagaaccat

SEQ ID NO: 1238 - DNA, 23 bp, Artificial Sequence
  Synthetic Construct
cactcacacatccacaggagaca

SEQ ID NO: 1239 - DNA, 23 bp, Artificial Sequence
  Synthetic Construct
gacgcagtatcccacagagcatt

SEQ ID NO: 1240 - DNA, 21 bp, Artificial Sequence
  Synthetic Construct
accagctctgagtcaggaagt

SEQ ID NO: 1241 - DNA, 22 bp, Artificial Sequence
  Synthetic Construct
cccacagtccgacgagtgtttt

SEQ ID NO: 1242 - DNA, 25 bp, Artificial Sequence
  Synthetic Construct
tcactccactttacaggcacatatt

SEQ ID NO: 1243 - DNA, 23 bp, Artificial Sequence
  Synthetic Construct
acgaggatcagacaagtcacaga

SEQ ID NO: 1244 - DNA, 23 bp, Artificial Sequence
  Synthetic Construct
cccatgaccccaggttggaattg

SEQ ID NO: 1245 - DNA, 21 bp, Artificial Sequence
  Synthetic Construct
cactctgtgcagttgctggtt

SEQ ID NO: 1246 - DNA, 22 bp, Artificial Sequence
  Synthetic Construct
gtctgtggagcacaccttggaa

SEQ ID NO: 1247 - DNA, 20 bp, Artificial Sequence
  Synthetic Construct
gcctttccactgagccatga

SEQ ID NO: 1248 - DNA, 23 bp, Artificial Sequence
  Synthetic Construct
cagcctggttggttagattctgt

SEQ ID NO: 1249 - DNA, 24 bp, Artificial Sequence
  Synthetic Construct
cttatgtgtggctttggcttcttg

SEQ ID NO: 1250 - DNA, 21 bp, Artificial Sequence
  Synthetic Construct
ggggctgaatcagacaaggaa

SEQ ID NO: 1251 - DNA, 20 bp, Artificial Sequence
  Synthetic Construct
cacagcttggaaggcctgaa

SEQ ID NO: 1252 - DNA, 24 bp, Artificial Sequence
  Synthetic Construct
ctcatgatgtcaaatgctgctcaa

SEQ ID NO: 1253 - DNA, 23 bp, Artificial Sequence
  Synthetic Construct
gttctggtgacagacaaccttct

SEQ ID NO: 1254 - DNA, 21 bp, Artificial Sequence
  Synthetic Construct
tgagcagcacagtccaattct

SEQ ID NO: 1255 - DNA, 23 bp, Artificial Sequence
  Synthetic Construct
cccctgggaaagttactgtcgat

SEQ ID NO: 1256 - DNA, 21 bp, Artificial Sequence
  Synthetic Construct
gtcagtgagctgccagttttc

SEQ ID NO: 1257 - DNA, 21 bp, Artificial Sequence
  Synthetic Construct
tcccaaatcctgagcctgtca

SEQ ID NO: 1258 - DNA, 28 bp, Artificial Sequence
  Synthetic Construct
gccaacctatagacacaactttggttac

SEQ ID NO: 1259 - DNA, 25 bp, Artificial Sequence
  Synthetic Construct
gttgacttccggcagtaagtgatga

SEQ ID NO: 1260 - DNA, 24 bp, Artificial Sequence
  Synthetic Construct
actgggacatttctcacgttatca

SEQ ID NO: 1261 - DNA, 23 bp, Artificial Sequence
  Synthetic Construct
ggaatccagcccatcctcacatc

SEQ ID NO: 1262 - DNA, 20 bp, Artificial Sequence
  Synthetic Construct
actgcaccaccacacggaaa

SEQ ID NO: 1263 - DNA, 22 bp, Artificial Sequence
  Synthetic Construct
ccttcaagggctttctctcaca

SEQ ID NO: 1264 - DNA, 24 bp, Artificial Sequence
  Synthetic Construct
acttccacatggcttaaacagaga

SEQ ID NO: 1265 - DNA, 25 bp, Artificial Sequence
  Synthetic Construct
tcgtgaagaagatggagaggagtta

SEQ ID NO: 1266 - DNA, 21 bp, Artificial Sequence
  Synthetic Construct
ctgggaccaacccatttcaca

SEQ ID NO: 1267 - DNA, 22 bp, Artificial Sequence
  Synthetic Construct
aaggaagtggggtatggactga

SEQ ID NO: 1268 - DNA, 24 bp, Artificial Sequence
  Synthetic Construct
tgttggccacatacattgttctca

SEQ ID NO: 1269 - DNA, 19 bp, Artificial Sequence
  Synthetic Construct
ctcctgccttcggggatgt

SEQ ID NO: 1270 - DNA, 21 bp, Artificial Sequence
  Synthetic Construct
cacaggccagagattcaccat

SEQ ID NO: 1271 - DNA, 21 bp, Artificial Sequence
  Synthetic Construct
tgggaagcctaccttgactct

SEQ ID NO: 1272 - DNA, 24 bp, Artificial Sequence
  Synthetic Construct
aagcccctgagaatctaaaagcaa

SEQ ID NO: 1273 - DNA, 19 bp, Artificial Sequence
  Synthetic Construct
cgacagggcctcccaattc

SEQ ID NO: 1274 - DNA, 24 bp, Artificial Sequence
  Synthetic Construct
aggtagacaccggaagtaatcaca

SEQ ID NO: 1275 - DNA, 22 bp, Artificial Sequence
  Synthetic Construct
tcaggtagaggtcgccaaggtt

SEQ ID NO: 1276 - DNA, 24 bp, Artificial Sequence
  Synthetic Construct
ggaggctatgagaagtgaggtttg

SEQ ID NO: 1277 - DNA, 23 bp, Artificial Sequence
  Synthetic Construct
gggcggttaaagagcttcagaga

SEQ ID NO: 1278 - DNA, 24 bp, Artificial Sequence
  Synthetic Construct
tggtcttctttatgcccaacaaac

SEQ ID NO: 1279 - DNA, 20 bp, Artificial Sequence
  Synthetic Construct
ctcacacgggctcacattct

SEQ ID NO: 1280 - DNA, 19 bp, Artificial Sequence
  Synthetic Construct
cctgctcaccgatgctcaa

SEQ ID NO: 1281 - DNA, 24 bp, Artificial Sequence
  Synthetic Construct
ggtcagaaacagagcctgtaaaac

SEQ ID NO: 1282 - DNA, 25 bp, Artificial Sequence
  Synthetic Construct
cctgagacagaagcagtagcgtctt

SEQ ID NO: 1283 - DNA, 20 bp, Artificial Sequence
  Synthetic Construct
cgcaaaatgggctcctgctt

SEQ ID NO: 1284 - DNA, 22 bp, Artificial Sequence
  Synthetic Construct
gccggattaggggtgaactttg

SEQ ID NO: 1285 - DNA, 24 bp, Artificial Sequence
  Synthetic Construct
ggaggtattctggcttccctaaga

SEQ ID NO: 1286 - DNA, 26 bp, Artificial Sequence
  Synthetic Construct
ggaagggtgagtttagcacaatggtt

SEQ ID NO: 1287 - DNA, 22 bp, Artificial Sequence
  Synthetic Construct
cccacttgcacaaatgcaaaga

SEQ ID NO: 1288 - DNA, 21 bp, Artificial Sequence
  Synthetic Construct
agctgtggttttcctgtgtca

SEQ ID NO: 1289 - DNA, 24 bp, Artificial Sequence
  Synthetic Construct
tgtgtgtgtttagcaagggatttc

SEQ ID NO: 1290 - DNA, 21 bp, Artificial Sequence
  Synthetic Construct
cgtttggcaacggagatgtgt

SEQ ID NO: 1291 - DNA, 22 bp, Artificial Sequence
  Synthetic Construct
tgcccacccttttcttttgctt

SEQ ID NO: 1292 - DNA, 23 bp, Artificial Sequence
  Synthetic Construct
gggctatacatttctgggctcaa

SEQ ID NO: 1293 - DNA, 22 bp, Artificial Sequence
  Synthetic Construct
tacattcccctctcccgcaaca

SEQ ID NO: 1294 - DNA, 25 bp, Artificial Sequence
  Synthetic Construct
ccagccaatcaggatcatggacaga

SEQ ID NO: 1295 - DNA, 20 bp, Artificial Sequence
  Synthetic Construct
ggcccatgactctgctggat

SEQ ID NO: 1296 - DNA, 19 bp, Artificial Sequence
  Synthetic Construct
ggaggcatctccggctaca

SEQ ID NO: 1297 - DNA, 24 bp, Artificial Sequence
  Synthetic Construct
agtgcaaggttggagaatgaaaag

SEQ ID NO: 1298 - DNA, 22 bp, Artificial Sequence
  Synthetic Construct
cgagttggcctcgtcttaccaa

SEQ ID NO: 1299 - DNA, 22 bp, Artificial Sequence
  Synthetic Construct
cgtggcagctggctttagaatc

SEQ ID NO: 1300 - DNA, 22 bp, Artificial Sequence
  Synthetic Construct
tggtgcagccacctctcttatc

SEQ ID NO: 1301 - DNA, 21 bp, Artificial Sequence
  Synthetic Construct
ctctggcacatgcgttagttg

SEQ ID NO: 1302 - DNA, 24 bp, Artificial Sequence
  Synthetic Construct
ggggctttggataacaccaaggta

SEQ ID NO: 1303 - DNA, 20 bp, Artificial Sequence
  Synthetic Construct
ttgcaacccctccgacattc

SEQ ID NO: 1304 - DNA, 21 bp, Artificial Sequence
  Synthetic Construct
aggagaagttcaggggaccaa

SEQ ID NO: 1305 - DNA, 24 bp, Artificial Sequence
  Synthetic Construct
agagctgctatcatgatgtggaaa

SEQ ID NO: 1306 - DNA, 21 bp, Artificial Sequence
  Synthetic Construct
agggtgagtctggaagaggtt

SEQ ID NO: 1307 - DNA, 22 bp, Artificial Sequence
  Synthetic Construct
ccccactcccctcaaggtatgt

SEQ ID NO: 1308 - DNA, 22 bp, Artificial Sequence
  Synthetic Construct
gtcaccctctgaggtacacact

SEQ ID NO: 1309 - DNA, 23 bp, Artificial Sequence
  Synthetic Construct
atgacaacatcacggacagagaa

SEQ ID NO: 1310 - DNA, 22 bp, Artificial Sequence
  Synthetic Construct
tgacaaatgccgaagggattct

SEQ ID NO: 1311 - DNA, 24 bp, Artificial Sequence
  Synthetic Construct
ctatgtttcagccacaccacattc

SEQ ID NO: 1312 - DNA, 23 bp, Artificial Sequence
  Synthetic Construct
caggcttgttcgggaaatacaag

SEQ ID NO: 1313 - DNA, 20 bp, Artificial Sequence
  Synthetic Construct
gccgaggtttcaaggtccaa

SEQ ID NO: 1314 - DNA, 22 bp, Artificial Sequence
  Synthetic Construct
tgctcaactcaaacaggacact

SEQ ID NO: 1315 - DNA, 18 bp, Artificial Sequence
  Synthetic Construct
tgcggcgatgtggctgta

SEQ ID NO: 1316 - DNA, 23 bp, Artificial Sequence
  Synthetic Construct
cagagggtggatggatacagttc

SEQ ID NO: 1317 - DNA, 19 bp, Artificial Sequence
  Synthetic Construct
cgtggcctcctgcactgat

SEQ ID NO: 1318 - DNA, 21 bp, Artificial Sequence
  Synthetic Construct
gtgcaggctcaagttgcttct

SEQ ID NO: 1319 - DNA, 24 bp, Artificial Sequence
  Synthetic Construct
gcttgcttggaaccgattttggat

SEQ ID NO: 1320 - DNA, 19 bp, Artificial Sequence
  Synthetic Construct
ggcgggaccgagtgcttta

SEQ ID NO: 1321 - DNA, 26 bp, Artificial Sequence
  Synthetic Construct
cctcaattactccccagatgttcaga

SEQ ID NO: 1322 - DNA, 22 bp, Artificial Sequence
  Synthetic Construct
tcagcaggaggaaggatgtttg

SEQ ID NO: 1323 - DNA, 20 bp, Artificial Sequence
  Synthetic Construct
accttccggccatgtgtgaa

SEQ ID NO: 1324 - DNA, 26 bp, Artificial Sequence
  Synthetic Construct
caaatctgctctgtctatgctaggaa

SEQ ID NO: 1325 - DNA, 22 bp, Artificial Sequence
  Synthetic Construct
agctcctgacattatgcccaaa

SEQ ID NO: 1326 - DNA, 24 bp, Artificial Sequence
  Synthetic Construct
gggaaagccagacatcctctccta

SEQ ID NO: 1327 - DNA, 22 bp, Artificial Sequence
  Synthetic Construct
gcccaggtagaggaacaaatca

SEQ ID NO: 1328 - DNA, 26 bp, Artificial Sequence
  Synthetic Construct
ggagaatatcaagctgtcatgggatt

SEQ ID NO: 1329 - DNA, 23 bp, Artificial Sequence
  Synthetic Construct
ccaaacgaggccctctctcttct

SEQ ID NO: 1330 - DNA, 20 bp, Artificial Sequence
  Synthetic Construct
gcccagaagagtgcttgaca

SEQ ID NO: 1331 - DNA, 24 bp, Artificial Sequence
  Synthetic Construct
ggcagtccttaactcctggttttc

SEQ ID NO: 1332 - DNA, 23 bp, Artificial Sequence
  Synthetic Construct
ccagcacattcagtccagaatca

SEQ ID NO: 1333 - DNA, 20 bp, Artificial Sequence
  Synthetic Construct
cagccaagtgcagactggaa

SEQ ID NO: 1334 - DNA, 22 bp, Artificial Sequence
  Synthetic Construct
tcctggcaaatcttgcacaaag

SEQ ID NO: 1335 - DNA, 26 bp, Artificial Sequence
  Synthetic Construct
gtgggattacattcacagatgcagaa

SEQ ID NO: 1336 - DNA, 22 bp, Artificial Sequence
  Synthetic Construct
agaccttcacctctgccacagt

SEQ ID NO: 1337 - DNA, 22 bp, Artificial Sequence
  Synthetic Construct
ggaacaggagaagagcaaggaa

SEQ ID NO: 1338 - DNA, 24 bp, Artificial Sequence
  Synthetic Construct
actgatgctaccaaagaggctaga

SEQ ID NO: 1339 - DNA, 20 bp, Artificial Sequence
  Synthetic Construct
cacaaccgctttccccttga

SEQ ID NO: 1340 - DNA, 22 bp, Artificial Sequence
  Synthetic Construct
gggagacactgcaggacaaagt

SEQ ID NO: 1341 - DNA, 21 bp, Artificial Sequence
  Synthetic Construct
gtgcctgagagtttcctggtt

SEQ ID NO: 1342 - DNA, 22 bp, Artificial Sequence
  Synthetic Construct
cacagtgctgtagttgcctgtt

SEQ ID NO: 1343 - DNA, 23 bp, Artificial Sequence
  Synthetic Construct
gccacaatctaggacctgcagaa

SEQ ID NO: 1344 - DNA, 23 bp, Artificial Sequence
  Synthetic Construct
tttctgccctagttcaggtcatc

SEQ ID NO: 1345 - DNA, 29 bp, Artificial Sequence
  Synthetic Construct
ccttgaagatgcaacagacattcttctac

SEQ ID NO: 1346 - DNA, 18 bp, Artificial Sequence
  Synthetic Construct
ggatgcaggcaggcaagt

SEQ ID NO: 1347 - DNA, 24 bp, Artificial Sequence
  Synthetic Construct
gtgctagagagcgaaatacctgtt

SEQ ID NO: 1348 - DNA, 24 bp, Artificial Sequence
  Synthetic Construct
ccacagaactcccactcgaataag

SEQ ID NO: 1349 - DNA, 21 bp, Artificial Sequence
  Synthetic Construct
ccccagaccaatccgaagtgt

SEQ ID NO: 1350 - DNA, 21 bp, Artificial Sequence
  Synthetic Construct
aagcaacccagttccttccaa

SEQ ID NO: 1351 - DNA, 21 bp, Artificial Sequence
  Synthetic Construct
cagctgctgcctcatttgcat

SEQ ID NO: 1352 - DNA, 23 bp, Artificial Sequence
  Synthetic Construct
aatggtagcctttgagacgatgt

SEQ ID NO: 1353 - DNA, 24 bp, Artificial Sequence
  Synthetic Construct
gccccttcttttctatgaggatgt

SEQ ID NO: 1354 - DNA, 22 bp, Artificial Sequence
  Synthetic Construct
agcatgggaaccagtgttcatc

SEQ ID NO: 1355 - DNA, 21 bp, Artificial Sequence
  Synthetic Construct
tgacaggacgaggagactcaa

SEQ ID NO: 1356 - DNA, 23 bp, Artificial Sequence
  Synthetic Construct
tctgccttgcagagttacagaat

SEQ ID NO: 1357 - DNA, 23 bp, Artificial Sequence
  Synthetic Construct
aaccttttcgctacccatgtact

SEQ ID NO: 1358 - DNA, 21 bp, Artificial Sequence
  Synthetic Construct
ccgagctcgtctgggtttgaa

SEQ ID NO: 1359 - DNA, 20 bp, Artificial Sequence
  Synthetic Construct
ctatctgcccgcatcacctt

SEQ ID NO: 1360 - DNA, 19 bp, Artificial Sequence
  Synthetic Construct
cgacggctcggagagaatc

SEQ ID NO: 1361 - DNA, 20 bp, Artificial Sequence
  Synthetic Construct
cccacgggtttgggtagctt

SEQ ID NO: 1362 - DNA, 24 bp, Artificial Sequence
  Synthetic Construct
cttgaccttgctctagcagttttg

SEQ ID NO: 1363 - DNA, 22 bp, Artificial Sequence
  Synthetic Construct
ctcacgtagtctccaccgtcat

SEQ ID NO: 1364 - DNA, 22 bp, Artificial Sequence
  Synthetic Construct
aaccctttcaaccctccacatt

SEQ ID NO: 1365 - DNA, 21 bp, Artificial Sequence
  Synthetic Construct
agttctcaggccaccttgttc

SEQ ID NO: 1366 - DNA, 19 bp, Artificial Sequence
  Synthetic Construct
cccgcaggactgagcacaa

SEQ ID NO: 1367 - DNA, 21 bp, Artificial Sequence
  Synthetic Construct
catccaggcacaccgttaaga

SEQ ID NO: 1368 - DNA, 20 bp, Artificial Sequence
  Synthetic Construct
tcgggagcacgtttgcagat

SEQ ID NO: 1369 - DNA, 22 bp, Artificial Sequence
  Synthetic Construct
ggttgctctcacgggaataaga

SEQ ID NO: 1370 - DNA, 23 bp, Artificial Sequence
  Synthetic Construct
ccggtaaacccaatccaaacaaa

SEQ ID NO: 1371 - DNA, 18 bp, Artificial Sequence
  Synthetic Construct
tgcacactgcgtcagctt

SEQ ID NO: 1372 - DNA, 27 bp, Artificial Sequence
  Synthetic Construct
gcatgcttcacaaacattatcccattc

SEQ ID NO: 1373 - DNA, 22 bp, Artificial Sequence
  Synthetic Construct
gggcatccaaggagagaagaga

SEQ ID NO: 1374 - DNA, 21 bp, Artificial Sequence
  Synthetic Construct
tgtcagcctggcttctgtaag

SEQ ID NO: 1375 - DNA, 21 bp, Artificial Sequence
  Synthetic Construct
tgagctggcctggtgaaatag

SEQ ID NO: 1376 - DNA, 25 bp, Artificial Sequence
  Synthetic Construct
acctcaccttctaattctggactgt

SEQ ID NO: 1377 - DNA, 22 bp, Artificial Sequence
  Synthetic Construct
cgtgacagctaatcacccacat

SEQ ID NO: 1378 - DNA, 24 bp, Artificial Sequence
  Synthetic Construct
ggaacacctctccctcaattcttt

SEQ ID NO: 1379 - DNA, 23 bp, Artificial Sequence
  Synthetic Construct
ccttggcagagggagatttgaga

SEQ ID NO: 1380 - DNA, 20 bp, Artificial Sequence
  Synthetic Construct
gtgaagcgtcctcctgttga

SEQ ID NO: 1381 - DNA, 25 bp, Artificial Sequence
  Synthetic Construct
ccagactagccgaattttccaggat

SEQ ID NO: 1382 - DNA, 24 bp, Artificial Sequence
  Synthetic Construct
tctggagaaagtgacagggtaaga

SEQ ID NO: 1383 - DNA, 25 bp, Artificial Sequence
  Synthetic Construct
gaaaggctgggtatttttgaaccaa

SEQ ID NO: 1384 - DNA, 24 bp, Artificial Sequence
  Synthetic Construct
cacaacctcacattctccaggtta

SEQ ID NO: 1385 - DNA, 22 bp, Artificial Sequence
  Synthetic Construct
gagcccacgtatcagctcaaca

SEQ ID NO: 1386 - DNA, 22 bp, Artificial Sequence
  Synthetic Construct
actgcaacctttttgcctgaga

SEQ ID NO: 1387 - DNA, 20 bp, Artificial Sequence
  Synthetic Construct
tctcaccgcttggtcagagt

SEQ ID NO: 1388 - DNA, 21 bp, Artificial Sequence
  Synthetic Construct
tctccagccctcagtccttct

SEQ ID NO: 1389 - DNA, 21 bp, Artificial Sequence
  Synthetic Construct
tgagaggtcaccacacacaga

SEQ ID NO: 1390 - DNA, 25 bp, Artificial Sequence
  Synthetic Construct
tcatcccagcatcatttgttgagaa

SEQ ID NO: 1391 - DNA, 22 bp, Artificial Sequence
  Synthetic Construct
ccgcctctccacctttgaactt

SEQ ID NO: 1392 - DNA, 25 bp, Artificial Sequence
  Synthetic Construct
cgacaatttaaggcgagacatggaa

SEQ ID NO: 1393 - DNA, 21 bp, Artificial Sequence
  Synthetic Construct
gcacattgccaccgtccagat

SEQ ID NO: 1394 - DNA, 21 bp, Artificial Sequence
  Synthetic Construct
cccatccttcaagtcgtggtt

SEQ ID NO: 1395 - DNA, 22 bp, Artificial Sequence
  Synthetic Construct
acccggtggagtcaggatttga

SEQ ID NO: 1396 - DNA, 21 bp, Artificial Sequence
  Synthetic Construct
tggatgggttggcttggtact

SEQ ID NO: 1397 - DNA, 23 bp, Artificial Sequence
  Synthetic Construct
gctgtgtatttgttgagccttgt

SEQ ID NO: 1398 - DNA, 25 bp, Artificial Sequence
  Synthetic Construct
ggggtgaggtactgcagttaaacat

SEQ ID NO: 1399 - DNA, 19 bp, Artificial Sequence
  Synthetic Construct
atcggcgcgagccaggatt

SEQ ID NO: 1400 - DNA, 24 bp, Artificial Sequence
  Synthetic Construct
gcagtctctcaactctgctgttgt

SEQ ID NO: 1401 - DNA, 20 bp, Artificial Sequence
  Synthetic Construct
agggatgtcctccccaactt

SEQ ID NO: 1402 - DNA, 22 bp, Artificial Sequence
  Synthetic Construct
gtcagcaccatgtagcagatgt

SEQ ID NO: 1403 - DNA, 20 bp, Artificial Sequence
  Synthetic Construct
ccagcattggggcagcttct

SEQ ID NO: 1404 - DNA, 23 bp, Artificial Sequence
  Synthetic Construct
gccctttaaggaaccttgctaca

SEQ ID NO: 1405 - DNA, 21 bp, Artificial Sequence
  Synthetic Construct
tccaggtccactactgtgtca

SEQ ID NO: 1406 - DNA, 21 bp, Artificial Sequence
  Synthetic Construct
cccttgggtccctcttcttca

SEQ ID NO: 1407 - DNA, 20 bp, Artificial Sequence
  Synthetic Construct
ggcgggtattgtgcctgaca

SEQ ID NO: 1408 - DNA, 24 bp, Artificial Sequence
  Synthetic Construct
ccattctgccaaatttctgtgtgt

SEQ ID NO: 1409 - DNA, 24 bp, Artificial Sequence
  Synthetic Construct
ggggagcagaatggatttgtcact

SEQ ID NO: 1410 - DNA, 22 bp, Artificial Sequence
  Synthetic Construct
cagctactcaggcaaccacaga

SEQ ID NO: 1411 - DNA, 25 bp, Artificial Sequence
  Synthetic Construct
aggcagatcactaactggttctaag

SEQ ID NO: 1412 - DNA, 23 bp, Artificial Sequence
  Synthetic Construct
tcagtagagccttgaggtagctt

SEQ ID NO: 1413 - DNA, 21 bp, Artificial Sequence
  Synthetic Construct
cctgccctaccaacccacatt

SEQ ID NO: 1414 - DNA, 22 bp, Artificial Sequence
  Synthetic Construct
ccctctgcttttgctccagata

SEQ ID NO: 1415 - DNA, 24 bp, Artificial Sequence
  Synthetic Construct
aagccaagctaaatcttccctgaa

SEQ ID NO: 1416 - DNA, 19 bp, Artificial Sequence
  Synthetic Construct
aggccttcagcctgagaca

SEQ ID NO: 1417 - DNA, 20 bp, Artificial Sequence
  Synthetic Construct
tcttcctgggcacgttcttc

SEQ ID NO: 1418 - DNA, 22 bp, Artificial Sequence
  Synthetic Construct
gggatctctgcagcatgacttg

SEQ ID NO: 1419 - DNA, 23 bp, Artificial Sequence
  Synthetic Construct
tcaacacctttttcggtgacagt

SEQ ID NO: 1420 - DNA, 22 bp, Artificial Sequence
  Synthetic Construct
ccgcgctctacctcttgattta

SEQ ID NO: 1421 - DNA, 23 bp, Artificial Sequence
  Synthetic Construct
tctgttcttgaacatgccagtga

SEQ ID NO: 1422 - DNA, 20 bp, Artificial Sequence
  Synthetic Construct
gcagtaggtggagggtgttc

SEQ ID NO: 1423 - DNA, 22 bp, Artificial Sequence
  Synthetic Construct
agaccttcctggcttccttttg

SEQ ID NO: 1424 - DNA, 20 bp, Artificial Sequence
  Synthetic Construct
atgggcctgaggcagattgt

SEQ ID NO: 1425 - DNA, 22 bp, Artificial Sequence
  Synthetic Construct
gcaagaggaaagaccagcatca

SEQ ID NO: 1426 - DNA, 19 bp, Artificial Sequence
  Synthetic Construct
caaccctgggctggactgt

SEQ ID NO: 1427 - DNA, 20 bp, Artificial Sequence
  Synthetic Construct
cagccgcaaagagagcctaa

SEQ ID NO: 1428 - DNA, 26 bp, Artificial Sequence
  Synthetic Construct
gaacacaccaggtttctgcactagat

SEQ ID NO: 1429 - DNA, 20 bp, Artificial Sequence
  Synthetic Construct
ccccgctctctgtcccatca

SEQ ID NO: 1430 - DNA, 20 bp, Artificial Sequence
  Synthetic Construct
atcgggagtcacagcacttg

SEQ ID NO: 1431 - DNA, 26 bp, Artificial Sequence
  Synthetic Construct
ctgagagaggagtctatcttccttga

SEQ ID NO: 1432 - DNA, 21 bp, Artificial Sequence
  Synthetic Construct
ggccaagggtgaactggagaa

SEQ ID NO: 1433 - DNA, 20 bp, Artificial Sequence
  Synthetic Construct
ccccgccaggtactgtctca

SEQ ID NO: 1434 - DNA, 19 bp, Artificial Sequence
  Synthetic Construct
ggaccagggctgcgagaaa

SEQ ID NO: 1435 - DNA, 25 bp, Artificial Sequence
  Synthetic Construct
gtgggacatcttatgatccgcttag

SEQ ID NO: 1436 - DNA, 25 bp, Artificial Sequence
  Synthetic Construct
tgagtgtctaaacatgggcacatac

SEQ ID NO: 1437 - DNA, 20 bp, Artificial Sequence
  Synthetic Construct
agcctgccctaccccaatct

SEQ ID NO: 1438 - DNA, 25 bp, Artificial Sequence
  Synthetic Construct
tgactatttgactggtcctggtaac

SEQ ID NO: 1439 - DNA, 23 bp, Artificial Sequence
  Synthetic Construct
gggacttgaccttgcttccacaa

SEQ ID NO: 1440 - DNA, 20 bp, Artificial Sequence
  Synthetic Construct
aagtaccgccctcgtctgtt

SEQ ID NO: 1441 - DNA, 20 bp, Artificial Sequence
  Synthetic Construct
tgccatggcgtgttggatct

SEQ ID NO: 1442 - DNA, 21 bp, Artificial Sequence
  Synthetic Construct
agagacccttggcaggtgcat

SEQ ID NO: 1443 - DNA, 23 bp, Artificial Sequence
  Synthetic Construct
cacattagtctgggagcttggtt

SEQ ID NO: 1444 - DNA, 23 bp, Artificial Sequence
  Synthetic Construct
ccccagtactcaggggactttgt

SEQ ID NO: 1445 - DNA, 19 bp, Artificial Sequence
  Synthetic Construct
gatgggccatgtggcttct

SEQ ID NO: 1446 - DNA, 21 bp, Artificial Sequence
  Synthetic Construct
tctccccagtggagcttatgt

SEQ ID NO: 1447 - DNA, 20 bp, Artificial Sequence
  Synthetic Construct
caccaacaagctggctctga

SEQ ID NO: 1448 - DNA, 19 bp, Artificial Sequence
  Synthetic Construct
cggctccaagttcccacat

SEQ ID NO: 1449 - DNA, 21 bp, Artificial Sequence
  Synthetic Construct
tgtccaaggttgaggggttgt

SEQ ID NO: 1450 - DNA, 23 bp, Artificial Sequence
  Synthetic Construct
ctggaatggctgttaggcacctt

SEQ ID NO: 1451 - DNA, 27 bp, Artificial Sequence
  Synthetic Construct
gcacataactgtacctcctaagccata

SEQ ID NO: 1452 - DNA, 25 bp, Artificial Sequence
  Synthetic Construct
gggaaagcaatgctgtgtgtttatg

SEQ ID NO: 1453 - DNA, 21 bp, Artificial Sequence
  Synthetic Construct
tcccacagtcaggccaaccat

SEQ ID NO: 1454 - DNA, 21 bp, Artificial Sequence
  Synthetic Construct
acagctggacccagggaagtt

SEQ ID NO: 1455 - DNA, 22 bp, Artificial Sequence
  Synthetic Construct
cctggtggcataagggatgctt

SEQ ID NO: 1456 - DNA, 23 bp, Artificial Sequence
  Synthetic Construct
gatgttggtactcgcttctcagt

SEQ ID NO: 1457 - DNA, 25 bp, Artificial Sequence
  Synthetic Construct
gggttactaaagggcagttctgttc

SEQ ID NO: 1458 - DNA, 21 bp, Artificial Sequence
  Synthetic Construct
tcctaggctgaccagtgtcat

SEQ ID NO: 1459 - DNA, 21 bp, Artificial Sequence
  Synthetic Construct
gcctttccccagtccatttct

SEQ ID NO: 1460 - DNA, 21 bp, Artificial Sequence
  Synthetic Construct
tgtctttcaccagcccagact

SEQ ID NO: 1461 - DNA, 26 bp, Artificial Sequence
  Synthetic Construct
cgtgtgagaaaaacctctcctactac

SEQ ID NO: 1462 - DNA, 25 bp, Artificial Sequence
  Synthetic Construct
tgtccaacagctttacatagcacat

SEQ ID NO: 1463 - DNA, 21 bp, Artificial Sequence
  Synthetic Construct
cagaagcagtgagctgtggtt

SEQ ID NO: 1464 - DNA, 20 bp, Artificial Sequence
  Synthetic Construct
ctgggcctgcagaaatgcta

SEQ ID NO: 1465 - DNA, 22 bp, Artificial Sequence
  Synthetic Construct
cactgaggcgatgctctgatct

SEQ ID NO: 1466 - DNA, 24 bp, Artificial Sequence
  Synthetic Construct
tggcctccttctctaaaagcattc

SEQ ID NO: 1467 - DNA, 23 bp, Artificial Sequence
  Synthetic Construct
cactcacaactcctttcccaagt

SEQ ID NO: 1468 - DNA, 19 bp, Artificial Sequence
  Synthetic Construct
gcgtgggcaaagcctccat

SEQ ID NO: 1469 - DNA, 20 bp, Artificial Sequence
  Synthetic Construct
atccactgccctgaccttgt

SEQ ID NO: 1470 - DNA, 20 bp, Artificial Sequence
  Synthetic Construct
actccaaaccccacctgcta

SEQ ID NO: 1471 - DNA, 22 bp, Artificial Sequence
  Synthetic Construct
gggtcctaaccctcagtcttgt

SEQ ID NO: 1472 - DNA, 21 bp, Artificial Sequence
  Synthetic Construct
acagggctcctggttctaact

SEQ ID NO: 1473 - DNA, 23 bp, Artificial Sequence
  Synthetic Construct
ctctaggagcatgggtcaccaaa

SEQ ID NO: 1474 - DNA, 18 bp, Artificial Sequence
  Synthetic Construct
aagccggcaggctgagtt

SEQ ID NO: 1475 - DNA, 22 bp, Artificial Sequence
  Synthetic Construct
ggagccacaaggaatgcagagt

SEQ ID NO: 1476 - DNA, 20 bp, Artificial Sequence
  Synthetic Construct
caagaccctgccacctctct

SEQ ID NO: 1477 - DNA, 18 bp, Artificial Sequence
  Synthetic Construct
ggtgcagccttgctcact

SEQ ID NO: 1478 - DNA, 21 bp, Artificial Sequence
  Synthetic Construct
gcggaaggtggaagaaccttt

SEQ ID NO: 1479 - DNA, 24 bp, Artificial Sequence
  Synthetic Construct
gggcacactgaagtctagaagcaa

SEQ ID NO: 1480 - DNA, 21 bp, Artificial Sequence
  Synthetic Construct
tgggcccatctcttgactttc

SEQ ID NO: 1481 - DNA, 22 bp, Artificial Sequence
  Synthetic Construct
gaaggatgagcggatggctcta

SEQ ID NO: 1482 - DNA, 25 bp, Artificial Sequence
  Synthetic Construct
gcagtacttggggtcgtatatctgt

SEQ ID NO: 1483 - DNA, 21 bp, Artificial Sequence
  Synthetic Construct
tccacctacctgtgggcaatc

SEQ ID NO: 1484 - DNA, 21 bp, Artificial Sequence
  Synthetic Construct
cccgggtacaacagtgacctt

SEQ ID NO: 1485 - DNA, 22 bp, Artificial Sequence
  Synthetic Construct
tctcccggaaagtccggttcta

SEQ ID NO: 1486 - DNA, 22 bp, Artificial Sequence
  Synthetic Construct
cacccaagctctcactgttact

SEQ ID NO: 1487 - DNA, 19 bp, Artificial Sequence
  Synthetic Construct
gggccagctgaccaactac

SEQ ID NO: 1488 - DNA, 20 bp, Artificial Sequence
  Synthetic Construct
ctccctgaagcagcagcaaa

SEQ ID NO: 1489 - DNA, 22 bp, Artificial Sequence
  Synthetic Construct
gctgtcacactgaccctggatt

SEQ ID NO: 1490 - DNA, 20 bp, Artificial Sequence
  Synthetic Construct
gccatgctgagagcctctgt

SEQ ID NO: 1491 - DNA, 24 bp, Artificial Sequence
  Synthetic Construct
gtccacgtgtggaacatgtttatt

SEQ ID NO: 1492 - DNA, 24 bp, Artificial Sequence
  Synthetic Construct
gcaaggagctgatctcatctgtgt

SEQ ID NO: 1493 - DNA, 22 bp, Artificial Sequence
  Synthetic Construct
caaagggctccttccccacaaa

SEQ ID NO: 1494 - DNA, 20 bp, Artificial Sequence
  Synthetic Construct
gggaagcctttgagggttgt

SEQ ID NO: 1495 - DNA, 20 bp, Artificial Sequence
  Synthetic Construct
tctgcacccctgccctgtgt

SEQ ID NO: 1496 - DNA, 22 bp, Artificial Sequence
  Synthetic Construct
tccccagagtgcacaactcctt

SEQ ID NO: 1497 - DNA, 23 bp, Artificial Sequence
  Synthetic Construct
gtttggctgcacgtagagaaaag

SEQ ID NO: 1498 - DNA, 19 bp, Artificial Sequence
  Synthetic Construct
gttggcactggggccttct

SEQ ID NO: 1499 - DNA, 24 bp, Artificial Sequence
  Synthetic Construct
gactcagtcagtagagagggagaa

SEQ ID NO: 1500 - DNA, 20 bp, Artificial Sequence
  Synthetic Construct
cgtggggagggagaccactt

SEQ ID NO: 1501 - DNA, 25 bp, Artificial Sequence
  Synthetic Construct
tcttcttttgacagactgggaacat

SEQ ID NO: 1502 - DNA, 22 bp, Artificial Sequence
  Synthetic Construct
accttctgaggtttggggtaga

SEQ ID NO: 1503 - DNA, 22 bp, Artificial Sequence
  Synthetic Construct
tgtaaggctaagccgcattttg

SEQ ID NO: 1504 - DNA, 22 bp, Artificial Sequence
  Synthetic Construct
tgaccagaaccactcggacaga

SEQ ID NO: 1505 - DNA, 20 bp, Artificial Sequence
  Synthetic Construct
acaggcccactgccctgtct

SEQ ID NO: 1506 - DNA, 20 bp, Artificial Sequence
  Synthetic Construct
gctgacggctggaatcatct

SEQ ID NO: 1507 - DNA, 24 bp, Artificial Sequence
  Synthetic Construct
agctcaggtaaaaggtcaaagaca

SEQ ID NO: 1508 - DNA, 21 bp, Artificial Sequence
  Synthetic Construct
gcaggccagtaacgtcaattc

SEQ ID NO: 1509 - DNA, 22 bp, Artificial Sequence
  Synthetic Construct
agtgcttcaagcctgagattgt

SEQ ID NO: 1510 - DNA, 21 bp, Artificial Sequence
  Synthetic Construct
cccggttccctccttctccat

SEQ ID NO: 1511 - DNA, 22 bp, Artificial Sequence
  Synthetic Construct
ggtgaccgatggcactgaatgt

SEQ ID NO: 1512 - DNA, 22 bp, Artificial Sequence
  Synthetic Construct
caccctgatcacctgggaaaag

SEQ ID NO: 1513 - DNA, 21 bp, Artificial Sequence
  Synthetic Construct
tgctgtcagccactctacaca

SEQ ID NO: 1514 - DNA, 24 bp, Artificial Sequence
  Synthetic Construct
ttcccttaatgcaatggaggtcaa

SEQ ID NO: 1515 - DNA, 20 bp, Artificial Sequence
  Synthetic Construct
caagcttgctccctgacact

SEQ ID NO: 1516 - DNA, 20 bp, Artificial Sequence
  Synthetic Construct
aggcagtgccaggtcctgaa

SEQ ID NO: 1517 - DNA, 22 bp, Artificial Sequence
  Synthetic Construct
tccttccagggttcgtttgttt

SEQ ID NO: 1518 - DNA, 24 bp, Artificial Sequence
  Synthetic Construct
gcagttaccagggacattactgaa

SEQ ID NO: 1519 - DNA, 24 bp, Artificial Sequence
  Synthetic Construct
ggacctgaagtggatgagctttgt

SEQ ID NO: 1520 - DNA, 20 bp, Artificial Sequence
  Synthetic Construct
agccctggaccagattgaga

SEQ ID NO: 1521 - DNA, 24 bp, Artificial Sequence
  Synthetic Construct
gcagaaggagcacctctctccata

SEQ ID NO: 1522 - DNA, 20 bp, Artificial Sequence
  Synthetic Construct
gtcacagccatccagtgcaa

SEQ ID NO: 1523 - DNA, 20 bp, Artificial Sequence
  Synthetic Construct
gagcgagccttgccttgtta

SEQ ID NO: 1524 - DNA, 22 bp, Artificial Sequence
  Synthetic Construct
aaggctagagtgggaactgact

SEQ ID NO: 1525 - DNA, 23 bp, Artificial Sequence
  Synthetic Construct
acattgttcatggaggagtgcaa

SEQ ID NO: 1526 - DNA, 24 bp, Artificial Sequence
  Synthetic Construct
gagggaaactgaagatggagcttt

SEQ ID NO: 1527 - DNA, 19 bp, Artificial Sequence
  Synthetic Construct
caagggctggggctcacat

SEQ ID NO: 1528 - DNA, 20 bp, Artificial Sequence
  Synthetic Construct
cagacacagtcagcgtccat

SEQ ID NO: 1529 - DNA, 23 bp, Artificial Sequence
  Synthetic Construct
tgttcttcagaatgtgccgtttc

SEQ ID NO: 1530 - DNA, 23 bp, Artificial Sequence
  Synthetic Construct
ctgcaaaaatcctgacccagtct

SEQ ID NO: 1531 - DNA, 20 bp, Artificial Sequence
  Synthetic Construct
ccaccttgttggctctgagt

SEQ ID NO: 1532 - DNA, 20 bp, Artificial Sequence
  Synthetic Construct
cctggagcggctgtctcata

SEQ ID NO: 1533 - DNA, 27 bp, Artificial Sequence
  Synthetic Construct
cagtctgtctgaacccatttacaccaa

SEQ ID NO: 1534 - DNA, 24 bp, Artificial Sequence
  Synthetic Construct
cagtgtgagtgctgagaaacaaag

SEQ ID NO: 1535 - DNA, 22 bp, Artificial Sequence
  Synthetic Construct
cacccctgggaaggatggaaat

SEQ ID NO: 1536 - DNA, 18 bp, Artificial Sequence
  Synthetic Construct
agggctgcatgccacaga

SEQ ID NO: 1537 - DNA, 23 bp, Artificial Sequence
  Synthetic Construct
cctgtactcccttccctggtatc

SEQ ID NO: 1538 - DNA, 19 bp, Artificial Sequence
  Synthetic Construct
tctctgtgccaggctgtgt

SEQ ID NO: 1539 - DNA, 22 bp, Artificial Sequence
  Synthetic Construct
tctgagacttcctcccttgtga

SEQ ID NO: 1540 - DNA, 24 bp, Artificial Sequence
  Synthetic Construct
cctcatggtcggtcttggtgactt

SEQ ID NO: 1541 - DNA, 19 bp, Artificial Sequence
  Synthetic Construct
agacggagagcccctgttg

SEQ ID NO: 1542 - DNA, 24 bp, Artificial Sequence
  Synthetic Construct
catgggtacaagctccaattcctt

SEQ ID NO: 1543 - DNA, 24 bp, Artificial Sequence
  Synthetic Construct
gagggaaagggttggggaaaaatc

SEQ ID NO: 1544 - DNA, 24 bp, Artificial Sequence
  Synthetic Construct
gcactagaaagggaaggaactaca

SEQ ID NO: 1545 - DNA, 22 bp, Artificial Sequence
  Synthetic Construct
gaggtaagccttgggcatttct

SEQ ID NO: 1546 - DNA, 21 bp, Artificial Sequence
  Synthetic Construct
gtgaggtgatgggcagactac

SEQ ID NO: 1547 - DNA, 22 bp, Artificial Sequence
  Synthetic Construct
ccttaccagcaggccttcacaa

SEQ ID NO: 1548 - DNA, 22 bp, Artificial Sequence
  Synthetic Construct
tacccacccacccagtcccatt

SEQ ID NO: 1549 - DNA, 23 bp, Artificial Sequence
  Synthetic Construct
cgaacttgctgggagtgtagaac

SEQ ID NO: 1550 - DNA, 22 bp, Artificial Sequence
  Synthetic Construct
ctgtggtccttggtgtcagaga

SEQ ID NO: 1551 - DNA, 22 bp, Artificial Sequence
  Synthetic Construct
ccaaggggctacagtgacaaca

SEQ ID NO: 1552 - DNA, 22 bp, Artificial Sequence
  Synthetic Construct
cagcagtgtggcctttctctac

SEQ ID NO: 1553 - DNA, 20 bp, Artificial Sequence
  Synthetic Construct
tgccacacggagcttgtttc

SEQ ID NO: 1554 - DNA, 25 bp, Artificial Sequence
  Synthetic Construct
caccatgtacttgcactctcagaaa

SEQ ID NO: 1555 - DNA, 20 bp, Artificial Sequence
  Synthetic Construct
cgccaacgtggctgatgttt

SEQ ID NO: 1556 - DNA, 22 bp, Artificial Sequence
  Synthetic Construct
cctggccttactcttcctgagt

SEQ ID NO: 1557 - DNA, 23 bp, Artificial Sequence
  Synthetic Construct
gacttcctgcaagcatttcaaca

SEQ ID NO: 1558 - DNA, 21 bp, Artificial Sequence
  Synthetic Construct
tcaagccaggagacccataca

SEQ ID NO: 1559 - DNA, 22 bp, Artificial Sequence
  Synthetic Construct
cccggaagcactagctcgtaag

SEQ ID NO: 1560 - DNA, 21 bp, Artificial Sequence
  Synthetic Construct
cgctcgcagctttgactgtag

SEQ ID NO: 1561 - DNA, 22 bp, Artificial Sequence
  Synthetic Construct
gcgtctggtctgtgagggtaga

SEQ ID NO: 1562 - DNA, 23 bp, Artificial Sequence
  Synthetic Construct
gagcgtggagagaaaagcaatgt

SEQ ID NO: 1563 - DNA, 21 bp, Artificial Sequence
  Synthetic Construct
cgataagcccgtgttcctgtt

SEQ ID NO: 1564 - DNA, 21 bp, Artificial Sequence
  Synthetic Construct
acgctggatctccaggacact

SEQ ID NO: 1565 - DNA, 24 bp, Artificial Sequence
  Synthetic Construct
caccctcttccctgttaaaggatt

SEQ ID NO: 1566 - DNA, 25 bp, Artificial Sequence
  Synthetic Construct
gctgattctgtgcaaagtccagtgt

SEQ ID NO: 1567 - DNA, 22 bp, Artificial Sequence
  Synthetic Construct
cgatgaaaggctgggagctgaa

SEQ ID NO: 1568 - DNA, 20 bp, Artificial Sequence
  Synthetic Construct
ccggccactggctgctatac

SEQ ID NO: 1569 - DNA, 22 bp, Artificial Sequence
  Synthetic Construct
ctctgcatgtggagcaaaccaa

SEQ ID NO: 1570 - DNA, 21 bp, Artificial Sequence
  Synthetic Construct
aggtaaggggaggctgcagaa

SEQ ID NO: 1571 - DNA, 23 bp, Artificial Sequence
  Synthetic Construct
gctagataatgctgcctgctttg

SEQ ID NO: 1572 - DNA, 26 bp, Artificial Sequence
  Synthetic Construct
ctgaaaagatcactaccaggatgcta

SEQ ID NO: 1573 - DNA, 22 bp, Artificial Sequence
  Synthetic Construct
agacaacagcgttgcttgagta

SEQ ID NO: 1574 - DNA, 23 bp, Artificial Sequence
  Synthetic Construct
agggagagcctctgatgaaaagt

SEQ ID NO: 1575 - DNA, 22 bp, Artificial Sequence
  Synthetic Construct
ccagtgtaggctcacattctgt

SEQ ID NO: 1576 - DNA, 22 bp, Artificial Sequence
  Synthetic Construct
cccaggagtctctgtccattgt

SEQ ID NO: 1577 - DNA, 22 bp, Artificial Sequence
  Synthetic Construct
tcctggtgtggacgtgtctcat

SEQ ID NO: 1578 - DNA, 22 bp, Artificial Sequence
  Synthetic Construct
cgtcaggggtcccttctttttg

SEQ ID NO: 1579 - DNA, 24 bp, Artificial Sequence
  Synthetic Construct
gccagagccttcatttgggagaaa

SEQ ID NO: 1580 - DNA, 19 bp, Artificial Sequence
  Synthetic Construct
tgggcctcctccagccttt

SEQ ID NO: 1581 - DNA, 23 bp, Artificial Sequence
  Synthetic Construct
gttttcccaggcctctcttcttc

SEQ ID NO: 1582 - DNA, 23 bp, Artificial Sequence
  Synthetic Construct
gggatgtacccaaaggcttctct

SEQ ID NO: 1583 - DNA, 22 bp, Artificial Sequence
  Synthetic Construct
ggtgcttcacagggttcacagt

SEQ ID NO: 1584 - DNA, 20 bp, Artificial Sequence
  Synthetic Construct
agccagcaggtgccattcat

SEQ ID NO: 1585 - DNA, 23 bp, Artificial Sequence
  Synthetic Construct
gggaagtaaacatcccagcttca

SEQ ID NO: 1586 - DNA, 21 bp, Artificial Sequence
  Synthetic Construct
gcagttctccctgcaggcttt

SEQ ID NO: 1587 - DNA, 27 bp, Artificial Sequence
  Synthetic Construct
cttcccgtattgctaaggaactattct

SEQ ID NO: 1588 - DNA, 22 bp, Artificial Sequence
  Synthetic Construct
ctgtgcagcagaggcagttatg

SEQ ID NO: 1589 - DNA, 21 bp, Artificial Sequence
  Synthetic Construct
gggcctcgaaaggcagaaatc

SEQ ID NO: 1590 - DNA, 22 bp, Artificial Sequence
  Synthetic Construct
gcatccatccgggcagttttca

SEQ ID NO: 1591 - DNA, 26 bp, Artificial Sequence
  Synthetic Construct
gaagagcaggagctacttctatccat

SEQ ID NO: 1592 - DNA, 24 bp, Artificial Sequence
  Synthetic Construct
gaccccagactcagtcagtagatg

SEQ ID NO: 1593 - DNA, 24 bp, Artificial Sequence
  Synthetic Construct
caaactggaaaccatacccacttc

SEQ ID NO: 1594 - DNA, 20 bp, Artificial Sequence
  Synthetic Construct
tggggctccaccagccagaa

SEQ ID NO: 1595 - DNA, 22 bp, Artificial Sequence
  Synthetic Construct
gcgtctaacagcctcacccaat

SEQ ID NO: 1596 - DNA, 21 bp, Artificial Sequence
  Synthetic Construct
ctggtgggagtgggcttattt

SEQ ID NO: 1597 - DNA, 28 bp, Artificial Sequence
  Synthetic Construct
gcaagtgttatcagaagtccaccttagt

SEQ ID NO: 1598 - DNA, 24 bp, Artificial Sequence
  Synthetic Construct
tgagccaaagactttccctgtatt

SEQ ID NO: 1599 - DNA, 20 bp, Artificial Sequence
  Synthetic Construct
gccagacgcaggcctagtaa

SEQ ID NO: 1600 - DNA, 20 bp, Artificial Sequence
  Synthetic Construct
tggccacgtcctctccacta

SEQ ID NO: 1601 - DNA, 24 bp, Artificial Sequence
  Synthetic Construct
acagcaggcttaatcctagaggta

SEQ ID NO: 1602 - DNA, 24 bp, Artificial Sequence
  Synthetic Construct
cccagagttgcagtaggacacagt

SEQ ID NO: 1603 - DNA, 19 bp, Artificial Sequence
  Synthetic Construct
ctgcttgccccgacctctt

SEQ ID NO: 1604 - DNA, 19 bp, Artificial Sequence
  Synthetic Construct
tgcccggctcagtttgaat

SEQ ID NO: 1605 - DNA, 23 bp, Artificial Sequence
  Synthetic Construct
ctgccttagggatctgggtgatg

SEQ ID NO: 1606 - DNA, 22 bp, Artificial Sequence
  Synthetic Construct
ggctttggaaggagccatctgt

SEQ ID NO: 1607 - DNA, 20 bp, Artificial Sequence
  Synthetic Construct
ccagcttcagtgtgcaccaa

SEQ ID NO: 1608 - DNA, 25 bp, Artificial Sequence
  Synthetic Construct
cctgagagctgtactgttgctcgaa

SEQ ID NO: 1609 - DNA, 21 bp, Artificial Sequence
  Synthetic Construct
tttcctcactgggtgggatct

SEQ ID NO: 1610 - DNA, 20 bp, Artificial Sequence
  Synthetic Construct
gcgggcaattccacatctga

SEQ ID NO: 1611 - DNA, 22 bp, Artificial Sequence
  Synthetic Construct
ccaactcagggcaagtggttct

SEQ ID NO: 1612 - DNA, 26 bp, Artificial Sequence
  Synthetic Construct
ggttgcaaagtactgtgggaataaag

SEQ ID NO: 1613 - DNA, 22 bp, Artificial Sequence
  Synthetic Construct
gaggacttgggcctttcctatc

SEQ ID NO: 1614 - DNA, 19 bp, Artificial Sequence
  Synthetic Construct
tctgcgatgcgttcctgtt

SEQ ID NO: 1615 - DNA, 20 bp, Artificial Sequence
  Synthetic Construct
gtgaagcttgggctggtttg

SEQ ID NO: 1616 - DNA, 24 bp, Artificial Sequence
  Synthetic Construct
ccatacaaagcaagagtgggaagt

SEQ ID NO: 1617 - DNA, 22 bp, Artificial Sequence
  Synthetic Construct
gggaggggtttccccactaaga

SEQ ID NO: 1618 - DNA, 23 bp, Artificial Sequence
  Synthetic Construct
catcttccaatgtggagctgtca

SEQ ID NO: 1619 - DNA, 19 bp, Artificial Sequence
  Synthetic Construct
cagccgctgactgcctcat

SEQ ID NO: 1620 - DNA, 21 bp, Artificial Sequence
  Synthetic Construct
cgaaaaggggatggtgctttc

SEQ ID NO: 1621 - DNA, 20 bp, Artificial Sequence
  Synthetic Construct
cccctgctggtggtctgttc

SEQ ID NO: 1622 - DNA, 19 bp, Artificial Sequence
  Synthetic Construct
gggcctgggttctccttct

SEQ ID NO: 1623 - DNA, 22 bp, Artificial Sequence
  Synthetic Construct
cagtgcctgtggttctcacact

SEQ ID NO: 1624 - DNA, 23 bp, Artificial Sequence
  Synthetic Construct
gcttacactgacgctgcaactga

SEQ ID NO: 1625 - DNA, 19 bp, Artificial Sequence
  Synthetic Construct
tgccctgcacctctgatct

SEQ ID NO: 1626 - DNA, 20 bp, Artificial Sequence
  Synthetic Construct
ggaggccaccacacctccta

SEQ ID NO: 1627 - DNA, 21 bp, Artificial Sequence
  Synthetic Construct
tctcagccgactcagatcact

SEQ ID NO: 1628 - DNA, 22 bp, Artificial Sequence
  Synthetic Construct
cattctggagtgtgggtggatt

SEQ ID NO: 1629 - DNA, 22 bp, Artificial Sequence
  Synthetic Construct
acggtgaaaaatgaggctgtgt

SEQ ID NO: 1630 - DNA, 19 bp, Artificial Sequence
  Synthetic Construct
ggggacaggaggcatgaga

SEQ ID NO: 1631 - DNA, 20 bp, Artificial Sequence
  Synthetic Construct
tgccactgcgtcatctgtga

SEQ ID NO: 1632 - DNA, 19 bp, Artificial Sequence
  Synthetic Construct
ggcgcctggggacttcatt

SEQ ID NO: 1633 - DNA, 22 bp, Artificial Sequence
  Synthetic Construct
ctctggccccacaaatcaatgt

SEQ ID NO: 1634 - DNA, 24 bp, Artificial Sequence
  Synthetic Construct
accctgtccccaataccctgtatc

SEQ ID NO: 1635 - DNA, 24 bp, Artificial Sequence
  Synthetic Construct
gcctgacctatgaccttcagtaac

SEQ ID NO: 1636 - DNA, 20 bp, Artificial Sequence
  Synthetic Construct
ggagccaccatgacgactgt

SEQ ID NO: 1637 - DNA, 24 bp, Artificial Sequence
  Synthetic Construct
cctgagccctaacaatgatccaaa

SEQ ID NO: 1638 - DNA, 18 bp, Artificial Sequence
  Synthetic Construct
tgagcctcctgcctgcta

SEQ ID NO: 1639 - DNA, 18 bp, Artificial Sequence
  Synthetic Construct
gtgccctttggccaccat

SEQ ID NO: 1640 - DNA, 21 bp, Artificial Sequence
  Synthetic Construct
gctggatgggcagacaggaaa

SEQ ID NO: 1641 - DNA, 19 bp, Artificial Sequence
  Synthetic Construct
acacggccgtccagtcagt

SEQ ID NO: 1642 - DNA, 20 bp, Artificial Sequence
  Synthetic Construct
tgcgtgacaaggggcaagat

SEQ ID NO: 1643 - DNA, 21 bp, Artificial Sequence
  Synthetic Construct
ccaccaggactcgggtcttct

SEQ ID NO: 1644 - DNA, 24 bp, Artificial Sequence
  Synthetic Construct
ggacctccctggatgaagatgaga

SEQ ID NO: 1645 - DNA, 20 bp, Artificial Sequence
  Synthetic Construct
ggggacaccgatgggagaca

SEQ ID NO: 1646 - DNA, 21 bp, Artificial Sequence
  Synthetic Construct
gtggaatgcaggactgtgtct

SEQ ID NO: 1647 - DNA, 23 bp, Artificial Sequence
  Synthetic Construct
ccagaccccttgactctatccaa

SEQ ID NO: 1648 - DNA, 20 bp, Artificial Sequence
  Synthetic Construct
tccacttcagctgcgccaaa

SEQ ID NO: 1649 - DNA, 22 bp, Artificial Sequence
  Synthetic Construct
gtgtgtgatttggcccggatct

SEQ ID NO: 1650 - DNA, 20 bp, Artificial Sequence
  Synthetic Construct
agaagggatcaccccacctt

SEQ ID NO: 1651 - DNA, 24 bp, Artificial Sequence
  Synthetic Construct
ctccgcctcaagtaccttgaattt

SEQ ID NO: 1652 - DNA, 22 bp, Artificial Sequence
  Synthetic Construct
gcttggactcatggtacacgtt

SEQ ID NO: 1653 - DNA, 25 bp, Artificial Sequence
  Synthetic Construct
catcgccactacaattcacctctga

SEQ ID NO: 1654 - DNA, 22 bp, Artificial Sequence
  Synthetic Construct
ctcccttgccactttcctctga

SEQ ID NO: 1655 - DNA, 22 bp, Artificial Sequence
  Synthetic Construct
gccaacaccttgatggcaggtt

SEQ ID NO: 1656 - DNA, 23 bp, Artificial Sequence
  Synthetic Construct
gttatcccatcgattccctgcat

SEQ ID NO: 1657 - DNA, 18 bp, Artificial Sequence
  Synthetic Construct
tgcgaggcagagcacgtt

SEQ ID NO: 1658 - DNA, 24 bp, Artificial Sequence
  Synthetic Construct
ggggatgggttacaatgtatgtct

SEQ ID NO: 1659 - DNA, 23 bp, Artificial Sequence
  Synthetic Construct
gattggggaatgcagcttacaga

SEQ ID NO: 1660 - DNA, 21 bp, Artificial Sequence
  Synthetic Construct
caggctttggggcaacagaga

SEQ ID NO: 1661 - DNA, 21 bp, Artificial Sequence
  Synthetic Construct
ggggcatctgccttctggaat

SEQ ID NO: 1662 - DNA, 22 bp, Artificial Sequence
  Synthetic Construct
cactagagccagctcggaatac

SEQ ID NO: 1663 - DNA, 24 bp, Artificial Sequence
  Synthetic Construct
cggattctcagagagcaagcgtaa

SEQ ID NO: 1664 - DNA, 18 bp, Artificial Sequence
  Synthetic Construct
gctgcacccttggagcat

SEQ ID NO: 1665 - DNA, 21 bp, Artificial Sequence
  Synthetic Construct
tttccgtgccctgaccactct

SEQ ID NO: 1666 - DNA, 22 bp, Artificial Sequence
  Synthetic Construct
gctttcagggtggtgagtgagt

SEQ ID NO: 1667 - DNA, 26 bp, Artificial Sequence
  Synthetic Construct
gccagaggacatatttccaagcaatc

SEQ ID NO: 1668 - DNA, 22 bp, Artificial Sequence
  Synthetic Construct
cacagactcacacgggtgttca

SEQ ID NO: 1669 - DNA, 22 bp, Artificial Sequence
  Synthetic Construct
ccctcaggcaaaatcccataca

SEQ ID NO: 1670 - DNA, 24 bp, Artificial Sequence
  Synthetic Construct
ctctctgtccctctggagtaagaa

SEQ ID NO: 1671 - DNA, 24 bp, Artificial Sequence
  Synthetic Construct
tctctgactaccatcttccactgt

SEQ ID NO: 1672 - DNA, 22 bp, Artificial Sequence
  Synthetic Construct
cgcagcaccatagtcacagcaa

SEQ ID NO: 1673 - DNA, 21 bp, Artificial Sequence
  Synthetic Construct
gccttggatgatggagcaagt

SEQ ID NO: 1674 - DNA, 24 bp, Artificial Sequence
  Synthetic Construct
gtctccaaactgtcctttcctcaa

SEQ ID NO: 1675 - DNA, 22 bp, Artificial Sequence
  Synthetic Construct
aagtgagggctgcaaggagtca

SEQ ID NO: 1676 - DNA, 20 bp, Artificial Sequence
  Synthetic Construct
acgtggtgatctgggagaga

SEQ ID NO: 1677 - DNA, 19 bp, Artificial Sequence
  Synthetic Construct
aggccgaggagctggactt

SEQ ID NO: 1678 - DNA, 24 bp, Artificial Sequence
  Synthetic Construct
caaggtgtgcccaatccaactatc

SEQ ID NO: 1679 - DNA, 19 bp, Artificial Sequence
  Synthetic Construct
ggtggtggtccctcagtct

SEQ ID NO: 1680 - DNA, 19 bp, Artificial Sequence
  Synthetic Construct
aagggcacggccagtaaac

SEQ ID NO: 1681 - DNA, 20 bp, Artificial Sequence
  Synthetic Construct
agcctggggcctgggaatta

SEQ ID NO: 1682 - DNA, 20 bp, Artificial Sequence
  Synthetic Construct
caccgtggctgtgtggagat

SEQ ID NO: 1683 - DNA, 22 bp, Artificial Sequence
  Synthetic Construct
tggagagatgggctctccttag

SEQ ID NO: 1684 - DNA, 24 bp, Artificial Sequence
  Synthetic Construct
ctgcattacctgccctacctatct

SEQ ID NO: 1685 - DNA, 20 bp, Artificial Sequence
  Synthetic Construct
ccctgcgggacttgtggtaa

SEQ ID NO: 1686 - DNA, 23 bp, Artificial Sequence
  Synthetic Construct
cagtggtgtccctaaagcactct

SEQ ID NO: 1687 - DNA, 23 bp, Artificial Sequence
  Synthetic Construct
acggggctgctataaggattaag

SEQ ID NO: 1688 - DNA, 24 bp, Artificial Sequence
  Synthetic Construct
cgacagaggctgtgaatccccaaa

SEQ ID NO: 1689 - DNA, 22 bp, Artificial Sequence
  Synthetic Construct
gccactgatccaggtgacttct

SEQ ID NO: 1690 - DNA, 22 bp, Artificial Sequence
  Synthetic Construct
gccagctcgacagtttcttaca

SEQ ID NO: 1691 - DNA, 20 bp, Artificial Sequence
  Synthetic Construct
agtgggatggggctgctgtt

SEQ ID NO: 1692 - DNA, 23 bp, Artificial Sequence
  Synthetic Construct
gcagagtcccttggtggtgtaag

SEQ ID NO: 1693 - DNA, 21 bp, Artificial Sequence
  Synthetic Construct
caggcccacattctccacaga

SEQ ID NO: 1694 - DNA, 22 bp, Artificial Sequence
  Synthetic Construct
tgcaaacatggacgggtttgat

SEQ ID NO: 1695 - DNA, 24 bp, Artificial Sequence
  Synthetic Construct
gtgttgcagcactaaaacatcaca

SEQ ID NO: 1696 - DNA, 24 bp, Artificial Sequence
  Synthetic Construct
acaaagggaaatccaatggtcact

SEQ ID NO: 1697 - DNA, 20 bp, Artificial Sequence
  Synthetic Construct
gctgggaagctctgcctcaa

SEQ ID NO: 1698 - DNA, 21 bp, Artificial Sequence
  Synthetic Construct
tgggaagtccacccactccaa

SEQ ID NO: 1699 - DNA, 22 bp, Artificial Sequence
  Synthetic Construct
ccacggaggaagaaccagaagt

SEQ ID NO: 1700 - DNA, 20 bp, Artificial Sequence
  Synthetic Construct
atcacccggaggacccatgt

SEQ ID NO: 1701 - DNA, 21 bp, Artificial Sequence
  Synthetic Construct
aggggcctaagtgggctcttc

SEQ ID NO: 1702 - DNA, 22 bp, Artificial Sequence
  Synthetic Construct
gaaaaacgggttagggcagaga

SEQ ID NO: 1703 - DNA, 20 bp, Artificial Sequence
  Synthetic Construct
cggaatgggatgccttggaa

SEQ ID NO: 1704 - DNA, 18 bp, Artificial Sequence
  Synthetic Construct
cactgtcccgctgcagat

SEQ ID NO: 1705 - DNA, 24 bp, Artificial Sequence
  Synthetic Construct
tgtcacagatcagttggtgaatgt

SEQ ID NO: 1706 - DNA, 21 bp, Artificial Sequence
  Synthetic Construct
ccaggacccgagatggtctgt

SEQ ID NO: 1707 - DNA, 23 bp, Artificial Sequence
  Synthetic Construct
agagaccaagggcttctctctaa

SEQ ID NO: 1708 - DNA, 23 bp, Artificial Sequence
  Synthetic Construct
gagggaggtgaatccacgagaga

SEQ ID NO: 1709 - DNA, 20 bp, Artificial Sequence
  Synthetic Construct
agggccaccacggtgagaaa

SEQ ID NO: 1710 - DNA, 22 bp, Artificial Sequence
  Synthetic Construct
agagagccatcctcccttccaa

SEQ ID NO: 1711 - DNA, 23 bp, Artificial Sequence
  Synthetic Construct
acttctgagcaagtgtgatgtga

SEQ ID NO: 1712 - DNA, 22 bp, Artificial Sequence
  Synthetic Construct
ggcgacagttcctctggactta

SEQ ID NO: 1713 - DNA, 22 bp, Artificial Sequence
  Synthetic Construct
cagattggcgacccacccttat

SEQ ID NO: 1714 - DNA, 24 bp, Artificial Sequence
  Synthetic Construct
ggcctttcctaagctgatggttga

SEQ ID NO: 1715 - DNA, 24 bp, Artificial Sequence
  Synthetic Construct
gctggcatctaatgctgccatgtt

SEQ ID NO: 1716 - DNA, 22 bp, Artificial Sequence
  Synthetic Construct
gctgctcagagagaaactgcat

SEQ ID NO: 1717 - DNA, 22 bp, Artificial Sequence
  Synthetic Construct
gatccgcctgagaaggaacaag

SEQ ID NO: 1718 - DNA, 22 bp, Artificial Sequence
  Synthetic Construct
atgccctcgagaccagctagaa

SEQ ID NO: 1719 - DNA, 21 bp, Artificial Sequence
  Synthetic Construct
gaggtttggggtgcgaatgat

SEQ ID NO: 1720 - DNA, 22 bp, Artificial Sequence
  Synthetic Construct
gcagaagttgctggttctgttt

SEQ ID NO: 1721 - DNA, 20 bp, Artificial Sequence
  Synthetic Construct
gggcagaggcaggaccattg

SEQ ID NO: 1722 - DNA, 24 bp, Artificial Sequence
  Synthetic Construct
gctggtattttcgtttctgcatgt

SEQ ID NO: 1723 - DNA, 19 bp, Artificial Sequence
  Synthetic Construct
ttgcccctcctcccctcaa

SEQ ID NO: 1724 - DNA, 23 bp, Artificial Sequence
  Synthetic Construct
acatgcctacacccaaagtcatc

SEQ ID NO: 1725 - DNA, 20 bp, Artificial Sequence
  Synthetic Construct
tgcctggaggaaggaagtca

SEQ ID NO: 1726 - DNA, 23 bp, Artificial Sequence
  Synthetic Construct
ccttccctctggattttgggttt

SEQ ID NO: 1727 - DNA, 20 bp, Artificial Sequence
  Synthetic Construct
agctcctcacccagcctcaa

SEQ ID NO: 1728 - DNA, 21 bp, Artificial Sequence
  Synthetic Construct
acacctgtggaccatgtctga

SEQ ID NO: 1729 - DNA, 22 bp, Artificial Sequence
  Synthetic Construct
gccccaggtatgcttgaccatt

SEQ ID NO: 1730 - DNA, 20 bp, Artificial Sequence
  Synthetic Construct
acccagcaacccacgaaatc

SEQ ID NO: 1731 - DNA, 25 bp, Artificial Sequence
  Synthetic Construct
ggagaccagaacatgacactccaat

SEQ ID NO: 1732 - DNA, 20 bp, Artificial Sequence
  Synthetic Construct
ctgggcaccttgcagctttt

SEQ ID NO: 1733 - DNA, 21 bp, Artificial Sequence
  Synthetic Construct
aggccctgtttccctggaatg

SEQ ID NO: 1734 - DNA, 21 bp, Artificial Sequence
  Synthetic Construct
atctgccgagccaggtcactt

SEQ ID NO: 1735 - DNA, 21 bp, Artificial Sequence
  Synthetic Construct
ggttttgcccaccacctctga

SEQ ID NO: 1736 - DNA, 23 bp, Artificial Sequence
  Synthetic Construct
aaggttgtgctttctctcgctat

SEQ ID NO: 1737 - DNA, 22 bp, Artificial Sequence
  Synthetic Construct
ccttagctcggtcgcctaaact

SEQ ID NO: 1738 - DNA, 23 bp, Artificial Sequence
  Synthetic Construct
cccactatggcaaagatccatca

SEQ ID NO: 1739 - DNA, 20 bp, Artificial Sequence
  Synthetic Construct
tggcacccagtcatctgcta

SEQ ID NO: 1740 - DNA, 23 bp, Artificial Sequence
  Synthetic Construct
catccccgtgtttcaaaggaaag

SEQ ID NO: 1741 - DNA, 23 bp, Artificial Sequence
  Synthetic Construct
aaggacgtacaatttcggagtca

SEQ ID NO: 1742 - DNA, 21 bp, Artificial Sequence
  Synthetic Construct
tccttccctagctgggccttt

SEQ ID NO: 1743 - DNA, 19 bp, Artificial Sequence
  Synthetic Construct
ggggcgataggcacacaca

SEQ ID NO: 1744 - DNA, 22 bp, Artificial Sequence
  Synthetic Construct
ctgacataggtggctggagtga

SEQ ID NO: 1745 - DNA, 22 bp, Artificial Sequence
  Synthetic Construct
ccgcagacagagaagcagtcta

SEQ ID NO: 1746 - DNA, 20 bp, Artificial Sequence
  Synthetic Construct
gactgccgcagctcttgtaa

SEQ ID NO: 1747 - DNA, 22 bp, Artificial Sequence
  Synthetic Construct
gccatggtttagggtcctggat

SEQ ID NO: 1748 - DNA, 20 bp, Artificial Sequence
  Synthetic Construct
ctccccgggtagagcagtga

SEQ ID NO: 1749 - DNA, 22 bp, Artificial Sequence
  Synthetic Construct
cactggggcttccctttacgat

SEQ ID NO: 1750 - DNA, 22 bp, Artificial Sequence
  Synthetic Construct
ccgatggccaaaggctctcaaa

SEQ ID NO: 1751 - DNA, 21 bp, Artificial Sequence
  Synthetic Construct
acacacttcatcacgccttgt

SEQ ID NO: 1752 - DNA, 24 bp, Artificial Sequence
  Synthetic Construct
tccttgatctcccactccattttc

SEQ ID NO: 1753 - DNA, 20 bp, Artificial Sequence
  Synthetic Construct
acctggctggccacttctca

SEQ ID NO: 1754 - DNA, 19 bp, Artificial Sequence
  Synthetic Construct
acctgcctgcctcgtgttc

SEQ ID NO: 1755 - DNA, 20 bp, Artificial Sequence
  Synthetic Construct
aagtctcagggccactccat

SEQ ID NO: 1756 - DNA, 21 bp, Artificial Sequence
  Synthetic Construct
atcaggcccagagagacatga

SEQ ID NO: 1757 - DNA, 22 bp, Artificial Sequence
  Synthetic Construct
ggatgaggggctggcttcatac

SEQ ID NO: 1758 - DNA, 19 bp, Artificial Sequence
  Synthetic Construct
accccagggaagcaagcat

SEQ ID NO: 1759 - DNA, 18 bp, Artificial Sequence
  Synthetic Construct
cgcgtggctgcttgagaa

SEQ ID NO: 1760 - DNA, 23 bp, Artificial Sequence
  Synthetic Construct
agctcaagggaagatgtctccta

SEQ ID NO: 1761 - DNA, 23 bp, Artificial Sequence
  Synthetic Construct
gccctcctcaaagttaggactga

SEQ ID NO: 1762 - DNA, 22 bp, Artificial Sequence
  Synthetic Construct
tcgccctagccctggaaattca

SEQ ID NO: 1763 - DNA, 20 bp, Artificial Sequence
  Synthetic Construct
gggcagtgtccgcaaagttc

SEQ ID NO: 1764 - DNA, 22 bp, Artificial Sequence
  Synthetic Construct
agactccgtcaccctccacaat

SEQ ID NO: 1765 - DNA, 21 bp, Artificial Sequence
  Synthetic Construct
ttgtagccgttccaagagcaa

SEQ ID NO: 1766 - DNA, 24 bp, Artificial Sequence
  Synthetic Construct
ccagaaaacctgtaggcaagatgt

SEQ ID NO: 1767 - DNA, 20 bp, Artificial Sequence
  Synthetic Construct
cgactcacccgctcagcaaa

SEQ ID NO: 1768 - DNA, 19 bp, Artificial Sequence
  Synthetic Construct
ctgccaggcctctctcaca

SEQ ID NO: 1769 - DNA, 20 bp, Artificial Sequence
  Synthetic Construct
cctgtccctgagccctctgt

SEQ ID NO: 1770 - DNA, 20 bp, Artificial Sequence
  Synthetic Construct
acggctggtccttccagtca

SEQ ID NO: 1771 - DNA, 21 bp, Artificial Sequence
  Synthetic Construct
ctcgagcctttgtggacatct

SEQ ID NO: 1772 - DNA, 20 bp, Artificial Sequence
  Synthetic Construct
catgcacactctgcctcgaa

SEQ ID NO: 1773 - DNA, 24 bp, Artificial Sequence
  Synthetic Construct
gccaaatcacctccatcactcaag

SEQ ID NO: 1774 - DNA, 23 bp, Artificial Sequence
  Synthetic Construct
cggacaccaactgtcttgttttg

SEQ ID NO: 1775 - DNA, 20 bp, Artificial Sequence
  Synthetic Construct
ccaccatgcctgttctcact

SEQ ID NO: 1776 - DNA, 25 bp, Artificial Sequence
  Synthetic Construct
gatttagttgcacctttcccaagtt

SEQ ID NO: 1777 - DNA, 20 bp, Artificial Sequence
  Synthetic Construct
tgtgctgccagctgtggtta

SEQ ID NO: 1778 - DNA, 20 bp, Artificial Sequence
  Synthetic Construct
cagcccctcgtttctgttct

SEQ ID NO: 1779 - DNA, 21 bp, Artificial Sequence
  Synthetic Construct
ttcctcttccgccccaacact

SEQ ID NO: 1780 - DNA, 23 bp, Artificial Sequence
  Synthetic Construct
cctctgagacctgaatggtgtga

SEQ ID NO: 1781 - DNA, 21 bp, Artificial Sequence
  Synthetic Construct
ggaagagccgtctccccttga

SEQ ID NO: 1782 - DNA, 19 bp, Artificial Sequence
  Synthetic Construct
acgtggccccagtgtgact

SEQ ID NO: 1783 - DNA, 21 bp, Artificial Sequence
  Synthetic Construct
ggctgcagcagagactgcttt

SEQ ID NO: 1784 - DNA, 23 bp, Artificial Sequence
  Synthetic Construct
ctcaatgagaccgatgcaagttc

SEQ ID NO: 1785 - DNA, 22 bp, Artificial Sequence
  Synthetic Construct
tggacacagaggcagaagagat

SEQ ID NO: 1786 - DNA, 22 bp, Artificial Sequence
  Synthetic Construct
cctcgctagccaactcttctga

SEQ ID NO: 1787 - DNA, 22 bp, Artificial Sequence
  Synthetic Construct
aaggctcccctgcatcctaaag

SEQ ID NO: 1788 - DNA, 26 bp, Artificial Sequence
  Synthetic Construct
ccaggctagacacagaggatgtttac

SEQ ID NO: 1789 - DNA, 23 bp, Artificial Sequence
  Synthetic Construct
agaagcagcatatggtggaaact

SEQ ID NO: 1790 - DNA, 18 bp, Artificial Sequence
  Synthetic Construct
gcgtggtgctggttggaa

SEQ ID NO: 1791 - DNA, 23 bp, Artificial Sequence
  Synthetic Construct
tgctttgctggggatcttttctt

SEQ ID NO: 1792 - DNA, 22 bp, Artificial Sequence
  Synthetic Construct
cctgacccgaatgccaacttca

SEQ ID NO: 1793 - DNA, 19 bp, Artificial Sequence
  Synthetic Construct
ctgatgcccagtgccacat

SEQ ID NO: 1794 - DNA, 21 bp, Artificial Sequence
  Synthetic Construct
acgctggcaggctctcaatag

SEQ ID NO: 1795 - DNA, 20 bp, Artificial Sequence
  Synthetic Construct
gccttggcccctcaaacaag

SEQ ID NO: 1796 - DNA, 21 bp, Artificial Sequence
  Synthetic Construct
tgctacctttggcagggtgta

SEQ ID NO: 1797 - DNA, 22 bp, Artificial Sequence
  Synthetic Construct
agaaggaacggctccagtgatg

SEQ ID NO: 1798 - DNA, 27 bp, Artificial Sequence
  Synthetic Construct
gcctaaggtttttcttaggtcttggta

SEQ ID NO: 1799 - DNA, 24 bp, Artificial Sequence
  Synthetic Construct
ccagaggaagcttgtttgatgaga

SEQ ID NO: 1800 - DNA, 20 bp, Artificial Sequence
  Synthetic Construct
tctccccacacttgcccttt

SEQ ID NO: 1801 - DNA, 19 bp, Artificial Sequence
  Synthetic Construct
gcaggcacctgcagtcaca

SEQ ID NO: 1802 - DNA, 22 bp, Artificial Sequence
  Synthetic Construct
ccagcaaaggctccttccttct

SEQ ID NO: 1803 - DNA, 23 bp, Artificial Sequence
  Synthetic Construct
ccgccaaaatctactgggacttt

SEQ ID NO: 1804 - DNA, 19 bp, Artificial Sequence
  Synthetic Construct
agccctgccgagtgacgat

SEQ ID NO: 1805 - DNA, 23 bp, Artificial Sequence
  Synthetic Construct
ctcccaccacccttcctagaaca

SEQ ID NO: 1806 - DNA, 20 bp, Artificial Sequence
  Synthetic Construct
aggttagagcccctgtgcaa

SEQ ID NO: 1807 - DNA, 23 bp, Artificial Sequence
  Synthetic Construct
ggaaaatgcacggtggaaagaga

SEQ ID NO: 1808 - DNA, 21 bp, Artificial Sequence
  Synthetic Construct
aggtacatgggctcagagaca

SEQ ID NO: 1809 - DNA, 20 bp, Artificial Sequence
  Synthetic Construct
gaggtgggtttgcagtggtt

SEQ ID NO: 1810 - DNA, 23 bp, Artificial Sequence
  Synthetic Construct
tccaccctttcctagcctttctt

SEQ ID NO: 1811 - DNA, 25 bp, Artificial Sequence
  Synthetic Construct
gcaacatagaagcaaggcagttttt

SEQ ID NO: 1812 - DNA, 24 bp, Artificial Sequence
  Synthetic Construct
cacagggcatgatttcctggctta

SEQ ID NO: 1813 - DNA, 20 bp, Artificial Sequence
  Synthetic Construct
atgggcggagttgtgttcaa

SEQ ID NO: 1814 - DNA, 26 bp, Artificial Sequence
  Synthetic Construct
gctacttcccaatttggtttgacaca

SEQ ID NO: 1815 - DNA, 19 bp, Artificial Sequence
  Synthetic Construct
tgctggggcaaggctcaaa

SEQ ID NO: 1816 - DNA, 20 bp, Artificial Sequence
  Synthetic Construct
acatgtgaccccagggatgt

SEQ ID NO: 1817 - DNA, 20 bp, Artificial Sequence
  Synthetic Construct
tggtccctgtcttgcagtct

SEQ ID NO: 1818 - DNA, 23 bp, Artificial Sequence
  Synthetic Construct
cccagaccctggaataggacttg

SEQ ID NO: 1819 - DNA, 19 bp, Artificial Sequence
  Synthetic Construct
agggctgccccttcacctt

SEQ ID NO: 1820 - DNA, 22 bp, Artificial Sequence
  Synthetic Construct
ggctgaggcaaggtttttgcat

SEQ ID NO: 1821 - DNA, 21 bp, Artificial Sequence
  Synthetic Construct
cctccccttctctccactgat

SEQ ID NO: 1822 - DNA, 21 bp, Artificial Sequence
  Synthetic Construct
agtgaccacaggtgcaagaag

SEQ ID NO: 1823 - DNA, 24 bp, Artificial Sequence
  Synthetic Construct
tgtgtatccttgggatctggtaca

SEQ ID NO: 1824 - DNA, 23 bp, Artificial Sequence
  Synthetic Construct
gagctttcctgatgccttacact

SEQ ID NO: 1825 - DNA, 19 bp, Artificial Sequence
  Synthetic Construct
cgcaggcttctgctgttga

SEQ ID NO: 1826 - DNA, 24 bp, Artificial Sequence
  Synthetic Construct
tgacctgaaagctctttgttccat

SEQ ID NO: 1827 - DNA, 22 bp, Artificial Sequence
  Synthetic Construct
cctctggaggccccactgtaat

SEQ ID NO: 1828 - DNA, 25 bp, Artificial Sequence
  Synthetic Construct
ttctagtacatgccttttggtggat

SEQ ID NO: 1829 - DNA, 21 bp, Artificial Sequence
  Synthetic Construct
gcatggaaccagggcatgact

SEQ ID NO: 1830 - DNA, 21 bp, Artificial Sequence
  Synthetic Construct
cgctttgtccccactcttaca

SEQ ID NO: 1831 - DNA, 23 bp, Artificial Sequence
  Synthetic Construct
cactctgtgcaaaccagttgtag

SEQ ID NO: 1832 - DNA, 21 bp, Artificial Sequence
  Synthetic Construct
tcagcacccatcttgctcatc

SEQ ID NO: 1833 - DNA, 20 bp, Artificial Sequence
  Synthetic Construct
ggagactcctaccccagctt

SEQ ID NO: 1834 - DNA, 23 bp, Artificial Sequence
  Synthetic Construct
ggggattgttaatggccgagact

SEQ ID NO: 1835 - DNA, 21 bp, Artificial Sequence
  Synthetic Construct
acccaccacttgcacagttac

SEQ ID NO: 1836 - DNA, 23 bp, Artificial Sequence
  Synthetic Construct
gggtccctaagcactgtgagaag

SEQ ID NO: 1837 - DNA, 20 bp, Artificial Sequence
  Synthetic Construct
aaccaggccttgcggtaaag

SEQ ID NO: 1838 - DNA, 24 bp, Artificial Sequence
  Synthetic Construct
cctagggaacagtccactgagaga

SEQ ID NO: 1839 - DNA, 24 bp, Artificial Sequence
  Synthetic Construct
gcccgtgttttgaagctactgtct

SEQ ID NO: 1840 - DNA, 24 bp, Artificial Sequence
  Synthetic Construct
gccaaccagttcagttgggagtca

SEQ ID NO: 1841 - DNA, 24 bp, Artificial Sequence
  Synthetic Construct
gccagctagtggctttaaccaagt

SEQ ID NO: 1842 - DNA, 20 bp, Artificial Sequence
  Synthetic Construct
gcttcgcccatggctgtctt

SEQ ID NO: 1843 - DNA, 22 bp, Artificial Sequence
  Synthetic Construct
cgtgatctaccccactgagaca

SEQ ID NO: 1844 - DNA, 20 bp, Artificial Sequence
  Synthetic Construct
agttgggcatggaggcatgt

SEQ ID NO: 1845 - DNA, 21 bp, Artificial Sequence
  Synthetic Construct
aggccttgcaggagagaaatg

SEQ ID NO: 1846 - DNA, 25 bp, Artificial Sequence
  Synthetic Construct
cacctctgctttaggtctcaggttt

SEQ ID NO: 1847 - DNA, 25 bp, Artificial Sequence
  Synthetic Construct
cgatgctgagactaaggagcctaaa

SEQ ID NO: 1848 - DNA, 24 bp, Artificial Sequence
  Synthetic Construct
gtcactcattctgctctacccaaa

SEQ ID NO: 1849 - DNA, 25 bp, Artificial Sequence
  Synthetic Construct
gagcatcctcgagaattgcatttga

SEQ ID NO: 1850 - DNA, 25 bp, Artificial Sequence
  Synthetic Construct
gacaagtcagctggtgaagagtgaa

SEQ ID NO: 1851 - DNA, 23 bp, Artificial Sequence
  Synthetic Construct
gcctgtggcaaacttgaacatga

SEQ ID NO: 1852 - DNA, 23 bp, Artificial Sequence
  Synthetic Construct
tccactgtggtttgagtggaaag

SEQ ID NO: 1853 - DNA, 24 bp, Artificial Sequence
  Synthetic Construct
agactcgctcattcactctcattt

SEQ ID NO: 1854 - DNA, 22 bp, Artificial Sequence
  Synthetic Construct
gaatccagctcagccccttcta

SEQ ID NO: 1855 - DNA, 23 bp, Artificial Sequence
  Synthetic Construct
tcaagcagaacaggactgacaat

SEQ ID NO: 1856 - DNA, 20 bp, Artificial Sequence
  Synthetic Construct
tctcagccttcccgcttcat

SEQ ID NO: 1857 - DNA, 19 bp, Artificial Sequence
  Synthetic Construct
agggcccaggttccttctt

SEQ ID NO: 1858 - DNA, 22 bp, Artificial Sequence
  Synthetic Construct
tcccttccaggatgaccattga

SEQ ID NO: 1859 - DNA, 19 bp, Artificial Sequence
  Synthetic Construct
agccaggaagcctcagagt

SEQ ID NO: 1860 - DNA, 22 bp, Artificial Sequence
  Synthetic Construct
ttgctctaccctcctccagctt

SEQ ID NO: 1861 - DNA, 25 bp, Artificial Sequence
  Synthetic Construct
cccctgccctattttaaccacaaag

SEQ ID NO: 1862 - DNA, 20 bp, Artificial Sequence
  Synthetic Construct
ccactgcacccagccaatct

SEQ ID NO: 1863 - DNA, 20 bp, Artificial Sequence
  Synthetic Construct
aggcaggaagcctgttcaga

SEQ ID NO: 1864 - DNA, 25 bp, Artificial Sequence
  Synthetic Construct
tgtgcaaactctgtgatggaatgta

SEQ ID NO: 1865 - DNA, 20 bp, Artificial Sequence
  Synthetic Construct
aggggcccttctggaggttt

SEQ ID NO: 1866 - DNA, 22 bp, Artificial Sequence
  Synthetic Construct
tcgttccaccatgcttttcctt

SEQ ID NO: 1867 - DNA, 22 bp, Artificial Sequence
  Synthetic Construct
tgcttaaacgaacagggctttg

SEQ ID NO: 1868 - DNA, 21 bp, Artificial Sequence
  Synthetic Construct
tctgcaggggtgtggtatttc

SEQ ID NO: 1869 - DNA, 22 bp, Artificial Sequence
  Synthetic Construct
ccacctatgccacccaaggtat

SEQ ID NO: 1870 - DNA, 23 bp, Artificial Sequence
  Synthetic Construct
cccctccctcgcagaagtataag

SEQ ID NO: 1871 - DNA, 24 bp, Artificial Sequence
  Synthetic Construct
gccttcctaatgccacccagatca

SEQ ID NO: 1872 - DNA, 22 bp, Artificial Sequence
  Synthetic Construct
gcctcagtctcggttagcttca

SEQ ID NO: 1873 - DNA, 20 bp, Artificial Sequence
  Synthetic Construct
tgccctgtgccctcaattct

SEQ ID NO: 1874 - DNA, 23 bp, Artificial Sequence
  Synthetic Construct
accctgtactcctctcattcaca

SEQ ID NO: 1875 - DNA, 19 bp, Artificial Sequence
  Synthetic Construct
ccgcgtctggtcgcttctt

SEQ ID NO: 1876 - DNA, 20 bp, Artificial Sequence
  Synthetic Construct
ctggaggagagggcagtcat

SEQ ID NO: 1877 - DNA, 23 bp, Artificial Sequence
  Synthetic Construct
gggattacaaagttgcgcgtttc

SEQ ID NO: 1878 - DNA, 20 bp, Artificial Sequence
  Synthetic Construct
ggatggagacggcaggaatg

SEQ ID NO: 1879 - DNA, 24 bp, Artificial Sequence
  Synthetic Construct
ggacagagaatcaggtcacggtat

SEQ ID NO: 1880 - DNA, 20 bp, Artificial Sequence
  Synthetic Construct
acctcggcctcaggacttct

SEQ ID NO: 1881 - DNA, 22 bp, Artificial Sequence
  Synthetic Construct
tgctcacaggctcggagatagt

SEQ ID NO: 1882 - DNA, 21 bp, Artificial Sequence
  Synthetic Construct
agcagtcaggtgctcctcctt

SEQ ID NO: 1883 - DNA, 19 bp, Artificial Sequence
  Synthetic Construct
tggtatggggcggcagtga

SEQ ID NO: 1884 - DNA, 20 bp, Artificial Sequence
  Synthetic Construct
cccagctgacacaggctcat

SEQ ID NO: 1885 - DNA, 25 bp, Artificial Sequence
  Synthetic Construct
gtgtccagtctccttgagtcatttg

SEQ ID NO: 1886 - DNA, 19 bp, Artificial Sequence
  Synthetic Construct
ggaggcatgccccatctca

SEQ ID NO: 1887 - DNA, 20 bp, Artificial Sequence
  Synthetic Construct
gtggtgcttgttgccactgt

SEQ ID NO: 1888 - DNA, 24 bp, Artificial Sequence
  Synthetic Construct
gggcagtgatagaactgacatttg

SEQ ID NO: 1889 - DNA, 20 bp, Artificial Sequence
  Synthetic Construct
ggaacgtcagtggtcagctt

SEQ ID NO: 1890 - DNA, 23 bp, Artificial Sequence
  Synthetic Construct
tgtcaccctctctgctcataagt

SEQ ID NO: 1891 - DNA, 22 bp, Artificial Sequence
  Synthetic Construct
gttccatccccaaggacacaga

SEQ ID NO: 1892 - DNA, 23 bp, Artificial Sequence
  Synthetic Construct
gggactggaccaagaagggtatg

SEQ ID NO: 1893 - DNA, 22 bp, Artificial Sequence
  Synthetic Construct
ccatggcagaagctcaggaaac

SEQ ID NO: 1894 - DNA, 22 bp, Artificial Sequence
  Synthetic Construct
ggtctcgctctgtgacaccatt

SEQ ID NO: 1895 - DNA, 23 bp, Artificial Sequence
  Synthetic Construct
gcttccccgtgactgtctcctat

SEQ ID NO: 1896 - DNA, 25 bp, Artificial Sequence
  Synthetic Construct
gagagggtactggtagaagcatttc

SEQ ID NO: 1897 - DNA, 20 bp, Artificial Sequence
  Synthetic Construct
aagtgtggggccctcctaag

SEQ ID NO: 1898 - DNA, 22 bp, Artificial Sequence
  Synthetic Construct
gcagctgctgtctctgcaattc

SEQ ID NO: 1899 - DNA, 21 bp, Artificial Sequence
  Synthetic Construct
ccttgtcctgtgcatctctgt

SEQ ID NO: 1900 - DNA, 23 bp, Artificial Sequence
  Synthetic Construct
caaaggcaaaaagtggcatctgt

SEQ ID NO: 1901 - DNA, 22 bp, Artificial Sequence
  Synthetic Construct
gagcctacctctgtggacttca

SEQ ID NO: 1902 - DNA, 24 bp, Artificial Sequence
  Synthetic Construct
ggaaaaccctctgagcctcacatt

SEQ ID NO: 1903 - DNA, 22 bp, Artificial Sequence
  Synthetic Construct
cggccccttagcttgagttagt

SEQ ID NO: 1904 - DNA, 21 bp, Artificial Sequence
  Synthetic Construct
gaggctgcctagagagacaga

SEQ ID NO: 1905 - DNA, 19 bp, Artificial Sequence
  Synthetic Construct
ggccacgcatgggcatttg

SEQ ID NO: 1906 - DNA, 19 bp, Artificial Sequence
  Synthetic Construct
ggggctcgcgtctctgttt

SEQ ID NO: 1907 - DNA, 22 bp, Artificial Sequence
  Synthetic Construct
ctgtgggatgtcctggaactac

SEQ ID NO: 1908 - DNA, 24 bp, Artificial Sequence
  Synthetic Construct
cttcgagaaaggcttggagatact

SEQ ID NO: 1909 - DNA, 19 bp, Artificial Sequence
  Synthetic Construct
tggccctcaaggagctgta

SEQ ID NO: 1910 - DNA, 22 bp, Artificial Sequence
  Synthetic Construct
gcacccagccagcaattggata

SEQ ID NO: 1911 - DNA, 20 bp, Artificial Sequence
  Synthetic Construct
ccccgattctgcgtttgctt

SEQ ID NO: 1912 - DNA, 22 bp, Artificial Sequence
  Synthetic Construct
agaacccggtccacatgctaac

SEQ ID NO: 1913 - DNA, 22 bp, Artificial Sequence
  Synthetic Construct
ccaaggccctcctctctctaag

SEQ ID NO: 1914 - DNA, 23 bp, Artificial Sequence
  Synthetic Construct
cacaggcagttagggtaggttct

SEQ ID NO: 1915 - DNA, 21 bp, Artificial Sequence
  Synthetic Construct
tccccacgatggcagtgagtt

SEQ ID NO: 1916 - DNA, 22 bp, Artificial Sequence
  Synthetic Construct
tggagcaatatggtgcactgtt

SEQ ID NO: 1917 - DNA, 24 bp, Artificial Sequence
  Synthetic Construct
cactctgtcaagttttgccgtctt

SEQ ID NO: 1918 - DNA, 22 bp, Artificial Sequence
  Synthetic Construct
gcaggcatgacagactttcctt

SEQ ID NO: 1919 - DNA, 23 bp, Artificial Sequence
  Synthetic Construct
gcgttccccatggcatgtctaaa

SEQ ID NO: 1920 - DNA, 24 bp, Artificial Sequence
  Synthetic Construct
ttggagtggacgtcttcctatttc

SEQ ID NO: 1921 - DNA, 20 bp, Artificial Sequence
  Synthetic Construct
cagggctccctcctccattt

SEQ ID NO: 1922 - DNA, 26 bp, Artificial Sequence
  Synthetic Construct
cagcactgagttcattgcctcaaaaa

SEQ ID NO: 1923 - DNA, 23 bp, Artificial Sequence
  Synthetic Construct
gccataggagagaccctgaatct

SEQ ID NO: 1924 - DNA, 22 bp, Artificial Sequence
  Synthetic Construct
gactgcaacagaggctgaccta

SEQ ID NO: 1925 - DNA, 18 bp, Artificial Sequence
  Synthetic Construct
tgccctgggtggtcttgt

SEQ ID NO: 1926 - DNA, 25 bp, Artificial Sequence
  Synthetic Construct
cagcagagacctgatagccctatgt

SEQ ID NO: 1927 - DNA, 23 bp, Artificial Sequence
  Synthetic Construct
gcaacaggttttgtcctctggtt

SEQ ID NO: 1928 - DNA, 22 bp, Artificial Sequence
  Synthetic Construct
cctcgtcctcctcccatccaaa

SEQ ID NO: 1929 - DNA, 19 bp, Artificial Sequence
  Synthetic Construct
ctggaaacggccccagagt

SEQ ID NO: 1930 - DNA, 22 bp, Artificial Sequence
  Synthetic Construct
tggtggggacattttcctgaag

SEQ ID NO: 1931 - DNA, 20 bp, Artificial Sequence
  Synthetic Construct
ctggttgcagtgtggagcat

SEQ ID NO: 1932 - DNA, 21 bp, Artificial Sequence
  Synthetic Construct
tcagatgtcaaccccgcctat

SEQ ID NO: 1933 - DNA, 20 bp, Artificial Sequence
  Synthetic Construct
cggcgactactggaggcttt

SEQ ID NO: 1934 - DNA, 22 bp, Artificial Sequence
  Synthetic Construct
aggtagcccagcagttctccat

SEQ ID NO: 1935 - DNA, 20 bp, Artificial Sequence
  Synthetic Construct
tggcctgcctcacttgctta

SEQ ID NO: 1936 - DNA, 21 bp, Artificial Sequence
  Synthetic Construct
tccggaagacacgagaggaaa

SEQ ID NO: 1937 - DNA, 23 bp, Artificial Sequence
  Synthetic Construct
acatgggttttgagtcagccatt

SEQ ID NO: 1938 - DNA, 25 bp, Artificial Sequence
  Synthetic Construct
gaaccttggctctttgcaagtcatc

SEQ ID NO: 1939 - DNA, 20 bp, Artificial Sequence
  Synthetic Construct
tgactgactgggccttcaga

SEQ ID NO: 1940 - DNA, 25 bp, Artificial Sequence
  Synthetic Construct
ggcaaggcagccaataaaggatgta

SEQ ID NO: 1941 - DNA, 21 bp, Artificial Sequence
  Synthetic Construct
gggcctgttgggcttgttttg

SEQ ID NO: 1942 - DNA, 24 bp, Artificial Sequence
  Synthetic Construct
caaagtggtgagttccttgggttt

SEQ ID NO: 1943 - DNA, 20 bp, Artificial Sequence
  Synthetic Construct
ttgccctcccagtggcttca

SEQ ID NO: 1944 - DNA, 19 bp, Artificial Sequence
  Synthetic Construct
ggtgctctagggcctcaca

SEQ ID NO: 1945 - DNA, 24 bp, Artificial Sequence
  Synthetic Construct
cagtgaggaacgtattcagcctat

SEQ ID NO: 1946 - DNA, 19 bp, Artificial Sequence
  Synthetic Construct
ggcatcgctccacccaagt

SEQ ID NO: 1947 - DNA, 23 bp, Artificial Sequence
  Synthetic Construct
aaagaaagaggccatgtggtaca

SEQ ID NO: 1948 - DNA, 19 bp, Artificial Sequence
  Synthetic Construct
tctggccacctggcgattt

SEQ ID NO: 1949 - DNA, 24 bp, Artificial Sequence
  Synthetic Construct
gacatgacccacaaagccttcctt

SEQ ID NO: 1950 - DNA, 20 bp, Artificial Sequence
  Synthetic Construct
tgcctgacctccatggaaac

SEQ ID NO: 1951 - DNA, 21 bp, Artificial Sequence
  Synthetic Construct
gcccatgtgaggcatagactt

SEQ ID NO: 1952 - DNA, 20 bp, Artificial Sequence
  Synthetic Construct
agaaagccgaggctcagaga

SEQ ID NO: 1953 - DNA, 24 bp, Artificial Sequence
  Synthetic Construct
aggcaagctagctgatatcctttc

SEQ ID NO: 1954 - DNA, 22 bp, Artificial Sequence
  Synthetic Construct
ggtggagtgacccaaaccttca

SEQ ID NO: 1955 - DNA, 27 bp, Artificial Sequence
  Synthetic Construct
ggcatgctttcaatatatcctcctagt

SEQ ID NO: 1956 - DNA, 20 bp, Artificial Sequence
  Synthetic Construct
ccgggaaacctgggaagtga

SEQ ID NO: 1957 - DNA, 22 bp, Artificial Sequence
  Synthetic Construct
cctggtgagtaacggagagtca

SEQ ID NO: 1958 - DNA, 24 bp, Artificial Sequence
  Synthetic Construct
caggcatgggcagtttcttttatc

SEQ ID NO: 1959 - DNA, 22 bp, Artificial Sequence
  Synthetic Construct
accctctgcttctggtgtcagt

SEQ ID NO: 1960 - DNA, 20 bp, Artificial Sequence
  Synthetic Construct
acgcctacagtgagcggaaa

SEQ ID NO: 1961 - DNA, 21 bp, Artificial Sequence
  Synthetic Construct
ggggcatggaatcaggaactt

SEQ ID NO: 1962 - DNA, 22 bp, Artificial Sequence
  Synthetic Construct
ttagagtgggagcggagacctt

SEQ ID NO: 1963 - DNA, 24 bp, Artificial Sequence
  Synthetic Construct
gcaatgatcagtggcgttttcaga

SEQ ID NO: 1964 - DNA, 20 bp, Artificial Sequence
  Synthetic Construct
accacagggttgggcaatga

SEQ ID NO: 1965 - DNA, 19 bp, Artificial Sequence
  Synthetic Construct
acggtgcccggccatttct

SEQ ID NO: 1966 - DNA, 23 bp, Artificial Sequence
  Synthetic Construct
gcatgtgcctgttttctaaccat

SEQ ID NO: 1967 - DNA, 24 bp, Artificial Sequence
  Synthetic Construct
gcccaccttatacctcgctcaact

SEQ ID NO: 1968 - DNA, 22 bp, Artificial Sequence
  Synthetic Construct
cctcctgccaccacatctatca

SEQ ID NO: 1969 - DNA, 21 bp, Artificial Sequence
  Synthetic Construct
tggtgacggaggatggcagaa

SEQ ID NO: 1970 - DNA, 22 bp, Artificial Sequence
  Synthetic Construct
tgcatcccacctgtctatgact

SEQ ID NO: 1971 - DNA, 21 bp, Artificial Sequence
  Synthetic Construct
agccagagttctgccttcttg

SEQ ID NO: 1972 - DNA, 20 bp, Artificial Sequence
  Synthetic Construct
aggctgcgagtttggcagat

SEQ ID NO: 1973 - DNA, 18 bp, Artificial Sequence
  Synthetic Construct
gtccctgctggtgcactt

SEQ ID NO: 1974 - DNA, 23 bp, Artificial Sequence
  Synthetic Construct
gcactatgcagcaggaacctaag

SEQ ID NO: 1975 - DNA, 20 bp, Artificial Sequence
  Synthetic Construct
acaggcctggttggctttgt

SEQ ID NO: 1976 - DNA, 26 bp, Artificial Sequence
  Synthetic Construct
ccaggtcagggtatattatggaaaca

SEQ ID NO: 1977 - DNA, 20 bp, Artificial Sequence
  Synthetic Construct
ccgtggccactcattcaaga

SEQ ID NO: 1978 - DNA, 24 bp, Artificial Sequence
  Synthetic Construct
gggctcacttggatggtcctaaag

SEQ ID NO: 1979 - DNA, 24 bp, Artificial Sequence
  Synthetic Construct
ccaagtgtgacagtgtctttgttt

SEQ ID NO: 1980 - DNA, 26 bp, Artificial Sequence
  Synthetic Construct
cgatacaagtggatggctcttcattc

SEQ ID NO: 1981 - DNA, 25 bp, Artificial Sequence
  Synthetic Construct
catctcaccagatcttgagtgctaa

SEQ ID NO: 1982 - DNA, 20 bp, Artificial Sequence
  Synthetic Construct
aggtggagctgccatcttga

SEQ ID NO: 1983 - DNA, 24 bp, Artificial Sequence
  Synthetic Construct
agacacagttagccagacctattg

SEQ ID NO: 1984 - DNA, 26 bp, Artificial Sequence
  Synthetic Construct
gacatgtcgggaggcttaatctgaac

SEQ ID NO: 1985 - DNA, 23 bp, Artificial Sequence
  Synthetic Construct
cctgcctaaaggtttgcagacaa

SEQ ID NO: 1986 - DNA, 24 bp, Artificial Sequence
  Synthetic Construct
ccacccagatggacctccctttta

SEQ ID NO: 1987 - DNA, 20 bp, Artificial Sequence
  Synthetic Construct
tgcctgtgtgactgccctta

SEQ ID NO: 1988 - DNA, 23 bp, Artificial Sequence
  Synthetic Construct
gaattctgccgtctggttctttc

SEQ ID NO: 1989 - DNA, 22 bp, Artificial Sequence
  Synthetic Construct
acccaatgtcctttgccagtag

SEQ ID NO: 1990 - DNA, 20 bp, Artificial Sequence
  Synthetic Construct
ggctgcagtacacccagact

SEQ ID NO: 1991 - DNA, 28 bp, Artificial Sequence
  Synthetic Construct
gtctttggggtaatcacccacagttaaa

SEQ ID NO: 1992 - DNA, 22 bp, Artificial Sequence
  Synthetic Construct
cacacaccttttggcccttttg

SEQ ID NO: 1993 - DNA, 23 bp, Artificial Sequence
  Synthetic Construct
tctggaggggtaaaaagctgact

SEQ ID NO: 1994 - DNA, 24 bp, Artificial Sequence
  Synthetic Construct
gtaggaccaaaacatggagactgt

SEQ ID NO: 1995 - DNA, 22 bp, Artificial Sequence
  Synthetic Construct
cactaagtgcccgagtcaggtt

SEQ ID NO: 1996 - DNA, 21 bp, Artificial Sequence
  Synthetic Construct
caaccattggtgcggcaaaac

SEQ ID NO: 1997 - DNA, 23 bp, Artificial Sequence
  Synthetic Construct
gacagcacatgctatccctactt

SEQ ID NO: 1998 - DNA, 23 bp, Artificial Sequence
  Synthetic Construct
agaaaccagactgtgagggaaga

SEQ ID NO: 1999 - DNA, 20 bp, Artificial Sequence
  Synthetic Construct
aggggaagggtccctcattt

SEQ ID NO: 2000 - DNA, 22 bp, Artificial Sequence
  Synthetic Construct
accttaggtaccagctcagaca

SEQ ID NO: 2001 - DNA, 20 bp, Artificial Sequence
  Synthetic Construct
agggctcttgagaccagcaa

SEQ ID NO: 2002 - DNA, 22 bp, Artificial Sequence
  Synthetic Construct
gtgtggattgttgcaggaggaa

SEQ ID NO: 2003 - DNA, 24 bp, Artificial Sequence
  Synthetic Construct
cagcaaagactggattcctactca

SEQ ID NO: 2004 - DNA, 25 bp, Artificial Sequence
  Synthetic Construct
ggcatcattgcattcaaagacattc

SEQ ID NO: 2005 - DNA, 20 bp, Artificial Sequence
  Synthetic Construct
cacccatggccacctttctt

SEQ ID NO: 2006 - DNA, 25 bp, Artificial Sequence
  Synthetic Construct
cctctctgatcatttggcaggaaga

SEQ ID NO: 2007 - DNA, 25 bp, Artificial Sequence
  Synthetic Construct
tcattgtaactagggactccacgta

SEQ ID NO: 2008 - DNA, 25 bp, Artificial Sequence
  Synthetic Construct
catattaccctgggaatcacagcaa

SEQ ID NO: 2009 - DNA, 21 bp, Artificial Sequence
  Synthetic Construct
ttggcctgccacatcccctat

SEQ ID NO: 2010 - DNA, 21 bp, Artificial Sequence
  Synthetic Construct
cccaaatggcagaggctgtgt

SEQ ID NO: 2011 - DNA, 24 bp, Artificial Sequence
  Synthetic Construct
cctgattcccttcagttctgttct

SEQ ID NO: 2012 - DNA, 26 bp, Artificial Sequence
  Synthetic Construct
tgcactaatgtcttagaggagctttc

SEQ ID NO: 2013 - DNA, 22 bp, Artificial Sequence
  Synthetic Construct
caaggccacacaggatgtgtct

SEQ ID NO: 2014 - DNA, 23 bp, Artificial Sequence
  Synthetic Construct
gggtccagggtataggtggaaga

SEQ ID NO: 2015 - DNA, 22 bp, Artificial Sequence
  Synthetic Construct
gcgcctctggaaaggtgagatt

SEQ ID NO: 2016 - DNA, 27 bp, Artificial Sequence
  Synthetic Construct
ggcctggtgtaaatttctacctacata

SEQ ID NO: 2017 - DNA, 23 bp, Artificial Sequence
  Synthetic Construct
tgagtgaaatgcaaaggctgcta

SEQ ID NO: 2018 - DNA, 23 bp, Artificial Sequence
  Synthetic Construct
cacctggatgattgccattgctt

SEQ ID NO: 2019 - DNA, 23 bp, Artificial Sequence
  Synthetic Construct
ggtcagtgacagatccaggacta

SEQ ID NO: 2020 - DNA, 22 bp, Artificial Sequence
  Synthetic Construct
tttcaggccctagctccaggat

SEQ ID NO: 2021 - DNA, 23 bp, Artificial Sequence
  Synthetic Construct
cagcctctttcctagggttgtgt

SEQ ID NO: 2022 - DNA, 25 bp, Artificial Sequence
  Synthetic Construct
ggcagttattgcagcaaggaaatct

SEQ ID NO: 2023 - DNA, 20 bp, Artificial Sequence
  Synthetic Construct
gccaccctaagtgctcatgt

SEQ ID NO: 2024 - DNA, 23 bp, Artificial Sequence
  Synthetic Construct
caggacaaggtgctcagagtttc

SEQ ID NO: 2025 - DNA, 20 bp, Artificial Sequence
  Synthetic Construct
aagatggaggccggcagttc

SEQ ID NO: 2026 - DNA, 20 bp, Artificial Sequence
  Synthetic Construct
gttgaggctgaagcccatga

SEQ ID NO: 2027 - DNA, 24 bp, Artificial Sequence
  Synthetic Construct
ccacttagcattgcttgtcatcaa

SEQ ID NO: 2028 - DNA, 20 bp, Artificial Sequence
  Synthetic Construct
tccaggaacaaccgcacagt

SEQ ID NO: 2029 - DNA, 22 bp, Artificial Sequence
  Synthetic Construct
ggagccccaagaaccttggatt

SEQ ID NO: 2030 - DNA, 23 bp, Artificial Sequence
  Synthetic Construct
ggctatcgaagccttcatgtcta

SEQ ID NO: 2031 - DNA, 22 bp, Artificial Sequence
  Synthetic Construct
gtgacaactgtgtgggtgagta

SEQ ID NO: 2032 - DNA, 21 bp, Artificial Sequence
  Synthetic Construct
tgggacacctgagtcatggat

SEQ ID NO: 2033 - DNA, 23 bp, Artificial Sequence
  Synthetic Construct
agtactcattttggcagcacgta

SEQ ID NO: 2034 - DNA, 21 bp, Artificial Sequence
  Synthetic Construct
caggctgctcaaggcattagt

SEQ ID NO: 2035 - DNA, 25 bp, Artificial Sequence
  Synthetic Construct
ggttgttgttcccggactctgaata

SEQ ID NO: 2036 - DNA, 22 bp, Artificial Sequence
  Synthetic Construct
ggattgaggaaggtagcgcttt

SEQ ID NO: 2037 - DNA, 24 bp, Artificial Sequence
  Synthetic Construct
gtggtagtaaagctggtgatgaca

SEQ ID NO: 2038 - DNA, 20 bp, Artificial Sequence
  Synthetic Construct
cccagcaccaatcccatgaa

SEQ ID NO: 2039 - DNA, 26 bp, Artificial Sequence
  Synthetic Construct
caaattacaggcaatgacgcacatag

SEQ ID NO: 2040 - DNA, 23 bp, Artificial Sequence
  Synthetic Construct
tctggccactttaacacctcatt

SEQ ID NO: 2041 - DNA, 24 bp, Artificial Sequence
  Synthetic Construct
gggtcatgcttcgcttgatactgt

SEQ ID NO: 2042 - DNA, 22 bp, Artificial Sequence
  Synthetic Construct
tctctaccccaccccagcaaat

SEQ ID NO: 2043 - DNA, 24 bp, Artificial Sequence
  Synthetic Construct
caccagagccctccattcctaaac

SEQ ID NO: 2044 - DNA, 19 bp, Artificial Sequence
  Synthetic Construct
ggagggcaagggcatctca

SEQ ID NO: 2045 - DNA, 22 bp, Artificial Sequence
  Synthetic Construct
ctcccctgtgcactctttcact

SEQ ID NO: 2046 - DNA, 24 bp, Artificial Sequence
  Synthetic Construct
gtggtagatagacccggctagact

SEQ ID NO: 2047 - DNA, 21 bp, Artificial Sequence
  Synthetic Construct
ggtcctgagcaactgggtaaa

SEQ ID NO: 2048 - DNA, 20 bp, Artificial Sequence
  Synthetic Construct
gaagatgggacaggcgttgt

SEQ ID NO: 2049 - DNA, 22 bp, Artificial Sequence
  Synthetic Construct
gggtaaggtgtgcccttgttct

SEQ ID NO: 2050 - DNA, 20 bp, Artificial Sequence
  Synthetic Construct
caagcggagcacagaactga

SEQ ID NO: 2051 - DNA, 24 bp, Artificial Sequence
  Synthetic Construct
gcaagatcccaacctccaggagaa

SEQ ID NO: 2052 - DNA, 23 bp, Artificial Sequence
  Synthetic Construct
ggagacatcctcgcctgaaccta

SEQ ID NO: 2053 - DNA, 27 bp, Artificial Sequence
  Synthetic Construct
ggcctgagctaagctttttctttgcta

SEQ ID NO: 2054 - DNA, 19 bp, Artificial Sequence
  Synthetic Construct
cgccagcattctgctgctt

SEQ ID NO: 2055 - DNA, 19 bp, Artificial Sequence
  Synthetic Construct
acagtggtgcccagtgtga

SEQ ID NO: 2056 - DNA, 25 bp, Artificial Sequence
  Synthetic Construct
gcagaataaacaggttcttgtgtca

SEQ ID NO: 2057 - DNA, 22 bp, Artificial Sequence
  Synthetic Construct
cccaatcagccccagacatttg

SEQ ID NO: 2058 - DNA, 21 bp, Artificial Sequence
  Synthetic Construct
tcgctctctctccacctctgt

SEQ ID NO: 2059 - DNA, 20 bp, Artificial Sequence
  Synthetic Construct
gtgtgtggcaaggtgtgtct

SEQ ID NO: 2060 - DNA, 21 bp, Artificial Sequence
  Synthetic Construct
aggtgggattggaggttggaa

SEQ ID NO: 2061 - DNA, 20 bp, Artificial Sequence
  Synthetic Construct
caggcagagaggaagccaaa

SEQ ID NO: 2062 - DNA, 19 bp, Artificial Sequence
  Synthetic Construct
cctgcctccccaacagtga

SEQ ID NO: 2063 - DNA, 23 bp, Artificial Sequence
  Synthetic Construct
tcccttaacaagtcacccacttc

SEQ ID NO: 2064 - DNA, 21 bp, Artificial Sequence
  Synthetic Construct
cccctcagcctgtatgtctct

SEQ ID NO: 2065 - DNA, 23 bp, Artificial Sequence
  Synthetic Construct
cccttcctaagtgccagagaaac

SEQ ID NO: 2066 - DNA, 20 bp, Artificial Sequence
  Synthetic Construct
aacctcactgttgcgtgagt

SEQ ID NO: 2067 - DNA, 22 bp, Artificial Sequence
  Synthetic Construct
ccctgctcccacaaactcttta

SEQ ID NO: 2068 - DNA, 27 bp, Artificial Sequence
  Synthetic Construct
cagagtaggattagccacttcagtaag

SEQ ID NO: 2069 - DNA, 23 bp, Artificial Sequence
  Synthetic Construct
gctcggagactctgcctctctat

SEQ ID NO: 2070 - DNA, 22 bp, Artificial Sequence
  Synthetic Construct
cctcaatgcaggggcagtctat

SEQ ID NO: 2071 - DNA, 22 bp, Artificial Sequence
  Synthetic Construct
aaaattgtagccccacccatgt

SEQ ID NO: 2072 - DNA, 25 bp, Artificial Sequence
  Synthetic Construct
gggagtttaccgctaagatgttttc

SEQ ID NO: 2073 - DNA, 21 bp, Artificial Sequence
  Synthetic Construct
gcctgaggtccatgactttgt

SEQ ID NO: 2074 - DNA, 20 bp, Artificial Sequence
  Synthetic Construct
aggcccactgtcacatggat

SEQ ID NO: 2075 - DNA, 19 bp, Artificial Sequence
  Synthetic Construct
gcggtaggctgcctgaaca

SEQ ID NO: 2076 - DNA, 20 bp, Artificial Sequence
  Synthetic Construct
tgggttccccgaggctctgt

SEQ ID NO: 2077 - DNA, 25 bp, Artificial Sequence
  Synthetic Construct
catagcactgggatcaagaaagact

SEQ ID NO: 2078 - DNA, 23 bp, Artificial Sequence
  Synthetic Construct
gtctgttcactccaaagcacaag

SEQ ID NO: 2079 - DNA, 22 bp, Artificial Sequence
  Synthetic Construct
agggaccctagaggacaggaaa

SEQ ID NO: 2080 - DNA, 22 bp, Artificial Sequence
  Synthetic Construct
ctgctgttggaccctaaacact

SEQ ID NO: 2081 - DNA, 21 bp, Artificial Sequence
  Synthetic Construct
tcaggctttcctgtccctctt

SEQ ID NO: 2082 - DNA, 25 bp, Artificial Sequence
  Synthetic Construct
ttggatattgtttgtcacccctaca

SEQ ID NO: 2083 - DNA, 19 bp, Artificial Sequence
  Synthetic Construct
ggcccacctcgtcactatg

SEQ ID NO: 2084 - DNA, 22 bp, Artificial Sequence
  Synthetic Construct
gcttacaacgcaacttcacaca

SEQ ID NO: 2085 - DNA, 21 bp, Artificial Sequence
  Synthetic Construct
cccaccctgagccttcacttc

SEQ ID NO: 2086 - DNA, 20 bp, Artificial Sequence
  Synthetic Construct
ttggtggcgcccatgagtct

SEQ ID NO: 2087 - DNA, 21 bp, Artificial Sequence
  Synthetic Construct
ttgaaagcctcgtgccatttg

SEQ ID NO: 2088 - DNA, 24 bp, Artificial Sequence
  Synthetic Construct
tttaggtgggatgtgaatgtgtca

SEQ ID NO: 2089 - DNA, 23 bp, Artificial Sequence
  Synthetic Construct
cacataagggaacaagcgcacaa

SEQ ID NO: 2090 - DNA, 23 bp, Artificial Sequence
  Synthetic Construct
cctccaacctagactggatgtca

SEQ ID NO: 2091 - DNA, 22 bp, Artificial Sequence
  Synthetic Construct
gacttggtcgtgggttttgaga

SEQ ID NO: 2092 - DNA, 22 bp, Artificial Sequence
  Synthetic Construct
tgactgctgacacgggaggaat

SEQ ID NO: 2093 - DNA, 20 bp, Artificial Sequence
  Synthetic Construct
tggtggcgagggtagaagat

SEQ ID NO: 2094 - DNA, 24 bp, Artificial Sequence
  Synthetic Construct
actcacagtaatccaggggaaaag

SEQ ID NO: 2095 - DNA, 24 bp, Artificial Sequence
  Synthetic Construct
ctgcaaaaataccagggaggaact

SEQ ID NO: 2096 - DNA, 22 bp, Artificial Sequence
  Synthetic Construct
actctcacacccttaggccttt

SEQ ID NO: 2097 - DNA, 20 bp, Artificial Sequence
  Synthetic Construct
accgcgccccatcacttact

SEQ ID NO: 2098 - DNA, 22 bp, Artificial Sequence
  Synthetic Construct
ctgaccctgggcaaatgactct

SEQ ID NO: 2099 - DNA, 20 bp, Artificial Sequence
  Synthetic Construct
cgccacggactaatgctgtt

SEQ ID NO: 2100 - DNA, 23 bp, Artificial Sequence
  Synthetic Construct
ttggctttgtatctccagcaact

SEQ ID NO: 2101 - DNA, 23 bp, Artificial Sequence
  Synthetic Construct
catcgctaccgggttatgttttc

SEQ ID NO: 2102 - DNA, 21 bp, Artificial Sequence
  Synthetic Construct
agaggcaaaatccgcacctaa

SEQ ID NO: 2103 - DNA, 22 bp, Artificial Sequence
  Synthetic Construct
ccctgcccttctcactcacaaa

SEQ ID NO: 2104 - DNA, 22 bp, Artificial Sequence
  Synthetic Construct
catgcatgaccctgctcacttt

SEQ ID NO: 2105 - DNA, 24 bp, Artificial Sequence
  Synthetic Construct
ggcctgccttaagttctgctaaag

SEQ ID NO: 2106 - DNA, 23 bp, Artificial Sequence
  Synthetic Construct
ggagttctgcacttgtgatgttc

SEQ ID NO: 2107 - DNA, 21 bp, Artificial Sequence
  Synthetic Construct
gcgtccaaggctgggtaaaga

SEQ ID NO: 2108 - DNA, 20 bp, Artificial Sequence
  Synthetic Construct
ggcagcctgggtatgtcttg

SEQ ID NO: 2109 - DNA, 25 bp, Artificial Sequence
  Synthetic Construct
tcaacttgattgtctccacactgta

SEQ ID NO: 2110 - DNA, 23 bp, Artificial Sequence
  Synthetic Construct
ggccggccatcccagtataattt

SEQ ID NO: 2111 - DNA, 18 bp, Artificial Sequence
  Synthetic Construct
gtgcggggcttgaaggat

SEQ ID NO: 2112 - DNA, 25 bp, Artificial Sequence
  Synthetic Construct
ttgttcctatcgattacccaccaaa

SEQ ID NO: 2113 - DNA, 26 bp, Artificial Sequence
  Synthetic Construct
ctagtaccactttctccttgctcatt

SEQ ID NO: 2114 - DNA, 22 bp, Artificial Sequence
  Synthetic Construct
ctgccagaccacaccaatctca

SEQ ID NO: 2115 - DNA, 19 bp, Artificial Sequence
  Synthetic Construct
ccaggcaggacgcaactca

SEQ ID NO: 2116 - DNA, 23 bp, Artificial Sequence
  Synthetic Construct
tggtatagccactctggcatttt

SEQ ID NO: 2117 - DNA, 24 bp, Artificial Sequence
  Synthetic Construct
ggaggagtgcgtgcagaagtatca

SEQ ID NO: 2118 - DNA, 22 bp, Artificial Sequence
  Synthetic Construct
gcctctgttttctcgggctaag

SEQ ID NO: 2119 - DNA, 22 bp, Artificial Sequence
  Synthetic Construct
ccatctaccctgtgcccagaaa

SEQ ID NO: 2120 - DNA, 19 bp, Artificial Sequence
  Synthetic Construct
gcccacgtcttggccttgt

SEQ ID NO: 2121 - DNA, 22 bp, Artificial Sequence
  Synthetic Construct
tccgcttccacaacccaagaac

SEQ ID NO: 2122 - DNA, 25 bp, Artificial Sequence
  Synthetic Construct
ccactttgccaaattccctttcatc

SEQ ID NO: 2123 - DNA, 19 bp, Artificial Sequence
  Synthetic Construct
acgaggacccgcgatgtct

SEQ ID NO: 2124 - DNA, 21 bp, Artificial Sequence
  Synthetic Construct
cggccagagactcactcagaa

SEQ ID NO: 2125 - DNA, 21 bp, Artificial Sequence
  Synthetic Construct
acccaccaacaccacattgat

SEQ ID NO: 2126 - DNA, 22 bp, Artificial Sequence
  Synthetic Construct
tcccttgagcctcctctgttct

SEQ ID NO: 2127 - DNA, 21 bp, Artificial Sequence
  Synthetic Construct
ggggacagtgggaggatgtca

SEQ ID NO: 2128 - DNA, 21 bp, Artificial Sequence
  Synthetic Construct
actggctagctcccagtgatg

SEQ ID NO: 2129 - DNA, 20 bp, Artificial Sequence
  Synthetic Construct
cgccacctggacaggaaaca

SEQ ID NO: 2130 - DNA, 22 bp, Artificial Sequence
  Synthetic Construct
agcaatcctcaggccaggaaag

SEQ ID NO: 2131 - DNA, 23 bp, Artificial Sequence
  Synthetic Construct
gcctctgttacctttctcccatt

SEQ ID NO: 2132 - DNA, 19 bp, Artificial Sequence
  Synthetic Construct
agctgctgggagtgggaaa

SEQ ID NO: 2133 - DNA, 21 bp, Artificial Sequence
  Synthetic Construct
gcccagtgaaagggcaaaact

SEQ ID NO: 2134 - DNA, 21 bp, Artificial Sequence
  Synthetic Construct
ggtccgtgcagactggacaat

SEQ ID NO: 2135 - DNA, 23 bp, Artificial Sequence
  Synthetic Construct
tccatcacatgctggtgaaatgt

SEQ ID NO: 2136 - DNA, 22 bp, Artificial Sequence
  Synthetic Construct
tctatgctcagggcctaacact

SEQ ID NO: 2137 - DNA, 20 bp, Artificial Sequence
  Synthetic Construct
caccttcccacgttgcctat

SEQ ID NO: 2138 - DNA, 25 bp, Artificial Sequence
  Synthetic Construct
tgagctacccatcagggttattttt

SEQ ID NO: 2139 - DNA, 24 bp, Artificial Sequence
  Synthetic Construct
ccattgagtttcaactggggtaca

SEQ ID NO: 2140 - DNA, 22 bp, Artificial Sequence
  Synthetic Construct
gcctcatcaacgacccgattca

SEQ ID NO: 2141 - DNA, 18 bp, Artificial Sequence
  Synthetic Construct
accaggaccccactggtt

SEQ ID NO: 2142 - DNA, 20 bp, Artificial Sequence
  Synthetic Construct
aggtctcagccctgactgtt

SEQ ID NO: 2143 - DNA, 24 bp, Artificial Sequence
  Synthetic Construct
tggtttaccctgaatccactctga

SEQ ID NO: 2144 - DNA, 22 bp, Artificial Sequence
  Synthetic Construct
accatatgaccgtcaggcttct

SEQ ID NO: 2145 - DNA, 19 bp, Artificial Sequence
  Synthetic Construct
ccaggggttggcgtgaaag

SEQ ID NO: 2146 - DNA, 25 bp, Artificial Sequence
  Synthetic Construct
caaaccaagtgcctggtagatttca

SEQ ID NO: 2147 - DNA, 19 bp, Artificial Sequence
  Synthetic Construct
cctccacctgcccatcagt

SEQ ID NO: 2148 - DNA, 22 bp, Artificial Sequence
  Synthetic Construct
gtagccaggcatgcatttttga

SEQ ID NO: 2149 - DNA, 22 bp, Artificial Sequence
  Synthetic Construct
cccagctgtccaaaggacttca

SEQ ID NO: 2150 - DNA, 18 bp, Artificial Sequence
  Synthetic Construct
ctgtcccgtgcgttccaa

SEQ ID NO: 2151 - DNA, 20 bp, Artificial Sequence
  Synthetic Construct
gccacctccctcccagctaa

SEQ ID NO: 2152 - DNA, 26 bp, Artificial Sequence
  Synthetic Construct
gcactttgcctttgatgcctgaaata

SEQ ID NO: 2153 - DNA, 23 bp, Artificial Sequence
  Synthetic Construct
ccgcacagtagcacctctgtaag

SEQ ID NO: 2154 - DNA, 20 bp, Artificial Sequence
  Synthetic Construct
ggcctcctcctctccccatt

SEQ ID NO: 2155 - DNA, 21 bp, Artificial Sequence
  Synthetic Construct
tcccacccctcgatccccata

SEQ ID NO: 2156 - DNA, 21 bp, Artificial Sequence
  Synthetic Construct
gaaggacatggccatcagcaa

SEQ ID NO: 2157 - DNA, 19 bp, Artificial Sequence
  Synthetic Construct
aggcagagggcggtgtctt

SEQ ID NO: 2158 - DNA, 19 bp, Artificial Sequence
  Synthetic Construct
cgtctgccttcctgggttt

SEQ ID NO: 2159 - DNA, 21 bp, Artificial Sequence
  Synthetic Construct
aggtgaccatgtgaccacaga

SEQ ID NO: 2160 - DNA, 25 bp, Artificial Sequence
  Synthetic Construct
gggtagcttattggggttcagttct

SEQ ID NO: 2161 - DNA, 22 bp, Artificial Sequence
  Synthetic Construct
gccgttattgcaggcacaatct

SEQ ID NO: 2162 - DNA, 20 bp, Artificial Sequence
  Synthetic Construct
aagcaggcaggaaggagaca

SEQ ID NO: 2163 - DNA, 22 bp, Artificial Sequence
  Synthetic Construct
tggaccaactctcacagcagat

SEQ ID NO: 2164 - DNA, 23 bp, Artificial Sequence
  Synthetic Construct
caggccaatggacagtgaagcta

SEQ ID NO: 2165 - DNA, 21 bp, Artificial Sequence
  Synthetic Construct
ggtggcgaaggggtagtgaaa

SEQ ID NO: 2166 - DNA, 20 bp, Artificial Sequence
  Synthetic Construct
acttcccgggcctggcttct

SEQ ID NO: 2167 - DNA, 24 bp, Artificial Sequence
  Synthetic Construct
gctaggaaccttccaggcatttta

SEQ ID NO: 2168 - DNA, 27 bp, Artificial Sequence
  Synthetic Construct
gttctgactttctagtaaccaccgatt

SEQ ID NO: 2169 - DNA, 19 bp, Artificial Sequence
  Synthetic Construct
tccacagccgtgcatctga

SEQ ID NO: 2170 - DNA, 23 bp, Artificial Sequence
  Synthetic Construct
gtgatgccaacttgggcctatga

SEQ ID NO: 2171 - DNA, 22 bp, Artificial Sequence
  Synthetic Construct
gctgaaagctttgctggcttct

SEQ ID NO: 2172 - DNA, 27 bp, Artificial Sequence
  Synthetic Construct
caatgggtaactaggcaagggaattat

SEQ ID NO: 2173 - DNA, 24 bp, Artificial Sequence
  Synthetic Construct
cccggcctccttataatggaaaga

SEQ ID NO: 2174 - DNA, 21 bp, Artificial Sequence
  Synthetic Construct
gccagttctggcgatggctaa

SEQ ID NO: 2175 - DNA, 22 bp, Artificial Sequence
  Synthetic Construct
ttccctaccccttccccagaac

SEQ ID NO: 2176 - DNA, 23 bp, Artificial Sequence
  Synthetic Construct
ggaagaaagccctctcgagacaa

SEQ ID NO: 2177 - DNA, 26 bp, Artificial Sequence
  Synthetic Construct
gaactagccaccttgatgtcatctgt

SEQ ID NO: 2178 - DNA, 21 bp, Artificial Sequence
  Synthetic Construct
tgcccaccagtgagactaaac

SEQ ID NO: 2179 - DNA, 22 bp, Artificial Sequence
  Synthetic Construct
gcaggtgctaagtgtcctgctt

SEQ ID NO: 2180 - DNA, 25 bp, Artificial Sequence
  Synthetic Construct
gagttcctttccctccagtttcttg

SEQ ID NO: 2181 - DNA, 20 bp, Artificial Sequence
  Synthetic Construct
gccagctgaggactctcctt

SEQ ID NO: 2182 - DNA, 22 bp, Artificial Sequence
  Synthetic Construct
cagtgccagtggaatcccagat

SEQ ID NO: 2183 - DNA, 22 bp, Artificial Sequence
  Synthetic Construct
ctcagcctccctgagaacaaac

SEQ ID NO: 2184 - DNA, 20 bp, Artificial Sequence
  Synthetic Construct
gccatgccctttccaacctt

SEQ ID NO: 2185 - DNA, 20 bp, Artificial Sequence
  Synthetic Construct
acagactgcgtgtcctgcaa

SEQ ID NO: 2186 - DNA, 23 bp, Artificial Sequence
  Synthetic Construct
gattacgaacgtagggcacaaac

SEQ ID NO: 2187 - DNA, 23 bp, Artificial Sequence
  Synthetic Construct
cccaggggttcctgaagtgaaaa

SEQ ID NO: 2188 - DNA, 22 bp, Artificial Sequence
  Synthetic Construct
gcccatccccaggagttaggat

SEQ ID NO: 2189 - DNA, 24 bp, Artificial Sequence
  Synthetic Construct
aacttcctcaaacttccactccat

SEQ ID NO: 2190 - DNA, 21 bp, Artificial Sequence
  Synthetic Construct
ggctttgagagcagggttgaa

SEQ ID NO: 2191 - DNA, 20 bp, Artificial Sequence
  Synthetic Construct
ccacgttgggatgtgaggtt

SEQ ID NO: 2192 - DNA, 22 bp, Artificial Sequence
  Synthetic Construct
ctggagccaggaagccaagaaa

SEQ ID NO: 2193 - DNA, 22 bp, Artificial Sequence
  Synthetic Construct
ggatgtctgctgttgcctcttc

SEQ ID NO: 2194 - DNA, 21 bp, Artificial Sequence
  Synthetic Construct
ttccagagggctccacccaaa

SEQ ID NO: 2195 - DNA, 22 bp, Artificial Sequence
  Synthetic Construct
ctcggtctcctcgtacctactt

SEQ ID NO: 2196 - DNA, 22 bp, Artificial Sequence
  Synthetic Construct
acgacccacttcctccttctgt

SEQ ID NO: 2197 - DNA, 25 bp, Artificial Sequence
  Synthetic Construct
ccaagatgctcatccaagaatggaa

SEQ ID NO: 2198 - DNA, 21 bp, Artificial Sequence
  Synthetic Construct
tgaaaaaccctggggagcaaa

SEQ ID NO: 2199 - DNA, 22 bp, Artificial Sequence
  Synthetic Construct
gagagggccaagatgggaacat

SEQ ID NO: 2200 - DNA, 20 bp, Artificial Sequence
  Synthetic Construct
ccccaacacactgcacagaa

SEQ ID NO: 2201 - DNA, 26 bp, Artificial Sequence
  Synthetic Construct
ctgctctgctcaatccataccatttc

SEQ ID NO: 2202 - DNA, 20 bp, Artificial Sequence
  Synthetic Construct
caagggcaagcccagtgtct

SEQ ID NO: 2203 - DNA, 19 bp, Artificial Sequence
  Synthetic Construct
cggggaggccatcactgtt

SEQ ID NO: 2204 - DNA, 21 bp, Artificial Sequence
  Synthetic Construct
gcccatggtcactagctcaaa

SEQ ID NO: 2205 - DNA, 22 bp, Artificial Sequence
  Synthetic Construct
gctcccagatgtttcggatcaa

SEQ ID NO: 2206 - DNA, 20 bp, Artificial Sequence
  Synthetic Construct
tccccaggtgtctgtggaaa

SEQ ID NO: 2207 - DNA, 21 bp, Artificial Sequence
  Synthetic Construct
gttcagcccaacctggaaagt

SEQ ID NO: 2208 - DNA, 26 bp, Artificial Sequence
  Synthetic Construct
gatttttcaaggacctactggacact

SEQ ID NO: 2209 - DNA, 22 bp, Artificial Sequence
  Synthetic Construct
cccaaggcagtggtatttccaa

SEQ ID NO: 2210 - DNA, 21 bp, Artificial Sequence
  Synthetic Construct
agggtggtggcctacaggatt

SEQ ID NO: 2211 - DNA, 20 bp, Artificial Sequence
  Synthetic Construct
tacaacgcgccaggtgtaac

SEQ ID NO: 2212 - DNA, 20 bp, Artificial Sequence
  Synthetic Construct
acagcggcctccttcctttt

SEQ ID NO: 2213 - DNA, 23 bp, Artificial Sequence
  Synthetic Construct
ttgcatggttgaatgcactgtag

SEQ ID NO: 2214 - DNA, 21 bp, Artificial Sequence
  Synthetic Construct
acctcaggatgctgccatttg

SEQ ID NO: 2215 - DNA, 19 bp, Artificial Sequence
  Synthetic Construct
cagcagctggtgggcaaag

SEQ ID NO: 2216 - DNA, 22 bp, Artificial Sequence
  Synthetic Construct
gagccacctgaaaccaccaaag

SEQ ID NO: 2217 - DNA, 20 bp, Artificial Sequence
  Synthetic Construct
gcccttgcggctctacatta

SEQ ID NO: 2218 - DNA, 20 bp, Artificial Sequence
  Synthetic Construct
tgaggcaggcattggacatt

SEQ ID NO: 2219 - DNA, 24 bp, Artificial Sequence
  Synthetic Construct
tcttgctttgcctaacagggtatt

SEQ ID NO: 2220 - DNA, 23 bp, Artificial Sequence
  Synthetic Construct
gcatttttggcccactgaacact

SEQ ID NO: 2221 - DNA, 24 bp, Artificial Sequence
  Synthetic Construct
ggtgccaagctgagaaggtacttg

SEQ ID NO: 2222 - DNA, 20 bp, Artificial Sequence
  Synthetic Construct
gcagaagagcctcacacact

SEQ ID NO: 2223 - DNA, 23 bp, Artificial Sequence
  Synthetic Construct
ggaaatggctggcctgtaacctt

SEQ ID NO: 2224 - DNA, 23 bp, Artificial Sequence
  Synthetic Construct
aatctcctggtcccacccctact

SEQ ID NO: 2225 - DNA, 19 bp, Artificial Sequence
  Synthetic Construct
tggcaccctggctctctct

SEQ ID NO: 2226 - DNA, 21 bp, Artificial Sequence
  Synthetic Construct
agctcagccagtgcttgattt

SEQ ID NO: 2227 - DNA, 18 bp, Artificial Sequence
  Synthetic Construct
aaggggcggcaacattca

SEQ ID NO: 2228 - DNA, 20 bp, Artificial Sequence
  Synthetic Construct
atgtactgtgcccgcgactt

SEQ ID NO: 2229 - DNA, 23 bp, Artificial Sequence
  Synthetic Construct
gccactgacaaattgccgagttt

SEQ ID NO: 2230 - DNA, 23 bp, Artificial Sequence
  Synthetic Construct
gggtagacatggtggacgtggat

SEQ ID NO: 2231 - DNA, 20 bp, Artificial Sequence
  Synthetic Construct
cctcagcagtgccacaaatg

SEQ ID NO: 2232 - DNA, 23 bp, Artificial Sequence
  Synthetic Construct
gctcatggggctgaagatagaca

SEQ ID NO: 2233 - DNA, 21 bp, Artificial Sequence
  Synthetic Construct
aggtctgtggccctagcatgt

SEQ ID NO: 2234 - DNA, 22 bp, Artificial Sequence
  Synthetic Construct
accctggtcattgctggaaaag

SEQ ID NO: 2235 - DNA, 22 bp, Artificial Sequence
  Synthetic Construct
ccaacatcccagccaaatcaag

SEQ ID NO: 2236 - DNA, 21 bp, Artificial Sequence
  Synthetic Construct
ggtgacggtgtcttcacttca

SEQ ID NO: 2237 - DNA, 22 bp, Artificial Sequence
  Synthetic Construct
ggtatcagacagccctgcatct

SEQ ID NO: 2238 - DNA, 20 bp, Artificial Sequence
  Synthetic Construct
agtcgcgtctggtagagcat

SEQ ID NO: 2239 - DNA, 19 bp, Artificial Sequence
  Synthetic Construct
tgctgccgtggctctcaca

SEQ ID NO: 2240 - DNA, 22 bp, Artificial Sequence
  Synthetic Construct
accctcatccagcactccacta

SEQ ID NO: 2241 - DNA, 21 bp, Artificial Sequence
  Synthetic Construct
tgtttcagcctccaacgtgat

SEQ ID NO: 2242 - DNA, 20 bp, Artificial Sequence
  Synthetic Construct
atctccagacgtcggcaatg

SEQ ID NO: 2243 - DNA, 21 bp, Artificial Sequence
  Synthetic Construct
gcagggaagaggcagcattga

SEQ ID NO: 2244 - DNA, 20 bp, Artificial Sequence
  Synthetic Construct
agcgtgtgcagggtaatgaa

SEQ ID NO: 2245 - DNA, 22 bp, Artificial Sequence
  Synthetic Construct
gttctccactgcgtggtgacta

SEQ ID NO: 2246 - DNA, 24 bp, Artificial Sequence
  Synthetic Construct
actgctgatttttctccagaccat

SEQ ID NO: 2247 - DNA, 20 bp, Artificial Sequence
  Synthetic Construct
aatccggttcccacctccat

SEQ ID NO: 2248 - DNA, 23 bp, Artificial Sequence
  Synthetic Construct
gggaggtggtggagtcagaatca

SEQ ID NO: 2249 - DNA, 25 bp, Artificial Sequence
  Synthetic Construct
acacacagctaaaagaaagcagttg

SEQ ID NO: 2250 - DNA, 21 bp, Artificial Sequence
  Synthetic Construct
acctttgtgcctgctgaatct

SEQ ID NO: 2251 - DNA, 20 bp, Artificial Sequence
  Synthetic Construct
gactggctggcaccaagatt

SEQ ID NO: 2252 - DNA, 25 bp, Artificial Sequence
  Synthetic Construct
ccttctacagacattgcaggtcatc

SEQ ID NO: 2253 - DNA, 26 bp, Artificial Sequence
  Synthetic Construct
ggacaatgattttgagctacggtgta

SEQ ID NO: 2254 - DNA, 21 bp, Artificial Sequence
  Synthetic Construct
aacccacagggtcccctaaca

SEQ ID NO: 2255 - DNA, 22 bp, Artificial Sequence
  Synthetic Construct
cactgccaggggaagaaactga

SEQ ID NO: 2256 - DNA, 25 bp, Artificial Sequence
  Synthetic Construct
gtctatgccagttgctagaggaaac

SEQ ID NO: 2257 - DNA, 20 bp, Artificial Sequence
  Synthetic Construct
ggggaccatcagtgccatct

SEQ ID NO: 2258 - DNA, 19 bp, Artificial Sequence
  Synthetic Construct
ccgccaggcttcagacctt

SEQ ID NO: 2259 - DNA, 18 bp, Artificial Sequence
  Synthetic Construct
tgggcctcccctgaacaa

SEQ ID NO: 2260 - DNA, 24 bp, Artificial Sequence
  Synthetic Construct
gaggagtcaaggaatcgaggatga

SEQ ID NO: 2261 - DNA, 25 bp, Artificial Sequence
  Synthetic Construct
ggtaatgtgtagaccccacagttca

SEQ ID NO: 2262 - DNA, 21 bp, Artificial Sequence
  Synthetic Construct
tgaacccacagccccatctca

SEQ ID NO: 2263 - DNA, 20 bp, Artificial Sequence
  Synthetic Construct
acctgcggcaagatctcagt

SEQ ID NO: 2264 - DNA, 20 bp, Artificial Sequence
  Synthetic Construct
tgctgggtccctggatggat

SEQ ID NO: 2265 - DNA, 22 bp, Artificial Sequence
  Synthetic Construct
actctccaccaggcatgcagat

SEQ ID NO: 2266 - DNA, 22 bp, Artificial Sequence
  Synthetic Construct
tctgagagaggctggctacctt

SEQ ID NO: 2267 - DNA, 21 bp, Artificial Sequence
  Synthetic Construct
agcctgaggacttggcagtca

SEQ ID NO: 2268 - DNA, 20 bp, Artificial Sequence
  Synthetic Construct
tcgggcaactgctcctctgt

SEQ ID NO: 2269 - DNA, 20 bp, Artificial Sequence
  Synthetic Construct
gggacaactttggggcttga

SEQ ID NO: 2270 - DNA, 20 bp, Artificial Sequence
  Synthetic Construct
ggccaagctttcagcctttc

SEQ ID NO: 2271 - DNA, 24 bp, Artificial Sequence
  Synthetic Construct
ctggatgagaatggttggcctaat

SEQ ID NO: 2272 - DNA, 19 bp, Artificial Sequence
  Synthetic Construct
agcgagccctgcagcaaga

SEQ ID NO: 2273 - DNA, 22 bp, Artificial Sequence
  Synthetic Construct
cagagcagggctgtcattgtct

SEQ ID NO: 2274 - DNA, 24 bp, Artificial Sequence
  Synthetic Construct
caggaaatccaggggacagaagaa

SEQ ID NO: 2275 - DNA, 22 bp, Artificial Sequence
  Synthetic Construct
ggccaaacacatcagggagcaa

SEQ ID NO: 2276 - DNA, 20 bp, Artificial Sequence
  Synthetic Construct
tggggctgctgggagaggaa

SEQ ID NO: 2277 - DNA, 20 bp, Artificial Sequence
  Synthetic Construct
gggtggcaaccctcagattc

SEQ ID NO: 2278 - DNA, 24 bp, Artificial Sequence
  Synthetic Construct
cttgtttgccagatttacctgtgt

SEQ ID NO: 2279 - DNA, 20 bp, Artificial Sequence
  Synthetic Construct
gcttgtggtcctgggtgtca

SEQ ID NO: 2280 - DNA, 22 bp, Artificial Sequence
  Synthetic Construct
aaggcgaggtcacctgagtaag

SEQ ID NO: 2281 - DNA, 23 bp, Artificial Sequence
  Synthetic Construct
ccagaagaggtgtggcctgaaag

SEQ ID NO: 2282 - DNA, 21 bp, Artificial Sequence
  Synthetic Construct
cagtcagtagagggcgctgtt

SEQ ID NO: 2283 - DNA, 24 bp, Artificial Sequence
  Synthetic Construct
ggatgggaatgggtaaggcacaga

SEQ ID NO: 2284 - DNA, 23 bp, Artificial Sequence
  Synthetic Construct
ggagcttttgactggggttcact

SEQ ID NO: 2285 - DNA, 22 bp, Artificial Sequence
  Synthetic Construct
ccaaggtccctggtctggaagt

SEQ ID NO: 2286 - DNA, 20 bp, Artificial Sequence
  Synthetic Construct
gggcagagcaatagccgaaa

SEQ ID NO: 2287 - DNA, 21 bp, Artificial Sequence
  Synthetic Construct
ggcccacgtggtcagattgtt

SEQ ID NO: 2288 - DNA, 23 bp, Artificial Sequence
  Synthetic Construct
cgagagcctgagcatgtacaaat

SEQ ID NO: 2289 - DNA, 28 bp, Artificial Sequence
  Synthetic Construct
gttatcttctcactgtcctgttccttag

SEQ ID NO: 2290 - DNA, 22 bp, Artificial Sequence
  Synthetic Construct
gcttctgcccagtgctcaagat

SEQ ID NO: 2291 - DNA, 25 bp, Artificial Sequence
  Synthetic Construct
ggctctgtagggcttctagaatgtt

SEQ ID NO: 2292 - DNA, 22 bp, Artificial Sequence
  Synthetic Construct
gggtgtagagcaggatgggtta

SEQ ID NO: 2293 - DNA, 24 bp, Artificial Sequence
  Synthetic Construct
gtccccgaaacccacactgtattc

SEQ ID NO: 2294 - DNA, 21 bp, Artificial Sequence
  Synthetic Construct
cccaaaactgaggtggagctt

SEQ ID NO: 2295 - DNA, 21 bp, Artificial Sequence
  Synthetic Construct
gtgaccagtgctagctgacaa

SEQ ID NO: 2296 - DNA, 22 bp, Artificial Sequence
  Synthetic Construct
ttccggaggtcagatcccaaga

SEQ ID NO: 2297 - DNA, 19 bp, Artificial Sequence
  Synthetic Construct
cagctcatccgcccacaga

SEQ ID NO: 2298 - DNA, 19 bp, Artificial Sequence
  Synthetic Construct
agggagcagcgcgactgaa

SEQ ID NO: 2299 - DNA, 23 bp, Artificial Sequence
  Synthetic Construct
ggcagtggggtccatttgaaaca

SEQ ID NO: 2300 - DNA, 21 bp, Artificial Sequence
  Synthetic Construct
tctccagaagcctcgccttga

SEQ ID NO: 2301 - DNA, 23 bp, Artificial Sequence
  Synthetic Construct
gccgcatgtctctacttcttctt

SEQ ID NO: 2302 - DNA, 20 bp, Artificial Sequence
  Synthetic Construct
aggccgagcagctttagtct

SEQ ID NO: 2303 - DNA, 23 bp, Artificial Sequence
  Synthetic Construct
tcaagatggagcacaacaaccaa

SEQ ID NO: 2304 - DNA, 22 bp, Artificial Sequence
  Synthetic Construct
gtgttgagcaggcaacttgtga

SEQ ID NO: 2305 - DNA, 21 bp, Artificial Sequence
  Synthetic Construct
actcatcaccttggcatgctt

SEQ ID NO: 2306 - DNA, 25 bp, Artificial Sequence
  Synthetic Construct
tcagccaagaaggtatttgttggaa

SEQ ID NO: 2307 - DNA, 23 bp, Artificial Sequence
  Synthetic Construct
caatgcaggagcttctccacaaa

SEQ ID NO: 2308 - DNA, 22 bp, Artificial Sequence
  Synthetic Construct
cccaccaaagggagccaattct

SEQ ID NO: 2309 - DNA, 21 bp, Artificial Sequence
  Synthetic Construct
ctttgccctggcatctgaaac

SEQ ID NO: 2310 - DNA, 20 bp, Artificial Sequence
  Synthetic Construct
ctctggcacctggaaacact

SEQ ID NO: 2311 - DNA, 24 bp, Artificial Sequence
  Synthetic Construct
tcatccatcctgagccaaatttct

SEQ ID NO: 2312 - DNA, 24 bp, Artificial Sequence
  Synthetic Construct
aaatccagccacaggatgatacaa

SEQ ID NO: 2313 - DNA, 23 bp, Artificial Sequence
  Synthetic Construct
gcaccaaggaagcatcaggtact

SEQ ID NO: 2314 - DNA, 20 bp, Artificial Sequence
  Synthetic Construct
ctgctcaggggccagacttc

SEQ ID NO: 2315 - DNA, 27 bp, Artificial Sequence
  Synthetic Construct
gaagagcagtttcacttatctgtgtca

SEQ ID NO: 2316 - DNA, 23 bp, Artificial Sequence
  Synthetic Construct
gcctccggatctgttgctagtga

SEQ ID NO: 2317 - DNA, 22 bp, Artificial Sequence
  Synthetic Construct
aggggagcctcagcatcctaaa

SEQ ID NO: 2318 - DNA, 19 bp, Artificial Sequence
  Synthetic Construct
cggctgactgcagttgtct

SEQ ID NO: 2319 - DNA, 20 bp, Artificial Sequence
  Synthetic Construct
tcgcttcgggctttcagcaa

SEQ ID NO: 2320 - DNA, 23 bp, Artificial Sequence
  Synthetic Construct
gatcagaactcctggcatgatga

SEQ ID NO: 2321 - DNA, 20 bp, Artificial Sequence
  Synthetic Construct
gagagcccctcaggctcttg

SEQ ID NO: 2322 - DNA, 22 bp, Artificial Sequence
  Synthetic Construct
ccccaggagagctggtgtatga

SEQ ID NO: 2323 - DNA, 21 bp, Artificial Sequence
  Synthetic Construct
actgtcctgttccacccttca

SEQ ID NO: 2324 - DNA, 22 bp, Artificial Sequence
  Synthetic Construct
agggcccctactaccactttag

SEQ ID NO: 2325 - DNA, 24 bp, Artificial Sequence
  Synthetic Construct
gaccagggaagaaagacctctgaa

SEQ ID NO: 2326 - DNA, 22 bp, Artificial Sequence
  Synthetic Construct
tggacactgccgtaaggtgaag

SEQ ID NO: 2327 - DNA, 22 bp, Artificial Sequence
  Synthetic Construct
gcctttccacctcgatgtcttc

SEQ ID NO: 2328 - DNA, 20 bp, Artificial Sequence
  Synthetic Construct
ttcccatggcagatgctgtt

SEQ ID NO: 2329 - DNA, 24 bp, Artificial Sequence
  Synthetic Construct
ggggataaatgtcacaagctggat

SEQ ID NO: 2330 - DNA, 26 bp, Artificial Sequence
  Synthetic Construct
ggcttactatgcctgctaaacattac

SEQ ID NO: 2331 - DNA, 23 bp, Artificial Sequence
  Synthetic Construct
tggtacctgatatgcagccattg

SEQ ID NO: 2332 - DNA, 21 bp, Artificial Sequence
  Synthetic Construct
aggcagggcaaatggtgtatc

SEQ ID NO: 2333 - DNA, 24 bp, Artificial Sequence
  Synthetic Construct
gcagacctactgacccctttggtt

SEQ ID NO: 2334 - DNA, 25 bp, Artificial Sequence
  Synthetic Construct
cagtactgagtcccttgtgtttttg

SEQ ID NO: 2335 - DNA, 21 bp, Artificial Sequence
  Synthetic Construct
catcactcccctctgctgcta

SEQ ID NO: 2336 - DNA, 20 bp, Artificial Sequence
  Synthetic Construct
aggccactgccttctacctt

SEQ ID NO: 2337 - DNA, 18 bp, Artificial Sequence
  Synthetic Construct
acgagggctggcacgaaa

SEQ ID NO: 2338 - DNA, 24 bp, Artificial Sequence
  Synthetic Construct
gacagcttgcagtcaagaccttct

SEQ ID NO: 2339 - DNA, 23 bp, Artificial Sequence
  Synthetic Construct
catggggaatgggtcagtacagt

SEQ ID NO: 2340 - DNA, 24 bp, Artificial Sequence
  Synthetic Construct
gccagtggaggtagtagcatttac

SEQ ID NO: 2341 - DNA, 23 bp, Artificial Sequence
  Synthetic Construct
gttacagcatcaagtgcaacagt

SEQ ID NO: 2342 - DNA, 22 bp, Artificial Sequence
  Synthetic Construct
tgaggatttcctgggacacaga

SEQ ID NO: 2343 - DNA, 20 bp, Artificial Sequence
  Synthetic Construct
agcggctgtgtgcagaatca

SEQ ID NO: 2344 - DNA, 22 bp, Artificial Sequence
  Synthetic Construct
actgcctccaatgacccaggat

SEQ ID NO: 2345 - DNA, 20 bp, Artificial Sequence
  Synthetic Construct
tccctgcgttgcttctcact

SEQ ID NO: 2346 - DNA, 21 bp, Artificial Sequence
  Synthetic Construct
ttggactccagtgctttgcat

SEQ ID NO: 2347 - DNA, 24 bp, Artificial Sequence
  Synthetic Construct
tcttttggcactacgagctatgaa

SEQ ID NO: 2348 - DNA, 23 bp, Artificial Sequence
  Synthetic Construct
ccaaagcacattagcctgtgatg

SEQ ID NO: 2349 - DNA, 19 bp, Artificial Sequence
  Synthetic Construct
tggcccaggtccattctct

SEQ ID NO: 2350 - DNA, 25 bp, Artificial Sequence
  Synthetic Construct
ggaaaacaacttgtccctcactttg

SEQ ID NO: 2351 - DNA, 21 bp, Artificial Sequence
  Synthetic Construct
aggagggtacctccgtctcta

SEQ ID NO: 2352 - DNA, 24 bp, Artificial Sequence
  Synthetic Construct
gtaggcttccaatgccaagaaatg

SEQ ID NO: 2353 - DNA, 23 bp, Artificial Sequence
  Synthetic Construct
ctcaggcatggacacctatcttc

SEQ ID NO: 2354 - DNA, 20 bp, Artificial Sequence
  Synthetic Construct
agctcccactccaactcaga

SEQ ID NO: 2355 - DNA, 20 bp, Artificial Sequence
  Synthetic Construct
gcaggcgagactccccaaac

SEQ ID NO: 2356 - DNA, 20 bp, Artificial Sequence
  Synthetic Construct
tgcactcttgcggaggaaaa

SEQ ID NO: 2357 - DNA, 19 bp, Artificial Sequence
  Synthetic Construct
gctcaggctggcttgaaca

SEQ ID NO: 2358 - DNA, 22 bp, Artificial Sequence
  Synthetic Construct
ggctggacagttggttgctgat

SEQ ID NO: 2359 - DNA, 20 bp, Artificial Sequence
  Synthetic Construct
agatcagcgaccctgaggaa

SEQ ID NO: 2360 - DNA, 20 bp, Artificial Sequence
  Synthetic Construct
aggcaccccttactgtgaga

SEQ ID NO: 2361 - DNA, 23 bp, Artificial Sequence
  Synthetic Construct
ccaggatggagaatgcagacaca

SEQ ID NO: 2362 - DNA, 23 bp, Artificial Sequence
  Synthetic Construct
agaccagaatggatggaggtgta

SEQ ID NO: 2363 - DNA, 22 bp, Artificial Sequence
  Synthetic Construct
cgctacctcctcaagccagaaa

SEQ ID NO: 2364 - DNA, 20 bp, Artificial Sequence
  Synthetic Construct
tggcagccctccaccatttt

SEQ ID NO: 2365 - DNA, 22 bp, Artificial Sequence
  Synthetic Construct
tggcaggtgacaaggtgaattt

SEQ ID NO: 2366 - DNA, 24 bp, Artificial Sequence
  Synthetic Construct
aattccctacggagtgaaacacaa

SEQ ID NO: 2367 - DNA, 25 bp, Artificial Sequence
  Synthetic Construct
tgtgtaagggcaggataaaacaact

SEQ ID NO: 2368 - DNA, 22 bp, Artificial Sequence
  Synthetic Construct
acctcaacctctgtgtgtgttc

SEQ ID NO: 2369 - DNA, 23 bp, Artificial Sequence
  Synthetic Construct
ccacagtgagggtgaacaatcat

SEQ ID NO: 2370 - DNA, 20 bp, Artificial Sequence
  Synthetic Construct
cctcactcccctcctgtctt

SEQ ID NO: 2371 - DNA, 27 bp, Artificial Sequence
  Synthetic Construct
acagctagtctggataaaacctagaga

SEQ ID NO: 2372 - DNA, 25 bp, Artificial Sequence
  Synthetic Construct
cattctctgtacattggagggaact

SEQ ID NO: 2373 - DNA, 23 bp, Artificial Sequence
  Synthetic Construct
ggtgggacgagtcaatcactaag

SEQ ID NO: 2374 - DNA, 19 bp, Artificial Sequence
  Synthetic Construct
caccgtgcccagcctgtaa

SEQ ID NO: 2375 - DNA, 23 bp, Artificial Sequence
  Synthetic Construct
ggcatgttagcgagcattttaca

SEQ ID NO: 2376 - DNA, 23 bp, Artificial Sequence
  Synthetic Construct
gttctcgttcagacagtggttct

SEQ ID NO: 2377 - DNA, 25 bp, Artificial Sequence
  Synthetic Construct
caggaacctcatcctgagttgattt

SEQ ID NO: 2378 - DNA, 21 bp, Artificial Sequence
  Synthetic Construct
tcttgctggaccagagtgtga

SEQ ID NO: 2379 - DNA, 21 bp, Artificial Sequence
  Synthetic Construct
aggcccgagggagtttgtttg

SEQ ID NO: 2380 - DNA, 22 bp, Artificial Sequence
  Synthetic Construct
ggccctcaaagtggtgaagagt

SEQ ID NO: 2381 - DNA, 22 bp, Artificial Sequence
  Synthetic Construct
ccttgcctgagctggtatttct

SEQ ID NO: 2382 - DNA, 21 bp, Artificial Sequence
  Synthetic Construct
tgtggctacaactcaggcaaa

SEQ ID NO: 2383 - DNA, 23 bp, Artificial Sequence
  Synthetic Construct
gacattgcttgacttgggtgtgt

SEQ ID NO: 2384 - DNA, 23 bp, Artificial Sequence
  Synthetic Construct
ctcaccgctcccatgaatgaatc

SEQ ID NO: 2385 - DNA, 21 bp, Artificial Sequence
  Synthetic Construct
tgtgtgctgacaggtttgtga

SEQ ID NO: 2386 - DNA, 22 bp, Artificial Sequence
  Synthetic Construct
gcaacaggagctacttgccaaa

SEQ ID NO: 2387 - DNA, 20 bp, Artificial Sequence
  Synthetic Construct
gcccctgttgttgtgctgat

SEQ ID NO: 2388 - DNA, 22 bp, Artificial Sequence
  Synthetic Construct
ggctgcagcataaggaatgtga

SEQ ID NO: 2389 - DNA, 24 bp, Artificial Sequence
  Synthetic Construct
gcagaccattgcttggaggagata

SEQ ID NO: 2390 - DNA, 22 bp, Artificial Sequence
  Synthetic Construct
ctgagctgggaagactcaaact

SEQ ID NO: 2391 - DNA, 22 bp, Artificial Sequence
  Synthetic Construct
gcaactttaggccagctgagtt

SEQ ID NO: 2392 - DNA, 22 bp, Artificial Sequence
  Synthetic Construct
aagacagggtgggagatgtagt

SEQ ID NO: 2393 - DNA, 22 bp, Artificial Sequence
  Synthetic Construct
cctggatttgggcatacgtgaa

SEQ ID NO: 2394 - DNA, 22 bp, Artificial Sequence
  Synthetic Construct
ttccctgaactcttgctggttt

SEQ ID NO: 2395 - DNA, 23 bp, Artificial Sequence
  Synthetic Construct
gggttgaaactggaggcttgttc

SEQ ID NO: 2396 - DNA, 24 bp, Artificial Sequence
  Synthetic Construct
actctgtaccgggtatttcacact

SEQ ID NO: 2397 - DNA, 23 bp, Artificial Sequence
  Synthetic Construct
gcccatccagacccttctaattg

SEQ ID NO: 2398 - DNA, 19 bp, Artificial Sequence
  Synthetic Construct
cagcctcgtgcagcagttg

SEQ ID NO: 2399 - DNA, 24 bp, Artificial Sequence
  Synthetic Construct
agaaccccatacctgcattacaaa

SEQ ID NO: 2400 - DNA, 21 bp, Artificial Sequence
  Synthetic Construct
tcccctggaacctccaaaact

SEQ ID NO: 2401 - DNA, 24 bp, Artificial Sequence
  Synthetic Construct
gcttaagccacagaaaggcacaac

SEQ ID NO: 2402 - DNA, 21 bp, Artificial Sequence
  Synthetic Construct
cgagtgccctggaacctgaaa

SEQ ID NO: 2403 - DNA, 21 bp, Artificial Sequence
  Synthetic Construct
agccaccactcctgcttctga

SEQ ID NO: 2404 - DNA, 20 bp, Artificial Sequence
  Synthetic Construct
ttggggacccctggactaag

SEQ ID NO: 2405 - DNA, 26 bp, Artificial Sequence
  Synthetic Construct
cctccccagtatcttaccactacaac

SEQ ID NO: 2406 - DNA, 22 bp, Artificial Sequence
  Synthetic Construct
caccaagccctcaactcctaaa

SEQ ID NO: 2407 - DNA, 25 bp, Artificial Sequence
  Synthetic Construct
gaagtgaaagaaaatggcaggaact

SEQ ID NO: 2408 - DNA, 27 bp, Artificial Sequence
  Synthetic Construct
gctggtattgttttggggatagaggtt

SEQ ID NO: 2409 - DNA, 26 bp, Artificial Sequence
  Synthetic Construct
gtggaggaaattagatgtctgcttct

SEQ ID NO: 2410 - DNA, 21 bp, Artificial Sequence
  Synthetic Construct
gggcaagtccctcacaccttt

SEQ ID NO: 2411 - DNA, 21 bp, Artificial Sequence
  Synthetic Construct
tgaggtctggctgcaggagta

SEQ ID NO: 2412 - DNA, 22 bp, Artificial Sequence
  Synthetic Construct
ctgaagcccaagtggcaagaag

SEQ ID NO: 2413 - DNA, 22 bp, Artificial Sequence
  Synthetic Construct
aagtcctgagcctgagttcttg

SEQ ID NO: 2414 - DNA, 21 bp, Artificial Sequence
  Synthetic Construct
tctcagggtgcctggaaaaag

SEQ ID NO: 2415 - DNA, 24 bp, Artificial Sequence
  Synthetic Construct
gcactgcaaaagaagaggctattg

SEQ ID NO: 2416 - DNA, 20 bp, Artificial Sequence
  Synthetic Construct
tgggaaccagccctttggaa

SEQ ID NO: 2417 - DNA, 29 bp, Artificial Sequence
  Synthetic Construct
ggcttcactatcaagaagggccttgattt

SEQ ID NO: 2418 - DNA, 18 bp, Artificial Sequence
  Synthetic Construct
aagaggccacccgcttct

SEQ ID NO: 2419 - DNA, 19 bp, Artificial Sequence
  Synthetic Construct
tggagcaggctggcgctaa

SEQ ID NO: 2420 - DNA, 21 bp, Artificial Sequence
  Synthetic Construct
ccgaaaaccttccccgcttct

SEQ ID NO: 2421 - DNA, 24 bp, Artificial Sequence
  Synthetic Construct
ggaaggggaatttgtcagcgttta

SEQ ID NO: 2422 - DNA, 24 bp, Artificial Sequence
  Synthetic Construct
gcagtctcagcctttcctttgcat

SEQ ID NO: 2423 - DNA, 24 bp, Artificial Sequence
  Synthetic Construct
gttgggaagcatcttcctagacat

SEQ ID NO: 2424 - DNA, 24 bp, Artificial Sequence
  Synthetic Construct
gcctattttggagtcccaagtcaa

SEQ ID NO: 2425 - DNA, 18 bp, Artificial Sequence
  Synthetic Construct
tgggccacgttgcctact

SEQ ID NO: 2426 - DNA, 29 bp, Artificial Sequence
  Synthetic Construct
caccttattactaccttcctctcacaatg

SEQ ID NO: 2427 - DNA, 21 bp, Artificial Sequence
  Synthetic Construct
actggggtaaaggctggttgt

SEQ ID NO: 2428 - DNA, 21 bp, Artificial Sequence
  Synthetic Construct
aagcctcgtggccgactcaat

SEQ ID NO: 2429 - DNA, 21 bp, Artificial Sequence
  Synthetic Construct
aacagggcgtgagttttcctt

SEQ ID NO: 2430 - DNA, 23 bp, Artificial Sequence
  Synthetic Construct
ggagaggccagggcatttctaag

SEQ ID NO: 2431 - DNA, 23 bp, Artificial Sequence
  Synthetic Construct
cagcctgctaggaacacactgta

SEQ ID NO: 2432 - DNA, 23 bp, Artificial Sequence
  Synthetic Construct
ggtgattctggccgaacttgtct

SEQ ID NO: 2433 - DNA, 22 bp, Artificial Sequence
  Synthetic Construct
tggatcggaaacaccagactca

SEQ ID NO: 2434 - DNA, 26 bp, Artificial Sequence
  Synthetic Construct
cctgagaccgttgctagagaaacaag

SEQ ID NO: 2435 - DNA, 19 bp, Artificial Sequence
  Synthetic Construct
tgggatgcgggcatagaga

SEQ ID NO: 2436 - DNA, 20 bp, Artificial Sequence
  Synthetic Construct
tctcccaggcttcagtcctt

SEQ ID NO: 2437 - DNA, 23 bp, Artificial Sequence
  Synthetic Construct
ccaagttatgcctgctgctcaga

SEQ ID NO: 2438 - DNA, 24 bp, Artificial Sequence
  Synthetic Construct
gggaacctggaaagacctttactt

SEQ ID NO: 2439 - DNA, 25 bp, Artificial Sequence
  Synthetic Construct
ggtgggatagttgagaagggagtaa

SEQ ID NO: 2440 - DNA, 20 bp, Artificial Sequence
  Synthetic Construct
cctcagctcccgcctctaaa

SEQ ID NO: 2441 - DNA, 23 bp, Artificial Sequence
  Synthetic Construct
ggatgagcataagcagtggttca

SEQ ID NO: 2442 - DNA, 24 bp, Artificial Sequence
  Synthetic Construct
aggagtgagaagggagactcaatc

SEQ ID NO: 2443 - DNA, 19 bp, Artificial Sequence
  Synthetic Construct
tcaagtcccggctgccatt

SEQ ID NO: 2444 - DNA, 22 bp, Artificial Sequence
  Synthetic Construct
gacagagagatgagggctgagt

SEQ ID NO: 2445 - DNA, 24 bp, Artificial Sequence
  Synthetic Construct
aattgccagctgtattctccttct

SEQ ID NO: 2446 - DNA, 20 bp, Artificial Sequence
  Synthetic Construct
acagaggatggggcaccaaa

SEQ ID NO: 2447 - DNA, 25 bp, Artificial Sequence
  Synthetic Construct
gcatgaggatggaatggactcatca

SEQ ID NO: 2448 - DNA, 23 bp, Artificial Sequence
  Synthetic Construct
gaccttcaaggggagctcagtat

SEQ ID NO: 2449 - DNA, 24 bp, Artificial Sequence
  Synthetic Construct
tctgatatggaacccagggattgt

SEQ ID NO: 2450 - DNA, 20 bp, Artificial Sequence
  Synthetic Construct
tgcaccatcgctaggccatt

SEQ ID NO: 2451 - DNA, 24 bp, Artificial Sequence
  Synthetic Construct
gtcagttcacacgacacccttaga

SEQ ID NO: 2452 - DNA, 20 bp, Artificial Sequence
  Synthetic Construct
agcctggaaagctggcacaa

SEQ ID NO: 2453 - DNA, 21 bp, Artificial Sequence
  Synthetic Construct
ttcccagcctcctctgcatct

SEQ ID NO: 2454 - DNA, 22 bp, Artificial Sequence
  Synthetic Construct
ctcaaaggggaagaacgtcagt

SEQ ID NO: 2455 - DNA, 21 bp, Artificial Sequence
  Synthetic Construct
tctgcgtctcacttcctggta

SEQ ID NO: 2456 - DNA, 23 bp, Artificial Sequence
  Synthetic Construct
aaggtgacagaggtcttccaaag

SEQ ID NO: 2457 - DNA, 21 bp, Artificial Sequence
  Synthetic Construct
tcccaaatcctgagcctgtca

SEQ ID NO: 2458 - DNA, 22 bp, Artificial Sequence
  Synthetic Construct
ggagaaagagtggagagcaaca

SEQ ID NO: 2459 - DNA, 29 bp, Artificial Sequence
  Synthetic Construct
gactatacgataccaaatagccctacaag

SEQ ID NO: 2460 - DNA, 20 bp, Artificial Sequence
  Synthetic Construct
gtcacaagggaggcacttca

SEQ ID NO: 2461 - DNA, 20 bp, Artificial Sequence
  Synthetic Construct
agagctgccctggaactgaa

SEQ ID NO: 2462 - DNA, 24 bp, Artificial Sequence
  Synthetic Construct
ggaaaggtaccccagaatgaggtt

SEQ ID NO: 2463 - DNA, 23 bp, Artificial Sequence
  Synthetic Construct
ggtggtagaggctcatgtctctt

SEQ ID NO: 2464 - DNA, 22 bp, Artificial Sequence
  Synthetic Construct
tccccaaatcctttggcaatgt

SEQ ID NO: 2465 - DNA, 22 bp, Artificial Sequence
  Synthetic Construct
gtgtcaaagggcctgttcttgt

SEQ ID NO: 2466 - DNA, 24 bp, Artificial Sequence
  Synthetic Construct
ctctcatcagctgtttgctgttac

SEQ ID NO: 2467 - DNA, 25 bp, Artificial Sequence
  Synthetic Construct
gacctctttctccctgcacatgtaa

SEQ ID NO: 2468 - DNA, 24 bp, Artificial Sequence
  Synthetic Construct
ccttccttgaacttgcctctggta

SEQ ID NO: 2469 - DNA, 23 bp, Artificial Sequence
  Synthetic Construct
gctgtcaccaagactgagactga

SEQ ID NO: 2470 - DNA, 24 bp, Artificial Sequence
  Synthetic Construct
tgaaagctattgggacaacaggat

SEQ ID NO: 2471 - DNA, 27 bp, Artificial Sequence
  Synthetic Construct
caggaagataagtactgagccatgtgt

SEQ ID NO: 2472 - DNA, 23 bp, Artificial Sequence
  Synthetic Construct
gcacatgtctgcgacctcacttt

SEQ ID NO: 2473 - DNA, 22 bp, Artificial Sequence
  Synthetic Construct
cagcagagcagagtgctattgt

SEQ ID NO: 2474 - DNA, 21 bp, Artificial Sequence
  Synthetic Construct
gctgttgcactgtgaacttgt

SEQ ID NO: 2475 - DNA, 22 bp, Artificial Sequence
  Synthetic Construct
gcagcagacagctggagatgaa

SEQ ID NO: 2476 - DNA, 23 bp, Artificial Sequence
  Synthetic Construct
ctctgctgttccctcacctgtaa

SEQ ID NO: 2477 - DNA, 20 bp, Artificial Sequence
  Synthetic Construct
tctggcttctcagtgcgttt

SEQ ID NO: 2478 - DNA, 27 bp, Artificial Sequence
  Synthetic Construct
tgtcaagggactaagtttctaggtttc

SEQ ID NO: 2479 - DNA, 24 bp, Artificial Sequence
  Synthetic Construct
ggctcatgcttgtgataggagaca

SEQ ID NO: 2480 - DNA, 25 bp, Artificial Sequence
  Synthetic Construct
gccgaggagaatatgggttggaaac

SEQ ID NO: 2481 - DNA, 24 bp, Artificial Sequence
  Synthetic Construct
gcatcttgtggttgcccttagcaa

SEQ ID NO: 2482 - DNA, 19 bp, Artificial Sequence
  Synthetic Construct
gtccattgggcagccttct

SEQ ID NO: 2483 - DNA, 22 bp, Artificial Sequence
  Synthetic Construct
cctgatgctccctctgccaaaa

SEQ ID NO: 2484 - DNA, 25 bp, Artificial Sequence
  Synthetic Construct
gcctcattctcgcacacatccaatc

SEQ ID NO: 2485 - DNA, 22 bp, Artificial Sequence
  Synthetic Construct
gcccttcctcttgctgaacagt

SEQ ID NO: 2486 - DNA, 20 bp, Artificial Sequence
  Synthetic Construct
acctgaagccaggcactttc

SEQ ID NO: 2487 - DNA, 20 bp, Artificial Sequence
  Synthetic Construct
tgggagaaaaagcccacgtt

SEQ ID NO: 2488 - DNA, 23 bp, Artificial Sequence
  Synthetic Construct
gcaaggctcagtagggtgaaaag

SEQ ID NO: 2489 - DNA, 24 bp, Artificial Sequence
  Synthetic Construct
gccaaactgcttcttgctggatct

SEQ ID NO: 2490 - DNA, 23 bp, Artificial Sequence
  Synthetic Construct
ggaaaggcggtggtaatgtggtt

SEQ ID NO: 2491 - DNA, 21 bp, Artificial Sequence
  Synthetic Construct
tctgaccaagtccgcctctca

SEQ ID NO: 2492 - DNA, 24 bp, Artificial Sequence
  Synthetic Construct
cctcacactttcctgtccttgact

SEQ ID NO: 2493 - DNA, 26 bp, Artificial Sequence
  Synthetic Construct
cagctgatctatgcattggaggacat

SEQ ID NO: 2494 - DNA, 26 bp, Artificial Sequence
  Synthetic Construct
gcatctacccaatcactacagttaga

SEQ ID NO: 2495 - DNA, 21 bp, Artificial Sequence
  Synthetic Construct
ctcatcagacacaggcagctt

SEQ ID NO: 2496 - DNA, 23 bp, Artificial Sequence
  Synthetic Construct
agggcaaaagctttccagagtag

SEQ ID NO: 2497 - DNA, 24 bp, Artificial Sequence
  Synthetic Construct
gcaaagtttcatggccaagtgtca

SEQ ID NO: 2498 - DNA, 20 bp, Artificial Sequence
  Synthetic Construct
tgctgccaggctgctgaaat

SEQ ID NO: 2499 - DNA, 20 bp, Artificial Sequence
  Synthetic Construct
tccccaggcacctgctccaa

SEQ ID NO: 2500 - DNA, 27 bp, Artificial Sequence
  Synthetic Construct
tcacctacctaggattaaaggtgaaag

SEQ ID NO: 2501 - DNA, 20 bp, Artificial Sequence
  Synthetic Construct
ggacaggttggtgccagatt

SEQ ID NO: 2502 - DNA, 19 bp, Artificial Sequence
  Synthetic Construct
aaggaggtcctggggcaat

SEQ ID NO: 2503 - DNA, 22 bp, Artificial Sequence
  Synthetic Construct
cttgcctaggaagggcattaca

SEQ ID NO: 2504 - DNA, 20 bp, Artificial Sequence
  Synthetic Construct
gttgcagcctggaggagaaa

SEQ ID NO: 2505 - DNA, 30 bp, Artificial Sequence
  Synthetic Construct
gctggtcaattctgttaaatcaaggagaca

SEQ ID NO: 2506 - DNA, 19 bp, Artificial Sequence
  Synthetic Construct
tgggtgagggcggatcttc

SEQ ID NO: 2507 - DNA, 24 bp, Artificial Sequence
  Synthetic Construct
cccagagaggctggatactgtgta

SEQ ID NO: 2508 - DNA, 26 bp, Artificial Sequence
  Synthetic Construct
cctgtggctcctgagagagaaatcaa

SEQ ID NO: 2509 - DNA, 20 bp, Artificial Sequence
  Synthetic Construct
tgggacacttcaggccaaga

SEQ ID NO: 2510 - DNA, 22 bp, Artificial Sequence
  Synthetic Construct
ggctagcattcggcgaaaatga

SEQ ID NO: 2511 - DNA, 28 bp, Artificial Sequence
  Synthetic Construct
gctcagatgtgtaaaggaaggcagtaca

SEQ ID NO: 2512 - DNA, 20 bp, Artificial Sequence
  Synthetic Construct
ttcccggtgttctggcgatt

SEQ ID NO: 2513 - DNA, 26 bp, Artificial Sequence
  Synthetic Construct
ggcatgtaagggtgacaaaggagttg

SEQ ID NO: 2514 - DNA, 20 bp, Artificial Sequence
  Synthetic Construct
ccctcccaggcttctcatct

SEQ ID NO: 2515 - DNA, 22 bp, Artificial Sequence
  Synthetic Construct
cctgcctacggtcctaaagtgt

SEQ ID NO: 2516 - DNA, 21 bp, Artificial Sequence
  Synthetic Construct
tccctcaaaccccagctcctt

SEQ ID NO: 2517 - DNA, 23 bp, Artificial Sequence
  Synthetic Construct
ggcatgcttttcattgtgagtga

SEQ ID NO: 2518 - DNA, 25 bp, Artificial Sequence
  Synthetic Construct
ggatcttccttctgggtcataaagt

SEQ ID NO: 2519 - DNA, 25 bp, Artificial Sequence
  Synthetic Construct
gcttttaaaaacccagctgtgaatg

SEQ ID NO: 2520 - DNA, 20 bp, Artificial Sequence
  Synthetic Construct
tcttcccgctccgtccctta

SEQ ID NO: 2521 - DNA, 20 bp, Artificial Sequence
  Synthetic Construct
ctgtccgcagaagccaaaag

SEQ ID NO: 2522 - DNA, 23 bp, Artificial Sequence
  Synthetic Construct
ctgtactgcctcctttcctctca

SEQ ID NO: 2523 - DNA, 20 bp, Artificial Sequence
  Synthetic Construct
cctgagcaagggcacagaag

SEQ ID NO: 2524 - DNA, 20 bp, Artificial Sequence
  Synthetic Construct
aggttcatgggccctcattg

SEQ ID NO: 2525 - DNA, 21 bp, Artificial Sequence
  Synthetic Construct
gggctcccactttcctgagat

SEQ ID NO: 2526 - DNA, 26 bp, Artificial Sequence
  Synthetic Construct
gcaggctcgatatctaattccagaga

SEQ ID NO: 2527 - DNA, 20 bp, Artificial Sequence
  Synthetic Construct
gcagaatcgcctgtggttgt

SEQ ID NO: 2528 - DNA, 23 bp, Artificial Sequence
  Synthetic Construct
gagaagctaaatggtccccaaga

SEQ ID NO: 2529 - DNA, 21 bp, Artificial Sequence
  Synthetic Construct
ggactgaggggctctctggaa

SEQ ID NO: 2530 - DNA, 22 bp, Artificial Sequence
  Synthetic Construct
gcccctgtagtacatccacact

SEQ ID NO: 2531 - DNA, 24 bp, Artificial Sequence
  Synthetic Construct
cctttcgcatgaattgtgcagtga

SEQ ID NO: 2532 - DNA, 24 bp, Artificial Sequence
  Synthetic Construct
gagctctagctgtgagtaggatct

SEQ ID NO: 2533 - DNA, 20 bp, Artificial Sequence
  Synthetic Construct
cctctttgccaggtcacaca

SEQ ID NO: 2534 - DNA, 24 bp, Artificial Sequence
  Synthetic Construct
actgggtgaataaaggacccaaga

SEQ ID NO: 2535 - DNA, 18 bp, Artificial Sequence
  Synthetic Construct
agaggctcgtgggtgtga

SEQ ID NO: 2536 - DNA, 19 bp, Artificial Sequence
  Synthetic Construct
tgggctctgctgcctgttg

SEQ ID NO: 2537 - DNA, 20 bp, Artificial Sequence
  Synthetic Construct
gatggtccccagagggatga

SEQ ID NO: 2538 - DNA, 21 bp, Artificial Sequence
  Synthetic Construct
acccctgatgggctcaagtca

SEQ ID NO: 2539 - DNA, 25 bp, Artificial Sequence
  Synthetic Construct
gtcaatactgtggacagctgcttct

SEQ ID NO: 2540 - DNA, 19 bp, Artificial Sequence
  Synthetic Construct
ggaagcatcccgccagcat

SEQ ID NO: 2541 - DNA, 27 bp, Artificial Sequence
  Synthetic Construct
actaggatctatttcaacccagaccat

SEQ ID NO: 2542 - DNA, 22 bp, Artificial Sequence
  Synthetic Construct
gcctctgcctgcaaagaaccat

SEQ ID NO: 2543 - DNA, 26 bp, Artificial Sequence
  Synthetic Construct
gctcaccatcttcctcatcaaacaga

SEQ ID NO: 2544 - DNA, 26 bp, Artificial Sequence
  Synthetic Construct
gggagagacaggttaagaggccattg

SEQ ID NO: 2545 - DNA, 20 bp, Artificial Sequence
  Synthetic Construct
ccagcaagcatggggttcaa

SEQ ID NO: 2546 - DNA, 20 bp, Artificial Sequence
  Synthetic Construct
cgccaggaattcgtgcctta

SEQ ID NO: 2547 - DNA, 24 bp, Artificial Sequence
  Synthetic Construct
ggctctcaaaaccctcaggtctca

SEQ ID NO: 2548 - DNA, 21 bp, Artificial Sequence
  Synthetic Construct
atgcttagtgcctgacacaca

SEQ ID NO: 2549 - DNA, 21 bp, Artificial Sequence
  Synthetic Construct
accgactcctgtccctctttg

SEQ ID NO: 2550 - DNA, 25 bp, Artificial Sequence
  Synthetic Construct
caggaggtggtctttacctcaattc

SEQ ID NO: 2551 - DNA, 26 bp, Artificial Sequence
  Synthetic Construct
caccttagaaaaatgcctacccttga

SEQ ID NO: 2552 - DNA, 29 bp, Artificial Sequence
  Synthetic Construct
ggaaatagatttcagggactagccaaaag

SEQ ID NO: 2553 - DNA, 21 bp, Artificial Sequence
  Synthetic Construct
gccttctcactgctgaacctt

SEQ ID NO: 2554 - DNA, 20 bp, Artificial Sequence
  Synthetic Construct
agcctcctcactgccaaatc

SEQ ID NO: 2555 - DNA, 27 bp, Artificial Sequence
  Synthetic Construct
cccactacacgagaattacacccatct

SEQ ID NO: 2556 - DNA, 21 bp, Artificial Sequence
  Synthetic Construct
tttagcagggcaagggctaag

SEQ ID NO: 2557 - DNA, 29 bp, Artificial Sequence
  Synthetic Construct
cagggaaaaagactgaatcctaactccta

SEQ ID NO: 2558 - DNA, 21 bp, Artificial Sequence
  Synthetic Construct
atgaggacgaggccgggacta

SEQ ID NO: 2559 - DNA, 27 bp, Artificial Sequence
  Synthetic Construct
gagttagatgacccttactttctgcta

SEQ ID NO: 2560 - DNA, 22 bp, Artificial Sequence
  Synthetic Construct
ccattagtggcgcacagacatc

SEQ ID NO: 2561 - DNA, 21 bp, Artificial Sequence
  Synthetic Construct
tcctggctgtcactactgtgt

SEQ ID NO: 2562 - DNA, 21 bp, Artificial Sequence
  Synthetic Construct
ctgggaacaaagccgcctaat

SEQ ID NO: 2563 - DNA, 22 bp, Artificial Sequence
  Synthetic Construct
cgtctccgctgatgttctgtag

SEQ ID NO: 2564 - DNA, 19 bp, Artificial Sequence
  Synthetic Construct
gtgccaactgtggctgtga

SEQ ID NO: 2565 - DNA, 22 bp, Artificial Sequence
  Synthetic Construct
tggctagtggggaagccagata

SEQ ID NO: 2566 - DNA, 24 bp, Artificial Sequence
  Synthetic Construct
ttggtaccagaagtgggattcaaa

SEQ ID NO: 2567 - DNA, 23 bp, Artificial Sequence
  Synthetic Construct
ctgtggtttgtgtaggcccaaag

SEQ ID NO: 2568 - DNA, 21 bp, Artificial Sequence
  Synthetic Construct
gggccaacacatgagggatgt

SEQ ID NO: 2569 - DNA, 22 bp, Artificial Sequence
  Synthetic Construct
ccactggatcactgggtgctta

SEQ ID NO: 2570 - DNA, 21 bp, Artificial Sequence
  Synthetic Construct
tgggacagtgattcccagctt

SEQ ID NO: 2571 - DNA, 20 bp, Artificial Sequence
  Synthetic Construct
agggacagggcagccagtca

SEQ ID NO: 2572 - DNA, 21 bp, Artificial Sequence
  Synthetic Construct
ttatagccgctgcctcctaga

SEQ ID NO: 2573 - DNA, 22 bp, Artificial Sequence
  Synthetic Construct
gctcatccaggaccccatcttt

SEQ ID NO: 2574 - DNA, 20 bp, Artificial Sequence
  Synthetic Construct
ctcattggcgtcagccgata

SEQ ID NO: 2575 - DNA, 24 bp, Artificial Sequence
  Synthetic Construct
cctcgatgttggtagggactcttc

SEQ ID NO: 2576 - DNA, 22 bp, Artificial Sequence
  Synthetic Construct
gcgagtcacctctgccatgttt

SEQ ID NO: 2577 - DNA, 21 bp, Artificial Sequence
  Synthetic Construct
aggccactcagggctttgtga

SEQ ID NO: 2578 - DNA, 28 bp, Artificial Sequence
  Synthetic Construct
ctggggagatgatattaaagctgactct

SEQ ID NO: 2579 - DNA, 20 bp, Artificial Sequence
  Synthetic Construct
gctgcctctgtggtcacatc

SEQ ID NO: 2580 - DNA, 20 bp, Artificial Sequence
  Synthetic Construct
ccaaggcagcacttgaggta

SEQ ID NO: 2581 - DNA, 21 bp, Artificial Sequence
  Synthetic Construct
gccaactgctgtgttgtcttg

SEQ ID NO: 2582 - DNA, 21 bp, Artificial Sequence
  Synthetic Construct
acaacctcacctttgcagaca

SEQ ID NO: 2583 - DNA, 25 bp, Artificial Sequence
  Synthetic Construct
gtcatttgctttcatgaccctcctt

SEQ ID NO: 2584 - DNA, 20 bp, Artificial Sequence
  Synthetic Construct
agtgcgcagcccttttcctt

SEQ ID NO: 2585 - DNA, 19 bp, Artificial Sequence
  Synthetic Construct
atggcgaagcgcaggaaga

SEQ ID NO: 2586 - DNA, 22 bp, Artificial Sequence
  Synthetic Construct
ttgccagaggttccccagattg

SEQ ID NO: 2587 - DNA, 25 bp, Artificial Sequence
  Synthetic Construct
caaataaaggccctccttcaacaac

SEQ ID NO: 2588 - DNA, 22 bp, Artificial Sequence
  Synthetic Construct
caaggaggaggaccaagtctca

SEQ ID NO: 2589 - DNA, 23 bp, Artificial Sequence
  Synthetic Construct
gcatctgtatgcacactgggttt

SEQ ID NO: 2590 - DNA, 20 bp, Artificial Sequence
  Synthetic Construct
aaggtgccagggcaactcaa

SEQ ID NO: 2591 - DNA, 20 bp, Artificial Sequence
  Synthetic Construct
gttctgcagctggtcactgt

SEQ ID NO: 2592 - DNA, 20 bp, Artificial Sequence
  Synthetic Construct
tgctgcagccatgcttccta

SEQ ID NO: 2593 - DNA, 18 bp, Artificial Sequence
  Synthetic Construct
agaagcggctggctccat

SEQ ID NO: 2594 - DNA, 21 bp, Artificial Sequence
  Synthetic Construct
gccttcagggaagctttgaca

SEQ ID NO: 2595 - DNA, 22 bp, Artificial Sequence
  Synthetic Construct
gcagcaccgctctctagttaag

SEQ ID NO: 2596 - DNA, 22 bp, Artificial Sequence
  Synthetic Construct
gacactaagtgcggctgtcatc

SEQ ID NO: 2597 - DNA, 20 bp, Artificial Sequence
  Synthetic Construct
gctaccaggaacgggagtca

SEQ ID NO: 2598 - DNA, 20 bp, Artificial Sequence
  Synthetic Construct
accctgttccctctgtcagt

SEQ ID NO: 2599 - DNA, 22 bp, Artificial Sequence
  Synthetic Construct
gcccagctttagcggatgaagt

SEQ ID NO: 2600 - DNA, 21 bp, Artificial Sequence
  Synthetic Construct
gctgcgcccatttgtttgcat

SEQ ID NO: 2601 - DNA, 19 bp, Artificial Sequence
  Synthetic Construct
ggcacaaagccctctgcat

SEQ ID NO: 2602 - DNA, 21 bp, Artificial Sequence
  Synthetic Construct
tgggcccatggtccatccaaa

SEQ ID NO: 2603 - DNA, 20 bp, Artificial Sequence
  Synthetic Construct
ttgccgctcctctttctgtt

SEQ ID NO: 2604 - DNA, 22 bp, Artificial Sequence
  Synthetic Construct
tcttccccaaatgggaccttca

SEQ ID NO: 2605 - DNA, 24 bp, Artificial Sequence
  Synthetic Construct
ccacatagctctccatctggctat

SEQ ID NO: 2606 - DNA, 21 bp, Artificial Sequence
  Synthetic Construct
ggagtttccgaaggcaacagt

SEQ ID NO: 2607 - DNA, 20 bp, Artificial Sequence
  Synthetic Construct
tcctggcctaaggggtgttt

SEQ ID NO: 2608 - DNA, 20 bp, Artificial Sequence
  Synthetic Construct
gtgctcaggttgtggagaca

SEQ ID NO: 2609 - DNA, 22 bp, Artificial Sequence
  Synthetic Construct
ctcttcaagcaaggctgtctct

SEQ ID NO: 2610 - DNA, 24 bp, Artificial Sequence
  Synthetic Construct
gtgtacagtgaaggccatgtgttc

SEQ ID NO: 2611 - DNA, 23 bp, Artificial Sequence
  Synthetic Construct
tccatggctcaggagggacatag

SEQ ID NO: 2612 - DNA, 22 bp, Artificial Sequence
  Synthetic Construct
accacgatccacacctcctaac

SEQ ID NO: 2613 - DNA, 20 bp, Artificial Sequence
  Synthetic Construct
ttggctggagggctctggaa

SEQ ID NO: 2614 - DNA, 20 bp, Artificial Sequence
  Synthetic Construct
gcaccactggagccaagatt

SEQ ID NO: 2615 - DNA, 25 bp, Artificial Sequence
  Synthetic Construct
gctggaactctgtcataggctgaag

SEQ ID NO: 2616 - DNA, 21 bp, Artificial Sequence
  Synthetic Construct
agtgggagtggtctggtcaac

SEQ ID NO: 2617 - DNA, 20 bp, Artificial Sequence
  Synthetic Construct
actggagcgcttgaggtaga

SEQ ID NO: 2618 - DNA, 24 bp, Artificial Sequence
  Synthetic Construct
gcacaccagaagataacccagctt

SEQ ID NO: 2619 - DNA, 27 bp, Artificial Sequence
  Synthetic Construct
gggcattattgaatgctctgctttctt

SEQ ID NO: 2620 - DNA, 22 bp, Artificial Sequence
  Synthetic Construct
accctggagctcccttccaaaa

SEQ ID NO: 2621 - DNA, 21 bp, Artificial Sequence
  Synthetic Construct
ggcctcctggtgcattgaaac

SEQ ID NO: 2622 - DNA, 24 bp, Artificial Sequence
  Synthetic Construct
gtgcatacacttgactgcttgaca

SEQ ID NO: 2623 - DNA, 21 bp, Artificial Sequence
  Synthetic Construct
tgtaagtgccagccagctaga

SEQ ID NO: 2624 - DNA, 23 bp, Artificial Sequence
  Synthetic Construct
gacctgagtgtggtgaaatgtct

SEQ ID NO: 2625 - DNA, 21 bp, Artificial Sequence
  Synthetic Construct
cagggtgcctcatctcaggat

SEQ ID NO: 2626 - DNA, 22 bp, Artificial Sequence
  Synthetic Construct
agctgaggctatggggatgact

SEQ ID NO: 2627 - DNA, 22 bp, Artificial Sequence
  Synthetic Construct
gcttgtttccacccacctcgtt

SEQ ID NO: 2628 - DNA, 21 bp, Artificial Sequence
  Synthetic Construct
gctgagtgcctttctgccttt

SEQ ID NO: 2629 - DNA, 23 bp, Artificial Sequence
  Synthetic Construct
agtgacagagtatggggtgagaa

SEQ ID NO: 2630 - DNA, 22 bp, Artificial Sequence
  Synthetic Construct
gcttcccagatcccacagttag

SEQ ID NO: 2631 - DNA, 22 bp, Artificial Sequence
  Synthetic Construct
cccaggactgtcattcccaaga

SEQ ID NO: 2632 - DNA, 20 bp, Artificial Sequence
  Synthetic Construct
gggttatgggcaccttcaca

SEQ ID NO: 2633 - DNA, 21 bp, Artificial Sequence
  Synthetic Construct
ggcagacacaacttggggaaa

SEQ ID NO: 2634 - DNA, 21 bp, Artificial Sequence
  Synthetic Construct
gacgtgctcagtgggatttgt

SEQ ID NO: 2635 - DNA, 23 bp, Artificial Sequence
  Synthetic Construct
gcaataacccatcggtggagcaa

SEQ ID NO: 2636 - DNA, 22 bp, Artificial Sequence
  Synthetic Construct
tggtgagatcttggctctccat

SEQ ID NO: 2637 - DNA, 22 bp, Artificial Sequence
  Synthetic Construct
gccctctttccattgcccagaa

SEQ ID NO: 2638 - DNA, 22 bp, Artificial Sequence
  Synthetic Construct
gtctctgtctgcccatcagtct

SEQ ID NO: 2639 - DNA, 20 bp, Artificial Sequence
  Synthetic Construct
gcagggaaagcccagtcatc

SEQ ID NO: 2640 - DNA, 27 bp, Artificial Sequence
  Synthetic Construct
ccccacatttcttcagacagtggaatc

SEQ ID NO: 2641 - DNA, 18 bp, Artificial Sequence
  Synthetic Construct
tcccgcccactgctatct

SEQ ID NO: 2642 - DNA, 19 bp, Artificial Sequence
  Synthetic Construct
tgtctcggggtgccacaca

SEQ ID NO: 2643 - DNA, 23 bp, Artificial Sequence
  Synthetic Construct
gcacgtggagagtgttcatccat

SEQ ID NO: 2644 - DNA, 25 bp, Artificial Sequence
  Synthetic Construct
tgaaatgaacagaccagctaacctt

SEQ ID NO: 2645 - DNA, 22 bp, Artificial Sequence
  Synthetic Construct
cctgggctatgctgtcatccat

SEQ ID NO: 2646 - DNA, 25 bp, Artificial Sequence
  Synthetic Construct
gagactgcctgaataccatggaaga

SEQ ID NO: 2647 - DNA, 20 bp, Artificial Sequence
  Synthetic Construct
tgggagggtgccacctcttg

SEQ ID NO: 2648 - DNA, 20 bp, Artificial Sequence
  Synthetic Construct
ctttggttgcaggccacaga

SEQ ID NO: 2649 - DNA, 20 bp, Artificial Sequence
  Synthetic Construct
ggctgccttgggacacatct

SEQ ID NO: 2650 - DNA, 22 bp, Artificial Sequence
  Synthetic Construct
gccaggaacactgcttgtgatg

SEQ ID NO: 2651 - DNA, 22 bp, Artificial Sequence
  Synthetic Construct
gagaggggtttgcttccctctt

SEQ ID NO: 2652 - DNA, 19 bp, Artificial Sequence
  Synthetic Construct
aggggcctgcactgtgatt

SEQ ID NO: 2653 - DNA, 23 bp, Artificial Sequence
  Synthetic Construct
ccatcagcagattcacactcaga

SEQ ID NO: 2654 - DNA, 24 bp, Artificial Sequence
  Synthetic Construct
cagggaaaacagggatgaaagaca

SEQ ID NO: 2655 - DNA, 26 bp, Artificial Sequence
  Synthetic Construct
ctgctgtgaagctggagactttttac

SEQ ID NO: 2656 - DNA, 19 bp, Artificial Sequence
  Synthetic Construct
tcgccgcgttgaccagtgt

SEQ ID NO: 2657 - DNA, 22 bp, Artificial Sequence
  Synthetic Construct
ggacaggtactaggtgctgctt

SEQ ID NO: 2658 - DNA, 22 bp, Artificial Sequence
  Synthetic Construct
gaagccggtttaactggtgttg

SEQ ID NO: 2659 - DNA, 22 bp, Artificial Sequence
  Synthetic Construct
cagcaggagggaaaaggctatg

SEQ ID NO: 2660 - DNA, 22 bp, Artificial Sequence
  Synthetic Construct
ctcaaaaggcaggtgcttgaca

SEQ ID NO: 2661 - DNA, 21 bp, Artificial Sequence
  Synthetic Construct
tggttcccaaggggctcagat

SEQ ID NO: 2662 - DNA, 26 bp, Artificial Sequence
  Synthetic Construct
gtggtgaaagtaatggcatcaagcat

SEQ ID NO: 2663 - DNA, 21 bp, Artificial Sequence
  Synthetic Construct
tgctgtggtgtggtcatttgt

SEQ ID NO: 2664 - DNA, 20 bp, Artificial Sequence
  Synthetic Construct
tcccagtgcaagggcattag

SEQ ID NO: 2665 - DNA, 19 bp, Artificial Sequence
  Synthetic Construct
aggctggcctcccacttac

SEQ ID NO: 2666 - DNA, 26 bp, Artificial Sequence
  Synthetic Construct
agagtaaacttggaaggatgggtttc

SEQ ID NO: 2667 - DNA, 19 bp, Artificial Sequence
  Synthetic Construct
gcaatccctgcgaccacat

SEQ ID NO: 2668 - DNA, 20 bp, Artificial Sequence
  Synthetic Construct
aggccaaagtccctgtgaac

SEQ ID NO: 2669 - DNA, 25 bp, Artificial Sequence
  Synthetic Construct
ggatgagattcccttcctccacact

SEQ ID NO: 2670 - DNA, 21 bp, Artificial Sequence
  Synthetic Construct
gctgtttctctgtcgctcctt

SEQ ID NO: 2671 - DNA, 22 bp, Artificial Sequence
  Synthetic Construct
gggtgctgggaaacatgaggaa

SEQ ID NO: 2672 - DNA, 22 bp, Artificial Sequence
  Synthetic Construct
cagccttctgtccactccttag

SEQ ID NO: 2673 - DNA, 20 bp, Artificial Sequence
  Synthetic Construct
tgcttccagagccccacact

SEQ ID NO: 2674 - DNA, 20 bp, Artificial Sequence
  Synthetic Construct
cactccgcattgttgtgcat

SEQ ID NO: 2675 - DNA, 20 bp, Artificial Sequence
  Synthetic Construct
acaccctgtggggccgatga

SEQ ID NO: 2676 - DNA, 24 bp, Artificial Sequence
  Synthetic Construct
gtggtagttagacctccccgaaag

SEQ ID NO: 2677 - DNA, 21 bp, Artificial Sequence
  Synthetic Construct
gggcagaagtggatggtgaga

SEQ ID NO: 2678 - DNA, 21 bp, Artificial Sequence
  Synthetic Construct
gcccctaccctgttcctccat

SEQ ID NO: 2679 - DNA, 24 bp, Artificial Sequence
  Synthetic Construct
acttccaggagcacctttgaatag

SEQ ID NO: 2680 - DNA, 26 bp, Artificial Sequence
  Synthetic Construct
ccatcaaagaggtaacaagccagtga

SEQ ID NO: 2681 - DNA, 20 bp, Artificial Sequence
  Synthetic Construct
aaccccgtcttggctcgatt

SEQ ID NO: 2682 - DNA, 19 bp, Artificial Sequence
  Synthetic Construct
gctacacgctgggcaccaa

SEQ ID NO: 2683 - DNA, 22 bp, Artificial Sequence
  Synthetic Construct
gccctatggcaaaggctcacta

SEQ ID NO: 2684 - DNA, 20 bp, Artificial Sequence
  Synthetic Construct
aagcctctggctggtgtttc

SEQ ID NO: 2685 - DNA, 20 bp, Artificial Sequence
  Synthetic Construct
cctgtggttttgggcaggtt

SEQ ID NO: 2686 - DNA, 20 bp, Artificial Sequence
  Synthetic Construct
tggttaccaccctgggatca

SEQ ID NO: 2687 - DNA, 21 bp, Artificial Sequence
  Synthetic Construct
tctggtactcccagggtgcat

SEQ ID NO: 2688 - DNA, 20 bp, Artificial Sequence
  Synthetic Construct
tggatacaccgggcttgtct

SEQ ID NO: 2689 - DNA, 20 bp, Artificial Sequence
  Synthetic Construct
aagacaccgcgctgcctagt

SEQ ID NO: 2690 - DNA, 21 bp, Artificial Sequence
  Synthetic Construct
tccagaggcaggagacaatca

SEQ ID NO: 2691 - DNA, 27 bp, Artificial Sequence
  Synthetic Construct
ccgcaattggagctgaattcttaaatc

SEQ ID NO: 2692 - DNA, 20 bp, Artificial Sequence
  Synthetic Construct
ccttggggtggcccacttag

SEQ ID NO: 2693 - DNA, 21 bp, Artificial Sequence
  Synthetic Construct
ttttccctgacgatcggcttt

SEQ ID NO: 2694 - DNA, 23 bp, Artificial Sequence
  Synthetic Construct
gtcagggagaacctatggaccta

SEQ ID NO: 2695 - DNA, 24 bp, Artificial Sequence
  Synthetic Construct
ccccagacagatgtaagtccaaca

SEQ ID NO: 2696 - DNA, 20 bp, Artificial Sequence
  Synthetic Construct
ctgcatgcctggaacacact

SEQ ID NO: 2697 - DNA, 22 bp, Artificial Sequence
  Synthetic Construct
ctggactgctcactctggaact

SEQ ID NO: 2698 - DNA, 20 bp, Artificial Sequence
  Synthetic Construct
tgcccgaagaggcatgaaac

SEQ ID NO: 2699 - DNA, 23 bp, Artificial Sequence
  Synthetic Construct
tcttctccaaagtcagggtgtct

SEQ ID NO: 2700 - DNA, 20 bp, Artificial Sequence
  Synthetic Construct
gcagtgccaggagcaaaaga

SEQ ID NO: 2701 - DNA, 25 bp, Artificial Sequence
  Synthetic Construct
agccttaaaaactgccttctacaca

SEQ ID NO: 2702 - DNA, 25 bp, Artificial Sequence
  Synthetic Construct
gggattcactagtgttgtggattga

SEQ ID NO: 2703 - DNA, 22 bp, Artificial Sequence
  Synthetic Construct
ccaatggtggaaacagcctaca

SEQ ID NO: 2704 - DNA, 23 bp, Artificial Sequence
  Synthetic Construct
gctagatgagggaggctggaaac

SEQ ID NO: 2705 - DNA, 20 bp, Artificial Sequence
  Synthetic Construct
cctggatgtggctggcagta

SEQ ID NO: 2706 - DNA, 20 bp, Artificial Sequence
  Synthetic Construct
cattggcaacccagctcaca

SEQ ID NO: 2707 - DNA, 21 bp, Artificial Sequence
  Synthetic Construct
agcccgagcctcctacaactt

SEQ ID NO: 2708 - DNA, 20 bp, Artificial Sequence
  Synthetic Construct
acagggctccaggcgagtgt

SEQ ID NO: 2709 - DNA, 21 bp, Artificial Sequence
  Synthetic Construct
tgggaggtgaaccagggacat

SEQ ID NO: 2710 - DNA, 22 bp, Artificial Sequence
  Synthetic Construct
gggctgcagagataagctcgtt

SEQ ID NO: 2711 - DNA, 22 bp, Artificial Sequence
  Synthetic Construct
cgtcacagccagttctcacaca

SEQ ID NO: 2712 - DNA, 20 bp, Artificial Sequence
  Synthetic Construct
tctgacctgcgggcagtttg

SEQ ID NO: 2713 - DNA, 23 bp, Artificial Sequence
  Synthetic Construct
gcgagaaacaccactgacatttg

SEQ ID NO: 2714 - DNA, 22 bp, Artificial Sequence
  Synthetic Construct
cccaatggtagctggcatgctt

SEQ ID NO: 2715 - DNA, 21 bp, Artificial Sequence
  Synthetic Construct
acctccccagggacactcact

SEQ ID NO: 2716 - DNA, 22 bp, Artificial Sequence
  Synthetic Construct
aggcagtggcctcctctttgta

SEQ ID NO: 2717 - DNA, 20 bp, Artificial Sequence
  Synthetic Construct
ttgccggtggatcctgactt

SEQ ID NO: 2718 - DNA, 22 bp, Artificial Sequence
  Synthetic Construct
tgcaattgatcgttggctccta

SEQ ID NO: 2719 - DNA, 22 bp, Artificial Sequence
  Synthetic Construct
ggccgctttcttagggtgtaag

SEQ ID NO: 2720 - DNA, 24 bp, Artificial Sequence
  Synthetic Construct
ggtgaaaggtgaggatcaatcaga

SEQ ID NO: 2721 - DNA, 20 bp, Artificial Sequence
  Synthetic Construct
tgtgccttctgggagaccat

SEQ ID NO: 2722 - DNA, 25 bp, Artificial Sequence
  Synthetic Construct
ggttctccagaatggtcctgtcgtt

SEQ ID NO: 2723 - DNA, 20 bp, Artificial Sequence
  Synthetic Construct
gcagccttagggctagcaaa

SEQ ID NO: 2724 - DNA, 22 bp, Artificial Sequence
  Synthetic Construct
cccctaaacctgggccaaatga

SEQ ID NO: 2725 - DNA, 20 bp, Artificial Sequence
  Synthetic Construct
tgacaggccatgccacaaag

SEQ ID NO: 2726 - DNA, 26 bp, Artificial Sequence
  Synthetic Construct
cccatcctattaccccaaacgtcttc

SEQ ID NO: 2727 - DNA, 20 bp, Artificial Sequence
  Synthetic Construct
actgcagcccctgtgaatac

SEQ ID NO: 2728 - DNA, 23 bp, Artificial Sequence
  Synthetic Construct
ggagacgtcctgcctgcagtctt

SEQ ID NO: 2729 - DNA, 20 bp, Artificial Sequence
  Synthetic Construct
gcgcacagcagaatggagat

SEQ ID NO: 2730 - DNA, 23 bp, Artificial Sequence
  Synthetic Construct
gcatgcagtggtgtatgttgtag

SEQ ID NO: 2731 - DNA, 25 bp, Artificial Sequence
  Synthetic Construct
gcctaatgtttgtggggtagtggta

SEQ ID NO: 2732 - DNA, 20 bp, Artificial Sequence
  Synthetic Construct
gggagaccaggcccctaaga

SEQ ID NO: 2733 - DNA, 20 bp, Artificial Sequence
  Synthetic Construct
tccctgcaaggaccctcagt

SEQ ID NO: 2734 - DNA, 22 bp, Artificial Sequence
  Synthetic Construct
tctcacctgaccctgaggtctt

SEQ ID NO: 2735 - DNA, 22 bp, Artificial Sequence
  Synthetic Construct
gacgcagcttgccttagacttc

SEQ ID NO: 2736 - DNA, 24 bp, Artificial Sequence
  Synthetic Construct
gggtgcagctgacttcctagtctt

SEQ ID NO: 2737 - DNA, 22 bp, Artificial Sequence
  Synthetic Construct
gtgcggtcaaggtttacaggtt

SEQ ID NO: 2738 - DNA, 22 bp, Artificial Sequence
  Synthetic Construct
tcacaagctccactccctcaag

SEQ ID NO: 2739 - DNA, 18 bp, Artificial Sequence
  Synthetic Construct
tctgcgtgtgcgtgtgtt

SEQ ID NO: 2740 - DNA, 21 bp, Artificial Sequence
  Synthetic Construct
cagtgacatgtggcccagttt

SEQ ID NO: 2741 - DNA, 25 bp, Artificial Sequence
  Synthetic Construct
tgttcaatgatactggtgcaggatt

SEQ ID NO: 2742 - DNA, 24 bp, Artificial Sequence
  Synthetic Construct
ggcgtggagttgcttcatctcctt

SEQ ID NO: 2743 - DNA, 19 bp, Artificial Sequence
  Synthetic Construct
tggggtggcacagccaact

SEQ ID NO: 2744 - DNA, 22 bp, Artificial Sequence
  Synthetic Construct
accacgtgacaggtgtgaggat

SEQ ID NO: 2745 - DNA, 24 bp, Artificial Sequence
  Synthetic Construct
ggagtagctctgtagggagagttg

SEQ ID NO: 2746 - DNA, 23 bp, Artificial Sequence
  Synthetic Construct
acatgattgatgccaaggggtaa

SEQ ID NO: 2747 - DNA, 22 bp, Artificial Sequence
  Synthetic Construct
tgcgtgctcagagtcacataag

SEQ ID NO: 2748 - DNA, 20 bp, Artificial Sequence
  Synthetic Construct
agcacacccctcctgcactt

SEQ ID NO: 2749 - DNA, 19 bp, Artificial Sequence
  Synthetic Construct
ccaggcggctccaagaagt

SEQ ID NO: 2750 - DNA, 20 bp, Artificial Sequence
  Synthetic Construct
aaacctggcagaggttgcat

SEQ ID NO: 2751 - DNA, 22 bp, Artificial Sequence
  Synthetic Construct
caggatctgaacgggaggtttc

SEQ ID NO: 2752 - DNA, 24 bp, Artificial Sequence
  Synthetic Construct
ggtggaaatctaccccaggcaact

SEQ ID NO: 2753 - DNA, 22 bp, Artificial Sequence
  Synthetic Construct
ctgccggtgaactgagagtaga

SEQ ID NO: 2754 - DNA, 19 bp, Artificial Sequence
  Synthetic Construct
atccctggccatgctgcta

SEQ ID NO: 2755 - DNA, 24 bp, Artificial Sequence
  Synthetic Construct
agtgactcatcctgaagtcctgaa

SEQ ID NO: 2756 - DNA, 20 bp, Artificial Sequence
  Synthetic Construct
acaggaaggcaccacgttga

SEQ ID NO: 2757 - DNA, 19 bp, Artificial Sequence
  Synthetic Construct
gaggggccaagtgcagaag

SEQ ID NO: 2758 - DNA, 21 bp, Artificial Sequence
  Synthetic Construct
agaggtgaccaggccctttga

SEQ ID NO: 2759 - DNA, 22 bp, Artificial Sequence
  Synthetic Construct
gtgacgcgacctgctcataagt

SEQ ID NO: 2760 - DNA, 22 bp, Artificial Sequence
  Synthetic Construct
acctgggctccatcctgtgaat

SEQ ID NO: 2761 - DNA, 23 bp, Artificial Sequence
  Synthetic Construct
gctcaattcctcccactgcttct

SEQ ID NO: 2762 - DNA, 22 bp, Artificial Sequence
  Synthetic Construct
ctcttctggagaaggggagagt

SEQ ID NO: 2763 - DNA, 27 bp, Artificial Sequence
  Synthetic Construct
gtccaactccttccatctgaattcttc

SEQ ID NO: 2764 - DNA, 24 bp, Artificial Sequence
  Synthetic Construct
cacgtaggcctctgttttctggtt

SEQ ID NO: 2765 - DNA, 22 bp, Artificial Sequence
  Synthetic Construct
cccctggctaagctcaaagtca

SEQ ID NO: 2766 - DNA, 22 bp, Artificial Sequence
  Synthetic Construct
ggaaaacacaccgccagagaag

SEQ ID NO: 2767 - DNA, 23 bp, Artificial Sequence
  Synthetic Construct
gcaaactcctaggctctgtgctt

SEQ ID NO: 2768 - DNA, 23 bp, Artificial Sequence
  Synthetic Construct
gtgagaggatgtgtgcgttccat

SEQ ID NO: 2769 - DNA, 23 bp, Artificial Sequence
  Synthetic Construct
cattaccccagttggcagaaaac

SEQ ID NO: 2770 - DNA, 22 bp, Artificial Sequence
  Synthetic Construct
gacaagttgggtggacagtctt

SEQ ID NO: 2771 - DNA, 19 bp, Artificial Sequence
  Synthetic Construct
aaggggtgctctcccttga

SEQ ID NO: 2772 - DNA, 23 bp, Artificial Sequence
  Synthetic Construct
ccccgtgaaatgatggtggaaac

SEQ ID NO: 2773 - DNA, 25 bp, Artificial Sequence
  Synthetic Construct
ggtaatcaaccctcagtctctcatc

SEQ ID NO: 2774 - DNA, 19 bp, Artificial Sequence
  Synthetic Construct
aggccagccctctgacttc

SEQ ID NO: 2775 - DNA, 20 bp, Artificial Sequence
  Synthetic Construct
gcttgggactctggggttga

SEQ ID NO: 2776 - DNA, 21 bp, Artificial Sequence
  Synthetic Construct
cctggctttgccccttcatct

SEQ ID NO: 2777 - DNA, 18 bp, Artificial Sequence
  Synthetic Construct
agccagcctctgcacctt

SEQ ID NO: 2778 - DNA, 21 bp, Artificial Sequence
  Synthetic Construct
cctctgaaaggcggaaaccaa

SEQ ID NO: 2779 - DNA, 18 bp, Artificial Sequence
  Synthetic Construct
agtggccagcaggagcaa

SEQ ID NO: 2780 - DNA, 23 bp, Artificial Sequence
  Synthetic Construct
ccagggcaggactctaaccattg

SEQ ID NO: 2781 - DNA, 24 bp, Artificial Sequence
  Synthetic Construct
gttaggaaagggtcccctaaggtt

SEQ ID NO: 2782 - DNA, 20 bp, Artificial Sequence
  Synthetic Construct
ggtggcttggattgcctact

SEQ ID NO: 2783 - DNA, 20 bp, Artificial Sequence
  Synthetic Construct
tccaccctggccccagcatt

SEQ ID NO: 2784 - DNA, 21 bp, Artificial Sequence
  Synthetic Construct
cgtggaggggaggaagtcttg

SEQ ID NO: 2785 - DNA, 20 bp, Artificial Sequence
  Synthetic Construct
accaatgggaggcaccatca

SEQ ID NO: 2786 - DNA, 24 bp, Artificial Sequence
  Synthetic Construct
gagttgcacttgtactctgtcagt

SEQ ID NO: 2787 - DNA, 25 bp, Artificial Sequence
  Synthetic Construct
ggctttttggctttccaggttgatg

SEQ ID NO: 2788 - DNA, 20 bp, Artificial Sequence
  Synthetic Construct
cccgcaagggttggggaaat

SEQ ID NO: 2789 - DNA, 20 bp, Artificial Sequence
  Synthetic Construct
tccaacaccatccgctcttc

SEQ ID NO: 2790 - DNA, 22 bp, Artificial Sequence
  Synthetic Construct
gtgggtgccagagttgagattc

SEQ ID NO: 2791 - DNA, 19 bp, Artificial Sequence
  Synthetic Construct
ggccgggaaaagggagcat

SEQ ID NO: 2792 - DNA, 28 bp, Artificial Sequence
  Synthetic Construct
gtcttccccatagttaagttgtctcttc

SEQ ID NO: 2793 - DNA, 28 bp, Artificial Sequence
  Synthetic Construct
gcagctacgcatacaaatcactcacatc

SEQ ID NO: 2794 - DNA, 21 bp, Artificial Sequence
  Synthetic Construct
actggactcagggagcagcat

SEQ ID NO: 2795 - DNA, 19 bp, Artificial Sequence
  Synthetic Construct
aggccactgcctcgcatca

SEQ ID NO: 2796 - DNA, 25 bp, Artificial Sequence
  Synthetic Construct
ggacttttgttttccccgtttgaag

SEQ ID NO: 2797 - DNA, 25 bp, Artificial Sequence
  Synthetic Construct
tctaaatgttctctgggtgctgttc

SEQ ID NO: 2798 - DNA, 22 bp, Artificial Sequence
  Synthetic Construct
ggggtctaatggctgtggttgt

SEQ ID NO: 2799 - DNA, 22 bp, Artificial Sequence
  Synthetic Construct
ggctgttagccctgtggaacaa

SEQ ID NO: 2800 - DNA, 20 bp, Artificial Sequence
  Synthetic Construct
acggcagagcaaaggcttgt

SEQ ID NO: 2801 - DNA, 28 bp, Artificial Sequence
  Synthetic Construct
ggacaaggccctttaattcataccaaga

SEQ ID NO: 2802 - DNA, 18 bp, Artificial Sequence
  Synthetic Construct
agcccagagcagcgttca

SEQ ID NO: 2803 - DNA, 21 bp, Artificial Sequence
  Synthetic Construct
tggtagtgtagaggggcaact

SEQ ID NO: 2804 - DNA, 20 bp, Artificial Sequence
  Synthetic Construct
gggccaagcgttcagactac

SEQ ID NO: 2805 - DNA, 18 bp, Artificial Sequence
  Synthetic Construct
atgctcaggctgcgttgt

SEQ ID NO: 2806 - DNA, 21 bp, Artificial Sequence
  Synthetic Construct
tggctccctgaggagtgtttg

SEQ ID NO: 2807 - DNA, 25 bp, Artificial Sequence
  Synthetic Construct
cagaaaagtctagtgaagccagaca

SEQ ID NO: 2808 - DNA, 22 bp, Artificial Sequence
  Synthetic Construct
cacagacaactggagggtgaac

SEQ ID NO: 2809 - DNA, 23 bp, Artificial Sequence
  Synthetic Construct
acatacctgctgtaccccaaatg

SEQ ID NO: 2810 - DNA, 24 bp, Artificial Sequence
  Synthetic Construct
gcaatgaacaacgacaggctttca

SEQ ID NO: 2811 - DNA, 22 bp, Artificial Sequence
  Synthetic Construct
gactgagcttgtgaggcaggaa

SEQ ID NO: 2812 - DNA, 25 bp, Artificial Sequence
  Synthetic Construct
gcatactaaaggagctttggagaca

SEQ ID NO: 2813 - DNA, 19 bp, Artificial Sequence
  Synthetic Construct
gccaaccaggccagcatca

SEQ ID NO: 2814 - DNA, 21 bp, Artificial Sequence
  Synthetic Construct
acagagcggtacagcggaatc

SEQ ID NO: 2815 - DNA, 26 bp, Artificial Sequence
  Synthetic Construct
gagaaagtgagcatttgccatgaaag

SEQ ID NO: 2816 - DNA, 26 bp, Artificial Sequence
  Synthetic Construct
ggtcttaccttcagagttctgtccta

SEQ ID NO: 2817 - DNA, 27 bp, Artificial Sequence
  Synthetic Construct
ggggaacatttcagaccagataacact

SEQ ID NO: 2818 - DNA, 20 bp, Artificial Sequence
  Synthetic Construct
agggccaatcctggaacact

SEQ ID NO: 2819 - DNA, 29 bp, Artificial Sequence
  Synthetic Construct
ccttgcaccaaaaatagaagtgtgagcta

SEQ ID NO: 2820 - DNA, 18 bp, Artificial Sequence
  Synthetic Construct
actgccaagtggctgcaa

SEQ ID NO: 2821 - DNA, 22 bp, Artificial Sequence
  Synthetic Construct
cacagctgaacctcaggcaatc

SEQ ID NO: 2822 - DNA, 22 bp, Artificial Sequence
  Synthetic Construct
caacagccgggatcttctgaac

SEQ ID NO: 2823 - DNA, 24 bp, Artificial Sequence
  Synthetic Construct
gggcctaggtgtgtgtatccagtt

SEQ ID NO: 2824 - DNA, 25 bp, Artificial Sequence
  Synthetic Construct
cctgtcggaatgttttctccaccaa

SEQ ID NO: 2825 - DNA, 22 bp, Artificial Sequence
  Synthetic Construct
gggtctaaggacaccgggtcta

SEQ ID NO: 2826 - DNA, 21 bp, Artificial Sequence
  Synthetic Construct
tttccggtggggccaatgtgt

SEQ ID NO: 2827 - DNA, 23 bp, Artificial Sequence
  Synthetic Construct
gcattgtcaggcttctctctttg

SEQ ID NO: 2828 - DNA, 25 bp, Artificial Sequence
  Synthetic Construct
cagaaatcagaagctctcagggaaa

SEQ ID NO: 2829 - DNA, 24 bp, Artificial Sequence
  Synthetic Construct
actcttttgcctgggatttaccat

SEQ ID NO: 2830 - DNA, 20 bp, Artificial Sequence
  Synthetic Construct
atctggcccgtgctccactt

SEQ ID NO: 2831 - DNA, 19 bp, Artificial Sequence
  Synthetic Construct
aacacctggggaggcaaca

SEQ ID NO: 2832 - DNA, 19 bp, Artificial Sequence
  Synthetic Construct
aggcagggagcacagagat

SEQ ID NO: 2833 - DNA, 23 bp, Artificial Sequence
  Synthetic Construct
ggttttggggcatagtccacagt

SEQ ID NO: 2834 - DNA, 20 bp, Artificial Sequence
  Synthetic Construct
cctcccctcccagcatgaag

SEQ ID NO: 2835 - DNA, 22 bp, Artificial Sequence
  Synthetic Construct
tccctgggtggtctgtctgatt

SEQ ID NO: 2836 - DNA, 22 bp, Artificial Sequence
  Synthetic Construct
ccccatcccattgcttctcagt

SEQ ID NO: 2837 - DNA, 21 bp, Artificial Sequence
  Synthetic Construct
tggcttcaaggtagggaggtt

SEQ ID NO: 2838 - DNA, 19 bp, Artificial Sequence
  Synthetic Construct
ggagggtggcagtgtggta

SEQ ID NO: 2839 - DNA, 23 bp, Artificial Sequence
  Synthetic Construct
gctgtatccagggaggtgacaag

SEQ ID NO: 2840 - DNA, 25 bp, Artificial Sequence
  Synthetic Construct
cctgcgtgtcaaatactcctttcta

SEQ ID NO: 2841 - DNA, 24 bp, Artificial Sequence
  Synthetic Construct
gctgttgtggttaagagcctggat

SEQ ID NO: 2842 - DNA, 23 bp, Artificial Sequence
  Synthetic Construct
accaggcatagtggagataggaa

SEQ ID NO: 2843 - DNA, 20 bp, Artificial Sequence
  Synthetic Construct
tgccggcctcccagtctcat

SEQ ID NO: 2844 - DNA, 19 bp, Artificial Sequence
  Synthetic Construct
tgctcgggcagggtgagaa

SEQ ID NO: 2845 - DNA, 22 bp, Artificial Sequence
  Synthetic Construct
ggcacccgtttggccttaattg

SEQ ID NO: 2846 - DNA, 20 bp, Artificial Sequence
  Synthetic Construct
tggtgggcaggagaggctaa

SEQ ID NO: 2847 - DNA, 22 bp, Artificial Sequence
  Synthetic Construct
aagtgggtgctacagaagcatt

SEQ ID NO: 2848 - DNA, 27 bp, Artificial Sequence
  Synthetic Construct
gggctaagaatgagtgattgggtcata

SEQ ID NO: 2849 - DNA, 22 bp, Artificial Sequence
  Synthetic Construct
ttcaggctctgagacacgaaag

SEQ ID NO: 2850 - DNA, 20 bp, Artificial Sequence
  Synthetic Construct
actcctgaccgagggaatgt

SEQ ID NO: 2851 - DNA, 22 bp, Artificial Sequence
  Synthetic Construct
cccaaaggaaaccatcccatgt

SEQ ID NO: 2852 - DNA, 22 bp, Artificial Sequence
  Synthetic Construct
cacaggttccctcccacttact

SEQ ID NO: 2853 - DNA, 22 bp, Artificial Sequence
  Synthetic Construct
agccggggaatgtcctgtattc

SEQ ID NO: 2854 - DNA, 25 bp, Artificial Sequence
  Synthetic Construct
ccttctgatgcttggataccgcaaa

SEQ ID NO: 2855 - DNA, 23 bp, Artificial Sequence
  Synthetic Construct
gcagatcaggattgcaggctttg

SEQ ID NO: 2856 - DNA, 21 bp, Artificial Sequence
  Synthetic Construct
ggcctcagaagccaggataag

SEQ ID NO: 2857 - DNA, 22 bp, Artificial Sequence
  Synthetic Construct
ggtttcgctcatgcctctgttg

SEQ ID NO: 2858 - DNA, 20 bp, Artificial Sequence
  Synthetic Construct
ttcctgagagggctgtgcta

SEQ ID NO: 2859 - DNA, 21 bp, Artificial Sequence
  Synthetic Construct
accagctccttcctcccttct

SEQ ID NO: 2860 - DNA, 21 bp, Artificial Sequence
  Synthetic Construct
gcacagctaggaatgggaaca

SEQ ID NO: 2861 - DNA, 27 bp, Artificial Sequence
  Synthetic Construct
gctaatgctcaaagggaaaagtgtctt

SEQ ID NO: 2862 - DNA, 24 bp, Artificial Sequence
  Synthetic Construct
gtggcattgtggaaacaagcaaag

SEQ ID NO: 2863 - DNA, 22 bp, Artificial Sequence
  Synthetic Construct
cctgccagcagggcatttttct

SEQ ID NO: 2864 - DNA, 21 bp, Artificial Sequence
  Synthetic Construct
cctcagatggctgagggaaga

SEQ ID NO: 2865 - DNA, 20 bp, Artificial Sequence
  Synthetic Construct
gttcaggcctgcagggaaaa

SEQ ID NO: 2866 - DNA, 26 bp, Artificial Sequence
  Synthetic Construct
gggtacaaatagcctttacagcattg

SEQ ID NO: 2867 - DNA, 22 bp, Artificial Sequence
  Synthetic Construct
aggcagcttaggccactagtct

SEQ ID NO: 2868 - DNA, 25 bp, Artificial Sequence
  Synthetic Construct
gaactccacccagttctaaggatag

SEQ ID NO: 2869 - DNA, 22 bp, Artificial Sequence
  Synthetic Construct
ccctggaagaaggagagggaat

SEQ ID NO: 2870 - DNA, 21 bp, Artificial Sequence
  Synthetic Construct
agggcagtgagcactgagttg

SEQ ID NO: 2871 - DNA, 21 bp, Artificial Sequence
  Synthetic Construct
atccccacggacaccaacgat

SEQ ID NO: 2872 - DNA, 21 bp, Artificial Sequence
  Synthetic Construct
gcagccattccctcaccacat

SEQ ID NO: 2873 - DNA, 19 bp, Artificial Sequence
  Synthetic Construct
ccccgggcaaacacatact

SEQ ID NO: 2874 - DNA, 20 bp, Artificial Sequence
  Synthetic Construct
atcctggtcctgggcagtaa

SEQ ID NO: 2875 - DNA, 22 bp, Artificial Sequence
  Synthetic Construct
accaggtgccagctccctatac

SEQ ID NO: 2876 - DNA, 24 bp, Artificial Sequence
  Synthetic Construct
gtggagcaggactagctgagaatc

SEQ ID NO: 2877 - DNA, 23 bp, Artificial Sequence
  Synthetic Construct
gccagaaatccacaccatacaag

SEQ ID NO: 2878 - DNA, 24 bp, Artificial Sequence
  Synthetic Construct
ggggacagtttcaagtggatgaga

SEQ ID NO: 2879 - DNA, 21 bp, Artificial Sequence
  Synthetic Construct
aggtgagggcttgaggcagtt

SEQ ID NO: 2880 - DNA, 23 bp, Artificial Sequence
  Synthetic Construct
tgagggaaaccaaaactgcattc

SEQ ID NO: 2881 - DNA, 22 bp, Artificial Sequence
  Synthetic Construct
aggccttttccactctccctta

SEQ ID NO: 2882 - DNA, 24 bp, Artificial Sequence
  Synthetic Construct
cccttacaaaccacagatgcaaag

SEQ ID NO: 2883 - DNA, 24 bp, Artificial Sequence
  Synthetic Construct
cactcttaggaagggagtgtctgt

SEQ ID NO: 2884 - DNA, 22 bp, Artificial Sequence
  Synthetic Construct
atagggaagtggtgtggtcaac

SEQ ID NO: 2885 - DNA, 18 bp, Artificial Sequence
  Synthetic Construct
tccctgcctgggtcttgt

SEQ ID NO: 2886 - DNA, 22 bp, Artificial Sequence
  Synthetic Construct
caggagctgaggctttggtttg

SEQ ID NO: 2887 - DNA, 22 bp, Artificial Sequence
  Synthetic Construct
tgttttctgtgtgccagtgtgt

SEQ ID NO: 2888 - DNA, 20 bp, Artificial Sequence
  Synthetic Construct
gcagggttcaggccagtaga

SEQ ID NO: 2889 - DNA, 22 bp, Artificial Sequence
  Synthetic Construct
agctgggatggagggacattga

SEQ ID NO: 2890 - DNA, 27 bp, Artificial Sequence
  Synthetic Construct
ggtgtacaattgctggatcctaagaca

SEQ ID NO: 2891 - DNA, 22 bp, Artificial Sequence
  Synthetic Construct
cagcctccaggcaaatttccaa

SEQ ID NO: 2892 - DNA, 23 bp, Artificial Sequence
  Synthetic Construct
gcaagtttggccatctcttgtga

SEQ ID NO: 2893 - DNA, 25 bp, Artificial Sequence
  Synthetic Construct
cgtccatgaaggaatagctggtgtt

SEQ ID NO: 2894 - DNA, 23 bp, Artificial Sequence
  Synthetic Construct
acccggctatacgagaactcttt

SEQ ID NO: 2895 - DNA, 25 bp, Artificial Sequence
  Synthetic Construct
gttcatgaaagtgaaagagccatga

SEQ ID NO: 2896 - DNA, 23 bp, Artificial Sequence
  Synthetic Construct
gggacaaaatcggctccttcaga

SEQ ID NO: 2897 - DNA, 20 bp, Artificial Sequence
  Synthetic Construct
atgccctgaatcgcccttgt

SEQ ID NO: 2898 - DNA, 21 bp, Artificial Sequence
  Synthetic Construct
cccacacctcttgccaaggaa

SEQ ID NO: 2899 - DNA, 20 bp, Artificial Sequence
  Synthetic Construct
gcccatgggtaaggcaggaa

SEQ ID NO: 2900 - DNA, 19 bp, Artificial Sequence
  Synthetic Construct
actggccggtggtcctgtt

SEQ ID NO: 2901 - DNA, 22 bp, Artificial Sequence
  Synthetic Construct
cgctgtcctggaagtgttgttc

SEQ ID NO: 2902 - DNA, 21 bp, Artificial Sequence
  Synthetic Construct
tggcccacagaaagggtctca

SEQ ID NO: 2903 - DNA, 24 bp, Artificial Sequence
  Synthetic Construct
tctctggttaacagatgccagatg

SEQ ID NO: 2904 - DNA, 22 bp, Artificial Sequence
  Synthetic Construct
cccaaaaggctctgaggtcatc

SEQ ID NO: 2905 - DNA, 21 bp, Artificial Sequence
  Synthetic Construct
ggacatgactccctgggacaa

SEQ ID NO: 2906 - DNA, 20 bp, Artificial Sequence
  Synthetic Construct
tgtcttagctgcgcctctgt

SEQ ID NO: 2907 - DNA, 19 bp, Artificial Sequence
  Synthetic Construct
gccaagggcaggtgggata

SEQ ID NO: 2908 - DNA, 25 bp, Artificial Sequence
  Synthetic Construct
cctttccaactccatcatctggtta

SEQ ID NO: 2909 - DNA, 25 bp, Artificial Sequence
  Synthetic Construct
cctgcctgataccttcttgatgact

SEQ ID NO: 2910 - DNA, 22 bp, Artificial Sequence
  Synthetic Construct
ggcctaaaggccaaggagtgaa

SEQ ID NO: 2911 - DNA, 20 bp, Artificial Sequence
  Synthetic Construct
cactgcttagcgacctgtgt

SEQ ID NO: 2912 - DNA, 20 bp, Artificial Sequence
  Synthetic Construct
tggtcagcgtgaagctctgt

SEQ ID NO: 2913 - DNA, 20 bp, Artificial Sequence
  Synthetic Construct
aggctccacaggaggtcatt

SEQ ID NO: 2914 - DNA, 25 bp, Artificial Sequence
  Synthetic Construct
tgtgaaagaaagggcagacattgta

SEQ ID NO: 2915 - DNA, 22 bp, Artificial Sequence
  Synthetic Construct
ccagtgtgggatctcaggcatt

SEQ ID NO: 2916 - DNA, 25 bp, Artificial Sequence
  Synthetic Construct
gaatttactctgaccaccacaccta

SEQ ID NO: 2917 - DNA, 19 bp, Artificial Sequence
  Synthetic Construct
tgctgtgtgcagggactgt

SEQ ID NO: 2918 - DNA, 22 bp, Artificial Sequence
  Synthetic Construct
tcaggtgacaggtggggtaaca

SEQ ID NO: 2919 - DNA, 20 bp, Artificial Sequence
  Synthetic Construct
gaaaccaactgccggagact

SEQ ID NO: 2920 - DNA, 20 bp, Artificial Sequence
  Synthetic Construct
aaggaagtggccgcagtatg

SEQ ID NO: 2921 - DNA, 19 bp, Artificial Sequence
  Synthetic Construct
agcgctgggccatgtcatt

SEQ ID NO: 2922 - DNA, 27 bp, Artificial Sequence
  Synthetic Construct
ggttagttccctttattgccccaagat

SEQ ID NO: 2923 - DNA, 23 bp, Artificial Sequence
  Synthetic Construct
gtgtgcagttggtaaaggcaaag

SEQ ID NO: 2924 - DNA, 24 bp, Artificial Sequence
  Synthetic Construct
gtgattttccagcacctcccacta

SEQ ID NO: 2925 - DNA, 27 bp, Artificial Sequence
  Synthetic Construct
gggaaaccctgtaataactcactctgt

SEQ ID NO: 2926 - DNA, 23 bp, Artificial Sequence
  Synthetic Construct
gtcagtgcttttcatggcatctt

SEQ ID NO: 2927 - DNA, 24 bp, Artificial Sequence
  Synthetic Construct
aaattactccatggtgggaagtgt

SEQ ID NO: 2928 - DNA, 22 bp, Artificial Sequence
  Synthetic Construct
gcctgattgaacccctacaaca

SEQ ID NO: 2929 - DNA, 19 bp, Artificial Sequence
  Synthetic Construct
cggcgtccaggagacagtt

SEQ ID NO: 2930 - DNA, 23 bp, Artificial Sequence
  Synthetic Construct
ccagggtctttccaagagcattc

SEQ ID NO: 2931 - DNA, 25 bp, Artificial Sequence
  Synthetic Construct
gtttctcaggataagcagctcaaac

SEQ ID NO: 2932 - DNA, 20 bp, Artificial Sequence
  Synthetic Construct
tgaccaggcagagggctgat

SEQ ID NO: 2933 - DNA, 21 bp, Artificial Sequence
  Synthetic Construct
ttggccacccagagcagtcat

SEQ ID NO: 2934 - DNA, 21 bp, Artificial Sequence
  Synthetic Construct
gcagtgatgcgatgtgagtct

SEQ ID NO: 2935 - DNA, 27 bp, Artificial Sequence
  Synthetic Construct
gaaacctaaggatatcaaagggctgat

SEQ ID NO: 2936 - DNA, 22 bp, Artificial Sequence
  Synthetic Construct
caggcccaataggcccatttac

SEQ ID NO: 2937 - DNA, 22 bp, Artificial Sequence
  Synthetic Construct
ctgggtcagctcaagtggattg

SEQ ID NO: 2938 - DNA, 20 bp, Artificial Sequence
  Synthetic Construct
tgtgccgctgtgtgacattc

SEQ ID NO: 2939 - DNA, 22 bp, Artificial Sequence
  Synthetic Construct
gcccaggcatccaatccctaag

SEQ ID NO: 2940 - DNA, 23 bp, Artificial Sequence
  Synthetic Construct
tgatgtgcctctcttgttccaat

SEQ ID NO: 2941 - DNA, 21 bp, Artificial Sequence
  Synthetic Construct
aggaactctggggagatgcaa

SEQ ID NO: 2942 - DNA, 22 bp, Artificial Sequence
  Synthetic Construct
cgttgctgcaatcaaggtgttg

SEQ ID NO: 2943 - DNA, 25 bp, Artificial Sequence
  Synthetic Construct
gacacctcctctatcctgtggaatg

SEQ ID NO: 2944 - DNA, 25 bp, Artificial Sequence
  Synthetic Construct
aaaggtaatgtccattcggctagat

SEQ ID NO: 2945 - DNA, 29 bp, Artificial Sequence
  Synthetic Construct
cggagaaaattggttttcctatcggtgtt

SEQ ID NO: 2946 - DNA, 20 bp, Artificial Sequence
  Synthetic Construct
gcactaaacgccagggtgat

SEQ ID NO: 2947 - DNA, 21 bp, Artificial Sequence
  Synthetic Construct
aaaggggacctgccaccttca

SEQ ID NO: 2948 - DNA, 22 bp, Artificial Sequence
  Synthetic Construct
tggtgtcagcctcgttccttct

SEQ ID NO: 2949 - DNA, 20 bp, Artificial Sequence
  Synthetic Construct
caccacacaggtgcatcaca

SEQ ID NO: 2950 - DNA, 22 bp, Artificial Sequence
  Synthetic Construct
cccattgccaaaagcaaactgt

SEQ ID NO: 2951 - DNA, 20 bp, Artificial Sequence
  Synthetic Construct
agggccacagcagaggagat

SEQ ID NO: 2952 - DNA, 23 bp, Artificial Sequence
  Synthetic Construct
ctgcgtttgtgttcaggctaaag

SEQ ID NO: 2953 - DNA, 21 bp, Artificial Sequence
  Synthetic Construct
atgttcccaggccctgctctt

SEQ ID NO: 2954 - DNA, 20 bp, Artificial Sequence
  Synthetic Construct
cacgcggaactagcaaccta

SEQ ID NO: 2955 - DNA, 21 bp, Artificial Sequence
  Synthetic Construct
atgtgctgcctaccccacttg

SEQ ID NO: 2956 - DNA, 18 bp, Artificial Sequence
  Synthetic Construct
tgggtgcaccaggagtgt

SEQ ID NO: 2957 - DNA, 25 bp, Artificial Sequence
  Synthetic Construct
ctcagggactaagtgtctctgacaa

SEQ ID NO: 2958 - DNA, 28 bp, Artificial Sequence
  Synthetic Construct
cctaaatacagggagtgggatgtagaag

SEQ ID NO: 2959 - DNA, 23 bp, Artificial Sequence
  Synthetic Construct
gcttcctccaccccgtgattaag

SEQ ID NO: 2960 - DNA, 22 bp, Artificial Sequence
  Synthetic Construct
ggagaacctccgaccacagaaa

SEQ ID NO: 2961 - DNA, 20 bp, Artificial Sequence
  Synthetic Construct
agtccccagggaggcagctt

SEQ ID NO: 2962 - DNA, 18 bp, Artificial Sequence
  Synthetic Construct
accccagagcctgctgtt

SEQ ID NO: 2963 - DNA, 23 bp, Artificial Sequence
  Synthetic Construct
ctcgagctgaacacttgtgtgat

SEQ ID NO: 2964 - DNA, 19 bp, Artificial Sequence
  Synthetic Construct
tggaagggacgcccgcaat

SEQ ID NO: 2965 - DNA, 22 bp, Artificial Sequence
  Synthetic Construct
atttggcctggaggggctgagt

SEQ ID NO: 2966 - DNA, 22 bp, Artificial Sequence
  Synthetic Construct
gaagtcagtggtcagagcatca

SEQ ID NO: 2967 - DNA, 22 bp, Artificial Sequence
  Synthetic Construct
caccgtgtctctaagggtcagt

SEQ ID NO: 2968 - DNA, 24 bp, Artificial Sequence
  Synthetic Construct
ggagccacagaattagcacagtca

SEQ ID NO: 2969 - DNA, 24 bp, Artificial Sequence
  Synthetic Construct
cagatttggctggcatttcagaag

SEQ ID NO: 2970 - DNA, 24 bp, Artificial Sequence
  Synthetic Construct
cctgtctgcttttgtgtcaacagt

SEQ ID NO: 2971 - DNA, 20 bp, Artificial Sequence
  Synthetic Construct
agagaggtgagacggtgcaa

SEQ ID NO: 2972 - DNA, 21 bp, Artificial Sequence
  Synthetic Construct
cgacaggggagcaggagagat

SEQ ID NO: 2973 - DNA, 24 bp, Artificial Sequence
  Synthetic Construct
gctggatggtctaggatggcttca

SEQ ID NO: 2974 - DNA, 22 bp, Artificial Sequence
  Synthetic Construct
ccaacttcagcacatgcacttc

SEQ ID NO: 2975 - DNA, 20 bp, Artificial Sequence
  Synthetic Construct
gcacgcacctcttgcaaatc

SEQ ID NO: 2976 - DNA, 26 bp, Artificial Sequence
  Synthetic Construct
cacaccttttctcaggtacaccttca

SEQ ID NO: 2977 - DNA, 19 bp, Artificial Sequence
  Synthetic Construct
tggcgtctgcactcactca

SEQ ID NO: 2978 - DNA, 20 bp, Artificial Sequence
  Synthetic Construct
gctatgaggcagtgcgtgtt

SEQ ID NO: 2979 - DNA, 20 bp, Artificial Sequence
  Synthetic Construct
agatggggcagcagcattca

SEQ ID NO: 2980 - DNA, 24 bp, Artificial Sequence
  Synthetic Construct
ctcatgacctttgcatttgctgat

SEQ ID NO: 2981 - DNA, 20 bp, Artificial Sequence
  Synthetic Construct
tgcctcccactcttggtgtt

SEQ ID NO: 2982 - DNA, 22 bp, Artificial Sequence
  Synthetic Construct
ggcttctgcacccctaagtttg

SEQ ID NO: 2983 - DNA, 20 bp, Artificial Sequence
  Synthetic Construct
cttgctgtgccccttccaat

SEQ ID NO: 2984 - DNA, 22 bp, Artificial Sequence
  Synthetic Construct
agtacaggccacaggggatgaa

SEQ ID NO: 2985 - DNA, 23 bp, Artificial Sequence
  Synthetic Construct
aaaagccacaaagatgggtcaag

SEQ ID NO: 2986 - DNA, 22 bp, Artificial Sequence
  Synthetic Construct
gcagccctgaattggaagttct

SEQ ID NO: 2987 - DNA, 21 bp, Artificial Sequence
  Synthetic Construct
cccattcccacagagcaggaa

SEQ ID NO: 2988 - DNA, 22 bp, Artificial Sequence
  Synthetic Construct
cccacaggagcaggtgttttag

SEQ ID NO: 2989 - DNA, 24 bp, Artificial Sequence
  Synthetic Construct
cagtaaatggtgaggccacagttg

SEQ ID NO: 2990 - DNA, 20 bp, Artificial Sequence
  Synthetic Construct
accaaccagtggacccagat

SEQ ID NO: 2991 - DNA, 30 bp, Artificial Sequence
  Synthetic Construct
ctccagttcactaaggaacatgaaatgctt

SEQ ID NO: 2992 - DNA, 23 bp, Artificial Sequence
  Synthetic Construct
ggtccttccatgtccctcagtct

SEQ ID NO: 2993 - DNA, 20 bp, Artificial Sequence
  Synthetic Construct
tcctgtggctgaaggacaga

SEQ ID NO: 2994 - DNA, 20 bp, Artificial Sequence
  Synthetic Construct
aactgagcgaggggctttgt

SEQ ID NO: 2995 - DNA, 19 bp, Artificial Sequence
  Synthetic Construct
ggagccacaggggatggaa

SEQ ID NO: 2996 - DNA, 20 bp, Artificial Sequence
  Synthetic Construct
tccagcaggctgaggcattg

SEQ ID NO: 2997 - DNA, 20 bp, Artificial Sequence
  Synthetic Construct
tcctggtccgggagaacgat

SEQ ID NO: 2998 - DNA, 20 bp, Artificial Sequence
  Synthetic Construct
agggaagcctgcatgtctct

SEQ ID NO: 2999 - DNA, 22 bp, Artificial Sequence
  Synthetic Construct
gtctggaacccgcacaacttac

SEQ ID NO: 3000 - DNA, 23 bp, Artificial Sequence
  Synthetic Construct
tgggtttttccaccatagcaaga

SEQ ID NO: 3001 - DNA, 19 bp, Artificial Sequence
  Synthetic Construct
ggaccgcacggtgtcttct

SEQ ID NO: 3002 - DNA, 20 bp, Artificial Sequence
  Synthetic Construct
ggtgggtcccttgtgagcat

SEQ ID NO: 3003 - DNA, 24 bp, Artificial Sequence
  Synthetic Construct
cacctcgttcatatccaggtgagt

SEQ ID NO: 3004 - DNA, 20 bp, Artificial Sequence
  Synthetic Construct
tggaactgcaccagcacaga

SEQ ID NO: 3005 - DNA, 19 bp, Artificial Sequence
  Synthetic Construct
gtaccctccagcccaggaa

SEQ ID NO: 3006 - DNA, 20 bp, Artificial Sequence
  Synthetic Construct
aggaggggctcagcatggat

SEQ ID NO: 3007 - DNA, 19 bp, Artificial Sequence
  Synthetic Construct
tggacgtgcagacctcaca

SEQ ID NO: 3008 - DNA, 24 bp, Artificial Sequence
  Synthetic Construct
tcaaggaaatgcagtggtatgtgt

SEQ ID NO: 3009 - DNA, 25 bp, Artificial Sequence
  Synthetic Construct
gggcagtgggtaagaagaacccatt

SEQ ID NO: 3010 - DNA, 20 bp, Artificial Sequence
  Synthetic Construct
taggccacggagccacttta

SEQ ID NO: 3011 - DNA, 24 bp, Artificial Sequence
  Synthetic Construct
cgcttctgtttaatgccttagcaa

SEQ ID NO: 3012 - DNA, 25 bp, Artificial Sequence
  Synthetic Construct
gggcgagtttcagaacaagggaaag

SEQ ID NO: 3013 - DNA, 24 bp, Artificial Sequence
  Synthetic Construct
ctgtatctgtgggcttttccttca

SEQ ID NO: 3014 - DNA, 23 bp, Artificial Sequence
  Synthetic Construct
tctatcccatggaagggcaaaag

SEQ ID NO: 3015 - DNA, 25 bp, Artificial Sequence
  Synthetic Construct
tcaaaacagagtctcactgtcactt

SEQ ID NO: 3016 - DNA, 20 bp, Artificial Sequence
  Synthetic Construct
ggccctctctgggcactttg

SEQ ID NO: 3017 - DNA, 21 bp, Artificial Sequence
  Synthetic Construct
cctcatattgctccgccacaa

SEQ ID NO: 3018 - DNA, 20 bp, Artificial Sequence
  Synthetic Construct
ccttgttctccggcgatgtt

SEQ ID NO: 3019 - DNA, 27 bp, Artificial Sequence
  Synthetic Construct
ctgatgtgtaccccgaaatcattgaac

SEQ ID NO: 3020 - DNA, 25 bp, Artificial Sequence
  Synthetic Construct
ggctcctccatttccttccacctaa

SEQ ID NO: 3021 - DNA, 26 bp, Artificial Sequence
  Synthetic Construct
cacatcagaaacgtttgggctgatac

SEQ ID NO: 3022 - DNA, 21 bp, Artificial Sequence
  Synthetic Construct
tcgggccagcccagatttact

SEQ ID NO: 3023 - DNA, 25 bp, Artificial Sequence
  Synthetic Construct
caagaatttccctgtctggaaccaa

SEQ ID NO: 3024 - DNA, 22 bp, Artificial Sequence
  Synthetic Construct
ggccagcccagagtagtaacaa

SEQ ID NO: 3025 - DNA, 22 bp, Artificial Sequence
  Synthetic Construct
gacagagggctaaggtcagcaa

SEQ ID NO: 3026 - DNA, 21 bp, Artificial Sequence
  Synthetic Construct
cagccatcaccacagaagtca

SEQ ID NO: 3027 - DNA, 20 bp, Artificial Sequence
  Synthetic Construct
tgccaggtgctggagaaaga

SEQ ID NO: 3028 - DNA, 25 bp, Artificial Sequence
  Synthetic Construct
agcatacccttagctctacttcaca

SEQ ID NO: 3029 - DNA, 24 bp, Artificial Sequence
  Synthetic Construct
cctttgttgttgctcttccagttc

SEQ ID NO: 3030 - DNA, 20 bp, Artificial Sequence
  Synthetic Construct
cagtttccccagccttgctt

SEQ ID NO: 3031 - DNA, 20 bp, Artificial Sequence
  Synthetic Construct
ttcactgaggggcagggaat

SEQ ID NO: 3032 - DNA, 28 bp, Artificial Sequence
  Synthetic Construct
ggccaacttggtgtaaaaatcccttgaa

SEQ ID NO: 3033 - DNA, 24 bp, Artificial Sequence
  Synthetic Construct
gagttaccagtgaggtgtggaaac

SEQ ID NO: 3034 - DNA, 20 bp, Artificial Sequence
  Synthetic Construct
cgcctccacggcttgattga

SEQ ID NO: 3035 - DNA, 29 bp, Artificial Sequence
  Synthetic Construct
ggcaccaacactaaaaatcaacccgaaga

SEQ ID NO: 3036 - DNA, 22 bp, Artificial Sequence
  Synthetic Construct
tgctttcttgggcatgggaata

SEQ ID NO: 3037 - DNA, 22 bp, Artificial Sequence
  Synthetic Construct
aagcctgagggcaggagacttg

SEQ ID NO: 3038 - DNA, 24 bp, Artificial Sequence
  Synthetic Construct
gcagaatagccagcagttttgaag

SEQ ID NO: 3039 - DNA, 23 bp, Artificial Sequence
  Synthetic Construct
gcagctacttgcaaggtctgagt

SEQ ID NO: 3040 - DNA, 24 bp, Artificial Sequence
  Synthetic Construct
cctccattctggatgccacttttg

SEQ ID NO: 3041 - DNA, 23 bp, Artificial Sequence
  Synthetic Construct
gcacttcaccaagctctgtctca

SEQ ID NO: 3042 - DNA, 24 bp, Artificial Sequence
  Synthetic Construct
ggcgtggaaggatgtctaacaagt

SEQ ID NO: 3043 - DNA, 20 bp, Artificial Sequence
  Synthetic Construct
ccaaatgggcaggtgggaaa

SEQ ID NO: 3044 - DNA, 20 bp, Artificial Sequence
  Synthetic Construct
actcctgggctcaagcaatc

SEQ ID NO: 3045 - DNA, 21 bp, Artificial Sequence
  Synthetic Construct
ctgcattgtcagtccctctgt

SEQ ID NO: 3046 - DNA, 24 bp, Artificial Sequence
  Synthetic Construct
gcagaagttatagcagggatgaca

SEQ ID NO: 3047 - DNA, 23 bp, Artificial Sequence
  Synthetic Construct
ccagcaacctttttggagtgttt

SEQ ID NO: 3048 - DNA, 23 bp, Artificial Sequence
  Synthetic Construct
aacagcttgatgtcttccctgaa

SEQ ID NO: 3049 - DNA, 25 bp, Artificial Sequence
  Synthetic Construct
ggacagaacaatatcctggtgagaa

SEQ ID NO: 3050 - DNA, 24 bp, Artificial Sequence
  Synthetic Construct
ccaccagagcaggtcttctacaac

SEQ ID NO: 3051 - DNA, 25 bp, Artificial Sequence
  Synthetic Construct
ccaaatgtgaggatcaacccaggaa

SEQ ID NO: 3052 - DNA, 24 bp, Artificial Sequence
  Synthetic Construct
ggagctaaggccagaaggtagttc

SEQ ID NO: 3053 - DNA, 20 bp, Artificial Sequence
  Synthetic Construct
acagagtgggctggcacata

SEQ ID NO: 3054 - DNA, 20 bp, Artificial Sequence
  Synthetic Construct
gtgtgttcagggcgacaaca

SEQ ID NO: 3055 - DNA, 20 bp, Artificial Sequence
  Synthetic Construct
gccgcccctctcttttctca

SEQ ID NO: 3056 - DNA, 20 bp, Artificial Sequence
  Synthetic Construct
gaatggggctgcactgcata

SEQ ID NO: 3057 - DNA, 24 bp, Artificial Sequence
  Synthetic Construct
ttcaccacactagtaaggcaaagt

SEQ ID NO: 3058 - DNA, 27 bp, Artificial Sequence
  Synthetic Construct
gtgagaatccattggaaatctgagcat

SEQ ID NO: 3059 - DNA, 26 bp, Artificial Sequence
  Synthetic Construct
gggccctgaataaccaatagcgatac

SEQ ID NO: 3060 - DNA, 21 bp, Artificial Sequence
  Synthetic Construct
gccaggagaggaaggccattt

SEQ ID NO: 3061 - DNA, 20 bp, Artificial Sequence
  Synthetic Construct
caaagctgcccttggtctgt

SEQ ID NO: 3062 - DNA, 27 bp, Artificial Sequence
  Synthetic Construct
ggccttaaagaggacatcgagagaaag

SEQ ID NO: 3063 - DNA, 21 bp, Artificial Sequence
  Synthetic Construct
tatggctccaccctgcctaac

SEQ ID NO: 3064 - DNA, 22 bp, Artificial Sequence
  Synthetic Construct
gggtggtgaggtttggtggaaa

SEQ ID NO: 3065 - DNA, 24 bp, Artificial Sequence
  Synthetic Construct
ggagacaaacagaccaagcgaaca

SEQ ID NO: 3066 - DNA, 22 bp, Artificial Sequence
  Synthetic Construct
gctctctcactgggatggacta

SEQ ID NO: 3067 - DNA, 27 bp, Artificial Sequence
  Synthetic Construct
acaacctaggaagaattagggcttttc

SEQ ID NO: 3068 - DNA, 21 bp, Artificial Sequence
  Synthetic Construct
cctaccccaggacagaagcat

SEQ ID NO: 3069 - DNA, 25 bp, Artificial Sequence
  Synthetic Construct
gtcaaggataggcaagagacgaagt

SEQ ID NO: 3070 - DNA, 21 bp, Artificial Sequence
  Synthetic Construct
ctgaagcaagctgggtgaagt

SEQ ID NO: 3071 - DNA, 24 bp, Artificial Sequence
  Synthetic Construct
ggtccccaaattctctgccagttg

SEQ ID NO: 3072 - DNA, 23 bp, Artificial Sequence
  Synthetic Construct
ccggaaagaatcggcctccttag

SEQ ID NO: 3073 - DNA, 25 bp, Artificial Sequence
  Synthetic Construct
gaaaaagagctgaacaaacggaaac

SEQ ID NO: 3074 - DNA, 20 bp, Artificial Sequence
  Synthetic Construct
tgctgctccagccataggtt

SEQ ID NO: 3075 - DNA, 20 bp, Artificial Sequence
  Synthetic Construct
aacaccctgggaggcatagt

SEQ ID NO: 3076 - DNA, 22 bp, Artificial Sequence
  Synthetic Construct
ggccctccaaactcatggaagt

SEQ ID NO: 3077 - DNA, 24 bp, Artificial Sequence
  Synthetic Construct
gctctcacaaaggaggttcaaaga

SEQ ID NO: 3078 - DNA, 25 bp, Artificial Sequence
  Synthetic Construct
catgcctatctcccttagtcctact

SEQ ID NO: 3079 - DNA, 21 bp, Artificial Sequence
  Synthetic Construct
agtcagctcaggggtgacctt

SEQ ID NO: 3080 - DNA, 21 bp, Artificial Sequence
  Synthetic Construct
ccacagcactgactgccatct

SEQ ID NO: 3081 - DNA, 24 bp, Artificial Sequence
  Synthetic Construct
acatgctgaaagccaaaacctcta

SEQ ID NO: 3082 - DNA, 24 bp, Artificial Sequence
  Synthetic Construct
cagaatagcacagagtgtcacaga

SEQ ID NO: 3083 - DNA, 22 bp, Artificial Sequence
  Synthetic Construct
ccacatcctgccataggagcta

SEQ ID NO: 3084 - DNA, 20 bp, Artificial Sequence
  Synthetic Construct
tagggcaaagagcgcctagt

SEQ ID NO: 3085 - DNA, 27 bp, Artificial Sequence
  Synthetic Construct
ggaattctgtaagctaagaagccaagt

SEQ ID NO: 3086 - DNA, 20 bp, Artificial Sequence
  Synthetic Construct
gctcccaaccccagaacact

SEQ ID NO: 3087 - DNA, 22 bp, Artificial Sequence
  Synthetic Construct
ggcattccagcagtgaccatag

SEQ ID NO: 3088 - DNA, 23 bp, Artificial Sequence
  Synthetic Construct
ccatgggcacaatccaagcctat

SEQ ID NO: 3089 - DNA, 19 bp, Artificial Sequence
  Synthetic Construct
ggggccctttctggaggta

SEQ ID NO: 3090 - DNA, 19 bp, Artificial Sequence
  Synthetic Construct
aacggcaggtgagcagtct

SEQ ID NO: 3091 - DNA, 25 bp, Artificial Sequence
  Synthetic Construct
gtggttgctttcaccctacttcttc

SEQ ID NO: 3092 - DNA, 21 bp, Artificial Sequence
  Synthetic Construct
gactcctggcttggaacagaa

SEQ ID NO: 3093 - DNA, 27 bp, Artificial Sequence
  Synthetic Construct
gcaaagatgacataagcaaaggcttga

SEQ ID NO: 3094 - DNA, 25 bp, Artificial Sequence
  Synthetic Construct
ggagtatcactttagcactggagtt

SEQ ID NO: 3095 - DNA, 20 bp, Artificial Sequence
  Synthetic Construct
aggatcggtcaggccagtgt

SEQ ID NO: 3096 - DNA, 18 bp, Artificial Sequence
  Synthetic Construct
tccaagccaccgccatca

SEQ ID NO: 3097 - DNA, 26 bp, Artificial Sequence
  Synthetic Construct
cctccactctaccaaagcttataaca

SEQ ID NO: 3098 - DNA, 21 bp, Artificial Sequence
  Synthetic Construct
tacgctgaccaccctgacact

SEQ ID NO: 3099 - DNA, 23 bp, Artificial Sequence
  Synthetic Construct
gtgggtactactctgtgcaggaa

SEQ ID NO: 3100 - DNA, 25 bp, Artificial Sequence
  Synthetic Construct
tgaggcatttgagtcaaggtgatac

SEQ ID NO: 3101 - DNA, 20 bp, Artificial Sequence
  Synthetic Construct
tgcctgggttaaggcgcata

SEQ ID NO: 3102 - DNA, 29 bp, Artificial Sequence
  Synthetic Construct
gggaaccttactgatcactagtacaaaac

SEQ ID NO: 3103 - DNA, 22 bp, Artificial Sequence
  Synthetic Construct
ctcctgacacatgcccagtaaa

SEQ ID NO: 3104 - DNA, 19 bp, Artificial Sequence
  Synthetic Construct
agtgtggggccacctggaa

SEQ ID NO: 3105 - DNA, 21 bp, Artificial Sequence
  Synthetic Construct
atgtccggtcggaggtacagt

SEQ ID NO: 3106 - DNA, 23 bp, Artificial Sequence
  Synthetic Construct
aatactgccctccccggactaca

SEQ ID NO: 3107 - DNA, 22 bp, Artificial Sequence
  Synthetic Construct
cactgcagcaaaggctttcaac

SEQ ID NO: 3108 - DNA, 23 bp, Artificial Sequence
  Synthetic Construct
ctcagctctgtgcctggataatg

SEQ ID NO: 3109 - DNA, 25 bp, Artificial Sequence
  Synthetic Construct
ctgatgaattgctggggtggttaag

SEQ ID NO: 3110 - DNA, 26 bp, Artificial Sequence
  Synthetic Construct
ggtttaggtcctccatagtgagcata

SEQ ID NO: 3111 - DNA, 25 bp, Artificial Sequence
  Synthetic Construct
cgggttctttcttgacaggggatct

SEQ ID NO: 3112 - DNA, 20 bp, Artificial Sequence
  Synthetic Construct
aggcttcccctggtgactgt

SEQ ID NO: 3113 - DNA, 20 bp, Artificial Sequence
  Synthetic Construct
agagctggcaggctcaagta

SEQ ID NO: 3114 - DNA, 20 bp, Artificial Sequence
  Synthetic Construct
ctggggcctgcagtttgatt

SEQ ID NO: 3115 - DNA, 22 bp, Artificial Sequence
  Synthetic Construct
gcagcctgaatcttggcagaca

SEQ ID NO: 3116 - DNA, 30 bp, Artificial Sequence
  Synthetic Construct
gagctgtccactaaccattaattaggtcat

SEQ ID NO: 3117 - DNA, 21 bp, Artificial Sequence
  Synthetic Construct
tctcaccttagcctcccaagt

SEQ ID NO: 3118 - DNA, 21 bp, Artificial Sequence
  Synthetic Construct
tggctgccctccttccatgat

SEQ ID NO: 3119 - DNA, 25 bp, Artificial Sequence
  Synthetic Construct
cccaggagtgtatcttggtcctaca

SEQ ID NO: 3120 - DNA, 23 bp, Artificial Sequence
  Synthetic Construct
gcggattttgaagccagagatga

SEQ ID NO: 3121 - DNA, 23 bp, Artificial Sequence
  Synthetic Construct
ccatatgagctctccctgtgcta

SEQ ID NO: 3122 - DNA, 20 bp, Artificial Sequence
  Synthetic Construct
gcgtggtgcagatggtgttt

SEQ ID NO: 3123 - DNA, 20 bp, Artificial Sequence
  Synthetic Construct
tggtctcctggaagctcctt

SEQ ID NO: 3124 - DNA, 24 bp, Artificial Sequence
  Synthetic Construct
tgtaaaacagggaagatgcactca

SEQ ID NO: 3125 - DNA, 25 bp, Artificial Sequence
  Synthetic Construct
cctcctgtgaggatcaaagttcaag

SEQ ID NO: 3126 - DNA, 20 bp, Artificial Sequence
  Synthetic Construct
ggaaaatccgccaccagcat

SEQ ID NO: 3127 - DNA, 22 bp, Artificial Sequence
  Synthetic Construct
agcagtcagtcagttccagcta

SEQ ID NO: 3128 - DNA, 23 bp, Artificial Sequence
  Synthetic Construct
cctcaatgattaccggggctttc

SEQ ID NO: 3129 - DNA, 20 bp, Artificial Sequence
  Synthetic Construct
ggctctcttggccacaggtt

SEQ ID NO: 3130 - DNA, 23 bp, Artificial Sequence
  Synthetic Construct
cacgcccagaatcaaagccaaag

SEQ ID NO: 3131 - DNA, 24 bp, Artificial Sequence
  Synthetic Construct
cctcttagctgtccctcttgtttc

SEQ ID NO: 3132 - DNA, 20 bp, Artificial Sequence
  Synthetic Construct
acacaccccacagcttcttc

SEQ ID NO: 3133 - DNA, 21 bp, Artificial Sequence
  Synthetic Construct
ggctggagggcaaatctgtgt

SEQ ID NO: 3134 - DNA, 24 bp, Artificial Sequence
  Synthetic Construct
gccatcacagaggggttacaggtt

SEQ ID NO: 3135 - DNA, 27 bp, Artificial Sequence
  Synthetic Construct
tcactaagtataaggcctagcctacaa

SEQ ID NO: 3136 - DNA, 25 bp, Artificial Sequence
  Synthetic Construct
gggtccaatgtgaaaagcacagagt

SEQ ID NO: 3137 - DNA, 22 bp, Artificial Sequence
  Synthetic Construct
caaggccataaggccaatgagt

SEQ ID NO: 3138 - DNA, 21 bp, Artificial Sequence
  Synthetic Construct
cctgaggtgaggggtgctagt

SEQ ID NO: 3139 - DNA, 25 bp, Artificial Sequence
  Synthetic Construct
ggcatgctcttcagggagaagttag

SEQ ID NO: 3140 - DNA, 22 bp, Artificial Sequence
  Synthetic Construct
tgtccccagcaccagtaagttc

SEQ ID NO: 3141 - DNA, 24 bp, Artificial Sequence
  Synthetic Construct
gcgggaattggacacagactggta

SEQ ID NO: 3142 - DNA, 27 bp, Artificial Sequence
  Synthetic Construct
ggcttcttcaactccaagtccaggata

SEQ ID NO: 3143 - DNA, 22 bp, Artificial Sequence
  Synthetic Construct
gggctccattgtgttcctcaac

SEQ ID NO: 3144 - DNA, 23 bp, Artificial Sequence
  Synthetic Construct
ggttctgagggagcaaacctctt

SEQ ID NO: 3145 - DNA, 25 bp, Artificial Sequence
  Synthetic Construct
accctcttaattgctttggggtttt

SEQ ID NO: 3146 - DNA, 24 bp, Artificial Sequence
  Synthetic Construct
cgtggagaggtattttggcagtgt

SEQ ID NO: 3147 - DNA, 27 bp, Artificial Sequence
  Synthetic Construct
ggctgatttctgctgtccttcaagcta

SEQ ID NO: 3148 - DNA, 23 bp, Artificial Sequence
  Synthetic Construct
cagttgcctgcatcttgatctgt

SEQ ID NO: 3149 - DNA, 24 bp, Artificial Sequence
  Synthetic Construct
gcactggtggaagagacagcaaag

SEQ ID NO: 3150 - DNA, 20 bp, Artificial Sequence
  Synthetic Construct
acccatgacagccgactctt

SEQ ID NO: 3151 - DNA, 24 bp, Artificial Sequence
  Synthetic Construct
ccttagaaggcctctcttctctgt

SEQ ID NO: 3152 - DNA, 23 bp, Artificial Sequence
  Synthetic Construct
cggtctgaacggaaactgccata

SEQ ID NO: 3153 - DNA, 21 bp, Artificial Sequence
  Synthetic Construct
accctggtctgccttgccttt

SEQ ID NO: 3154 - DNA, 22 bp, Artificial Sequence
  Synthetic Construct
gctcaatcgaggcaggactaac

SEQ ID NO: 3155 - DNA, 22 bp, Artificial Sequence
  Synthetic Construct
ggagttggcccagaacttccat

SEQ ID NO: 3156 - DNA, 23 bp, Artificial Sequence
  Synthetic Construct
ctaagggcttggagaagagcaaa

SEQ ID NO: 3157 - DNA, 21 bp, Artificial Sequence
  Synthetic Construct
agccaaccaggacccagaagt

SEQ ID NO: 3158 - DNA, 23 bp, Artificial Sequence
  Synthetic Construct
agacacatttgcatgcctaccat

SEQ ID NO: 3159 - DNA, 30 bp, Artificial Sequence
  Synthetic Construct
cactccattaaagccatttgggaatagaag

SEQ ID NO: 3160 - DNA, 24 bp, Artificial Sequence
  Synthetic Construct
gcagccaaaagggcttgttaaatg

SEQ ID NO: 3161 - DNA, 22 bp, Artificial Sequence
  Synthetic Construct
tgggtaccagttaagccacagt

SEQ ID NO: 3162 - DNA, 24 bp, Artificial Sequence
  Synthetic Construct
agagggacttatgtgcagtgaatg

SEQ ID NO: 3163 - DNA, 23 bp, Artificial Sequence
  Synthetic Construct
gctggttttctcacaagcctaga

SEQ ID NO: 3164 - DNA, 21 bp, Artificial Sequence
  Synthetic Construct
agactgcctgctgtttcatca

SEQ ID NO: 3165 - DNA, 21 bp, Artificial Sequence
  Synthetic Construct
gcaggggctgtaaagggtgta

SEQ ID NO: 3166 - DNA, 23 bp, Artificial Sequence
  Synthetic Construct
ctgggtcttctatggccttgttg

SEQ ID NO: 3167 - DNA, 22 bp, Artificial Sequence
  Synthetic Construct
ggtgcctcacttcatagtgtca

SEQ ID NO: 3168 - DNA, 23 bp, Artificial Sequence
  Synthetic Construct
agatggagggcagatttcagaag

SEQ ID NO: 3169 - DNA, 23 bp, Artificial Sequence
  Synthetic Construct
cacacagagcctgggcttatatc

SEQ ID NO: 3170 - DNA, 25 bp, Artificial Sequence
  Synthetic Construct
gcctgggatctctgaagaacagttg

SEQ ID NO: 3171 - DNA, 25 bp, Artificial Sequence
  Synthetic Construct
ccctttgtaaagcatggccctatac

SEQ ID NO: 3172 - DNA, 25 bp, Artificial Sequence
  Synthetic Construct
ttctcatacacaggtgatagcaaca

SEQ ID NO: 3173 - DNA, 21 bp, Artificial Sequence
  Synthetic Construct
cctctttgcccttgggtggaa

SEQ ID NO: 3174 - DNA, 19 bp, Artificial Sequence
  Synthetic Construct
gttgttggccaggcaccat

SEQ ID NO: 3175 - DNA, 21 bp, Artificial Sequence
  Synthetic Construct
ccctggctactgcccatgttt

SEQ ID NO: 3176 - DNA, 22 bp, Artificial Sequence
  Synthetic Construct
gccttgctgtcagctccaatgt

SEQ ID NO: 3177 - DNA, 22 bp, Artificial Sequence
  Synthetic Construct
catctttgtggggctggagttc

SEQ ID NO: 3178 - DNA, 20 bp, Artificial Sequence
  Synthetic Construct
gagcccacatcccgtgaaca

SEQ ID NO: 3179 - DNA, 20 bp, Artificial Sequence
  Synthetic Construct
gaatgtgtccgccagtctgt

SEQ ID NO: 3180 - DNA, 23 bp, Artificial Sequence
  Synthetic Construct
cctggaagccagctagaaaccat

SEQ ID NO: 3181 - DNA, 22 bp, Artificial Sequence
  Synthetic Construct
ggagaggaagacagtggcatct

SEQ ID NO: 3182 - DNA, 22 bp, Artificial Sequence
  Synthetic Construct
gggtgaatgccggtagttgtga

SEQ ID NO: 3183 - DNA, 20 bp, Artificial Sequence
  Synthetic Construct
agccgggcgtacttcctttt

SEQ ID NO: 3184 - DNA, 22 bp, Artificial Sequence
  Synthetic Construct
gctgtatgtctgcaggtcaagt

SEQ ID NO: 3185 - DNA, 24 bp, Artificial Sequence
  Synthetic Construct
tcctcacatgagagtttcctgttc

SEQ ID NO: 3186 - DNA, 22 bp, Artificial Sequence
  Synthetic Construct
ctccagcatctggaaggagaca

SEQ ID NO: 3187 - DNA, 20 bp, Artificial Sequence
  Synthetic Construct
cgggaggcttgcctgagaaa

SEQ ID NO: 3188 - DNA, 20 bp, Artificial Sequence
  Synthetic Construct
tagccagctcccacacacaa

SEQ ID NO: 3189 - DNA, 21 bp, Artificial Sequence
  Synthetic Construct
tgggcgtagcacaagaaatca

SEQ ID NO: 3190 - DNA, 22 bp, Artificial Sequence
  Synthetic Construct
tgggttgctctttgctgttcaa

SEQ ID NO: 3191 - DNA, 24 bp, Artificial Sequence
  Synthetic Construct
gtggcaaacaactctgaggctaac

SEQ ID NO: 3192 - DNA, 24 bp, Artificial Sequence
  Synthetic Construct
gggaagaatgctgtgtcctcacaa

SEQ ID NO: 3193 - DNA, 20 bp, Artificial Sequence
  Synthetic Construct
atttcctgccgtgccacctt

SEQ ID NO: 3194 - DNA, 20 bp, Artificial Sequence
  Synthetic Construct
cacagaaagctggggcaaca

SEQ ID NO: 3195 - DNA, 23 bp, Artificial Sequence
  Synthetic Construct
ccagtacatgctttcccaacaca

SEQ ID NO: 3196 - DNA, 27 bp, Artificial Sequence
  Synthetic Construct
cctttttaaaggagtggatgcagaagt

SEQ ID NO: 3197 - DNA, 23 bp, Artificial Sequence
  Synthetic Construct
gagccccaaatgtacactagcaa

SEQ ID NO: 3198 - DNA, 27 bp, Artificial Sequence
  Synthetic Construct
gcccagtgcttttcttaattgctttga

SEQ ID NO: 3199 - DNA, 23 bp, Artificial Sequence
  Synthetic Construct
ccactggactactggactacact

SEQ ID NO: 3200 - DNA, 24 bp, Artificial Sequence
  Synthetic Construct
caatagccagggtctgaattgcat

SEQ ID NO: 3201 - DNA, 23 bp, Artificial Sequence
  Synthetic Construct
gagtgcagaagaatgggttctga

SEQ ID NO: 3202 - DNA, 20 bp, Artificial Sequence
  Synthetic Construct
aagccctaaacccgcgttac

SEQ ID NO: 3203 - DNA, 25 bp, Artificial Sequence
  Synthetic Construct
agcagaaatcacacaatggcaatac

SEQ ID NO: 3204 - DNA, 20 bp, Artificial Sequence
  Synthetic Construct
tgccttcactgcctggtgat

SEQ ID NO: 3205 - DNA, 20 bp, Artificial Sequence
  Synthetic Construct
accctccccgccatcaagta

SEQ ID NO: 3206 - DNA, 27 bp, Artificial Sequence
  Synthetic Construct
cgtctttctccagtttctgagccctat

SEQ ID NO: 3207 - DNA, 25 bp, Artificial Sequence
  Synthetic Construct
ggtcagctgtgtcaataaggactga

SEQ ID NO: 3208 - DNA, 20 bp, Artificial Sequence
  Synthetic Construct
ggaagcaggtgtcagtgtga

SEQ ID NO: 3209 - DNA, 24 bp, Artificial Sequence
  Synthetic Construct
ggtctgcttctggagtctgcagtt

SEQ ID NO: 3210 - DNA, 25 bp, Artificial Sequence
  Synthetic Construct
cacactcggttcctgtttcaggatt

SEQ ID NO: 3211 - DNA, 25 bp, Artificial Sequence
  Synthetic Construct
acacccatcccaaagggattaaaag

SEQ ID NO: 3212 - DNA, 22 bp, Artificial Sequence
  Synthetic Construct
cctgtctcccttgccagatcaa

SEQ ID NO: 3213 - DNA, 23 bp, Artificial Sequence
  Synthetic Construct
aggcttccctgagcagagatatt

SEQ ID NO: 3214 - DNA, 20 bp, Artificial Sequence
  Synthetic Construct
tctctggctccagcgtctga

SEQ ID NO: 3215 - DNA, 19 bp, Artificial Sequence
  Synthetic Construct
agggatatggccggcttct

SEQ ID NO: 3216 - DNA, 20 bp, Artificial Sequence
  Synthetic Construct
gtggtggtggttgtgctact

SEQ ID NO: 3217 - DNA, 24 bp, Artificial Sequence
  Synthetic Construct
ccttccttttcactaagcctgtct

SEQ ID NO: 3218 - DNA, 24 bp, Artificial Sequence
  Synthetic Construct
gagagattggaaggggagagattg

SEQ ID NO: 3219 - DNA, 26 bp, Artificial Sequence
  Synthetic Construct
ggtggagtaaaaacagcactggacta

SEQ ID NO: 3220 - DNA, 25 bp, Artificial Sequence
  Synthetic Construct
ccttcagggcagtgagttctcttct

SEQ ID NO: 3221 - DNA, 22 bp, Artificial Sequence
  Synthetic Construct
tccaggaaaaggaactgcaaca

SEQ ID NO: 3222 - DNA, 26 bp, Artificial Sequence
  Synthetic Construct
cgcatgtgtaccttaatgatgtcaac

SEQ ID NO: 3223 - DNA, 21 bp, Artificial Sequence
  Synthetic Construct
ccctgaatgttccaccagctt

SEQ ID NO: 3224 - DNA, 23 bp, Artificial Sequence
  Synthetic Construct
gcctccagagctagggatggtta

SEQ ID NO: 3225 - DNA, 19 bp, Artificial Sequence
  Synthetic Construct
tggaggggaccgggttcta

SEQ ID NO: 3226 - DNA, 24 bp, Artificial Sequence
  Synthetic Construct
cctggatttgtctcctgtcacttc

SEQ ID NO: 3227 - DNA, 24 bp, Artificial Sequence
  Synthetic Construct
ggggacacgtcttactgtagtctt

SEQ ID NO: 3228 - DNA, 22 bp, Artificial Sequence
  Synthetic Construct
tcagcaggaaaagcacttgact

SEQ ID NO: 3229 - DNA, 24 bp, Artificial Sequence
  Synthetic Construct
gtttccttccttgtttgcagagtt

SEQ ID NO: 3230 - DNA, 27 bp, Artificial Sequence
  Synthetic Construct
ccataccagacacaaactacagtcaca

SEQ ID NO: 3231 - DNA, 28 bp, Artificial Sequence
  Synthetic Construct
cctgactttctagttcaactcagccttt

SEQ ID NO: 3232 - DNA, 22 bp, Artificial Sequence
  Synthetic Construct
gttgatgctctggctactgcta

SEQ ID NO: 3233 - DNA, 24 bp, Artificial Sequence
  Synthetic Construct
caagggctattcaggactcacaaa

SEQ ID NO: 3234 - DNA, 25 bp, Artificial Sequence
  Synthetic Construct
cactgcataccagcaaatgagttgt

SEQ ID NO: 3235 - DNA, 20 bp, Artificial Sequence
  Synthetic Construct
actgcatggcagagcagctt

SEQ ID NO: 3236 - DNA, 21 bp, Artificial Sequence
  Synthetic Construct
gcagagctcctcaaagggaaa

SEQ ID NO: 3237 - DNA, 25 bp, Artificial Sequence
  Synthetic Construct
ccaccactaccatcatcactatgaa

SEQ ID NO: 3238 - DNA, 22 bp, Artificial Sequence
  Synthetic Construct
gtgagtgaatgggtgggaggta

SEQ ID NO: 3239 - DNA, 25 bp, Artificial Sequence
  Synthetic Construct
catgtgctctagcaagacaatcaaa

SEQ ID NO: 3240 - DNA, 24 bp, Artificial Sequence
  Synthetic Construct
ggagaccacaatgcacaggtctac

SEQ ID NO: 3241 - DNA, 22 bp, Artificial Sequence
  Synthetic Construct
agctctgtaggagggcaaggat

SEQ ID NO: 3242 - DNA, 20 bp, Artificial Sequence
  Synthetic Construct
tccatggctctggctgctat

SEQ ID NO: 3243 - DNA, 22 bp, Artificial Sequence
  Synthetic Construct
ccgtgactagtgcttcgtgctt

SEQ ID NO: 3244 - DNA, 22 bp, Artificial Sequence
  Synthetic Construct
ggaccaatggctggaagaccaa

SEQ ID NO: 3245 - DNA, 24 bp, Artificial Sequence
  Synthetic Construct
cagaagtgtggtggggttacttac

SEQ ID NO: 3246 - DNA, 21 bp, Artificial Sequence
  Synthetic Construct
ggctgttgcagaagcatcact

SEQ ID NO: 3247 - DNA, 21 bp, Artificial Sequence
  Synthetic Construct
ccaaacctgctcctccaccat

SEQ ID NO: 3248 - DNA, 20 bp, Artificial Sequence
  Synthetic Construct
gcccaggtctcgtctccatt

SEQ ID NO: 3249 - DNA, 21 bp, Artificial Sequence
  Synthetic Construct
tgagccttgcagtggggtaac

SEQ ID NO: 3250 - DNA, 30 bp, Artificial Sequence
  Synthetic Construct
gcatagctctttgtagaaacttgaccctta

SEQ ID NO: 3251 - DNA, 22 bp, Artificial Sequence
  Synthetic Construct
ccacagtgaagcctggagaaca

SEQ ID NO: 3252 - DNA, 20 bp, Artificial Sequence
  Synthetic Construct
ggacatgggcgaggcaattt

SEQ ID NO: 3253 - DNA, 23 bp, Artificial Sequence
  Synthetic Construct
atcccagggaggagaggtgacat

SEQ ID NO: 3254 - DNA, 22 bp, Artificial Sequence
  Synthetic Construct
cgctggcccttctagtgaatgt

SEQ ID NO: 3255 - DNA, 24 bp, Artificial Sequence
  Synthetic Construct
ctgcaattccccaacaatctctgt

SEQ ID NO: 3256 - DNA, 20 bp, Artificial Sequence
  Synthetic Construct
ggctgtcctccctgcctaaa

SEQ ID NO: 3257 - DNA, 21 bp, Artificial Sequence
  Synthetic Construct
gctgtggggtttgagggctat

SEQ ID NO: 3258 - DNA, 23 bp, Artificial Sequence
  Synthetic Construct
ccctgagagtggtagctactgaa

SEQ ID NO: 3259 - DNA, 25 bp, Artificial Sequence
  Synthetic Construct
gccagatcaaatcattccaggtgaa

SEQ ID NO: 3260 - DNA, 24 bp, Artificial Sequence
  Synthetic Construct
cacagaagggcagataaagcaaaa

SEQ ID NO: 3261 - DNA, 23 bp, Artificial Sequence
  Synthetic Construct
gccatgtggatttccaggtcact

SEQ ID NO: 3262 - DNA, 24 bp, Artificial Sequence
  Synthetic Construct
cgctgtagctgaagcactgtccta

SEQ ID NO: 3263 - DNA, 22 bp, Artificial Sequence
  Synthetic Construct
ctgctgattcaggaccacagaa

SEQ ID NO: 3264 - DNA, 22 bp, Artificial Sequence
  Synthetic Construct
agcacagggcaacagaagtaac

SEQ ID NO: 3265 - DNA, 25 bp, Artificial Sequence
  Synthetic Construct
gggcccaacatctagttctgctaca

SEQ ID NO: 3266 - DNA, 25 bp, Artificial Sequence
  Synthetic Construct
gagaaagcaggtactgaccttttca

SEQ ID NO: 3267 - DNA, 23 bp, Artificial Sequence
  Synthetic Construct
ccagtctccatctggaggaccaa

SEQ ID NO: 3268 - DNA, 28 bp, Artificial Sequence
  Synthetic Construct
ggcaagcccatcatagattttagtgaca

SEQ ID NO: 3269 - DNA, 22 bp, Artificial Sequence
  Synthetic Construct
ccccacctctttctgggatttg

SEQ ID NO: 3270 - DNA, 22 bp, Artificial Sequence
  Synthetic Construct
agtggctgaacagaccgtctac

SEQ ID NO: 3271 - DNA, 24 bp, Artificial Sequence
  Synthetic Construct
cagcctagtgagggtgtaagacta

SEQ ID NO: 3272 - DNA, 19 bp, Artificial Sequence
  Synthetic Construct
gggtgtggggcgtagtgaa

SEQ ID NO: 3273 - DNA, 19 bp, Artificial Sequence
  Synthetic Construct
gcagaggcaccaccacact

SEQ ID NO: 3274 - DNA, 22 bp, Artificial Sequence
  Synthetic Construct
cctgcatacggagaggtcaaag

SEQ ID NO: 3275 - DNA, 22 bp, Artificial Sequence
  Synthetic Construct
gcgccatctttttgaggcatag

SEQ ID NO: 3276 - DNA, 26 bp, Artificial Sequence
  Synthetic Construct
ggaaggttctgacagacaatggaact

SEQ ID NO: 3277 - DNA, 20 bp, Artificial Sequence
  Synthetic Construct
catcttccacgcctgagctt

SEQ ID NO: 3278 - DNA, 21 bp, Artificial Sequence
  Synthetic Construct
gctcatgggcagggttcactt

SEQ ID NO: 3279 - DNA, 20 bp, Artificial Sequence
  Synthetic Construct
gcagaagcactgtccagact

SEQ ID NO: 3280 - DNA, 26 bp, Artificial Sequence
  Synthetic Construct
ccttctatcagtagcaaggagacagt

SEQ ID NO: 3281 - DNA, 20 bp, Artificial Sequence
  Synthetic Construct
agcgggttggactcactgtt

SEQ ID NO: 3282 - DNA, 23 bp, Artificial Sequence
  Synthetic Construct
ggctaactgagccctggtgaatg

SEQ ID NO: 3283 - DNA, 22 bp, Artificial Sequence
  Synthetic Construct
ctggagacgtacatgccagtca

SEQ ID NO: 3284 - DNA, 22 bp, Artificial Sequence
  Synthetic Construct
ccgcccatctctcctgtttgtt

SEQ ID NO: 3285 - DNA, 21 bp, Artificial Sequence
  Synthetic Construct
ggggaacagctggaaaagcat

SEQ ID NO: 3286 - DNA, 21 bp, Artificial Sequence
  Synthetic Construct
agtctggcctgtggtgtctgt

SEQ ID NO: 3287 - DNA, 22 bp, Artificial Sequence
  Synthetic Construct
agggaccccatcacccatttac

SEQ ID NO: 3288 - DNA, 30 bp, Artificial Sequence
  Synthetic Construct
ggaactacaatagacataaactggctgtca

SEQ ID NO: 3289 - DNA, 24 bp, Artificial Sequence
  Synthetic Construct
tgttttagcagcacgagatgaact

SEQ ID NO: 3290 - DNA, 22 bp, Artificial Sequence
  Synthetic Construct
aggcaaatggcaggagggaatg

SEQ ID NO: 3291 - DNA, 24 bp, Artificial Sequence
  Synthetic Construct
gagattacaggagcatgccacttc

SEQ ID NO: 3292 - DNA, 22 bp, Artificial Sequence
  Synthetic Construct
tgctttcgagaaaagccacact

SEQ ID NO: 3293 - DNA, 23 bp, Artificial Sequence
  Synthetic Construct
gcagcggctatagacagatccaa

SEQ ID NO: 3294 - DNA, 20 bp, Artificial Sequence
  Synthetic Construct
gcactgcctctgcctcaaaa

SEQ ID NO: 3295 - DNA, 23 bp, Artificial Sequence
  Synthetic Construct
taccaccagggctgatccagaga

SEQ ID NO: 3296 - DNA, 22 bp, Artificial Sequence
  Synthetic Construct
gtggtctgcagtcacatcttga

SEQ ID NO: 3297 - DNA, 23 bp, Artificial Sequence
  Synthetic Construct
gtccatcagccagatgtggagtt

SEQ ID NO: 3298 - DNA, 22 bp, Artificial Sequence
  Synthetic Construct
gggtctgtcgcctgacttaaca

SEQ ID NO: 3299 - DNA, 21 bp, Artificial Sequence
  Synthetic Construct
agaggtcagggtgaagcacta

SEQ ID NO: 3300 - DNA, 27 bp, Artificial Sequence
  Synthetic Construct
ggaaaaagtggaggcactgattcattc

SEQ ID NO: 3301 - DNA, 26 bp, Artificial Sequence
  Synthetic Construct
agagaatagtacctcccatgggtaaa

SEQ ID NO: 3302 - DNA, 20 bp, Artificial Sequence
  Synthetic Construct
gcagagccaggcctcaaaac

SEQ ID NO: 3303 - DNA, 19 bp, Artificial Sequence
  Synthetic Construct
tgagtcctgccgcttcaca

SEQ ID NO: 3304 - DNA, 22 bp, Artificial Sequence
  Synthetic Construct
gtgggaagcgggttaggaagat

SEQ ID NO: 3305 - DNA, 22 bp, Artificial Sequence
  Synthetic Construct
ggagccagacttcttggtcctt

SEQ ID NO: 3306 - DNA, 21 bp, Artificial Sequence
  Synthetic Construct
gcgttgtggtgctttcctttc

SEQ ID NO: 3307 - DNA, 25 bp, Artificial Sequence
  Synthetic Construct
aattttcagaggaaagggaggaaca

SEQ ID NO: 3308 - DNA, 21 bp, Artificial Sequence
  Synthetic Construct
gcaccacataggtgacagcaa

SEQ ID NO: 3309 - DNA, 18 bp, Artificial Sequence
  Synthetic Construct
agtgcacgtccgccgtaa

SEQ ID NO: 3310 - DNA, 24 bp, Artificial Sequence
  Synthetic Construct
tcctcaggttgttaggcattttga

SEQ ID NO: 3311 - DNA, 21 bp, Artificial Sequence
  Synthetic Construct
ggcactggggaagacgaagaa

SEQ ID NO: 3312 - DNA, 21 bp, Artificial Sequence
  Synthetic Construct
tcctgcttgcctctggggaat

SEQ ID NO: 3313 - DNA, 20 bp, Artificial Sequence
  Synthetic Construct
accctggtgggatccagaaa

SEQ ID NO: 3314 - DNA, 23 bp, Artificial Sequence
  Synthetic Construct
cgagcccctatccagaaagaaaa

SEQ ID NO: 3315 - DNA, 23 bp, Artificial Sequence
  Synthetic Construct
gctcaaatcaccttcctgcaagt

SEQ ID NO: 3316 - DNA, 27 bp, Artificial Sequence
  Synthetic Construct
ggtacttttacttttgccgtaggtagt

SEQ ID NO: 3317 - DNA, 22 bp, Artificial Sequence
  Synthetic Construct
gggctgttacctcatcctcttg

SEQ ID NO: 3318 - DNA, 22 bp, Artificial Sequence
  Synthetic Construct
catcatgcccaagtagcgttca

SEQ ID NO: 3319 - DNA, 24 bp, Artificial Sequence
  Synthetic Construct
gggatttttgagcccctgaaattg

SEQ ID NO: 3320 - DNA, 20 bp, Artificial Sequence
  Synthetic Construct
acaccggcgacttctccaat

SEQ ID NO: 3321 - DNA, 22 bp, Artificial Sequence
  Synthetic Construct
tggcctcaggcaacactctgta

SEQ ID NO: 3322 - DNA, 28 bp, Artificial Sequence
  Synthetic Construct
ctcaaggctaaagtaactccttggaaag

SEQ ID NO: 3323 - DNA, 20 bp, Artificial Sequence
  Synthetic Construct
agtctgcagagacccgtgta

SEQ ID NO: 3324 - DNA, 22 bp, Artificial Sequence
  Synthetic Construct
tgctgggtaggtgtgtggtaca

SEQ ID NO: 3325 - DNA, 20 bp, Artificial Sequence
  Synthetic Construct
aacacaggcctggctctcaa

SEQ ID NO: 3326 - DNA, 20 bp, Artificial Sequence
  Synthetic Construct
ggaaagggagggaggtgctt

SEQ ID NO: 3327 - DNA, 22 bp, Artificial Sequence
  Synthetic Construct
gctctcctggctctgtgaggat

SEQ ID NO: 3328 - DNA, 22 bp, Artificial Sequence
  Synthetic Construct
acaacctagtgccaggggaagt

SEQ ID NO: 3329 - DNA, 21 bp, Artificial Sequence
  Synthetic Construct
acaagccccacagggtagact

SEQ ID NO: 3330 - DNA, 24 bp, Artificial Sequence
  Synthetic Construct
gaaccagtttcctttctcctggaa

SEQ ID NO: 3331 - DNA, 18 bp, Artificial Sequence
  Synthetic Construct
ggaagccactcgctgcat

SEQ ID NO: 3332 - DNA, 18 bp, Artificial Sequence
  Synthetic Construct
tgggtgcctcggatgctt

SEQ ID NO: 3333 - DNA, 23 bp, Artificial Sequence
  Synthetic Construct
gctcattaatgcacgcagacaca

SEQ ID NO: 3334 - DNA, 28 bp, Artificial Sequence
  Synthetic Construct
ggtggtacagaatacaatggctgtgatg

SEQ ID NO: 3335 - DNA, 22 bp, Artificial Sequence
  Synthetic Construct
tctggtagcaggagggagaaag

SEQ ID NO: 3336 - DNA, 26 bp, Artificial Sequence
  Synthetic Construct
ggatgtgttcatccgtctcttcacta

SEQ ID NO: 3337 - DNA, 20 bp, Artificial Sequence
  Synthetic Construct
agacatgggtccctctgctt

SEQ ID NO: 3338 - DNA, 28 bp, Artificial Sequence
  Synthetic Construct
cctggtacctgatatgatgttagctgta

SEQ ID NO: 3339 - DNA, 21 bp, Artificial Sequence
  Synthetic Construct
ggtccacccatagccctctga

SEQ ID NO: 3340 - DNA, 25 bp, Artificial Sequence
  Synthetic Construct
ggtaggcatttttcgatggcagaga

SEQ ID NO: 3341 - DNA, 20 bp, Artificial Sequence
  Synthetic Construct
agtagaggcagggtcacaca

SEQ ID NO: 3342 - DNA, 23 bp, Artificial Sequence
  Synthetic Construct
actaaggaagcctcttgggttct

SEQ ID NO: 3343 - DNA, 24 bp, Artificial Sequence
  Synthetic Construct
ctcttccctgaagacaaccaactt

SEQ ID NO: 3344 - DNA, 23 bp, Artificial Sequence
  Synthetic Construct
ccttccaggttgatggtcgcatt

SEQ ID NO: 3345 - DNA, 20 bp, Artificial Sequence
  Synthetic Construct
cactgcccagatggcagaag

SEQ ID NO: 3346 - DNA, 22 bp, Artificial Sequence
  Synthetic Construct
cgtggctgcatctgatcctttc

SEQ ID NO: 3347 - DNA, 20 bp, Artificial Sequence
  Synthetic Construct
tgtgagaggccgttgggaaa

SEQ ID NO: 3348 - DNA, 26 bp, Artificial Sequence
  Synthetic Construct
ggaaatgtttgactcatgccctgatg

SEQ ID NO: 3349 - DNA, 20 bp, Artificial Sequence
  Synthetic Construct
agtcagccagatgcccagaa

SEQ ID NO: 3350 - DNA, 20 bp, Artificial Sequence
  Synthetic Construct
agctcaggactgcgttcttc

SEQ ID NO: 3351 - DNA, 24 bp, Artificial Sequence
  Synthetic Construct
ccatgtacccaggagaggtgatga

SEQ ID NO: 3352 - DNA, 20 bp, Artificial Sequence
  Synthetic Construct
tgtgtgctgcagtggagctt

SEQ ID NO: 3353 - DNA, 25 bp, Artificial Sequence
  Synthetic Construct
ggcgtaacattagggtaccttctct

SEQ ID NO: 3354 - DNA, 24 bp, Artificial Sequence
  Synthetic Construct
gggtctgggagagggataacttca

SEQ ID NO: 3355 - DNA, 23 bp, Artificial Sequence
  Synthetic Construct
gtggtaactgcacgaggacaaag

SEQ ID NO: 3356 - DNA, 21 bp, Artificial Sequence
  Synthetic Construct
ggagcctcttggttcctgtgt

SEQ ID NO: 3357 - DNA, 21 bp, Artificial Sequence
  Synthetic Construct
aagacctctcgcaggccgatt

SEQ ID NO: 3358 - DNA, 20 bp, Artificial Sequence
  Synthetic Construct
agtgaaggccctctcctgaa

SEQ ID NO: 3359 - DNA, 24 bp, Artificial Sequence
  Synthetic Construct
cctcgattcagtctggggacattc

SEQ ID NO: 3360 - DNA, 22 bp, Artificial Sequence
  Synthetic Construct
tcactttccacctctcgaggaa

SEQ ID NO: 3361 - DNA, 22 bp, Artificial Sequence
  Synthetic Construct
aggtgaagcagagcaggacttc

SEQ ID NO: 3362 - DNA, 23 bp, Artificial Sequence
  Synthetic Construct
gcctcctcatctcatgggtttca

SEQ ID NO: 3363 - DNA, 21 bp, Artificial Sequence
  Synthetic Construct
aacccctttggtcttgcacat

SEQ ID NO: 3364 - DNA, 26 bp, Artificial Sequence
  Synthetic Construct
gctgctatggtggtatcagggagttc

SEQ ID NO: 3365 - DNA, 22 bp, Artificial Sequence
  Synthetic Construct
gcaggagcaggtttagctgaca

SEQ ID NO: 3366 - DNA, 20 bp, Artificial Sequence
  Synthetic Construct
ctcacacttgggcactgctt

SEQ ID NO: 3367 - DNA, 21 bp, Artificial Sequence
  Synthetic Construct
gctccccagtgatgggctttt

SEQ ID NO: 3368 - DNA, 27 bp, Artificial Sequence
  Synthetic Construct
cctctgtctacacagtgaacagcattg

SEQ ID NO: 3369 - DNA, 21 bp, Artificial Sequence
  Synthetic Construct
agcacccctgagcatgtggat

SEQ ID NO: 3370 - DNA, 21 bp, Artificial Sequence
  Synthetic Construct
cgatgcaggccatgacagaca

SEQ ID NO: 3371 - DNA, 23 bp, Artificial Sequence
  Synthetic Construct
ataatcagcctgcctcaaacaga

SEQ ID NO: 3372 - DNA, 23 bp, Artificial Sequence
  Synthetic Construct
gctgccaagagaaatgggacact

SEQ ID NO: 3373 - DNA, 22 bp, Artificial Sequence
  Synthetic Construct
gccatctcaaactcggccaatg

SEQ ID NO: 3374 - DNA, 22 bp, Artificial Sequence
  Synthetic Construct
gcagcttgcatgctttggaaca

SEQ ID NO: 3375 - DNA, 25 bp, Artificial Sequence
  Synthetic Construct
gtgaatggaaggtgcatgtaagaag

SEQ ID NO: 3376 - DNA, 25 bp, Artificial Sequence
  Synthetic Construct
ggggagaaacataatgctgggtctt

SEQ ID NO: 3377 - DNA, 22 bp, Artificial Sequence
  Synthetic Construct
gacagaccaagcctggagatca

SEQ ID NO: 3378 - DNA, 26 bp, Artificial Sequence
  Synthetic Construct
gcttcactaacaccagggtaggtatc

SEQ ID NO: 3379 - DNA, 22 bp, Artificial Sequence
  Synthetic Construct
gctggaactgggatttcagcaa

SEQ ID NO: 3380 - DNA, 24 bp, Artificial Sequence
  Synthetic Construct
gtccataacaggaccttagagcaa

SEQ ID NO: 3381 - DNA, 22 bp, Artificial Sequence
  Synthetic Construct
gctcttgggagtaggtggaaac

SEQ ID NO: 3382 - DNA, 24 bp, Artificial Sequence
  Synthetic Construct
ggttttgggacctagaagcagtca

SEQ ID NO: 3383 - DNA, 23 bp, Artificial Sequence
  Synthetic Construct
gggatagcaggtctctgttccaa

SEQ ID NO: 3384 - DNA, 23 bp, Artificial Sequence
  Synthetic Construct
ctcttctggagctctacccaact

SEQ ID NO: 3385 - DNA, 23 bp, Artificial Sequence
  Synthetic Construct
ccctttttccctgaagagctgaa

SEQ ID NO: 3386 - DNA, 24 bp, Artificial Sequence
  Synthetic Construct
ggactggtgaggaaggtgtaggaa

SEQ ID NO: 3387 - DNA, 22 bp, Artificial Sequence
  Synthetic Construct
gcaaaactccgggatcctcaac

SEQ ID NO: 3388 - DNA, 21 bp, Artificial Sequence
  Synthetic Construct
ttccctcccaggcaaggagtt

SEQ ID NO: 3389 - DNA, 18 bp, Artificial Sequence
  Synthetic Construct
tgcccaggtggagggttt

SEQ ID NO: 3390 - DNA, 22 bp, Artificial Sequence
  Synthetic Construct
aatcagccccaaagcaaagaac

SEQ ID NO: 3391 - DNA, 21 bp, Artificial Sequence
  Synthetic Construct
ccaaagtcgggagaagccaaa

SEQ ID NO: 3392 - DNA, 20 bp, Artificial Sequence
  Synthetic Construct
cctcaacacagcagccaaga

SEQ ID NO: 3393 - DNA, 23 bp, Artificial Sequence
  Synthetic Construct
cccacttcggtacaagtcagaca

SEQ ID NO: 3394 - DNA, 21 bp, Artificial Sequence
  Synthetic Construct
gccagtgtcactcccaagtca

SEQ ID NO: 3395 - DNA, 20 bp, Artificial Sequence
  Synthetic Construct
gggtagacagcagccgtaca

SEQ ID NO: 3396 - DNA, 21 bp, Artificial Sequence
  Synthetic Construct
cccctcctctgcagggttcta

SEQ ID NO: 3397 - DNA, 22 bp, Artificial Sequence
  Synthetic Construct
agggtcagttgggagtagaaca

SEQ ID NO: 3398 - DNA, 24 bp, Artificial Sequence
  Synthetic Construct
tgttcccacctctttatcctcctt

SEQ ID NO: 3399 - DNA, 18 bp, Artificial Sequence
  Synthetic Construct
tcagcgggctgtgtgtct

SEQ ID NO: 3400 - DNA, 19 bp, Artificial Sequence
  Synthetic Construct
ggagggctgcagctgaact

SEQ ID NO: 3401 - DNA, 19 bp, Artificial Sequence
  Synthetic Construct
acagccacagggcacttct

SEQ ID NO: 3402 - DNA, 22 bp, Artificial Sequence
  Synthetic Construct
gcagaagcttaggacggcattc

SEQ ID NO: 3403 - DNA, 26 bp, Artificial Sequence
  Synthetic Construct
gcctttccacctttgtctgaggagat

SEQ ID NO: 3404 - DNA, 22 bp, Artificial Sequence
  Synthetic Construct
gggcaggaatgcatgggcataa

SEQ ID NO: 3405 - DNA, 25 bp, Artificial Sequence
  Synthetic Construct
aaaactgcaaggagcctattgttac

SEQ ID NO: 3406 - DNA, 20 bp, Artificial Sequence
  Synthetic Construct
gcaaacagctgggcaagaga

SEQ ID NO: 3407 - DNA, 20 bp, Artificial Sequence
  Synthetic Construct
tccaggagcaggaggaggta

SEQ ID NO: 3408 - DNA, 21 bp, Artificial Sequence
  Synthetic Construct
ttgaatggccccagtgatgtt

SEQ ID NO: 3409 - DNA, 23 bp, Artificial Sequence
  Synthetic Construct
gaggctcagaaagatgcactgat

SEQ ID NO: 3410 - DNA, 21 bp, Artificial Sequence
  Synthetic Construct
aaggtgtggggagagcagtca

SEQ ID NO: 3411 - DNA, 20 bp, Artificial Sequence
  Synthetic Construct
gccttcgtggctagggttgt

SEQ ID NO: 3412 - DNA, 22 bp, Artificial Sequence
  Synthetic Construct
ggacggatgcaccaaacgtgat

SEQ ID NO: 3413 - DNA, 25 bp, Artificial Sequence
  Synthetic Construct
ccaatcagccatttggtgaatagtt

SEQ ID NO: 3414 - DNA, 22 bp, Artificial Sequence
  Synthetic Construct
cacaaaagcgcctctggtgaag

SEQ ID NO: 3415 - DNA, 19 bp, Artificial Sequence
  Synthetic Construct
taacgctgtggcggactca

SEQ ID NO: 3416 - DNA, 25 bp, Artificial Sequence
  Synthetic Construct
tttctacctgtgtcatttggacctt

SEQ ID NO: 3417 - DNA, 23 bp, Artificial Sequence
  Synthetic Construct
accatgacacttttcctgaccat

SEQ ID NO: 3418 - DNA, 22 bp, Artificial Sequence
  Synthetic Construct
gcatctccactccaagttcctt

SEQ ID NO: 3419 - DNA, 24 bp, Artificial Sequence
  Synthetic Construct
gttagaaaacctctgtgccagtga

SEQ ID NO: 3420 - DNA, 25 bp, Artificial Sequence
  Synthetic Construct
acgtatattttggtggggttgatgt

SEQ ID NO: 3421 - DNA, 20 bp, Artificial Sequence
  Synthetic Construct
cccggagtgttccccagttt

SEQ ID NO: 3422 - DNA, 21 bp, Artificial Sequence
  Synthetic Construct
aggctagtcccaggacaggaa

SEQ ID NO: 3423 - DNA, 21 bp, Artificial Sequence
  Synthetic Construct
agtgctaccggctcctgaact

SEQ ID NO: 3424 - DNA, 22 bp, Artificial Sequence
  Synthetic Construct
gggccactgtgattgcagactt

SEQ ID NO: 3425 - DNA, 20 bp, Artificial Sequence
  Synthetic Construct
cccaggcagctggtcctcta

SEQ ID NO: 3426 - DNA, 20 bp, Artificial Sequence
  Synthetic Construct
aactgatggcccctccaagt

SEQ ID NO: 3427 - DNA, 18 bp, Artificial Sequence
  Synthetic Construct
tgcccaccagtgccatgt

SEQ ID NO: 3428 - DNA, 19 bp, Artificial Sequence
  Synthetic Construct
aggatggcgagggctggaa

SEQ ID NO: 3429 - DNA, 23 bp, Artificial Sequence
  Synthetic Construct
ttggttcccagctactacagaga

SEQ ID NO: 3430 - DNA, 24 bp, Artificial Sequence
  Synthetic Construct
ggagcctggttttccatgccattc

SEQ ID NO: 3431 - DNA, 26 bp, Artificial Sequence
  Synthetic Construct
cagaagaaaacaatgcaggggttatg

SEQ ID NO: 3432 - DNA, 28 bp, Artificial Sequence
  Synthetic Construct
ccagctaccaaactcatttacagacaga

SEQ ID NO: 3433 - DNA, 20 bp, Artificial Sequence
  Synthetic Construct
tgacttctggtgccctggtt

SEQ ID NO: 3434 - DNA, 21 bp, Artificial Sequence
  Synthetic Construct
tgcaggggacccaacctttca

SEQ ID NO: 3435 - DNA, 21 bp, Artificial Sequence
  Synthetic Construct
tgcctaagcagaggcagtttg

SEQ ID NO: 3436 - DNA, 25 bp, Artificial Sequence
  Synthetic Construct
tccaatgtcagttggggtaactaaa

SEQ ID NO: 3437 - DNA, 27 bp, Artificial Sequence
  Synthetic Construct
gtccatttccacttattccagcatttg

SEQ ID NO: 3438 - DNA, 22 bp, Artificial Sequence
  Synthetic Construct
ccattgagagcaagggcaggta

SEQ ID NO: 3439 - DNA, 25 bp, Artificial Sequence
  Synthetic Construct
tgacatgtgtgtttatgagggagaa

SEQ ID NO: 3440 - DNA, 19 bp, Artificial Sequence
  Synthetic Construct
ttcggtgggagggctgtca

SEQ ID NO: 3441 - DNA, 26 bp, Artificial Sequence
  Synthetic Construct
cctgattccttgctcctcatccatag

SEQ ID NO: 3442 - DNA, 27 bp, Artificial Sequence
  Synthetic Construct
tgctgcttattgtctagaagctgtatc

SEQ ID NO: 3443 - DNA, 21 bp, Artificial Sequence
  Synthetic Construct
acatccctgcctcccacaagt

SEQ ID NO: 3444 - DNA, 20 bp, Artificial Sequence
  Synthetic Construct
tgctcctgcacggtcacaat

SEQ ID NO: 3445 - DNA, 23 bp, Artificial Sequence
  Synthetic Construct
gtgatcatttgcccttggctaca

SEQ ID NO: 3446 - DNA, 27 bp, Artificial Sequence
  Synthetic Construct
ctgacaatgattatggattggggtgtt

SEQ ID NO: 3447 - DNA, 25 bp, Artificial Sequence
  Synthetic Construct
ccctagaggttcatgggtacagaca

SEQ ID NO: 3448 - DNA, 19 bp, Artificial Sequence
  Synthetic Construct
acaatggagccggcactga

SEQ ID NO: 3449 - DNA, 27 bp, Artificial Sequence
  Synthetic Construct
gcttgtgggtttgactgaagagacttt

SEQ ID NO: 3450 - DNA, 20 bp, Artificial Sequence
  Synthetic Construct
ggccctggaagtcaggaaag

SEQ ID NO: 3451 - DNA, 21 bp, Artificial Sequence
  Synthetic Construct
ccagccttggttgtcctggtt

SEQ ID NO: 3452 - DNA, 27 bp, Artificial Sequence
  Synthetic Construct
ggaaggtaatacagcctgatgggagaa

SEQ ID NO: 3453 - DNA, 21 bp, Artificial Sequence
  Synthetic Construct
gcaagcagtgtctggcaaatc

SEQ ID NO: 3454 - DNA, 22 bp, Artificial Sequence
  Synthetic Construct
ccaactgcttcctgctgactgt

SEQ ID NO: 3455 - DNA, 22 bp, Artificial Sequence
  Synthetic Construct
ggtactaatgccgctgatgctt

SEQ ID NO: 3456 - DNA, 24 bp, Artificial Sequence
  Synthetic Construct
gtggtttaagtgcggactgtgttg

SEQ ID NO: 3457 - DNA, 21 bp, Artificial Sequence
  Synthetic Construct
tgagggaggtcggcacctaaa

SEQ ID NO: 3458 - DNA, 19 bp, Artificial Sequence
  Synthetic Construct
ggagcaggtccccagtgaa

SEQ ID NO: 3459 - DNA, 20 bp, Artificial Sequence
  Synthetic Construct
agtgctgagggtggcagaca

SEQ ID NO: 3460 - DNA, 25 bp, Artificial Sequence
  Synthetic Construct
gttctcaaatcaatccatggcaact

SEQ ID NO: 3461 - DNA, 23 bp, Artificial Sequence
  Synthetic Construct
ccttctccagcttcccaggatac

SEQ ID NO: 3462 - DNA, 19 bp, Artificial Sequence
  Synthetic Construct
aggcgatggcacgctgtct

SEQ ID NO: 3463 - DNA, 23 bp, Artificial Sequence
  Synthetic Construct
caacatccaacagagccgatttt

SEQ ID NO: 3464 - DNA, 20 bp, Artificial Sequence
  Synthetic Construct
acacaaggggcacccagaaa

SEQ ID NO: 3465 - DNA, 27 bp, Artificial Sequence
  Synthetic Construct
gcttcaggggagataaggaaatcaaga

SEQ ID NO: 3466 - DNA, 25 bp, Artificial Sequence
  Synthetic Construct
gcaatcacccaagaccaaacccaat

SEQ ID NO: 3467 - DNA, 19 bp, Artificial Sequence
  Synthetic Construct
caaggggctgccttcttga

SEQ ID NO: 3468 - DNA, 20 bp, Artificial Sequence
  Synthetic Construct
tgccccatttccctcagagt

SEQ ID NO: 3469 - DNA, 22 bp, Artificial Sequence
  Synthetic Construct
tttgtggagaaggcaagtgtca

SEQ ID NO: 3470 - DNA, 20 bp, Artificial Sequence
  Synthetic Construct
gcctgtgccatcagccaact

SEQ ID NO: 3471 - DNA, 22 bp, Artificial Sequence
  Synthetic Construct
aaccagatacacctgcatgctt

SEQ ID NO: 3472 - DNA, 19 bp, Artificial Sequence
  Synthetic Construct
atgccggggaaagccagaa

SEQ ID NO: 3473 - DNA, 22 bp, Artificial Sequence
  Synthetic Construct
ccatctgtgctggccaatccta

SEQ ID NO: 3474 - DNA, 21 bp, Artificial Sequence
  Synthetic Construct
ttcccaccatccgagactttg

SEQ ID NO: 3475 - DNA, 18 bp, Artificial Sequence
  Synthetic Construct
tgtgccctgggacactga

SEQ ID NO: 3476 - DNA, 21 bp, Artificial Sequence
  Synthetic Construct
gctgggtctggacccttctaa

SEQ ID NO: 3477 - DNA, 24 bp, Artificial Sequence
  Synthetic Construct
ggtgtgctggaccgagattctaac

SEQ ID NO: 3478 - DNA, 20 bp, Artificial Sequence
  Synthetic Construct
tgcacgcactctcccttatg

SEQ ID NO: 3479 - DNA, 22 bp, Artificial Sequence
  Synthetic Construct
ggaatgctgccacttggtgtag

SEQ ID NO: 3480 - DNA, 20 bp, Artificial Sequence
  Synthetic Construct
acacccacccatctctcctt

SEQ ID NO: 3481 - DNA, 19 bp, Artificial Sequence
  Synthetic Construct
tgccccaggccagaagcat

SEQ ID NO: 3482 - DNA, 19 bp, Artificial Sequence
  Synthetic Construct
ccgacggcagaacggaaac

SEQ ID NO: 3483 - DNA, 18 bp, Artificial Sequence
  Synthetic Construct
agggcaccagaggtgaca

SEQ ID NO: 3484 - DNA, 20 bp, Artificial Sequence
  Synthetic Construct
tggcaggtgctgctgtcaga

SEQ ID NO: 3485 - DNA, 20 bp, Artificial Sequence
  Synthetic Construct
tgttccctgcggtaggatgt

SEQ ID NO: 3486 - DNA, 22 bp, Artificial Sequence
  Synthetic Construct
gcccttgtgctttggggttcaa

SEQ ID NO: 3487 - DNA, 23 bp, Artificial Sequence
  Synthetic Construct
tccttactgctcagcatggatct

SEQ ID NO: 3488 - DNA, 26 bp, Artificial Sequence
  Synthetic Construct
ggaaacctcctatagtacggccagaa

SEQ ID NO: 3489 - DNA, 21 bp, Artificial Sequence
  Synthetic Construct
caccagccatggacaacaagt

SEQ ID NO: 3490 - DNA, 22 bp, Artificial Sequence
  Synthetic Construct
gcctcctggtattcctgtgcta

SEQ ID NO: 3491 - DNA, 23 bp, Artificial Sequence
  Synthetic Construct
ccgggaaatcagaggtgggtaac

SEQ ID NO: 3492 - DNA, 22 bp, Artificial Sequence
  Synthetic Construct
gtccatcaggaagcaagcacat

SEQ ID NO: 3493 - DNA, 22 bp, Artificial Sequence
  Synthetic Construct
ccagcaagaggaaactgcgtaa

SEQ ID NO: 3494 - DNA, 25 bp, Artificial Sequence
  Synthetic Construct
gggcagtagaaggtatcagcagtgt

SEQ ID NO: 3495 - DNA, 22 bp, Artificial Sequence
  Synthetic Construct
gtgccttacttcgggagctttc

SEQ ID NO: 3496 - DNA, 18 bp, Artificial Sequence
  Synthetic Construct
tgctgcgggtgaggttca

SEQ ID NO: 3497 - DNA, 21 bp, Artificial Sequence
  Synthetic Construct
cccaatccgagctgcagtcat

SEQ ID NO: 3498 - DNA, 23 bp, Artificial Sequence
  Synthetic Construct
tcctccatctaactcctgctcat

SEQ ID NO: 3499 - DNA, 24 bp, Artificial Sequence
  Synthetic Construct
ctgccttgataactctgggcattg

SEQ ID NO: 3500 - DNA, 19 bp, Artificial Sequence
  Synthetic Construct
ctggggtacccagggatgt

SEQ ID NO: 3501 - DNA, 20 bp, Artificial Sequence
  Synthetic Construct
tgggccagggctgtaatcta

SEQ ID NO: 3502 - DNA, 20 bp, Artificial Sequence
  Synthetic Construct
accggccgaggggtctttga

SEQ ID NO: 3503 - DNA, 21 bp, Artificial Sequence
  Synthetic Construct
tcccttccccacctctctttc

SEQ ID NO: 3504 - DNA, 20 bp, Artificial Sequence
  Synthetic Construct
ccgaaagctctgccaggaaa

SEQ ID NO: 3505 - DNA, 24 bp, Artificial Sequence
  Synthetic Construct
gtgccaatttttgtggggctgata

SEQ ID NO: 3506 - DNA, 21 bp, Artificial Sequence
  Synthetic Construct
cctctccaccaagcacagcat

SEQ ID NO: 3507 - DNA, 22 bp, Artificial Sequence
  Synthetic Construct
ctgccactgtccatccacatct

SEQ ID NO: 3508 - DNA, 20 bp, Artificial Sequence
  Synthetic Construct
tgcaaagtgcatggcacaga

SEQ ID NO: 3509 - DNA, 19 bp, Artificial Sequence
  Synthetic Construct
ggtggcgctgtctctccat

SEQ ID NO: 3510 - DNA, 22 bp, Artificial Sequence
  Synthetic Construct
tcctggcatcaagactgtgaac

SEQ ID NO: 3511 - DNA, 26 bp, Artificial Sequence
  Synthetic Construct
gtctttgtttacctccagggttccta

SEQ ID NO: 3512 - DNA, 24 bp, Artificial Sequence
  Synthetic Construct
ccatctctgcattcccaaatggat

SEQ ID NO: 3513 - DNA, 24 bp, Artificial Sequence
  Synthetic Construct
ccctctgttttcagctccactttc

SEQ ID NO: 3514 - DNA, 23 bp, Artificial Sequence
  Synthetic Construct
cagacttcacccactttgctctt

SEQ ID NO: 3515 - DNA, 20 bp, Artificial Sequence
  Synthetic Construct
tgggctgagcggctttctta

SEQ ID NO: 3516 - DNA, 24 bp, Artificial Sequence
  Synthetic Construct
gggatagcccttgtggctactttc

SEQ ID NO: 3517 - DNA, 27 bp, Artificial Sequence
  Synthetic Construct
tcccattggaaagtatggactacaaag

SEQ ID NO: 3518 - DNA, 24 bp, Artificial Sequence
  Synthetic Construct
gttcaggagtaaggaatggaccaa

SEQ ID NO: 3519 - DNA, 20 bp, Artificial Sequence
  Synthetic Construct
acttggcaggaagggtggat

SEQ ID NO: 3520 - DNA, 18 bp, Artificial Sequence
  Synthetic Construct
tccacccctgccccaaat

SEQ ID NO: 3521 - DNA, 22 bp, Artificial Sequence
  Synthetic Construct
ggcagacgggattcagttgcta

SEQ ID NO: 3522 - DNA, 18 bp, Artificial Sequence
  Synthetic Construct
accatgctggcccacagt

SEQ ID NO: 3523 - DNA, 21 bp, Artificial Sequence
  Synthetic Construct
gggactttcccaggccatgta

SEQ ID NO: 3524 - DNA, 26 bp, Artificial Sequence
  Synthetic Construct
gtcttgtgctgaatgctgaatggttt

SEQ ID NO: 3525 - DNA, 19 bp, Artificial Sequence
  Synthetic Construct
cctggctccatgggtcact

SEQ ID NO: 3526 - DNA, 19 bp, Artificial Sequence
  Synthetic Construct
tctggggtgccaccagcaa

SEQ ID NO: 3527 - DNA, 22 bp, Artificial Sequence
  Synthetic Construct
gcctcttcatacctgcagaact

SEQ ID NO: 3528 - DNA, 22 bp, Artificial Sequence
  Synthetic Construct
gcaggtggagtctgaagtgtca

SEQ ID NO: 3529 - DNA, 26 bp, Artificial Sequence
  Synthetic Construct
gtcctcattatccactccttccctta

SEQ ID NO: 3530 - DNA, 21 bp, Artificial Sequence
  Synthetic Construct
aggctgcagaacagcaaagat

SEQ ID NO: 3531 - DNA, 22 bp, Artificial Sequence
  Synthetic Construct
ctggtgggccttatggacaaga

SEQ ID NO: 3532 - DNA, 24 bp, Artificial Sequence
  Synthetic Construct
ctggggccagagtctgattcttag

SEQ ID NO: 3533 - DNA, 22 bp, Artificial Sequence
  Synthetic Construct
gcactggagatgaggctgcttt

SEQ ID NO: 3534 - DNA, 20 bp, Artificial Sequence
  Synthetic Construct
tttctgccccacctgcacaa

SEQ ID NO: 3535 - DNA, 24 bp, Artificial Sequence
  Synthetic Construct
ccaaaactatctcaggtgcaggaa

SEQ ID NO: 3536 - DNA, 22 bp, Artificial Sequence
  Synthetic Construct
cctctggcaaagcacccattca

SEQ ID NO: 3537 - DNA, 20 bp, Artificial Sequence
  Synthetic Construct
agagccaagaggctgcaaca

SEQ ID NO: 3538 - DNA, 22 bp, Artificial Sequence
  Synthetic Construct
gcagtgagccagtagccttttg

SEQ ID NO: 3539 - DNA, 23 bp, Artificial Sequence
  Synthetic Construct
gctccaaggtactagtgctgcat

SEQ ID NO: 3540 - DNA, 22 bp, Artificial Sequence
  Synthetic Construct
ggccaacctctgtaccttcagt

SEQ ID NO: 3541 - DNA, 23 bp, Artificial Sequence
  Synthetic Construct
cacttctcagtctctcccctttg

SEQ ID NO: 3542 - DNA, 22 bp, Artificial Sequence
  Synthetic Construct
ctcctggtttgcctggtactct

SEQ ID NO: 3543 - DNA, 20 bp, Artificial Sequence
  Synthetic Construct
agggagggaccagtcaactt

SEQ ID NO: 3544 - DNA, 29 bp, Artificial Sequence
  Synthetic Construct
gccctacaggtttacatgcaaagatattc

SEQ ID NO: 3545 - DNA, 21 bp, Artificial Sequence
  Synthetic Construct
gctgtccatgcagagctaagt

SEQ ID NO: 3546 - DNA, 22 bp, Artificial Sequence
  Synthetic Construct
gaatgaactggcaggcatctgt

SEQ ID NO: 3547 - DNA, 22 bp, Artificial Sequence
  Synthetic Construct
ggctaagggaatgccgacataa

SEQ ID NO: 3548 - DNA, 20 bp, Artificial Sequence
  Synthetic Construct
gccagaagggaatcgccaat

SEQ ID NO: 3549 - DNA, 20 bp, Artificial Sequence
  Synthetic Construct
ttccatccccggagcaactt

SEQ ID NO: 3550 - DNA, 21 bp, Artificial Sequence
  Synthetic Construct
ttgaaggaagtggcagccttt

SEQ ID NO: 3551 - DNA, 20 bp, Artificial Sequence
  Synthetic Construct
gccttccctggagctcgtta

SEQ ID NO: 3552 - DNA, 26 bp, Artificial Sequence
  Synthetic Construct
ctgaaatggcagcctttatgttcatc

SEQ ID NO: 3553 - DNA, 20 bp, Artificial Sequence
  Synthetic Construct
ttcctcggagtgctgctttg

SEQ ID NO: 3554 - DNA, 20 bp, Artificial Sequence
  Synthetic Construct
tggagctggcaggagtcagt

SEQ ID NO: 3555 - DNA, 20 bp, Artificial Sequence
  Synthetic Construct
gggctgtgaggtttgtgtca

SEQ ID NO: 3556 - DNA, 22 bp, Artificial Sequence
  Synthetic Construct
gctcagggcttgcacattcctt

SEQ ID NO: 3557 - DNA, 22 bp, Artificial Sequence
  Synthetic Construct
tgccctaacttctcctgcattg

SEQ ID NO: 3558 - DNA, 21 bp, Artificial Sequence
  Synthetic Construct
accaggccttccttctagtca

SEQ ID NO: 3559 - DNA, 20 bp, Artificial Sequence
  Synthetic Construct
gggtgagccgaatgttcact

SEQ ID NO: 3560 - DNA, 22 bp, Artificial Sequence
  Synthetic Construct
cccagccagagaggtatcaact

SEQ ID NO: 3561 - DNA, 23 bp, Artificial Sequence
  Synthetic Construct
gctactttgcagctaccactgaa

SEQ ID NO: 3562 - DNA, 26 bp, Artificial Sequence
  Synthetic Construct
ctgaagtatcatctcttccccggatt

SEQ ID NO: 3563 - DNA, 22 bp, Artificial Sequence
  Synthetic Construct
cagaggggtaggatgcatgaga

SEQ ID NO: 3564 - DNA, 26 bp, Artificial Sequence
  Synthetic Construct
ctgatgctagatcctccttctacttg

SEQ ID NO: 3565 - DNA, 20 bp, Artificial Sequence
  Synthetic Construct
ggcaataggagcctgcagat

SEQ ID NO: 3566 - DNA, 20 bp, Artificial Sequence
  Synthetic Construct
gggctgttgggccaagattt

SEQ ID NO: 3567 - DNA, 27 bp, Artificial Sequence
  Synthetic Construct
cccaactatttttgggttaggaagaac

SEQ ID NO: 3568 - DNA, 22 bp, Artificial Sequence
  Synthetic Construct
gggtgacacctgaggttcttga

SEQ ID NO: 3569 - DNA, 22 bp, Artificial Sequence
  Synthetic Construct
cccaaaatgcctcctgggaaac

SEQ ID NO: 3570 - DNA, 25 bp, Artificial Sequence
  Synthetic Construct
ggaacatctcatggtcacgtatttg

SEQ ID NO: 3571 - DNA, 25 bp, Artificial Sequence
  Synthetic Construct
ggtctagggtctcaatttggtcagt

SEQ ID NO: 3572 - DNA, 24 bp, Artificial Sequence
  Synthetic Construct
ccctttggatgactcttcgcacat

SEQ ID NO: 3573 - DNA, 20 bp, Artificial Sequence
  Synthetic Construct
ccactgccaccactgacaaa

SEQ ID NO: 3574 - DNA, 23 bp, Artificial Sequence
  Synthetic Construct
gagtggtttcccatcagggatga

SEQ ID NO: 3575 - DNA, 21 bp, Artificial Sequence
  Synthetic Construct
ggcaaaactgcaacactgtga

SEQ ID NO: 3576 - DNA, 24 bp, Artificial Sequence
  Synthetic Construct
tgcaggtttctcacataactcctt

SEQ ID NO: 3577 - DNA, 24 bp, Artificial Sequence
  Synthetic Construct
ttctctccagcagcactctttatt

SEQ ID NO: 3578 - DNA, 20 bp, Artificial Sequence
  Synthetic Construct
ctgtggcccatgaagcatct

SEQ ID NO: 3579 - DNA, 21 bp, Artificial Sequence
  Synthetic Construct
tgtctgcttcctagcgtcttc

SEQ ID NO: 3580 - DNA, 27 bp, Artificial Sequence
  Synthetic Construct
cacacatttcaggagcttgatctcatc

SEQ ID NO: 3581 - DNA, 26 bp, Artificial Sequence
  Synthetic Construct
ggaaccatgttcctttccaggttgtt

SEQ ID NO: 3582 - DNA, 23 bp, Artificial Sequence
  Synthetic Construct
tcatcatcccagagacacagcta

SEQ ID NO: 3583 - DNA, 24 bp, Artificial Sequence
  Synthetic Construct
ccttgtgctgctaaccatgagact

SEQ ID NO: 3584 - DNA, 24 bp, Artificial Sequence
  Synthetic Construct
ggaccctagtgattctcccatcat

SEQ ID NO: 3585 - DNA, 22 bp, Artificial Sequence
  Synthetic Construct
cacacttttcggtggtgccttt

SEQ ID NO: 3586 - DNA, 22 bp, Artificial Sequence
  Synthetic Construct
aggagccaagaacaaggagaag

SEQ ID NO: 3587 - DNA, 23 bp, Artificial Sequence
  Synthetic Construct
tggccataacagagtaggtgtga

SEQ ID NO: 3588 - DNA, 20 bp, Artificial Sequence
  Synthetic Construct
tagccccacgtgtcttccta

SEQ ID NO: 3589 - DNA, 24 bp, Artificial Sequence
  Synthetic Construct
acttgttcacttgctaggggatac

SEQ ID NO: 3590 - DNA, 22 bp, Artificial Sequence
  Synthetic Construct
cagagagaaggaggcccaaaga

SEQ ID NO: 3591 - DNA, 22 bp, Artificial Sequence
  Synthetic Construct
tgtcagtaacggtggagaccta

SEQ ID NO: 3592 - DNA, 24 bp, Artificial Sequence
  Synthetic Construct
gccttttaattagccttgcagctt

SEQ ID NO: 3593 - DNA, 20 bp, Artificial Sequence
  Synthetic Construct
agtgggagcctcgtaagcat

SEQ ID NO: 3594 - DNA, 24 bp, Artificial Sequence
  Synthetic Construct
ggaataggtaggtgcaagcagttg

SEQ ID NO: 3595 - DNA, 25 bp, Artificial Sequence
  Synthetic Construct
atccacaatttccctaggctagaag

SEQ ID NO: 3596 - DNA, 25 bp, Artificial Sequence
  Synthetic Construct
gcctagggttctcttccttcccttt

SEQ ID NO: 3597 - DNA, 20 bp, Artificial Sequence
  Synthetic Construct
tggttccccgagctcttttc

SEQ ID NO: 3598 - DNA, 25 bp, Artificial Sequence
  Synthetic Construct
tgggtctagaaggaaactgactttg

SEQ ID NO: 3599 - DNA, 21 bp, Artificial Sequence
  Synthetic Construct
gggctcagggagaaaatcaca

SEQ ID NO: 3600 - DNA, 21 bp, Artificial Sequence
  Synthetic Construct
tgagtcttacggggacgaagt

SEQ ID NO: 3601 - DNA, 21 bp, Artificial Sequence
  Synthetic Construct
gtgtcgtgcctgctaggtatt

SEQ ID NO: 3602 - DNA, 20 bp, Artificial Sequence
  Synthetic Construct
tgtgccaggcccaaaagctt

SEQ ID NO: 3603 - DNA, 19 bp, Artificial Sequence
  Synthetic Construct
tctgcttctgccggcattc

SEQ ID NO: 3604 - DNA, 22 bp, Artificial Sequence
  Synthetic Construct
aggaactgtcagattgcaacca

SEQ ID NO: 3605 - DNA, 21 bp, Artificial Sequence
  Synthetic Construct
ccaccaggtgctctcaactct

SEQ ID NO: 3606 - DNA, 22 bp, Artificial Sequence
  Synthetic Construct
tcccacacacgtgtctgtatct

SEQ ID NO: 3607 - DNA, 24 bp, Artificial Sequence
  Synthetic Construct
agaagggcaaggaaacataacctt

SEQ ID NO: 3608 - DNA, 24 bp, Artificial Sequence
  Synthetic Construct
ccactcctggcccttttctctttt

SEQ ID NO: 3609 - DNA, 19 bp, Artificial Sequence
  Synthetic Construct
aacttggggccaggctcta

SEQ ID NO: 3610 - DNA, 25 bp, Artificial Sequence
  Synthetic Construct
ccacgatgaaaaacagaaaccaaac

SEQ ID NO: 3611 - DNA, 21 bp, Artificial Sequence
  Synthetic Construct
ggttgcaaacccctcctcttt

SEQ ID NO: 3612 - DNA, 22 bp, Artificial Sequence
  Synthetic Construct
gcctttgtgtagacagccactt

SEQ ID NO: 3613 - DNA, 24 bp, Artificial Sequence
  Synthetic Construct
tgtgtgcataaagggtcttgaaga

SEQ ID NO: 3614 - DNA, 20 bp, Artificial Sequence
  Synthetic Construct
acccttccctgccactgttt

SEQ ID NO: 3615 - DNA, 23 bp, Artificial Sequence
  Synthetic Construct
tagccgtagctcagatcctagct

SEQ ID NO: 3616 - DNA, 21 bp, Artificial Sequence
  Synthetic Construct
tcatggtgccctggcctcact

SEQ ID NO: 3617 - DNA, 24 bp, Artificial Sequence
  Synthetic Construct
ctccaagccacagaactcaacatg

SEQ ID NO: 3618 - DNA, 20 bp, Artificial Sequence
  Synthetic Construct
gcctcaccatggctctgatc

SEQ ID NO: 3619 - DNA, 18 bp, Artificial Sequence
  Synthetic Construct
ccaggtccccccaaacac

SEQ ID NO: 3620 - DNA, 23 bp, Artificial Sequence
  Synthetic Construct
tccagtgctcactcactctcctt

SEQ ID NO: 3621 - DNA, 22 bp, Artificial Sequence
  Synthetic Construct
gagtagtgcatgcacacagtga

SEQ ID NO: 3622 - DNA, 20 bp, Artificial Sequence
  Synthetic Construct
tgggcctcattcccaagttc

SEQ ID NO: 3623 - DNA, 26 bp, Artificial Sequence
  Synthetic Construct
ggcttctgcagaataacatcctgatt

SEQ ID NO: 3624 - DNA, 18 bp, Artificial Sequence
  Synthetic Construct
tccagcctcagcctggtt

SEQ ID NO: 3625 - DNA, 21 bp, Artificial Sequence
  Synthetic Construct
tgcatggccagacaatatggt

SEQ ID NO: 3626 - DNA, 24 bp, Artificial Sequence
  Synthetic Construct
gaaagttgtgttcccaaggctttg

SEQ ID NO: 3627 - DNA, 26 bp, Artificial Sequence
  Synthetic Construct
gtatgactccccttaaggatgagaag

SEQ ID NO: 3628 - DNA, 20 bp, Artificial Sequence
  Synthetic Construct
agcagcatgatgccaacgaa

SEQ ID NO: 3629 - DNA, 25 bp, Artificial Sequence
  Synthetic Construct
ggctcatctttgccagttatttcca

SEQ ID NO: 3630 - DNA, 23 bp, Artificial Sequence
  Synthetic Construct
gctgttccatggagcaatcactt

SEQ ID NO: 3631 - DNA, 23 bp, Artificial Sequence
  Synthetic Construct
aaaaatggcccagttttgcagaa

SEQ ID NO: 3632 - DNA, 21 bp, Artificial Sequence
  Synthetic Construct
aacaatccccggcccaatcct

SEQ ID NO: 3633 - DNA, 19 bp, Artificial Sequence
  Synthetic Construct
tgcccaggctttccccaat

SEQ ID NO: 3634 - DNA, 20 bp, Artificial Sequence
  Synthetic Construct
tgctgtctgcctcaggatga

SEQ ID NO: 3635 - DNA, 21 bp, Artificial Sequence
  Synthetic Construct
gtgggacagacagcccttgtt

SEQ ID NO: 3636 - DNA, 25 bp, Artificial Sequence
  Synthetic Construct
gttttcctgttcaggtgacctagtc

SEQ ID NO: 3637 - DNA, 27 bp, Artificial Sequence
  Synthetic Construct
gagagctatacagaattgtggcttttc

SEQ ID NO: 3638 - DNA, 22 bp, Artificial Sequence
  Synthetic Construct
cccgcagtgattccaacataga

SEQ ID NO: 3639 - DNA, 20 bp, Artificial Sequence
  Synthetic Construct
tgcaaactgcgacctgaact

SEQ ID NO: 3640 - DNA, 20 bp, Artificial Sequence
  Synthetic Construct
agctggggctctgaatgtga

SEQ ID NO: 3641 - DNA, 21 bp, Artificial Sequence
  Synthetic Construct
cccaactgtcccctctcacta

SEQ ID NO: 3642 - DNA, 27 bp, Artificial Sequence
  Synthetic Construct
ctggtttgaatgtcttggattgcttag

SEQ ID NO: 3643 - DNA, 24 bp, Artificial Sequence
  Synthetic Construct
tcaacaggctaccattctttggat

SEQ ID NO: 3644 - DNA, 21 bp, Artificial Sequence
  Synthetic Construct
tcccccaaagaggaactgctt

SEQ ID NO: 3645 - DNA, 25 bp, Artificial Sequence
  Synthetic Construct
ggaatcccctcccctgtatttattg

SEQ ID NO: 3646 - DNA, 24 bp, Artificial Sequence
  Synthetic Construct
gaaatgtcctctctggtccaagat

SEQ ID NO: 3647 - DNA, 19 bp, Artificial Sequence
  Synthetic Construct
tgggctactggcactgagt

SEQ ID NO: 3648 - DNA, 22 bp, Artificial Sequence
  Synthetic Construct
cacggttaagttgcacccaaac

SEQ ID NO: 3649 - DNA, 22 bp, Artificial Sequence
  Synthetic Construct
aggaggtggtgagtgcagagaa

SEQ ID NO: 3650 - DNA, 18 bp, Artificial Sequence
  Synthetic Construct
gctgggcgagctctttgg

SEQ ID NO: 3651 - DNA, 22 bp, Artificial Sequence
  Synthetic Construct
agagtgaggagcagagacttca

SEQ ID NO: 3652 - DNA, 21 bp, Artificial Sequence
  Synthetic Construct
taggcagaggcatgcctgaat

SEQ ID NO: 3653 - DNA, 21 bp, Artificial Sequence
  Synthetic Construct
ttgggtgccagtttggaccaa

SEQ ID NO: 3654 - DNA, 20 bp, Artificial Sequence
  Synthetic Construct
ccccagctgtcttcactgtt

SEQ ID NO: 3655 - DNA, 20 bp, Artificial Sequence
  Synthetic Construct
gtgtgctcagtggacaagca

SEQ ID NO: 3656 - DNA, 21 bp, Artificial Sequence
  Synthetic Construct
aggacaggggcagggagtaat

SEQ ID NO: 3657 - DNA, 24 bp, Artificial Sequence
  Synthetic Construct
ggaaccacttatccagaaccagaa

SEQ ID NO: 3658 - DNA, 20 bp, Artificial Sequence
  Synthetic Construct
gaggctgactcctgttgcat

SEQ ID NO: 3659 - DNA, 29 bp, Artificial Sequence
  Synthetic Construct
tggaaagctacattcaattcaaagacaaa

SEQ ID NO: 3660 - DNA, 22 bp, Artificial Sequence
  Synthetic Construct
ctccaaaactgatcccggcaaa

SEQ ID NO: 3661 - DNA, 24 bp, Artificial Sequence
  Synthetic Construct
tgataagggctgtgctcttctaag

SEQ ID NO: 3662 - DNA, 26 bp, Artificial Sequence
  Synthetic Construct
agataccgagtgggtttattcttctc

SEQ ID NO: 3663 - DNA, 25 bp, Artificial Sequence
  Synthetic Construct
tgtttccccatccatcaaccatatc

SEQ ID NO: 3664 - DNA, 19 bp, Artificial Sequence
  Synthetic Construct
tgcccatgcccacatccat

SEQ ID NO: 3665 - DNA, 22 bp, Artificial Sequence
  Synthetic Construct
aggctatgaaccagctctcctt

SEQ ID NO: 3666 - DNA, 24 bp, Artificial Sequence
  Synthetic Construct
ccacacgattcagaaagagcctta

SEQ ID NO: 3667 - DNA, 24 bp, Artificial Sequence
  Synthetic Construct
cacctctacttcttcagggacaag

SEQ ID NO: 3668 - DNA, 22 bp, Artificial Sequence
  Synthetic Construct
gctatgcccacacaagtacaga

SEQ ID NO: 3669 - DNA, 28 bp, Artificial Sequence
  Synthetic Construct
gcatcttcattgatgggaactgtaaacc

SEQ ID NO: 3670 - DNA, 26 bp, Artificial Sequence
  Synthetic Construct
gcccatatctcattgaaaggagaaca

SEQ ID NO: 3671 - DNA, 25 bp, Artificial Sequence
  Synthetic Construct
ccattctaggttaggcttgacgttt

SEQ ID NO: 3672 - DNA, 19 bp, Artificial Sequence
  Synthetic Construct
cttcccccgagaccaacac

SEQ ID NO: 3673 - DNA, 18 bp, Artificial Sequence
  Synthetic Construct
agccaggctgagcaaggt

SEQ ID NO: 3674 - DNA, 23 bp, Artificial Sequence
  Synthetic Construct
tcccaagttaacggcattttcct

SEQ ID NO: 3675 - DNA, 21 bp, Artificial Sequence
  Synthetic Construct
agggcactgtggggatatcca

SEQ ID NO: 3676 - DNA, 30 bp, Artificial Sequence
  Synthetic Construct
agagataacctgtctacagaaaatgcttta

SEQ ID NO: 3677 - DNA, 21 bp, Artificial Sequence
  Synthetic Construct
ttcctaccccaggcagatgca

SEQ ID NO: 3678 - DNA, 20 bp, Artificial Sequence
  Synthetic Construct
gccctatggcggggtgaata

SEQ ID NO: 3679 - DNA, 21 bp, Artificial Sequence
  Synthetic Construct
agctcccaccctaccttagca

SEQ ID NO: 3680 - DNA, 20 bp, Artificial Sequence
  Synthetic Construct
agacacggtgggttctgcat

SEQ ID NO: 3681 - DNA, 24 bp, Artificial Sequence
  Synthetic Construct
tcttatgctactgggcctttcttc

SEQ ID NO: 3682 - DNA, 26 bp, Artificial Sequence
  Synthetic Construct
ggtctgttgggatttcagaagctaaa

SEQ ID NO: 3683 - DNA, 19 bp, Artificial Sequence
  Synthetic Construct
gaggccacactgcagtcaa

SEQ ID NO: 3684 - DNA, 27 bp, Artificial Sequence
  Synthetic Construct
ccccttccattatgggatcataagtag

SEQ ID NO: 3685 - DNA, 24 bp, Artificial Sequence
  Synthetic Construct
aaaggcaggaactagactgaaaca

SEQ ID NO: 3686 - DNA, 21 bp, Artificial Sequence
  Synthetic Construct
tccttgaggctttcccattcc

SEQ ID NO: 3687 - DNA, 21 bp, Artificial Sequence
  Synthetic Construct
gccagaaggtgccagttttgt

SEQ ID NO: 3688 - DNA, 20 bp, Artificial Sequence
  Synthetic Construct
tccagggttccctcttgtga

SEQ ID NO: 3689 - DNA, 20 bp, Artificial Sequence
  Synthetic Construct
tcctgggtgcagggtagact

SEQ ID NO: 3690 - DNA, 20 bp, Artificial Sequence
  Synthetic Construct
tgaaacaacacgccctcagt

SEQ ID NO: 3691 - DNA, 26 bp, Artificial Sequence
  Synthetic Construct
ctgaagcagaagttaactctttgctt

SEQ ID NO: 3692 - DNA, 19 bp, Artificial Sequence
  Synthetic Construct
aggcagtcccgggctgact

SEQ ID NO: 3693 - DNA, 22 bp, Artificial Sequence
  Synthetic Construct
tggtcttagaggcgtccagtct

SEQ ID NO: 3694 - DNA, 23 bp, Artificial Sequence
  Synthetic Construct
aggggtctgtagagtagcgagat

SEQ ID NO: 3695 - DNA, 22 bp, Artificial Sequence
  Synthetic Construct
gagtgttcagcagagcaccatt

SEQ ID NO: 3696 - DNA, 24 bp, Artificial Sequence
  Synthetic Construct
ccaaaaccttcactctctgttgtc

SEQ ID NO: 3697 - DNA, 26 bp, Artificial Sequence
  Synthetic Construct
ggagtaatgcccaactagaggttagg

SEQ ID NO: 3698 - DNA, 20 bp, Artificial Sequence
  Synthetic Construct
aatgggcccttgctctgttt

SEQ ID NO: 3699 - DNA, 21 bp, Artificial Sequence
  Synthetic Construct
aggatgggaaggctgtgagta

SEQ ID NO: 3700 - DNA, 21 bp, Artificial Sequence
  Synthetic Construct
cagcccatccttcctgatgac

SEQ ID NO: 3701 - DNA, 24 bp, Artificial Sequence
  Synthetic Construct
gaggtttcggctttagttgtgtga

SEQ ID NO: 3702 - DNA, 24 bp, Artificial Sequence
  Synthetic Construct
aggagatgaccttcaaggctgtct

SEQ ID NO: 3703 - DNA, 21 bp, Artificial Sequence
  Synthetic Construct
cagtggtgggaaagacagcaa

SEQ ID NO: 3704 - DNA, 24 bp, Artificial Sequence
  Synthetic Construct
cctgttgggcactgcatacttttc

SEQ ID NO: 3705 - DNA, 22 bp, Artificial Sequence
  Synthetic Construct
cctgattcacagaccccaagtt

SEQ ID NO: 3706 - DNA, 24 bp, Artificial Sequence
  Synthetic Construct
agaaggaagtagggggagtgagat

SEQ ID NO: 3707 - DNA, 26 bp, Artificial Sequence
  Synthetic Construct
tctttggcactccttccatcgagatg

SEQ ID NO: 3708 - DNA, 25 bp, Artificial Sequence
  Synthetic Construct
ggacaggaattcatgacttgtggtt

SEQ ID NO: 3709 - DNA, 27 bp, Artificial Sequence
  Synthetic Construct
cataggtaaaagctaggtgtggagaaa

SEQ ID NO: 3710 - DNA, 24 bp, Artificial Sequence
  Synthetic Construct
ggagatttctcaccatgggaatct

SEQ ID NO: 3711 - DNA, 28 bp, Artificial Sequence
  Synthetic Construct
agagatttagtttctcagttcgtaagga

SEQ ID NO: 3712 - DNA, 26 bp, Artificial Sequence
  Synthetic Construct
caacctagcaaggattctactggtaa

SEQ ID NO: 3713 - DNA, 20 bp, Artificial Sequence
  Synthetic Construct
ccttgctgttcctggaagct

SEQ ID NO: 3714 - DNA, 24 bp, Artificial Sequence
  Synthetic Construct
ggagaaatgaggccttggagcttt

SEQ ID NO: 3715 - DNA, 27 bp, Artificial Sequence
  Synthetic Construct
aagcacaatactaaacacagagtcaac

SEQ ID NO: 3716 - DNA, 26 bp, Artificial Sequence
  Synthetic Construct
acaaggtgattggttctaactttggt

SEQ ID NO: 3717 - DNA, 22 bp, Artificial Sequence
  Synthetic Construct
agaccacattgtaggccccata

SEQ ID NO: 3718 - DNA, 23 bp, Artificial Sequence
  Synthetic Construct
tgggtcctgatctccacacttct

SEQ ID NO: 3719 - DNA, 24 bp, Artificial Sequence
  Synthetic Construct
gatccctttggaggcattcaagga

SEQ ID NO: 3720 - DNA, 24 bp, Artificial Sequence
  Synthetic Construct
cagcaatccagactctacctcttc

SEQ ID NO: 3721 - DNA, 26 bp, Artificial Sequence
  Synthetic Construct
gccaacctttccattgtcatggttta

SEQ ID NO: 3722 - DNA, 23 bp, Artificial Sequence
  Synthetic Construct
cacagaactgctcacagatagca

SEQ ID NO: 3723 - DNA, 21 bp, Artificial Sequence
  Synthetic Construct
tctgcaaagtcccaccaaagg

SEQ ID NO: 3724 - DNA, 22 bp, Artificial Sequence
  Synthetic Construct
ccactggggctaattgctacaa

SEQ ID NO: 3725 - DNA, 27 bp, Artificial Sequence
  Synthetic Construct
gaggatacattttggggagataactgt

SEQ ID NO: 3726 - DNA, 23 bp, Artificial Sequence
  Synthetic Construct
tctcagggtgcaacagacatttc

SEQ ID NO: 3727 - DNA, 20 bp, Artificial Sequence
  Synthetic Construct
ggacaggcaagggagttgag

SEQ ID NO: 3728 - DNA, 23 bp, Artificial Sequence
  Synthetic Construct
ctttttccagaccccagattcct

SEQ ID NO: 3729 - DNA, 24 bp, Artificial Sequence
  Synthetic Construct
gaaaaggaagagccattccgtgta

SEQ ID NO: 3730 - DNA, 22 bp, Artificial Sequence
  Synthetic Construct
gcaaccacaaagcagtttgttg

SEQ ID NO: 3731 - DNA, 23 bp, Artificial Sequence
  Synthetic Construct
gcctgtagctagtgtctgtctct

SEQ ID NO: 3732 - DNA, 22 bp, Artificial Sequence
  Synthetic Construct
tctcctgagcgtgaagttggtt

SEQ ID NO: 3733 - DNA, 21 bp, Artificial Sequence
  Synthetic Construct
tggcaccatgtgttcctctct

SEQ ID NO: 3734 - DNA, 22 bp, Artificial Sequence
  Synthetic Construct
gcccctttacacctgatcttga

SEQ ID NO: 3735 - DNA, 28 bp, Artificial Sequence
  Synthetic Construct
gtttcaggcttagtacttaaaacagtca

SEQ ID NO: 3736 - DNA, 26 bp, Artificial Sequence
  Synthetic Construct
tgaaggagtgtggattagtggttaac

SEQ ID NO: 3737 - DNA, 20 bp, Artificial Sequence
  Synthetic Construct
aggtgtgtggtccagattgc

SEQ ID NO: 3738 - DNA, 21 bp, Artificial Sequence
  Synthetic Construct
gccgatgtgttgcctcaagtt

SEQ ID NO: 3739 - DNA, 24 bp, Artificial Sequence
  Synthetic Construct
cacagccttcaagttctgtttcca

SEQ ID NO: 3740 - DNA, 23 bp, Artificial Sequence
  Synthetic Construct
gcaacgggagtaattgcatttgg

SEQ ID NO: 3741 - DNA, 22 bp, Artificial Sequence
  Synthetic Construct
aagaggcagattgctggaagga

SEQ ID NO: 3742 - DNA, 20 bp, Artificial Sequence
  Synthetic Construct
ggaagctgagctgcctctag

SEQ ID NO: 3743 - DNA, 24 bp, Artificial Sequence
  Synthetic Construct
gtattacaacagcgagtggattgc

SEQ ID NO: 3744 - DNA, 23 bp, Artificial Sequence
  Synthetic Construct
gatgtccacctacactggatctc

SEQ ID NO: 3745 - DNA, 24 bp, Artificial Sequence
  Synthetic Construct
acagaagagagacttgggcaatag

SEQ ID NO: 3746 - DNA, 20 bp, Artificial Sequence
  Synthetic Construct
ggagctgcctgatcccagat

SEQ ID NO: 3747 - DNA, 22 bp, Artificial Sequence
  Synthetic Construct
tgatcccagatcaggctcaact

SEQ ID NO: 3748 - DNA, 23 bp, Artificial Sequence
  Synthetic Construct
gtccttgggttcaaatcctagct

SEQ ID NO: 3749 - DNA, 22 bp, Artificial Sequence
  Synthetic Construct
tgaggctccagttgaccttgac

SEQ ID NO: 3750 - DNA, 24 bp, Artificial Sequence
  Synthetic Construct
tcttgcatatacaccactgaagca

SEQ ID NO: 3751 - DNA, 24 bp, Artificial Sequence
  Synthetic Construct
tgtgcaatgaattcagcatgtgat

SEQ ID NO: 3752 - DNA, 20 bp, Artificial Sequence
  Synthetic Construct
tgaagcactcgcagctcact

SEQ ID NO: 3753 - DNA, 23 bp, Artificial Sequence
  Synthetic Construct
agctgaaccttgagaagagcaaa

SEQ ID NO: 3754 - DNA, 21 bp, Artificial Sequence
  Synthetic Construct
aggggtggctctgactaagga

SEQ ID NO: 3755 - DNA, 29 bp, Artificial Sequence
  Synthetic Construct
ccttgaaaataagctgttccaggtaaagg

SEQ ID NO: 3756 - DNA, 24 bp, Artificial Sequence
  Synthetic Construct
ggagtggttactatgcagggtatg

SEQ ID NO: 3757 - DNA, 26 bp, Artificial Sequence
  Synthetic Construct
ggactaggattaaaggagggcctact

SEQ ID NO: 3758 - DNA, 23 bp, Artificial Sequence
  Synthetic Construct
agggttagctaagtaggctgagt

SEQ ID NO: 3759 - DNA, 25 bp, Artificial Sequence
  Synthetic Construct
tggataggtgggcactatagtgtac

SEQ ID NO: 3760 - DNA, 26 bp, Artificial Sequence
  Synthetic Construct
ggagggtgaggacagagtatttatcc

SEQ ID NO: 3761 - DNA, 26 bp, Artificial Sequence
  Synthetic Construct
ccctcctgattctctctctcagatca

SEQ ID NO: 3762 - DNA, 24 bp, Artificial Sequence
  Synthetic Construct
gcttccatgaacacggactgtatg

SEQ ID NO: 3763 - DNA, 24 bp, Artificial Sequence
  Synthetic Construct
gtgggggttaagaggacaaagagt

SEQ ID NO: 3764 - DNA, 27 bp, Artificial Sequence
  Synthetic Construct
ggagagagaatagtgttgcactttgtc

SEQ ID NO: 3765 - DNA, 25 bp, Artificial Sequence
  Synthetic Construct
accccagggaaagtatagacttgag

SEQ ID NO: 3766 - DNA, 24 bp, Artificial Sequence
  Synthetic Construct
gatgaacactacagctgacacact

SEQ ID NO: 3767 - DNA, 22 bp, Artificial Sequence
  Synthetic Construct
aacacaccatgaacccactctt

SEQ ID NO: 3768 - DNA, 26 bp, Artificial Sequence
  Synthetic Construct
gatgctgggaagttgatgaaacatac

SEQ ID NO: 3769 - DNA, 22 bp, Artificial Sequence
  Synthetic Construct
ggttccatcgtctcaactgtgt

SEQ ID NO: 3770 - DNA, 19 bp, Artificial Sequence
  Synthetic Construct
agaaggctgccaggatcca

SEQ ID NO: 3771 - DNA, 24 bp, Artificial Sequence
  Synthetic Construct
tccacagtcgatttgcctatagag

SEQ ID NO: 3772 - DNA, 25 bp, Artificial Sequence
  Synthetic Construct
cgtcttcagagagtttgctttctct

SEQ ID NO: 3773 - DNA, 26 bp, Artificial Sequence
  Synthetic Construct
gctcagaaaaagagaagctgctgtga

SEQ ID NO: 3774 - DNA, 21 bp, Artificial Sequence
  Synthetic Construct
gccttgaacaagtcgctttcc

SEQ ID NO: 3775 - DNA, 23 bp, Artificial Sequence
  Synthetic Construct
ctgtgggttgatgtcttcaaagc

SEQ ID NO: 3776 - DNA, 21 bp, Artificial Sequence
  Synthetic Construct
cccaagccaacatgtcaactg

SEQ ID NO: 3777 - DNA, 25 bp, Artificial Sequence
  Synthetic Construct
ggctccttctcaatacaggtgattc

SEQ ID NO: 3778 - DNA, 21 bp, Artificial Sequence
  Synthetic Construct
agttcagcacctgcagatctg

SEQ ID NO: 3779 - DNA, 18 bp, Artificial Sequence
  Synthetic Construct
cccgcacacacacagact

SEQ ID NO: 3780 - DNA, 24 bp, Artificial Sequence
  Synthetic Construct
tgtgacgctattgttggtgataga

SEQ ID NO: 3781 - DNA, 23 bp, Artificial Sequence
  Synthetic Construct
ctacagccaccttacacctttgt

SEQ ID NO: 3782 - DNA, 24 bp, Artificial Sequence
  Synthetic Construct
ctccagaggaaactgagcttttgg

SEQ ID NO: 3783 - DNA, 25 bp, Artificial Sequence
  Synthetic Construct
gaataaaactgagcaatgccttcca

SEQ ID NO: 3784 - DNA, 26 bp, Artificial Sequence
  Synthetic Construct
ccatacactttgcctatccattgttt

SEQ ID NO: 3785 - DNA, 25 bp, Artificial Sequence
  Synthetic Construct
gggaagttaatctcagccattttgg

SEQ ID NO: 3786 - DNA, 20 bp, Artificial Sequence
  Synthetic Construct
aagcttgcatcccacatcca

SEQ ID NO: 3787 - DNA, 25 bp, Artificial Sequence
  Synthetic Construct
ggaaacgattctaacagagcatctg

SEQ ID NO: 3788 - DNA, 25 bp, Artificial Sequence
  Synthetic Construct
ggtaaggacagggaaaaggattagc

SEQ ID NO: 3789 - DNA, 20 bp, Artificial Sequence
  Synthetic Construct
ccagagccccacagtctaca

SEQ ID NO: 3790 - DNA, 24 bp, Artificial Sequence
  Synthetic Construct
tgagagagaactcttgcctctctt

SEQ ID NO: 3791 - DNA, 21 bp, Artificial Sequence
  Synthetic Construct
atgtctgatgggctgctttgc

SEQ ID NO: 3792 - DNA, 20 bp, Artificial Sequence
  Synthetic Construct
agggttgggcagacagagat

SEQ ID NO: 3793 - DNA, 21 bp, Artificial Sequence
  Synthetic Construct
aggctacagggagggaatgca

SEQ ID NO: 3794 - DNA, 24 bp, Artificial Sequence
  Synthetic Construct
gctctagagacctacaggacacta

SEQ ID NO: 3795 - DNA, 27 bp, Artificial Sequence
  Synthetic Construct
aaatcctcaaaactcattcctggaatg

SEQ ID NO: 3796 - DNA, 20 bp, Artificial Sequence
  Synthetic Construct
cggagtagccctcactctct

SEQ ID NO: 3797 - DNA, 22 bp, Artificial Sequence
  Synthetic Construct
cagagcccgtttttccaacatg

SEQ ID NO: 3798 - DNA, 22 bp, Artificial Sequence
  Synthetic Construct
ctggcagtggagggaaaacaaa

SEQ ID NO: 3799 - DNA, 23 bp, Artificial Sequence
  Synthetic Construct
gggctgtctacatgtagctgaga

SEQ ID NO: 3800 - DNA, 20 bp, Artificial Sequence
  Synthetic Construct
agctgaacctgtggggatgt

SEQ ID NO: 3801 - DNA, 21 bp, Artificial Sequence
  Synthetic Construct
tgggacacacaggaggagaga

SEQ ID NO: 3802 - DNA, 23 bp, Artificial Sequence
  Synthetic Construct
gctcttcatgtggctggattaca

SEQ ID NO: 3803 - DNA, 24 bp, Artificial Sequence
  Synthetic Construct
tgactatggtcaggtcacttgtct

SEQ ID NO: 3804 - DNA, 25 bp, Artificial Sequence
  Synthetic Construct
aagtgtaaagagagctggagttcaa

SEQ ID NO: 3805 - DNA, 26 bp, Artificial Sequence
  Synthetic Construct
gcaaactctcatgcaaccaggaataa

SEQ ID NO: 3806 - DNA, 26 bp, Artificial Sequence
  Synthetic Construct
gtgaaatttaccaccaatgccctgat

SEQ ID NO: 3807 - DNA, 24 bp, Artificial Sequence
  Synthetic Construct
gcgatggggagacaattactcagt

SEQ ID NO: 3808 - DNA, 20 bp, Artificial Sequence
  Synthetic Construct
agggctccaacctcaagcta

SEQ ID NO: 3809 - DNA, 20 bp, Artificial Sequence
  Synthetic Construct
ctgtgtgcatctggctgaca

SEQ ID NO: 3810 - DNA, 19 bp, Artificial Sequence
  Synthetic Construct
agtgccacccagcctagct

SEQ ID NO: 3811 - DNA, 26 bp, Artificial Sequence
  Synthetic Construct
ggcaactctagaatgacaaaggctta

SEQ ID NO: 3812 - DNA, 22 bp, Artificial Sequence
  Synthetic Construct
ctcttcactgggatgcttcctt

SEQ ID NO: 3813 - DNA, 24 bp, Artificial Sequence
  Synthetic Construct
ccccagccgacttacttttgaaga

SEQ ID NO: 3814 - DNA, 22 bp, Artificial Sequence
  Synthetic Construct
gctgactcttagccctgacttc

SEQ ID NO: 3815 - DNA, 24 bp, Artificial Sequence
  Synthetic Construct
ctctgtgctttctcactcatttcc

SEQ ID NO: 3816 - DNA, 20 bp, Artificial Sequence
  Synthetic Construct
ttgggtgccacttgggagaa

SEQ ID NO: 3817 - DNA, 29 bp, Artificial Sequence
  Synthetic Construct
ctccttagagtgctgaaatattcttagca

SEQ ID NO: 3818 - DNA, 22 bp, Artificial Sequence
  Synthetic Construct
gggaggctttttgtggtacaga

SEQ ID NO: 3819 - DNA, 28 bp, Artificial Sequence
  Synthetic Construct
gctagactatctctaagccagtctccta

SEQ ID NO: 3820 - DNA, 20 bp, Artificial Sequence
  Synthetic Construct
gcggcgtggtcaatctctca

SEQ ID NO: 3821 - DNA, 22 bp, Artificial Sequence
  Synthetic Construct
gcaagtaactgaaggcagcaaa

SEQ ID NO: 3822 - DNA, 25 bp, Artificial Sequence
  Synthetic Construct
ggtatgtggggcgatttatctcaag

SEQ ID NO: 3823 - DNA, 19 bp, Artificial Sequence
  Synthetic Construct
tcgctggcttgcctaacac

SEQ ID NO: 3824 - DNA, 24 bp, Artificial Sequence
  Synthetic Construct
gcttggtctcagataggcctgatt

SEQ ID NO: 3825 - DNA, 24 bp, Artificial Sequence
  Synthetic Construct
tcctaatcaccccatggccaaatc

SEQ ID NO: 3826 - DNA, 22 bp, Artificial Sequence
  Synthetic Construct
cgctacctcagtgatgtccatt

SEQ ID NO: 3827 - DNA, 28 bp, Artificial Sequence
  Synthetic Construct
ggcaaacaggttagaatttacacaggaa

SEQ ID NO: 3828 - DNA, 26 bp, Artificial Sequence
  Synthetic Construct
aggggattactgagggtgaggattac

SEQ ID NO: 3829 - DNA, 20 bp, Artificial Sequence
  Synthetic Construct
aatgcccgcctctgaggaat

SEQ ID NO: 3830 - DNA, 24 bp, Artificial Sequence
  Synthetic Construct
tgctgagagaaagctgatttggta

SEQ ID NO: 3831 - DNA, 20 bp, Artificial Sequence
  Synthetic Construct
tgaggccagaagcagtgcta

SEQ ID NO: 3832 - DNA, 26 bp, Artificial Sequence
  Synthetic Construct
aaggctgctattatccaaaagtgttg

SEQ ID NO: 3833 - DNA, 22 bp, Artificial Sequence
  Synthetic Construct
tgcctccttgtggcataccatt

SEQ ID NO: 3834 - DNA, 24 bp, Artificial Sequence
  Synthetic Construct
gttctctccttgaccttccttctg

SEQ ID NO: 3835 - DNA, 21 bp, Artificial Sequence
  Synthetic Construct
gtctgtcaggttggacactgt

SEQ ID NO: 3836 - DNA, 26 bp, Artificial Sequence
  Synthetic Construct
cgtgagcttatgtctctggtgttgag

SEQ ID NO: 3837 - DNA, 27 bp, Artificial Sequence
  Synthetic Construct
ctgatgttgaagctcacattgtttgag

SEQ ID NO: 3838 - DNA, 26 bp, Artificial Sequence
  Synthetic Construct
cagatattctctaatgccccttgagt

SEQ ID NO: 3839 - DNA, 21 bp, Artificial Sequence
  Synthetic Construct
agcacagaggagcaggagtgt

SEQ ID NO: 3840 - DNA, 27 bp, Artificial Sequence
  Synthetic Construct
gctgccaaatgaaaattgaccttcatg

SEQ ID NO: 3841 - DNA, 25 bp, Artificial Sequence
  Synthetic Construct
ccgtgacctaatgctgtatttctga

SEQ ID NO: 3842 - DNA, 22 bp, Artificial Sequence
  Synthetic Construct
gcaagatccactccctctctgt

SEQ ID NO: 3843 - DNA, 24 bp, Artificial Sequence
  Synthetic Construct
ctttaaaccaccagcctgacaaag

SEQ ID NO: 3844 - DNA, 24 bp, Artificial Sequence
  Synthetic Construct
ccgggtatgtcgtgatgaactaag

SEQ ID NO: 3845 - DNA, 26 bp, Artificial Sequence
  Synthetic Construct
gcaccagagacaaatttgcctcaaac

SEQ ID NO: 3846 - DNA, 19 bp, Artificial Sequence
  Synthetic Construct
agccagaccctgagcaagt

SEQ ID NO: 3847 - DNA, 21 bp, Artificial Sequence
  Synthetic Construct
tctgggcatctctgagcatca

SEQ ID NO: 3848 - DNA, 22 bp, Artificial Sequence
  Synthetic Construct
atcttcgtgcctcccaggttga

SEQ ID NO: 3849 - DNA, 27 bp, Artificial Sequence
  Synthetic Construct
cagcagtcccataatattcttggctta

SEQ ID NO: 3850 - DNA, 20 bp, Artificial Sequence
  Synthetic Construct
ctgccccttccgaggctact

SEQ ID NO: 3851 - DNA, 24 bp, Artificial Sequence
  Synthetic Construct
gaaaacatgggacacctgagtcat

SEQ ID NO: 3852 - DNA, 22 bp, Artificial Sequence
  Synthetic Construct
gagaggccatgtacacaaggtt

SEQ ID NO: 3853 - DNA, 24 bp, Artificial Sequence
  Synthetic Construct
ggcattagcagaagagggaacagt

SEQ ID NO: 3854 - DNA, 22 bp, Artificial Sequence
  Synthetic Construct
cttgcaaactgcccttctcagt

SEQ ID NO: 3855 - DNA, 19 bp, Artificial Sequence
  Synthetic Construct
aggggaggggcatcttagc

SEQ ID NO: 3856 - DNA, 24 bp, Artificial Sequence
  Synthetic Construct
gcctccaaaaccatccaaaatcca

SEQ ID NO: 3857 - DNA, 28 bp, Artificial Sequence
  Synthetic Construct
caaggaaagtatgcttgtaattggagtt

SEQ ID NO: 3858 - DNA, 23 bp, Artificial Sequence
  Synthetic Construct
ggtgttccctctctgtctctcta

SEQ ID NO: 3859 - DNA, 21 bp, Artificial Sequence
  Synthetic Construct
gctcatacagctggcaaaagg

SEQ ID NO: 3860 - DNA, 22 bp, Artificial Sequence
  Synthetic Construct
tccttgacaggctcttgctttg

SEQ ID NO: 3861 - DNA, 23 bp, Artificial Sequence
  Synthetic Construct
aaattgctgactcttgggacctt

SEQ ID NO: 3862 - DNA, 20 bp, Artificial Sequence
  Synthetic Construct
ctggagtgtgcctgcgttct

SEQ ID NO: 3863 - DNA, 22 bp, Artificial Sequence
  Synthetic Construct
ctccaaggcctagtttgctgaa

SEQ ID NO: 3864 - DNA, 18 bp, Artificial Sequence
  Synthetic Construct
cgcggctctcagtggaaa

SEQ ID NO: 3865 - DNA, 22 bp, Artificial Sequence
  Synthetic Construct
aaggtactgcctgtgtctacca

SEQ ID NO: 3866 - DNA, 24 bp, Artificial Sequence
  Synthetic Construct
gaatactttgagggctgacgtcaa

SEQ ID NO: 3867 - DNA, 20 bp, Artificial Sequence
  Synthetic Construct
gggttggggaagccctagtc

SEQ ID NO: 3868 - DNA, 26 bp, Artificial Sequence
  Synthetic Construct
tgagactgtcaccaaataagcctatc

SEQ ID NO: 3869 - DNA, 24 bp, Artificial Sequence
  Synthetic Construct
gggatcattgggtggtttctgtca

SEQ ID NO: 3870 - DNA, 23 bp, Artificial Sequence
  Synthetic Construct
accaccccagagattcagttgga

SEQ ID NO: 3871 - DNA, 22 bp, Artificial Sequence
  Synthetic Construct
gtgcccaagtggagtcatgttt

SEQ ID NO: 3872 - DNA, 23 bp, Artificial Sequence
  Synthetic Construct
ggagcgtaagagcctaactttgg

SEQ ID NO: 3873 - DNA, 27 bp, Artificial Sequence
  Synthetic Construct
ggttattgaagtccttgtcatggatga

SEQ ID NO: 3874 - DNA, 30 bp, Artificial Sequence
  Synthetic Construct
cctctttactaggatatctcccaggaatgt

SEQ ID NO: 3875 - DNA, 27 bp, Artificial Sequence
  Synthetic Construct
gcttagaatgagcatagtctacatgca

SEQ ID NO: 3876 - DNA, 24 bp, Artificial Sequence
  Synthetic Construct
cacccacctgttttggagatgttc

SEQ ID NO: 3877 - DNA, 18 bp, Artificial Sequence
  Synthetic Construct
gggcaggggtgcaaagca

SEQ ID NO: 3878 - DNA, 23 bp, Artificial Sequence
  Synthetic Construct
gcatctgcaactgtgtgatcttg

SEQ ID NO: 3879 - DNA, 21 bp, Artificial Sequence
  Synthetic Construct
aggcagaacccaaggatcctt

SEQ ID NO: 3880 - DNA, 20 bp, Artificial Sequence
  Synthetic Construct
agggaggatggcctgacatc

SEQ ID NO: 3881 - DNA, 25 bp, Artificial Sequence
  Synthetic Construct
cacttcccaaaaaggttccattgat

SEQ ID NO: 3882 - DNA, 24 bp, Artificial Sequence
  Synthetic Construct
ttcatcccttctgctttgtgaaga

SEQ ID NO: 3883 - DNA, 23 bp, Artificial Sequence
  Synthetic Construct
gatggtctctagggggctctatt

SEQ ID NO: 3884 - DNA, 25 bp, Artificial Sequence
  Synthetic Construct
ccactgaggctattcccctacaatt

SEQ ID NO: 3885 - DNA, 21 bp, Artificial Sequence
  Synthetic Construct
tgagtgggtggagagcttcct

SEQ ID NO: 3886 - DNA, 25 bp, Artificial Sequence
  Synthetic Construct
gagtcctctttttctctgcaatcct

SEQ ID NO: 3887 - DNA, 23 bp, Artificial Sequence
  Synthetic Construct
ctccgttcctcagtttaccacaa

SEQ ID NO: 3888 - DNA, 21 bp, Artificial Sequence
  Synthetic Construct
cctgaacagccacatgatgca

SEQ ID NO: 3889 - DNA, 22 bp, Artificial Sequence
  Synthetic Construct
agaccttagactggctggaagt

SEQ ID NO: 3890 - DNA, 24 bp, Artificial Sequence
  Synthetic Construct
ggggaagtatcactgatgcaagca

SEQ ID NO: 3891 - DNA, 23 bp, Artificial Sequence
  Synthetic Construct
gattggttgccaaagaggtcatc

SEQ ID NO: 3892 - DNA, 22 bp, Artificial Sequence
  Synthetic Construct
ccctgtgtcttcctctctccta

SEQ ID NO: 3893 - DNA, 23 bp, Artificial Sequence
  Synthetic Construct
caatttccctgtgtctggtgaca

SEQ ID NO: 3894 - DNA, 20 bp, Artificial Sequence
  Synthetic Construct
agccaggaacagagccaaga

SEQ ID NO: 3895 - DNA, 22 bp, Artificial Sequence
  Synthetic Construct
tggtccactgactggcatttgg

SEQ ID NO: 3896 - DNA, 25 bp, Artificial Sequence
  Synthetic Construct
tgccttcctaattaaccatcacact

SEQ ID NO: 3897 - DNA, 24 bp, Artificial Sequence
  Synthetic Construct
actccccaagacctttcagagatg

SEQ ID NO: 3898 - DNA, 19 bp, Artificial Sequence
  Synthetic Construct
gtgctgagcctgagatgct

SEQ ID NO: 3899 - DNA, 24 bp, Artificial Sequence
  Synthetic Construct
ctctgtttcaccttaggtcagtga

SEQ ID NO: 3900 - DNA, 22 bp, Artificial Sequence
  Synthetic Construct
ttcatgcatgaggctggatgaa

SEQ ID NO: 3901 - DNA, 19 bp, Artificial Sequence
  Synthetic Construct
agcacttccccagctgtga

SEQ ID NO: 3902 - DNA, 22 bp, Artificial Sequence
  Synthetic Construct
tttggcaggggaatggaaagat

SEQ ID NO: 3903 - DNA, 25 bp, Artificial Sequence
  Synthetic Construct
ggcacaattagagcagctactgtct

SEQ ID NO: 3904 - DNA, 25 bp, Artificial Sequence
  Synthetic Construct
tggcccatctatatctcagtgtgta

SEQ ID NO: 3905 - DNA, 23 bp, Artificial Sequence
  Synthetic Construct
gctgctttatgccaagagtgtac

SEQ ID NO: 3906 - DNA, 23 bp, Artificial Sequence
  Synthetic Construct
aggtggttcggtcagtccttaga

SEQ ID NO: 3907 - DNA, 19 bp, Artificial Sequence
  Synthetic Construct
tgctgctcttggcttggtt

SEQ ID NO: 3908 - DNA, 21 bp, Artificial Sequence
  Synthetic Construct
tcagcctgaacccaagtccaa

SEQ ID NO: 3909 - DNA, 22 bp, Artificial Sequence
  Synthetic Construct
aggtgacgcaaggtaacagttg

SEQ ID NO: 3910 - DNA, 28 bp, Artificial Sequence
  Synthetic Construct
ccccacaaatcattaagaggtctttacg

SEQ ID NO: 3911 - DNA, 24 bp, Artificial Sequence
  Synthetic Construct
gcacagtaatgtcaggagagtttg

SEQ ID NO: 3912 - DNA, 25 bp, Artificial Sequence
  Synthetic Construct
ggagacagttcttccttcaagatca

SEQ ID NO: 3913 - DNA, 26 bp, Artificial Sequence
  Synthetic Construct
tgtttccatgtcagttgatagaacct

SEQ ID NO: 3914 - DNA, 24 bp, Artificial Sequence
  Synthetic Construct
cagggacagtctgaagaactgatg

SEQ ID NO: 3915 - DNA, 25 bp, Artificial Sequence
  Synthetic Construct
aacagacatgtacattccccagaaa

SEQ ID NO: 3916 - DNA, 19 bp, Artificial Sequence
  Synthetic Construct
tgccctctgctgacacaga

SEQ ID NO: 3917 - DNA, 20 bp, Artificial Sequence
  Synthetic Construct
cctgcctctcagcctgaagt

SEQ ID NO: 3918 - DNA, 22 bp, Artificial Sequence
  Synthetic Construct
cacaggcagaagagcatctttg

SEQ ID NO: 3919 - DNA, 24 bp, Artificial Sequence
  Synthetic Construct
actgtaggtggtttgtaggagttg

SEQ ID NO: 3920 - DNA, 25 bp, Artificial Sequence
  Synthetic Construct
cctgtaccccagcctatttaattct

SEQ ID NO: 3921 - DNA, 27 bp, Artificial Sequence
  Synthetic Construct
cacactgtattagaatcagtgctgttt

SEQ ID NO: 3922 - DNA, 26 bp, Artificial Sequence
  Synthetic Construct
gccttcaatgacctttgacagctttc

SEQ ID NO: 3923 - DNA, 25 bp, Artificial Sequence
  Synthetic Construct
gtccaccctcacatggtttctattc

SEQ ID NO: 3924 - DNA, 20 bp, Artificial Sequence
  Synthetic Construct
tgctgcttggacaggtacct

SEQ ID NO: 3925 - DNA, 19 bp, Artificial Sequence
  Synthetic Construct
gggtggggaagcctctaca

SEQ ID NO: 3926 - DNA, 22 bp, Artificial Sequence
  Synthetic Construct
cctgagtgtccaagatgggttt

SEQ ID NO: 3927 - DNA, 21 bp, Artificial Sequence
  Synthetic Construct
ctatgcaccagcctccttctc

SEQ ID NO: 3928 - DNA, 19 bp, Artificial Sequence
  Synthetic Construct
ccctcgcgtgctgataagg

SEQ ID NO: 3929 - DNA, 23 bp, Artificial Sequence
  Synthetic Construct
gaccttttgccacttgagacgat

SEQ ID NO: 3930 - DNA, 23 bp, Artificial Sequence
  Synthetic Construct
caaacataagcatgagcgaaggt

SEQ ID NO: 3931 - DNA, 21 bp, Artificial Sequence
  Synthetic Construct
ttgtgaggccactgtgtctca

SEQ ID NO: 3932 - DNA, 22 bp, Artificial Sequence
  Synthetic Construct
tgctagaccctcagttctccat

SEQ ID NO: 3933 - DNA, 27 bp, Artificial Sequence
  Synthetic Construct
tgattatgacttgctttggtcaaaagg

SEQ ID NO: 3934 - DNA, 22 bp, Artificial Sequence
  Synthetic Construct
acagcacagcttttgagggaaa

SEQ ID NO: 3935 - DNA, 27 bp, Artificial Sequence
  Synthetic Construct
atcaatacatggtggttttgtttcctt

SEQ ID NO: 3936 - DNA, 24 bp, Artificial Sequence
  Synthetic Construct
gctctaaagcccactaccatgcaa

SEQ ID NO: 3937 - DNA, 25 bp, Artificial Sequence
  Synthetic Construct
cccgctaatgtgagtgcaggataaa

SEQ ID NO: 3938 - DNA, 27 bp, Artificial Sequence
  Synthetic Construct
ggaaagcaaaagatggaagagggaaaa

SEQ ID NO: 3939 - DNA, 24 bp, Artificial Sequence
  Synthetic Construct
ctgctgataacttttggtcaacgt

SEQ ID NO: 3940 - DNA, 23 bp, Artificial Sequence
  Synthetic Construct
cctcctgcaatagaaggcaaact

SEQ ID NO: 3941 - DNA, 22 bp, Artificial Sequence
  Synthetic Construct
ccagacaaaggtcagccctaat

SEQ ID NO: 3942 - DNA, 20 bp, Artificial Sequence
  Synthetic Construct
tccacgtctgtgtgctgatc

SEQ ID NO: 3943 - DNA, 19 bp, Artificial Sequence
  Synthetic Construct
tgctgggacccatgaacca

SEQ ID NO: 3944 - DNA, 21 bp, Artificial Sequence
  Synthetic Construct
ttagccaggcctcctcttctc

SEQ ID NO: 3945 - DNA, 27 bp, Artificial Sequence
  Synthetic Construct
tgtctcactggcaattaaactctaact

SEQ ID NO: 3946 - DNA, 19 bp, Artificial Sequence
  Synthetic Construct
accatggccaagcctgtca

SEQ ID NO: 3947 - DNA, 24 bp, Artificial Sequence
  Synthetic Construct
tgctgaagagtacccccagttttg

SEQ ID NO: 3948 - DNA, 20 bp, Artificial Sequence
  Synthetic Construct
cagctcacaggaagcagtca

SEQ ID NO: 3949 - DNA, 26 bp, Artificial Sequence
  Synthetic Construct
gtgaatttcttgtaggcagcagatag

SEQ ID NO: 3950 - DNA, 22 bp, Artificial Sequence
  Synthetic Construct
gctaaggcagccagtcctggaa

SEQ ID NO: 3951 - DNA, 28 bp, Artificial Sequence
  Synthetic Construct
gcttttgttttcaagtggcagaaaacac

SEQ ID NO: 3952 - DNA, 23 bp, Artificial Sequence
  Synthetic Construct
tcatggaatggtatccacaagca

SEQ ID NO: 3953 - DNA, 25 bp, Artificial Sequence
  Synthetic Construct
ggaaccagctgcagtagatctatag

SEQ ID NO: 3954 - DNA, 20 bp, Artificial Sequence
  Synthetic Construct
gattggtgcccaggaaacct

SEQ ID NO: 3955 - DNA, 24 bp, Artificial Sequence
  Synthetic Construct
gccctctttgccatctctacactt

SEQ ID NO: 3956 - DNA, 20 bp, Artificial Sequence
  Synthetic Construct
actccagccaggcaattcct

SEQ ID NO: 3957 - DNA, 22 bp, Artificial Sequence
  Synthetic Construct
ccatgcagcaacatctgtagtg

SEQ ID NO: 3958 - DNA, 22 bp, Artificial Sequence
  Synthetic Construct
caacttcaagtccctggagcaa

SEQ ID NO: 3959 - DNA, 21 bp, Artificial Sequence
  Synthetic Construct
ccagctgtgttctccagacaa

SEQ ID NO: 3960 - DNA, 19 bp, Artificial Sequence
  Synthetic Construct
gggctggagctcaggatca

SEQ ID NO: 3961 - DNA, 19 bp, Artificial Sequence
  Synthetic Construct
tccacctgcccctcagcaa

SEQ ID NO: 3962 - DNA, 27 bp, Artificial Sequence
  Synthetic Construct
gcagggaaagggtacacagttgtatag

SEQ ID NO: 3963 - DNA, 26 bp, Artificial Sequence
  Synthetic Construct
tttggttcaccttcatatcagtttcg

SEQ ID NO: 3964 - DNA, 22 bp, Artificial Sequence
  Synthetic Construct
tccaaaaccagctcctcctgaa

SEQ ID NO: 3965 - DNA, 24 bp, Artificial Sequence
  Synthetic Construct
gcactcccagaggtatgaacagat

SEQ ID NO: 3966 - DNA, 24 bp, Artificial Sequence
  Synthetic Construct
tgctctgagctacccatctccatt

SEQ ID NO: 3967 - DNA, 25 bp, Artificial Sequence
  Synthetic Construct
ggacaggacagtgatgattgctaga

SEQ ID NO: 3968 - DNA, 22 bp, Artificial Sequence
  Synthetic Construct
agggtgtggaggtatcgaagct

SEQ ID NO: 3969 - DNA, 24 bp, Artificial Sequence
  Synthetic Construct
cagagccctaggaacactatgtct

SEQ ID NO: 3970 - DNA, 24 bp, Artificial Sequence
  Synthetic Construct
gattagcatgagtgggaactgagt

SEQ ID NO: 3971 - DNA, 20 bp, Artificial Sequence
  Synthetic Construct
acccaagatggctgccaaca

SEQ ID NO: 3972 - DNA, 22 bp, Artificial Sequence
  Synthetic Construct
gctgacatgttgcccaagacta

SEQ ID NO: 3973 - DNA, 23 bp, Artificial Sequence
  Synthetic Construct
ccctagccttctgcatcataagg

SEQ ID NO: 3974 - DNA, 24 bp, Artificial Sequence
  Synthetic Construct
cctctctggtttggtgaagttacg

SEQ ID NO: 3975 - DNA, 23 bp, Artificial Sequence
  Synthetic Construct
gtagtgcctcccaaaatgtgact

SEQ ID NO: 3976 - DNA, 23 bp, Artificial Sequence
  Synthetic Construct
gacttgccccaaatctctgatca

SEQ ID NO: 3977 - DNA, 20 bp, Artificial Sequence
  Synthetic Construct
tcatggcttgcccttcaaca

SEQ ID NO: 3978 - DNA, 23 bp, Artificial Sequence
  Synthetic Construct
gtttcctgctagcactactctgt

SEQ ID NO: 3979 - DNA, 22 bp, Artificial Sequence
  Synthetic Construct
ggtcacagctgattggaccaaa

SEQ ID NO: 3980 - DNA, 23 bp, Artificial Sequence
  Synthetic Construct
gagaggagaagtctctggaaggt

SEQ ID NO: 3981 - DNA, 25 bp, Artificial Sequence
  Synthetic Construct
cccattttgcagtgaccttttactg

SEQ ID NO: 3982 - DNA, 26 bp, Artificial Sequence
  Synthetic Construct
ttattctgcccaccgagaatattaca

SEQ ID NO: 3983 - DNA, 21 bp, Artificial Sequence
  Synthetic Construct
aaaccttgccttcacctggaa

SEQ ID NO: 3984 - DNA, 24 bp, Artificial Sequence
  Synthetic Construct
tgctgagggatatttggggagagt

SEQ ID NO: 3985 - DNA, 22 bp, Artificial Sequence
  Synthetic Construct
ccttgaatctggctgacttggt

SEQ ID NO: 3986 - DNA, 22 bp, Artificial Sequence
  Synthetic Construct
tcttccaccccatatcccatca

SEQ ID NO: 3987 - DNA, 24 bp, Artificial Sequence
  Synthetic Construct
gcttcctaggaggtagtgaatgtc

SEQ ID NO: 3988 - DNA, 24 bp, Artificial Sequence
  Synthetic Construct
ccaccaattcaggaagctctccat

SEQ ID NO: 3989 - DNA, 24 bp, Artificial Sequence
  Synthetic Construct
ggatgaaggcagatccctgaaaca

SEQ ID NO: 3990 - DNA, 22 bp, Artificial Sequence
  Synthetic Construct
tgagatctgggatgcgtgcttt

SEQ ID NO: 3991 - DNA, 24 bp, Artificial Sequence
  Synthetic Construct
tggtgcaagagagggttacttcac

SEQ ID NO: 3992 - DNA, 21 bp, Artificial Sequence
  Synthetic Construct
agagtggagaagcaggacaga

SEQ ID NO: 3993 - DNA, 22 bp, Artificial Sequence
  Synthetic Construct
gagactcaatcctggcacttgt

SEQ ID NO: 3994 - DNA, 27 bp, Artificial Sequence
  Synthetic Construct
gacattggatagttcagagcaaatcca

SEQ ID NO: 3995 - DNA, 23 bp, Artificial Sequence
  Synthetic Construct
tgaatgttccaggcagaaggaat

SEQ ID NO: 3996 - DNA, 25 bp, Artificial Sequence
  Synthetic Construct
ggctttgaacaggaacacactatcc

SEQ ID NO: 3997 - DNA, 18 bp, Artificial Sequence
  Synthetic Construct
agctgctcctgggttcca

SEQ ID NO: 3998 - DNA, 26 bp, Artificial Sequence
  Synthetic Construct
tgctaatctaaacatggacctgagtt

SEQ ID NO: 3999 - DNA, 24 bp, Artificial Sequence
  Synthetic Construct
cctgattctgagccactgttccat

SEQ ID NO: 4000 - DNA, 26 bp, Artificial Sequence
  Synthetic Construct
cttatattgctgccatctggattcag

SEQ ID NO: 4001 - DNA, 20 bp, Artificial Sequence
  Synthetic Construct
accatagggcctctgttggt

SEQ ID NO: 4002 - DNA, 28 bp, Artificial Sequence
  Synthetic Construct
ttcatgtgtgtctttagtttcaaacact

SEQ ID NO: 4003 - DNA, 24 bp, Artificial Sequence
  Synthetic Construct
ggaagttctactcaaggcagagaa

SEQ ID NO: 4004 - DNA, 23 bp, Artificial Sequence
  Synthetic Construct
ctctctgaatgctccctcacatt

SEQ ID NO: 4005 - DNA, 27 bp, Artificial Sequence
  Synthetic Construct
agaaaagttttgttaccacttgcaatg

SEQ ID NO: 4006 - DNA, 21 bp, Artificial Sequence
  Synthetic Construct
ccaccactgccctgatatgac

SEQ ID NO: 4007 - DNA, 22 bp, Artificial Sequence
  Synthetic Construct
gctgagggtttgaatggggaaa

SEQ ID NO: 4008 - DNA, 27 bp, Artificial Sequence
  Synthetic Construct
gtagatgactgggttggttatgaaaac

SEQ ID NO: 4009 - DNA, 20 bp, Artificial Sequence
  Synthetic Construct
ccacagccagcagaaccata

SEQ ID NO: 4010 - DNA, 25 bp, Artificial Sequence
  Synthetic Construct
gactatgctcctcttcacaatttgg

SEQ ID NO: 4011 - DNA, 20 bp, Artificial Sequence
  Synthetic Construct
cacctcacaggatgcaccat

SEQ ID NO: 4012 - DNA, 22 bp, Artificial Sequence
  Synthetic Construct
acccagcccgaattctttgctt

SEQ ID NO: 4013 - DNA, 24 bp, Artificial Sequence
  Synthetic Construct
acagatagcgcttgtaaagttcca

SEQ ID NO: 4014 - DNA, 21 bp, Artificial Sequence
  Synthetic Construct
cgcaaagggcacttgttggat

SEQ ID NO: 4015 - DNA, 27 bp, Artificial Sequence
  Synthetic Construct
ctgctgaatttttaaggagaggaaggt

SEQ ID NO: 4016 - DNA, 22 bp, Artificial Sequence
  Synthetic Construct
ccagggtcacaaaaagcagaca

SEQ ID NO: 4017 - DNA, 25 bp, Artificial Sequence
  Synthetic Construct
ggcagatcaaaggaaccaggttttg

SEQ ID NO: 4018 - DNA, 25 bp, Artificial Sequence
  Synthetic Construct
gggatgacagtcaggaagtttttgg

SEQ ID NO: 4019 - DNA, 22 bp, Artificial Sequence
  Synthetic Construct
gcagttgggcagcagatattgt

SEQ ID NO: 4020 - DNA, 18 bp, Artificial Sequence
  Synthetic Construct
tgcccagccccacactgt

SEQ ID NO: 4021 - DNA, 19 bp, Artificial Sequence
  Synthetic Construct
agtaggggaggggcacatg

SEQ ID NO: 4022 - DNA, 24 bp, Artificial Sequence
  Synthetic Construct
gcttttaccaaagaacggctgttg

SEQ ID NO: 4023 - DNA, 20 bp, Artificial Sequence
  Synthetic Construct
atgggctctttgtgccacaa

SEQ ID NO: 4024 - DNA, 22 bp, Artificial Sequence
  Synthetic Construct
cctttatcccccatggcaagtt

SEQ ID NO: 4025 - DNA, 21 bp, Artificial Sequence
  Synthetic Construct
atcagcattggccagttctgt

SEQ ID NO: 4026 - DNA, 22 bp, Artificial Sequence
  Synthetic Construct
tgggccccactggatgtaaagt

SEQ ID NO: 4027 - DNA, 22 bp, Artificial Sequence
  Synthetic Construct
actcacaagggtgcaaggaatg

SEQ ID NO: 4028 - DNA, 23 bp, Artificial Sequence
  Synthetic Construct
agagcttcagaccctactgactt

SEQ ID NO: 4029 - DNA, 24 bp, Artificial Sequence
  Synthetic Construct
caagtgcaaaacatcatggttgga

SEQ ID NO: 4030 - DNA, 21 bp, Artificial Sequence
  Synthetic Construct
acggtggtcatgtctctacca

SEQ ID NO: 4031 - DNA, 22 bp, Artificial Sequence
  Synthetic Construct
tggccacacaacaggctcattt

SEQ ID NO: 4032 - DNA, 21 bp, Artificial Sequence
  Synthetic Construct
gccagttagtcacctgtgtga

SEQ ID NO: 4033 - DNA, 19 bp, Artificial Sequence
  Synthetic Construct
cacacccaggggcatgctt

SEQ ID NO: 4034 - DNA, 22 bp, Artificial Sequence
  Synthetic Construct
gcgctttctccacactctgttt

SEQ ID NO: 4035 - DNA, 22 bp, Artificial Sequence
  Synthetic Construct
tcctgcagtgaggcaaaacttc

SEQ ID NO: 4036 - DNA, 28 bp, Artificial Sequence
  Synthetic Construct
gagatcttaaggtgtcattgttcatagc

SEQ ID NO: 4037 - DNA, 25 bp, Artificial Sequence
  Synthetic Construct
cagaaggggtagaaaacagcctttc

SEQ ID NO: 4038 - DNA, 27 bp, Artificial Sequence
  Synthetic Construct
cctgagacacacttagtcactcctact

SEQ ID NO: 4039 - DNA, 21 bp, Artificial Sequence
  Synthetic Construct
tcaactgcagacccagaaacc

SEQ ID NO: 4040 - DNA, 22 bp, Artificial Sequence
  Synthetic Construct
tcttcagcaggtgtcaccagat

SEQ ID NO: 4041 - DNA, 22 bp, Artificial Sequence
  Synthetic Construct
atggctacagaccaggaaaagg

SEQ ID NO: 4042 - DNA, 22 bp, Artificial Sequence
  Synthetic Construct
tcaggtacagctcaacccatca

SEQ ID NO: 4043 - DNA, 21 bp, Artificial Sequence
  Synthetic Construct
ggggctgccaaaagtaaaacc

SEQ ID NO: 4044 - DNA, 27 bp, Artificial Sequence
  Synthetic Construct
cctgccaactgttctttgatcctctag

SEQ ID NO: 4045 - DNA, 21 bp, Artificial Sequence
  Synthetic Construct
agcagcaagcagcctattctg

SEQ ID NO: 4046 - DNA, 24 bp, Artificial Sequence
  Synthetic Construct
agcagggatcacagcattatactc

SEQ ID NO: 4047 - DNA, 19 bp, Artificial Sequence
  Synthetic Construct
aggcccacacaccccatga

SEQ ID NO: 4048 - DNA, 24 bp, Artificial Sequence
  Synthetic Construct
tcactggcttcttccctgagtaag

SEQ ID NO: 4049 - DNA, 21 bp, Artificial Sequence
  Synthetic Construct
gttgtttctgtgccccttcca

SEQ ID NO: 4050 - DNA, 22 bp, Artificial Sequence
  Synthetic Construct
tgttgtggagtgagtgcaagtt

SEQ ID NO: 4051 - DNA, 23 bp, Artificial Sequence
  Synthetic Construct
aacactggtctctggtagaagga

SEQ ID NO: 4052 - DNA, 22 bp, Artificial Sequence
  Synthetic Construct
tgacccctctggctatcacatt

SEQ ID NO: 4053 - DNA, 21 bp, Artificial Sequence
  Synthetic Construct
cactgggaggggtaacaagga

SEQ ID NO: 4054 - DNA, 22 bp, Artificial Sequence
  Synthetic Construct
acaactctgaagtgagcgttgt

SEQ ID NO: 4055 - DNA, 22 bp, Artificial Sequence
  Synthetic Construct
gcctgacatacatcctgggaaa

SEQ ID NO: 4056 - DNA, 20 bp, Artificial Sequence
  Synthetic Construct
ccctgcctccccaacagtga

SEQ ID NO: 4057 - DNA, 23 bp, Artificial Sequence
  Synthetic Construct
aggctacactcgagggatcttct

SEQ ID NO: 4058 - DNA, 25 bp, Artificial Sequence
  Synthetic Construct
tcattcatagcagtgcaagaatgga

SEQ ID NO: 4059 - DNA, 22 bp, Artificial Sequence
  Synthetic Construct
accttgcctggtatgggttgaa

SEQ ID NO: 4060 - DNA, 24 bp, Artificial Sequence
  Synthetic Construct
aataaaagtcctctgccgaagaca

SEQ ID NO: 4061 - DNA, 24 bp, Artificial Sequence
  Synthetic Construct
cctcttccctttcctactgtcaca

SEQ ID NO: 4062 - DNA, 24 bp, Artificial Sequence
  Synthetic Construct
atgaatcctgccatgtaggtgtag

SEQ ID NO: 4063 - DNA, 25 bp, Artificial Sequence
  Synthetic Construct
catgtatagcccttcctcctttctt

SEQ ID NO: 4064 - DNA, 23 bp, Artificial Sequence
  Synthetic Construct
cagcatgggaatttgggtagaca

SEQ ID NO: 4065 - DNA, 24 bp, Artificial Sequence
  Synthetic Construct
ggtctcagactaggcagaatttgg

SEQ ID NO: 4066 - DNA, 27 bp, Artificial Sequence
  Synthetic Construct
tgtggactttatttgaatggagactga

SEQ ID NO: 4067 - DNA, 20 bp, Artificial Sequence
  Synthetic Construct
tctgcaggccatctctgcat

SEQ ID NO: 4068 - DNA, 24 bp, Artificial Sequence
  Synthetic Construct
accagagccctccattcctaaact

SEQ ID NO: 4069 - DNA, 18 bp, Artificial Sequence
  Synthetic Construct
ccaggaggcgggaatcac

SEQ ID NO: 4070 - DNA, 29 bp, Artificial Sequence
  Synthetic Construct
ctgatcaaatttagtctggatgtgaccaa

SEQ ID NO: 4071 - DNA, 20 bp, Artificial Sequence
  Synthetic Construct
taggtgccatggcccagaca

SEQ ID NO: 4072 - DNA, 20 bp, Artificial Sequence
  Synthetic Construct
gcagaggctctgtgctatgt

SEQ ID NO: 4073 - DNA, 23 bp, Artificial Sequence
  Synthetic Construct
tgggggaatgaatggaagatgag

SEQ ID NO: 4074 - DNA, 24 bp, Artificial Sequence
  Synthetic Construct
gactaccctttgcaattggaagca

SEQ ID NO: 4075 - DNA, 22 bp, Artificial Sequence
  Synthetic Construct
caacagacctggctaggagcta

SEQ ID NO: 4076 - DNA, 18 bp, Artificial Sequence
  Synthetic Construct
agccctgtggtgccaaac

SEQ ID NO: 4077 - DNA, 25 bp, Artificial Sequence
  Synthetic Construct
ctgcatgaagtattctgcactactg

SEQ ID NO: 4078 - DNA, 24 bp, Artificial Sequence
  Synthetic Construct
caaactccctttggctagagagaa

SEQ ID NO: 4079 - DNA, 22 bp, Artificial Sequence
  Synthetic Construct
cactgggttagatcgccagttt

SEQ ID NO: 4080 - DNA, 22 bp, Artificial Sequence
  Synthetic Construct
tcctggtgatgtgggggaatat

SEQ ID NO: 4081 - DNA, 24 bp, Artificial Sequence
  Synthetic Construct
gctaggattcctgggtgttctgtt

SEQ ID NO: 4082 - DNA, 22 bp, Artificial Sequence
  Synthetic Construct
tctgggagccgaaattccttct

SEQ ID NO: 4083 - DNA, 24 bp, Artificial Sequence
  Synthetic Construct
gaacttaccaaggtagccagatgt

SEQ ID NO: 4084 - DNA, 22 bp, Artificial Sequence
  Synthetic Construct
caagatgctcaccccatacctt

SEQ ID NO: 4085 - DNA, 24 bp, Artificial Sequence
  Synthetic Construct
cccggccatcctgaattttattgc

SEQ ID NO: 4086 - DNA, 22 bp, Artificial Sequence
  Synthetic Construct
agaggactgggctcttgctatt

SEQ ID NO: 4087 - DNA, 20 bp, Artificial Sequence
  Synthetic Construct
ctggggccagtcatccctat

SEQ ID NO: 4088 - DNA, 20 bp, Artificial Sequence
  Synthetic Construct
tgaggcagggtgggctatca

SEQ ID NO: 4089 - DNA, 20 bp, Artificial Sequence
  Synthetic Construct
tgctcagttccacccaaacc

SEQ ID NO: 4090 - DNA, 25 bp, Artificial Sequence
  Synthetic Construct
aggctatatgagagcaggctaatct

SEQ ID NO: 4091 - DNA, 22 bp, Artificial Sequence
  Synthetic Construct
gcaacgggagggaaaagtttct

SEQ ID NO: 4092 - DNA, 22 bp, Artificial Sequence
  Synthetic Construct
tcccacctcctgtctcttgaga

SEQ ID NO: 4093 - DNA, 24 bp, Artificial Sequence
  Synthetic Construct
cccattggccataactcagctaca

SEQ ID NO: 4094 - DNA, 24 bp, Artificial Sequence
  Synthetic Construct
ggggccataacttctggattgtgt

SEQ ID NO: 4095 - DNA, 20 bp, Artificial Sequence
  Synthetic Construct
acctctgaggcaaggacctt

SEQ ID NO: 4096 - DNA, 25 bp, Artificial Sequence
  Synthetic Construct
ctaactgcacagagaagagcaaatg

SEQ ID NO: 4097 - DNA, 22 bp, Artificial Sequence
  Synthetic Construct
cgctgttcctgaatgccattag

SEQ ID NO: 4098 - DNA, 26 bp, Artificial Sequence
  Synthetic Construct
ctgagtaggacagtgatgttgtcaga

SEQ ID NO: 4099 - DNA, 22 bp, Artificial Sequence
  Synthetic Construct
agacctcttcgcctctttgttc

SEQ ID NO: 4100 - DNA, 27 bp, Artificial Sequence
  Synthetic Construct
gcaaaatgagagtaaaatgctgctgaa

SEQ ID NO: 4101 - DNA, 24 bp, Artificial Sequence
  Synthetic Construct
cctcctaaaaagccagtccctctt

SEQ ID NO: 4102 - DNA, 22 bp, Artificial Sequence
  Synthetic Construct
aacccagagacacacctatcct

SEQ ID NO: 4103 - DNA, 26 bp, Artificial Sequence
  Synthetic Construct
gcaggtctatacaatcctacccacaa

SEQ ID NO: 4104 - DNA, 22 bp, Artificial Sequence
  Synthetic Construct
tccctgtccttgacgcttaact

SEQ ID NO: 4105 - DNA, 24 bp, Artificial Sequence
  Synthetic Construct
cagagggtaataagtggcgcctta

SEQ ID NO: 4106 - DNA, 21 bp, Artificial Sequence
  Synthetic Construct
acccacgtggtctcagagtct

SEQ ID NO: 4107 - DNA, 22 bp, Artificial Sequence
  Synthetic Construct
aagcattcccttcctcctgcaa

SEQ ID NO: 4108 - DNA, 22 bp, Artificial Sequence
  Synthetic Construct
acccctcacttccaaccttttg

SEQ ID NO: 4109 - DNA, 24 bp, Artificial Sequence
  Synthetic Construct
ctggtggcatgagcaacttatagt

SEQ ID NO: 4110 - DNA, 24 bp, Artificial Sequence
  Synthetic Construct
ctgacttcctcccctcaattttct

SEQ ID NO: 4111 - DNA, 22 bp, Artificial Sequence
  Synthetic Construct
aggaaacgtcccctgctcacta

SEQ ID NO: 4112 - DNA, 24 bp, Artificial Sequence
  Synthetic Construct
gagtagattggaaggggcaaacag

SEQ ID NO: 4113 - DNA, 21 bp, Artificial Sequence
  Synthetic Construct
ctgacaacactcccagcaagt

SEQ ID NO: 4114 - DNA, 20 bp, Artificial Sequence
  Synthetic Construct
ggatgaaggccaggctgtag

SEQ ID NO: 4115 - DNA, 27 bp, Artificial Sequence
  Synthetic Construct
cgcttaagtgttcattgcctataacac

SEQ ID NO: 4116 - DNA, 23 bp, Artificial Sequence
  Synthetic Construct
cctctcctcagatgcctgtttct

SEQ ID NO: 4117 - DNA, 24 bp, Artificial Sequence
  Synthetic Construct
agacctactcatcccttgcttaga

SEQ ID NO: 4118 - DNA, 23 bp, Artificial Sequence
  Synthetic Construct
gttcaaacggtgctagcttagac

SEQ ID NO: 4119 - DNA, 26 bp, Artificial Sequence
  Synthetic Construct
acaacggtaagtgtatgatcatgtct

SEQ ID NO: 4120 - DNA, 22 bp, Artificial Sequence
  Synthetic Construct
aagttggtcagggaaggcagat

SEQ ID NO: 4121 - DNA, 22 bp, Artificial Sequence
  Synthetic Construct
cttggcactgtcccagttctaa

SEQ ID NO: 4122 - DNA, 26 bp, Artificial Sequence
  Synthetic Construct
catgactcatagaccctctactcaac

SEQ ID NO: 4123 - DNA, 22 bp, Artificial Sequence
  Synthetic Construct
gcaggcttcttgaggtcaagga

SEQ ID NO: 4124 - DNA, 20 bp, Artificial Sequence
  Synthetic Construct
atggtgactcgtggggtcat

SEQ ID NO: 4125 - DNA, 22 bp, Artificial Sequence
  Synthetic Construct
agctggatcctccggacaaaga

SEQ ID NO: 4126 - DNA, 24 bp, Artificial Sequence
  Synthetic Construct
gccttctcgacccatctgtgataa

SEQ ID NO: 4127 - DNA, 24 bp, Artificial Sequence
  Synthetic Construct
cctttaccttgacacgggacaaac

SEQ ID NO: 4128 - DNA, 24 bp, Artificial Sequence
  Synthetic Construct
tcccatgaaccacttttcctaagg

SEQ ID NO: 4129 - DNA, 22 bp, Artificial Sequence
  Synthetic Construct
tgtagagagccatgtccctgaa

SEQ ID NO: 4130 - DNA, 25 bp, Artificial Sequence
  Synthetic Construct
tgttccctgcagataccagttattg

SEQ ID NO: 4131 - DNA, 20 bp, Artificial Sequence
  Synthetic Construct
atgcaggctctggatttgca

SEQ ID NO: 4132 - DNA, 23 bp, Artificial Sequence
  Synthetic Construct
ggtgagaggcaagagaaagtctt

SEQ ID NO: 4133 - DNA, 26 bp, Artificial Sequence
  Synthetic Construct
gggggaggctttattcaaaaggagaa

SEQ ID NO: 4134 - DNA, 24 bp, Artificial Sequence
  Synthetic Construct
ggcagatagggaagagtctagact

SEQ ID NO: 4135 - DNA, 21 bp, Artificial Sequence
  Synthetic Construct
tggctcctgaactttggcttt

SEQ ID NO: 4136 - DNA, 21 bp, Artificial Sequence
  Synthetic Construct
tggcttctagtggccttttcc

SEQ ID NO: 4137 - DNA, 22 bp, Artificial Sequence
  Synthetic Construct
gccccttggtctctactcagta

SEQ ID NO: 4138 - DNA, 24 bp, Artificial Sequence
  Synthetic Construct
tctacacttcctacacagcttcac

SEQ ID NO: 4139 - DNA, 23 bp, Artificial Sequence
  Synthetic Construct
tgggaggatgttcacttctagct

SEQ ID NO: 4140 - DNA, 24 bp, Artificial Sequence
  Synthetic Construct
accggtaaagcagtactacaggta

SEQ ID NO: 4141 - DNA, 24 bp, Artificial Sequence
  Synthetic Construct
gctacctcgatccactttctaaca

SEQ ID NO: 4142 - DNA, 21 bp, Artificial Sequence
  Synthetic Construct
ttagcacccctgcggctttca

SEQ ID NO: 4143 - DNA, 22 bp, Artificial Sequence
  Synthetic Construct
gacagctgaaagggttggatgt

SEQ ID NO: 4144 - DNA, 24 bp, Artificial Sequence
  Synthetic Construct
gcacagctaatatgagggcagagt

SEQ ID NO: 4145 - DNA, 22 bp, Artificial Sequence
  Synthetic Construct
aaagccacaggactggaagaga

SEQ ID NO: 4146 - DNA, 26 bp, Artificial Sequence
  Synthetic Construct
gtgagggtagaaccagaatcaattcc

SEQ ID NO: 4147 - DNA, 26 bp, Artificial Sequence
  Synthetic Construct
gactggcattacatcttagtcactgt

SEQ ID NO: 4148 - DNA, 24 bp, Artificial Sequence
  Synthetic Construct
ggttttcttcctgttctccttggt

SEQ ID NO: 4149 - DNA, 24 bp, Artificial Sequence
  Synthetic Construct
gctttgtttgctactgatgcattg

SEQ ID NO: 4150 - DNA, 27 bp, Artificial Sequence
  Synthetic Construct
ctgcagctttatttttacacacttgct

SEQ ID NO: 4151 - DNA, 25 bp, Artificial Sequence
  Synthetic Construct
ctcatcaatgcctccttccttgaac

SEQ ID NO: 4152 - DNA, 26 bp, Artificial Sequence
  Synthetic Construct
cccaccaaatacaggatagctttgag

SEQ ID NO: 4153 - DNA, 27 bp, Artificial Sequence
  Synthetic Construct
cctgtcctatgcacccaaaattatgct

SEQ ID NO: 4154 - DNA, 23 bp, Artificial Sequence
  Synthetic Construct
ccacctgtaccctgtggtatgaa

SEQ ID NO: 4155 - DNA, 23 bp, Artificial Sequence
  Synthetic Construct
tttcccccatgtcttccataacc

SEQ ID NO: 4156 - DNA, 20 bp, Artificial Sequence
  Synthetic Construct
gccagaagccaggtgtcctt

SEQ ID NO: 4157 - DNA, 21 bp, Artificial Sequence
  Synthetic Construct
agtccctgtgtgagtccaact

SEQ ID NO: 4158 - DNA, 22 bp, Artificial Sequence
  Synthetic Construct
cacctatgcccacatacacaca

SEQ ID NO: 4159 - DNA, 23 bp, Artificial Sequence
  Synthetic Construct
gccttctatgtttctggccaact

SEQ ID NO: 4160 - DNA, 23 bp, Artificial Sequence
  Synthetic Construct
acatgctttgagctctgatggtt

SEQ ID NO: 4161 - DNA, 25 bp, Artificial Sequence
  Synthetic Construct
gcctcaagctatgtcttgtctgcat

SEQ ID NO: 4162 - DNA, 24 bp, Artificial Sequence
  Synthetic Construct
gcattgcaacctccatttctagct

SEQ ID NO: 4163 - DNA, 24 bp, Artificial Sequence
  Synthetic Construct
caaatcctcaccctttaggcatca

SEQ ID NO: 4164 - DNA, 20 bp, Artificial Sequence
  Synthetic Construct
gtcactgccagccaaatcct

SEQ ID NO: 4165 - DNA, 26 bp, Artificial Sequence
  Synthetic Construct
gctcatctttgtatctccagcagtga

SEQ ID NO: 4166 - DNA, 24 bp, Artificial Sequence
  Synthetic Construct
ctcagcttcctcatctcacaagga

SEQ ID NO: 4167 - DNA, 20 bp, Artificial Sequence
  Synthetic Construct
gatcccccagttccctccaa

SEQ ID NO: 4168 - DNA, 24 bp, Artificial Sequence
  Synthetic Construct
ggagattccttgaacatggagtct

SEQ ID NO: 4169 - DNA, 20 bp, Artificial Sequence
  Synthetic Construct
gcccactcagctccacacaa

SEQ ID NO: 4170 - DNA, 24 bp, Artificial Sequence
  Synthetic Construct
actcccagtgatccgacaaactat

SEQ ID NO: 4171 - DNA, 22 bp, Artificial Sequence
  Synthetic Construct
cctctgcacttgcttgttacgt

SEQ ID NO: 4172 - DNA, 21 bp, Artificial Sequence
  Synthetic Construct
aaaacctcctggtcccttcca

SEQ ID NO: 4173 - DNA, 24 bp, Artificial Sequence
  Synthetic Construct
ctggaaaattctgtggcaggctat

SEQ ID NO: 4174 - DNA, 24 bp, Artificial Sequence
  Synthetic Construct
gaaggtgtctgactatgccagttc

SEQ ID NO: 4175 - DNA, 20 bp, Artificial Sequence
  Synthetic Construct
agggatggggaacagaagca

SEQ ID NO: 4176 - DNA, 22 bp, Artificial Sequence
  Synthetic Construct
accccagaggaccctgatctta

SEQ ID NO: 4177 - DNA, 21 bp, Artificial Sequence
  Synthetic Construct
acctctcccctcccagaacat

SEQ ID NO: 4178 - DNA, 23 bp, Artificial Sequence
  Synthetic Construct
tgaaatcccgtgaaaccctgtga

SEQ ID NO: 4179 - DNA, 25 bp, Artificial Sequence
  Synthetic Construct
ccccactccctatgttttaggacat

SEQ ID NO: 4180 - DNA, 22 bp, Artificial Sequence
  Synthetic Construct
ggaaacctgctctccattgtga

SEQ ID NO: 4181 - DNA, 22 bp, Artificial Sequence
  Synthetic Construct
gggtgtccctaagatgcatcac

SEQ ID NO: 4182 - DNA, 20 bp, Artificial Sequence
  Synthetic Construct
ccttagtgctggtgctcgtt

SEQ ID NO: 4183 - DNA, 20 bp, Artificial Sequence
  Synthetic Construct
tggctgccaagtggatgctt

SEQ ID NO: 4184 - DNA, 22 bp, Artificial Sequence
  Synthetic Construct
tgcttccggatgtctacaccaa

SEQ ID NO: 4185 - DNA, 21 bp, Artificial Sequence
  Synthetic Construct
gcctcaggcacaagtgttgct

SEQ ID NO: 4186 - DNA, 25 bp, Artificial Sequence
  Synthetic Construct
ccgtcctacctctaaacacagaaca

SEQ ID NO: 4187 - DNA, 22 bp, Artificial Sequence
  Synthetic Construct
agaaggaacctgacagctctgt

SEQ ID NO: 4188 - DNA, 18 bp, Artificial Sequence
  Synthetic Construct
ccagggggaggccactta

SEQ ID NO: 4189 - DNA, 22 bp, Artificial Sequence
  Synthetic Construct
gtggcatgcagtctaggaactt

SEQ ID NO: 4190 - DNA, 20 bp, Artificial Sequence
  Synthetic Construct
gcagccttcccagctgaaga

SEQ ID NO: 4191 - DNA, 22 bp, Artificial Sequence
  Synthetic Construct
ccccctgaaaagcttgtccaat

SEQ ID NO: 4192 - DNA, 20 bp, Artificial Sequence
  Synthetic Construct
cctgcacagggctctgctat

SEQ ID NO: 4193 - DNA, 23 bp, Artificial Sequence
  Synthetic Construct
acctaagactagtgccgtgaagt

SEQ ID NO: 4194 - DNA, 27 bp, Artificial Sequence
  Synthetic Construct
gccaactgacagttatctggtgaagtc

SEQ ID NO: 4195 - DNA, 24 bp, Artificial Sequence
  Synthetic Construct
gctctttttgcccactcttcttca

SEQ ID NO: 4196 - DNA, 20 bp, Artificial Sequence
  Synthetic Construct
tccaagcaacccaacttgca

SEQ ID NO: 4197 - DNA, 24 bp, Artificial Sequence
  Synthetic Construct
gctggaacttcaaagtcccagagt

SEQ ID NO: 4198 - DNA, 27 bp, Artificial Sequence
  Synthetic Construct
tcaaccaatcaccagataactgttgat

SEQ ID NO: 4199 - DNA, 28 bp, Artificial Sequence
  Synthetic Construct
gcaaatagtgctgtgtgtagtgaataca

SEQ ID NO: 4200 - DNA, 22 bp, Artificial Sequence
  Synthetic Construct
gggtgattccgatgctcactta

SEQ ID NO: 4201 - DNA, 26 bp, Artificial Sequence
  Synthetic Construct
ccaacaaccacatgagtttggttgag

SEQ ID NO: 4202 - DNA, 18 bp, Artificial Sequence
  Synthetic Construct
atgcgggcttgctgcata

SEQ ID NO: 4203 - DNA, 24 bp, Artificial Sequence
  Synthetic Construct
gggccacttactcaaagcttcttg

SEQ ID NO: 4204 - DNA, 21 bp, Artificial Sequence
  Synthetic Construct
ttctcctcctgagggcttgct

SEQ ID NO: 4205 - DNA, 23 bp, Artificial Sequence
  Synthetic Construct
caagccatgtctagaaggaaggt

SEQ ID NO: 4206 - DNA, 23 bp, Artificial Sequence
  Synthetic Construct
ctgtcctgcagattccctttgat

SEQ ID NO: 4207 - DNA, 23 bp, Artificial Sequence
  Synthetic Construct
cccaatgaagagagcatggcatt

SEQ ID NO: 4208 - DNA, 23 bp, Artificial Sequence
  Synthetic Construct
ggctaagcaacacacatgtctac

SEQ ID NO: 4209 - DNA, 24 bp, Artificial Sequence
  Synthetic Construct
gcacattctgccccccagatattt

SEQ ID NO: 4210 - DNA, 28 bp, Artificial Sequence
  Synthetic Construct
caatatgggaatcagagggacttaaaac

SEQ ID NO: 4211 - DNA, 21 bp, Artificial Sequence
  Synthetic Construct
tgtcctggtgctctcaatgtc

SEQ ID NO: 4212 - DNA, 25 bp, Artificial Sequence
  Synthetic Construct
ggttgtaactcctgaccgtaatacg

SEQ ID NO: 4213 - DNA, 18 bp, Artificial Sequence
  Synthetic Construct
gggccactgtcgtttgca

SEQ ID NO: 4214 - DNA, 22 bp, Artificial Sequence
  Synthetic Construct
aggccctgaaggagtgagttca

SEQ ID NO: 4215 - DNA, 26 bp, Artificial Sequence
  Synthetic Construct
gagatagtgtcctttgtgtctgaaca

SEQ ID NO: 4216 - DNA, 22 bp, Artificial Sequence
  Synthetic Construct
ggcgtgttgggattttaaacca

SEQ ID NO: 4217 - DNA, 28 bp, Artificial Sequence
  Synthetic Construct
gtgatctatcagttgcaattcagatagc

SEQ ID NO: 4218 - DNA, 27 bp, Artificial Sequence
  Synthetic Construct
tgtggaccaggttaattacattgtctt

SEQ ID NO: 4219 - DNA, 18 bp, Artificial Sequence
  Synthetic Construct
gcgctgccctactttgct

SEQ ID NO: 4220 - DNA, 25 bp, Artificial Sequence
  Synthetic Construct
acaagcagagggagaaataggtcta

SEQ ID NO: 4221 - DNA, 24 bp, Artificial Sequence
  Synthetic Construct
cagttgttaggcagacatcggata

SEQ ID NO: 4222 - DNA, 21 bp, Artificial Sequence
  Synthetic Construct
caccccactcccattgtttga

SEQ ID NO: 4223 - DNA, 24 bp, Artificial Sequence
  Synthetic Construct
cctcccacaattttacccatgtct

SEQ ID NO: 4224 - DNA, 26 bp, Artificial Sequence
  Synthetic Construct
actctgagttgtgtcaaactatcact

SEQ ID NO: 4225 - DNA, 24 bp, Artificial Sequence
  Synthetic Construct
cagtagtttccccaacctcaatgg

SEQ ID NO: 4226 - DNA, 23 bp, Artificial Sequence
  Synthetic Construct
ggcaatgcgaatgagttcctaca

SEQ ID NO: 4227 - DNA, 26 bp, Artificial Sequence
  Synthetic Construct
ccataggtaatcatacgccctgaatc

SEQ ID NO: 4228 - DNA, 27 bp, Artificial Sequence
  Synthetic Construct
gagtttttgagcctagaatgtaaagct

SEQ ID NO: 4229 - DNA, 23 bp, Artificial Sequence
  Synthetic Construct
ggcctgacccatgatgaatagtt

SEQ ID NO: 4230 - DNA, 25 bp, Artificial Sequence
  Synthetic Construct
ccaggtttaaacccacactttatcc

SEQ ID NO: 4231 - DNA, 20 bp, Artificial Sequence
  Synthetic Construct
tggcacagagcagtcactgt

SEQ ID NO: 4232 - DNA, 22 bp, Artificial Sequence
  Synthetic Construct
tgcgaccacagaagtgcaaagt

SEQ ID NO: 4233 - DNA, 21 bp, Artificial Sequence
  Synthetic Construct
aaaacctgtgagggagttgca

SEQ ID NO: 4234 - DNA, 24 bp, Artificial Sequence
  Synthetic Construct
cgggggtactatttctgagatgag

SEQ ID NO: 4235 - DNA, 22 bp, Artificial Sequence
  Synthetic Construct
ctcaaactaccggtctcaagca

SEQ ID NO: 4236 - DNA, 22 bp, Artificial Sequence
  Synthetic Construct
tggcagttggtactagctgcta

SEQ ID NO: 4237 - DNA, 23 bp, Artificial Sequence
  Synthetic Construct
agctgctgcttcacctctttagc

SEQ ID NO: 4238 - DNA, 22 bp, Artificial Sequence
  Synthetic Construct
agcaagctcaaaccccagaagt

SEQ ID NO: 4239 - DNA, 24 bp, Artificial Sequence
  Synthetic Construct
ctctgccaattgttactccagcaa

SEQ ID NO: 4240 - DNA, 21 bp, Artificial Sequence
  Synthetic Construct
tcctgcaatgctgggaaagtg

SEQ ID NO: 4241 - DNA, 25 bp, Artificial Sequence
  Synthetic Construct
ctgaaattccagagggaggtctaag

SEQ ID NO: 4242 - DNA, 25 bp, Artificial Sequence
  Synthetic Construct
gactcgtcttgataggtgatttcca

SEQ ID NO: 4243 - DNA, 23 bp, Artificial Sequence
  Synthetic Construct
ctgttcctaaactgcagcaaagg

SEQ ID NO: 4244 - DNA, 30 bp, Artificial Sequence
  Synthetic Construct
ctctgttgatgaaggtatattccctatagc

SEQ ID NO: 4245 - DNA, 25 bp, Artificial Sequence
  Synthetic Construct
gcctactaacactgggttacaaagg

SEQ ID NO: 4246 - DNA, 21 bp, Artificial Sequence
  Synthetic Construct
tgacaaggagctgacctacct

SEQ ID NO: 4247 - DNA, 27 bp, Artificial Sequence
  Synthetic Construct
cccgcatagaaaagatgattccttggt

SEQ ID NO: 4248 - DNA, 25 bp, Artificial Sequence
  Synthetic Construct
gactgacgttctcaatgtatgcatt

SEQ ID NO: 4249 - DNA, 27 bp, Artificial Sequence
  Synthetic Construct
gaaagttctccttaagtgtctttgcaa

SEQ ID NO: 4250 - DNA, 26 bp, Artificial Sequence
  Synthetic Construct
gccttagaactccatctagacctgta

SEQ ID NO: 4251 - DNA, 25 bp, Artificial Sequence
  Synthetic Construct
gtgccagaaaaacttggtcatttgg

SEQ ID NO: 4252 - DNA, 25 bp, Artificial Sequence
  Synthetic Construct
ccctgtgataaggagggttgttttg

SEQ ID NO: 4253 - DNA, 22 bp, Artificial Sequence
  Synthetic Construct
tgtgacagagaggacagacact

SEQ ID NO: 4254 - DNA, 25 bp, Artificial Sequence
  Synthetic Construct
ctctttttgggtgcacatactcttg

SEQ ID NO: 4255 - DNA, 26 bp, Artificial Sequence
  Synthetic Construct
tgtcttagcatgtctttgttcctaca

SEQ ID NO: 4256 - DNA, 22 bp, Artificial Sequence
  Synthetic Construct
tgtcaggagggcactttcctat

SEQ ID NO: 4257 - DNA, 24 bp, Artificial Sequence
  Synthetic Construct
gcaaatgtgaccctaggcagaaac

SEQ ID NO: 4258 - DNA, 22 bp, Artificial Sequence
  Synthetic Construct
ttgactaacacgtcacgacact

SEQ ID NO: 4259 - DNA, 24 bp, Artificial Sequence
  Synthetic Construct
ccagagtcattacttctgcatgca

SEQ ID NO: 4260 - DNA, 28 bp, Artificial Sequence
  Synthetic Construct
gcagtctaggttttgttggttattcagt

SEQ ID NO: 4261 - DNA, 20 bp, Artificial Sequence
  Synthetic Construct
gccagtgtttgcaccttgga

SEQ ID NO: 4262 - DNA, 24 bp, Artificial Sequence
  Synthetic Construct
gagagccatattccacaagcaaca

SEQ ID NO: 4263 - DNA, 27 bp, Artificial Sequence
  Synthetic Construct
ggaactatttcctggagcctactgttt

SEQ ID NO: 4264 - DNA, 23 bp, Artificial Sequence
  Synthetic Construct
agacgtgttgtgttcaatgcatt

SEQ ID NO: 4265 - DNA, 20 bp, Artificial Sequence
  Synthetic Construct
atggggcagagggagaagca

SEQ ID NO: 4266 - DNA, 21 bp, Artificial Sequence
  Synthetic Construct
tggcctgaaaggatggttctg

SEQ ID NO: 4267 - DNA, 20 bp, Artificial Sequence
  Synthetic Construct
ctgccacatccttgctagct

SEQ ID NO: 4268 - DNA, 20 bp, Artificial Sequence
  Synthetic Construct
tctcccacccactgtaacca

SEQ ID NO: 4269 - DNA, 23 bp, Artificial Sequence
  Synthetic Construct
gcaaatcagtggaacatgttggt

SEQ ID NO: 4270 - DNA, 22 bp, Artificial Sequence
  Synthetic Construct
tgatagctgaggccaggtcata

SEQ ID NO: 4271 - DNA, 20 bp, Artificial Sequence
  Synthetic Construct
tcaatggcttggccctctga

SEQ ID NO: 4272 - DNA, 24 bp, Artificial Sequence
  Synthetic Construct
gcaaatggaccagaggaacagatg

SEQ ID NO: 4273 - DNA, 23 bp, Artificial Sequence
  Synthetic Construct
ggccctttcgcaacctttttttg

SEQ ID NO: 4274 - DNA, 21 bp, Artificial Sequence
  Synthetic Construct
cttcctccagcctctctgtga

SEQ ID NO: 4275 - DNA, 22 bp, Artificial Sequence
  Synthetic Construct
gtacccctgtgctaatgtggtt

SEQ ID NO: 4276 - DNA, 24 bp, Artificial Sequence
  Synthetic Construct
cagccttgcgaatagacaagacta

SEQ ID NO: 4277 - DNA, 25 bp, Artificial Sequence
  Synthetic Construct
gtctggtttcagtgtgactttagct

SEQ ID NO: 4278 - DNA, 23 bp, Artificial Sequence
  Synthetic Construct
tctcctgtccatttgtggaatgc

SEQ ID NO: 4279 - DNA, 18 bp, Artificial Sequence
  Synthetic Construct
gagcgcggcaatgtcgtt

SEQ ID NO: 4280 - DNA, 22 bp, Artificial Sequence
  Synthetic Construct
cgaaggttcaaagcccaaacac

SEQ ID NO: 4281 - DNA, 24 bp, Artificial Sequence
  Synthetic Construct
tggagtttgttccctgaattagca

SEQ ID NO: 4282 - DNA, 27 bp, Artificial Sequence
  Synthetic Construct
ccctctctctagattcaacccagaact

SEQ ID NO: 4283 - DNA, 21 bp, Artificial Sequence
  Synthetic Construct
tggctgcatggcaacttctca

SEQ ID NO: 4284 - DNA, 24 bp, Artificial Sequence
  Synthetic Construct
tgttcaatcagttggcagactttc

SEQ ID NO: 4285 - DNA, 21 bp, Artificial Sequence
  Synthetic Construct
aaagctgtggaggggtccttt

SEQ ID NO: 4286 - DNA, 23 bp, Artificial Sequence
  Synthetic Construct
ccttggcccagttatgttcttga

SEQ ID NO: 4287 - DNA, 28 bp, Artificial Sequence
  Synthetic Construct
ggaaattaggcccttcatgcatttctaa

SEQ ID NO: 4288 - DNA, 26 bp, Artificial Sequence
  Synthetic Construct
ggcagattttcaatctttggcttgca

SEQ ID NO: 4289 - DNA, 24 bp, Artificial Sequence
  Synthetic Construct
ggctcacccttaggctgatgataa

SEQ ID NO: 4290 - DNA, 24 bp, Artificial Sequence
  Synthetic Construct
ggcctatccttcctggtgattgta

SEQ ID NO: 4291 - DNA, 25 bp, Artificial Sequence
  Synthetic Construct
cacaacctagcaacctcttttacag

SEQ ID NO: 4292 - DNA, 26 bp, Artificial Sequence
  Synthetic Construct
ccaactagtctgtcctgcactttaga

SEQ ID NO: 4293 - DNA, 23 bp, Artificial Sequence
  Synthetic Construct
tgggttttaaagaccgtcgtcaa

SEQ ID NO: 4294 - DNA, 18 bp, Artificial Sequence
  Synthetic Construct
gccccagctgctgtgtgt

SEQ ID NO: 4295 - DNA, 22 bp, Artificial Sequence
  Synthetic Construct
ttgatgcctgctcgagacattg

SEQ ID NO: 4296 - DNA, 23 bp, Artificial Sequence
  Synthetic Construct
tgtggctacaattggctcttgag

SEQ ID NO: 4297 - DNA, 20 bp, Artificial Sequence
  Synthetic Construct
agttccgctcaccagtgcta

SEQ ID NO: 4298 - DNA, 23 bp, Artificial Sequence
  Synthetic Construct
gaagagtgaagagtgaccagcat

SEQ ID NO: 4299 - DNA, 21 bp, Artificial Sequence
  Synthetic Construct
agggcaggtgtttcaggaagt

SEQ ID NO: 4300 - DNA, 24 bp, Artificial Sequence
  Synthetic Construct
ccacagttcagtgaatgggagcat

SEQ ID NO: 4301 - DNA, 26 bp, Artificial Sequence
  Synthetic Construct
ctaatacccctgcaatttctcttcct

SEQ ID NO: 4302 - DNA, 20 bp, Artificial Sequence
  Synthetic Construct
agcaatctgccgccaggatt

SEQ ID NO: 4303 - DNA, 25 bp, Artificial Sequence
  Synthetic Construct
caggtcttggcttaaatgtcaacac

SEQ ID NO: 4304 - DNA, 23 bp, Artificial Sequence
  Synthetic Construct
tgcagtgggatcagctaccagta

SEQ ID NO: 4305 - DNA, 23 bp, Artificial Sequence
  Synthetic Construct
gccactgagaagactctgtcctt

SEQ ID NO: 4306 - DNA, 25 bp, Artificial Sequence
  Synthetic Construct
ggccaagactcctaaatctgaagct

SEQ ID NO: 4307 - DNA, 24 bp, Artificial Sequence
  Synthetic Construct
ggtgtgcctcaggtgtaagatgat

SEQ ID NO: 4308 - DNA, 25 bp, Artificial Sequence
  Synthetic Construct
tgacaatctcatcacgtctgacaag

SEQ ID NO: 4309 - DNA, 25 bp, Artificial Sequence
  Synthetic Construct
tcacacacatcagtctaaacctgaa

SEQ ID NO: 4310 - DNA, 24 bp, Artificial Sequence
  Synthetic Construct
cccaactgtctcactgttcatgga

SEQ ID NO: 4311 - DNA, 25 bp, Artificial Sequence
  Synthetic Construct
aagtgtagccacataaactggtgat

SEQ ID NO: 4312 - DNA, 22 bp, Artificial Sequence
  Synthetic Construct
tgccctaacctccgtttacaac

SEQ ID NO: 4313 - DNA, 25 bp, Artificial Sequence
  Synthetic Construct
cctatgtaatggccaaagacacttg

SEQ ID NO: 4314 - DNA, 20 bp, Artificial Sequence
  Synthetic Construct
tgggcatgttgtgtgatgct

SEQ ID NO: 4315 - DNA, 26 bp, Artificial Sequence
  Synthetic Construct
attttggttgccttttcccactatag

SEQ ID NO: 4316 - DNA, 22 bp, Artificial Sequence
  Synthetic Construct
tgctgaagaggctctgagtcat

SEQ ID NO: 4317 - DNA, 27 bp, Artificial Sequence
  Synthetic Construct
agtggtattcatgtcagcaagaaattg

SEQ ID NO: 4318 - DNA, 23 bp, Artificial Sequence
  Synthetic Construct
ggatcctgcactagtacaaagca

SEQ ID NO: 4319 - DNA, 20 bp, Artificial Sequence
  Synthetic Construct
catctggccacctgaacaca

SEQ ID NO: 4320 - DNA, 24 bp, Artificial Sequence
  Synthetic Construct
gaaagccagaagacatgtcatgag

SEQ ID NO: 4321 - DNA, 22 bp, Artificial Sequence
  Synthetic Construct
acctgagagccattgcctccta

SEQ ID NO: 4322 - DNA, 30 bp, Artificial Sequence
  Synthetic Construct
gcctaaggactgtgtaagaaggaaatacag

SEQ ID NO: 4323 - DNA, 26 bp, Artificial Sequence
  Synthetic Construct
gtgtcctctgaccactaaactatacc

SEQ ID NO: 4324 - DNA, 21 bp, Artificial Sequence
  Synthetic Construct
tctgtctcctgcatgcaactc

SEQ ID NO: 4325 - DNA, 26 bp, Artificial Sequence
  Synthetic Construct
ccacctatactgaacttaggggaaga

SEQ ID NO: 4326 - DNA, 26 bp, Artificial Sequence
  Synthetic Construct
agctggaaaggagtttattgaaagga

SEQ ID NO: 4327 - DNA, 20 bp, Artificial Sequence
  Synthetic Construct
tcaaggcaccctttccgttt

SEQ ID NO: 4328 - DNA, 23 bp, Artificial Sequence
  Synthetic Construct
gtgaggtaccagtggaggatctt

SEQ ID NO: 4329 - DNA, 21 bp, Artificial Sequence
  Synthetic Construct
acagtactgggccagatggaa

SEQ ID NO: 4330 - DNA, 24 bp, Artificial Sequence
  Synthetic Construct
aggatagcatacaccctacacagt

SEQ ID NO: 4331 - DNA, 22 bp, Artificial Sequence
  Synthetic Construct
ctcagcccctccacgtgggaat

SEQ ID NO: 4332 - DNA, 21 bp, Artificial Sequence
  Synthetic Construct
atggctgaagaggaccatgtg

SEQ ID NO: 4333 - DNA, 22 bp, Artificial Sequence
  Synthetic Construct
ccatgcctaccaagagctagtg

SEQ ID NO: 4334 - DNA, 20 bp, Artificial Sequence
  Synthetic Construct
ggggtacaggctggggattt

SEQ ID NO: 4335 - DNA, 24 bp, Artificial Sequence
  Synthetic Construct
gcactaggattgccttctgttctg

SEQ ID NO: 4336 - DNA, 27 bp, Artificial Sequence
  Synthetic Construct
ccacaatttaagactaaccaccatgct

SEQ ID NO: 4337 - DNA, 26 bp, Artificial Sequence
  Synthetic Construct
ttcagaaggtgtgaaagtgtatggta

SEQ ID NO: 4338 - DNA, 25 bp, Artificial Sequence
  Synthetic Construct
gtctcaagtagggttacgctgtatt

SEQ ID NO: 4339 - DNA, 25 bp, Artificial Sequence
  Synthetic Construct
tgatcaccatgcaggggtttattac

SEQ ID NO: 4340 - DNA, 30 bp, Artificial Sequence
  Synthetic Construct
catcaactatgactggtatttcagagttct

SEQ ID NO: 4341 - DNA, 21 bp, Artificial Sequence
  Synthetic Construct
ccttggcactgtggagcaaga

SEQ ID NO: 4342 - DNA, 27 bp, Artificial Sequence
  Synthetic Construct
ggtcatggtttcaaggaaatggattgg

SEQ ID NO: 4343 - DNA, 22 bp, Artificial Sequence
  Synthetic Construct
gggcagctgatgtaacaattcc

SEQ ID NO: 4344 - DNA, 22 bp, Artificial Sequence
  Synthetic Construct
tctggcagcttgttggagaaag

SEQ ID NO: 4345 - DNA, 22 bp, Artificial Sequence
  Synthetic Construct
aggacatctgggagcagaaaga

SEQ ID NO: 4346 - DNA, 23 bp, Artificial Sequence
  Synthetic Construct
gggaaagtacaccccatttctga

SEQ ID NO: 4347 - DNA, 27 bp, Artificial Sequence
  Synthetic Construct
gggacagttttcctgaaagtagagcta

SEQ ID NO: 4348 - DNA, 27 bp, Artificial Sequence
  Synthetic Construct
gtctgatttgaactgttatctgctgtt

SEQ ID NO: 4349 - DNA, 22 bp, Artificial Sequence
  Synthetic Construct
ggactaccagcctatgccatct

SEQ ID NO: 4350 - DNA, 19 bp, Artificial Sequence
  Synthetic Construct
agggctcgtcctcctgctt

SEQ ID NO: 4351 - DNA, 22 bp, Artificial Sequence
  Synthetic Construct
gctccttacagctccagcaaga

SEQ ID NO: 4352 - DNA, 22 bp, Artificial Sequence
  Synthetic Construct
tgtggggaactagagacccaaa

SEQ ID NO: 4353 - DNA, 25 bp, Artificial Sequence
  Synthetic Construct
tgagaactgtcctctcttcattctg

SEQ ID NO: 4354 - DNA, 25 bp, Artificial Sequence
  Synthetic Construct
agtagctggtgtattcaaggaacag

SEQ ID NO: 4355 - DNA, 22 bp, Artificial Sequence
  Synthetic Construct
aacacgcccttgatggatgaga

SEQ ID NO: 4356 - DNA, 24 bp, Artificial Sequence
  Synthetic Construct
gcatagctgtggtcaccaaacaac

SEQ ID NO: 4357 - DNA, 22 bp, Artificial Sequence
  Synthetic Construct
tcaaagccttgcctcagcttct

SEQ ID NO: 4358 - DNA, 24 bp, Artificial Sequence
  Synthetic Construct
tgctctgtttgtgggttagtttca

SEQ ID NO: 4359 - DNA, 26 bp, Artificial Sequence
  Synthetic Construct
caagaaggctttcccagtatcaactg

SEQ ID NO: 4360 - DNA, 23 bp, Artificial Sequence
  Synthetic Construct
cactgtctccagccatccctata

SEQ ID NO: 4361 - DNA, 21 bp, Artificial Sequence
  Synthetic Construct
ctccttacccatgggtttgct

SEQ ID NO: 4362 - DNA, 22 bp, Artificial Sequence
  Synthetic Construct
acggggtaggaaatgtcacctt

SEQ ID NO: 4363 - DNA, 25 bp, Artificial Sequence
  Synthetic Construct
ggagtgttaacagcttctgccattc

SEQ ID NO: 4364 - DNA, 27 bp, Artificial Sequence
  Synthetic Construct
gtggataaggtatagggagtacaggat

SEQ ID NO: 4365 - DNA, 24 bp, Artificial Sequence
  Synthetic Construct
ggctacaacaatgagggggaaatg

SEQ ID NO: 4366 - DNA, 22 bp, Artificial Sequence
  Synthetic Construct
ggtggtgcagtgtgccaaataa

SEQ ID NO: 4367 - DNA, 20 bp, Artificial Sequence
  Synthetic Construct
ccaggtaccctcaccactct

SEQ ID NO: 4368 - DNA, 24 bp, Artificial Sequence
  Synthetic Construct
gggaagcgaccattggaattagga

SEQ ID NO: 4369 - DNA, 23 bp, Artificial Sequence
  Synthetic Construct
tgttagcaaaagaccagggtgtt

SEQ ID NO: 4370 - DNA, 25 bp, Artificial Sequence
  Synthetic Construct
tcatatgtggagaacttggcatcaa

SEQ ID NO: 4371 - DNA, 20 bp, Artificial Sequence
  Synthetic Construct
ccttgcaatggtccccagat

SEQ ID NO: 4372 - DNA, 28 bp, Artificial Sequence
  Synthetic Construct
ggatcaggatcctacctttagactcctt

SEQ ID NO: 4373 - DNA, 27 bp, Artificial Sequence
  Synthetic Construct
tttgcatctgtgttcacattacactag

SEQ ID NO: 4374 - DNA, 24 bp, Artificial Sequence
  Synthetic Construct
ttgggtaataccaggactcccata

SEQ ID NO: 4375 - DNA, 22 bp, Artificial Sequence
  Synthetic Construct
tggtgggttgatgaggacaaga

SEQ ID NO: 4376 - DNA, 22 bp, Artificial Sequence
  Synthetic Construct
agctgctgcccatctttttcct

SEQ ID NO: 4377 - DNA, 21 bp, Artificial Sequence
  Synthetic Construct
tgtgaagcaaagccaccacaa

SEQ ID NO: 4378 - DNA, 24 bp, Artificial Sequence
  Synthetic Construct
gtgtcctcatagtctcaccttgca

SEQ ID NO: 4379 - DNA, 21 bp, Artificial Sequence
  Synthetic Construct
gcgtacctccgagaacacact

SEQ ID NO: 4380 - DNA, 26 bp, Artificial Sequence
  Synthetic Construct
actggtggttctttggtatttttcac

SEQ ID NO: 4381 - DNA, 24 bp, Artificial Sequence
  Synthetic Construct
cctggataaggcaagagacttgtc

SEQ ID NO: 4382 - DNA, 21 bp, Artificial Sequence
  Synthetic Construct
acaaacccaagggcacgtagt

SEQ ID NO: 4383 - DNA, 20 bp, Artificial Sequence
  Synthetic Construct
ccccatggcctggattaagc

SEQ ID NO: 4384 - DNA, 25 bp, Artificial Sequence
  Synthetic Construct
gcgctgatgatatttctggtgtgtt

SEQ ID NO: 4385 - DNA, 26 bp, Artificial Sequence
  Synthetic Construct
ggacctgttgactgaagaaatgatga

SEQ ID NO: 4386 - DNA, 24 bp, Artificial Sequence
  Synthetic Construct
ctttgaagtctctgcacctcagtt

SEQ ID NO: 4387 - DNA, 18 bp, Artificial Sequence
  Synthetic Construct
tcctgctggctgcacaca

SEQ ID NO: 4388 - DNA, 23 bp, Artificial Sequence
  Synthetic Construct
gaggaaacccagagtcaggaact

SEQ ID NO: 4389 - DNA, 25 bp, Artificial Sequence
  Synthetic Construct
catgcatcaggtgtacattaagctt

SEQ ID NO: 4390 - DNA, 26 bp, Artificial Sequence
  Synthetic Construct
gggtctcagtatcaagctgactgttg

SEQ ID NO: 4391 - DNA, 24 bp, Artificial Sequence
  Synthetic Construct
cctgaacctactccatctgttcct

SEQ ID NO: 4392 - DNA, 24 bp, Artificial Sequence
  Synthetic Construct
ctgagctgaggtcatgttcttcct

SEQ ID NO: 4393 - DNA, 27 bp, Artificial Sequence
  Synthetic Construct
aggaggtttatattgtgctcagacatt

SEQ ID NO: 4394 - DNA, 20 bp, Artificial Sequence
  Synthetic Construct
tggatccccccaccactctt

SEQ ID NO: 4395 - DNA, 18 bp, Artificial Sequence
  Synthetic Construct
tggccgtgctcctcagta

SEQ ID NO: 4396 - DNA, 22 bp, Artificial Sequence
  Synthetic Construct
ggtttggggttgctcctttagt

SEQ ID NO: 4397 - DNA, 23 bp, Artificial Sequence
  Synthetic Construct
ctctgtggggcatgtttagaact

SEQ ID NO: 4398 - DNA, 20 bp, Artificial Sequence
  Synthetic Construct
gaggtggtgagcacaaagga

SEQ ID NO: 4399 - DNA, 25 bp, Artificial Sequence
  Synthetic Construct
ctgctaaaaccctccaatggcttac

SEQ ID NO: 4400 - DNA, 21 bp, Artificial Sequence
  Synthetic Construct
gctgggacatggtgttagtgt

SEQ ID NO: 4401 - DNA, 22 bp, Artificial Sequence
  Synthetic Construct
actgaggctgactccattgaga

SEQ ID NO: 4402 - DNA, 20 bp, Artificial Sequence
  Synthetic Construct
gctggcgggaagtcacacaa

SEQ ID NO: 4403 - DNA, 26 bp, Artificial Sequence
  Synthetic Construct
gtgttatcactgccataatggtcaag

SEQ ID NO: 4404 - DNA, 22 bp, Artificial Sequence
  Synthetic Construct
tgtttctggcgtgtgaaagtga

SEQ ID NO: 4405 - DNA, 25 bp, Artificial Sequence
  Synthetic Construct
cagaactcagaggctagtctaggta

SEQ ID NO: 4406 - DNA, 19 bp, Artificial Sequence
  Synthetic Construct
cctcaggcagctggtgtct

SEQ ID NO: 4407 - DNA, 26 bp, Artificial Sequence
  Synthetic Construct
gatctcaaggtaggaatgtgtctcaa

SEQ ID NO: 4408 - DNA, 25 bp, Artificial Sequence
  Synthetic Construct
gtttccccaagtctgcctcatattt

SEQ ID NO: 4409 - DNA, 26 bp, Artificial Sequence
  Synthetic Construct
cactttgatctccttatgctgctagt

SEQ ID NO: 4410 - DNA, 28 bp, Artificial Sequence
  Synthetic Construct
catcttttaccacaagctaacagtacag

SEQ ID NO: 4411 - DNA, 24 bp, Artificial Sequence
  Synthetic Construct
ggtgatttgccaaccattcttgac

SEQ ID NO: 4412 - DNA, 23 bp, Artificial Sequence
  Synthetic Construct
agcaccccagaaaacttcttgag

SEQ ID NO: 4413 - DNA, 23 bp, Artificial Sequence
  Synthetic Construct
tctctctagagcaagcagacaca

SEQ ID NO: 4414 - DNA, 23 bp, Artificial Sequence
  Synthetic Construct
tggctcatgcttctgggaatgtg

SEQ ID NO: 4415 - DNA, 25 bp, Artificial Sequence
  Synthetic Construct
cagattcctaactcaccttcagcaa

SEQ ID NO: 4416 - DNA, 21 bp, Artificial Sequence
  Synthetic Construct
ggactgctgcagagactcttc

SEQ ID NO: 4417 - DNA, 19 bp, Artificial Sequence
  Synthetic Construct
tgccgtgagcgtgtgttca

SEQ ID NO: 4418 - DNA, 26 bp, Artificial Sequence
  Synthetic Construct
gagaagaaaaacgccatgaagaaacc

SEQ ID NO: 4419 - DNA, 26 bp, Artificial Sequence
  Synthetic Construct
gctgagagggcctcggaattatattg

SEQ ID NO: 4420 - DNA, 22 bp, Artificial Sequence
  Synthetic Construct
gaccactgtagctgcttttgtc

SEQ ID NO: 4421 - DNA, 22 bp, Artificial Sequence
  Synthetic Construct
gggtgaagtgggtgcatctaat

SEQ ID NO: 4422 - DNA, 24 bp, Artificial Sequence
  Synthetic Construct
tttgaagggtgcatttgtgatgtt

SEQ ID NO: 4423 - DNA, 28 bp, Artificial Sequence
  Synthetic Construct
gggattctgtgtcctagcacttttatgg

SEQ ID NO: 4424 - DNA, 22 bp, Artificial Sequence
  Synthetic Construct
cgcgctggaagttaatgcagta

SEQ ID NO: 4425 - DNA, 25 bp, Artificial Sequence
  Synthetic Construct
gcaatgaaaagtcttgcagtttgag

SEQ ID NO: 4426 - DNA, 24 bp, Artificial Sequence
  Synthetic Construct
agcagtctgagtcaccctatcctt

SEQ ID NO: 4427 - DNA, 25 bp, Artificial Sequence
  Synthetic Construct
tcctaggtaggcttccattcctatc

SEQ ID NO: 4428 - DNA, 27 bp, Artificial Sequence
  Synthetic Construct
aaggaaatgcaattgtatgtacagcat

SEQ ID NO: 4429 - DNA, 22 bp, Artificial Sequence
  Synthetic Construct
gggagccaaaggttttcaggaa

SEQ ID NO: 4430 - DNA, 28 bp, Artificial Sequence
  Synthetic Construct
gcttgtgtttgtccagggattttagttg

SEQ ID NO: 4431 - DNA, 25 bp, Artificial Sequence
  Synthetic Construct
agaacgcgattgacccattttaaac

SEQ ID NO: 4432 - DNA, 24 bp, Artificial Sequence
  Synthetic Construct
catcagaatttgctgcagcttaga

SEQ ID NO: 4433 - DNA, 22 bp, Artificial Sequence
  Synthetic Construct
cgcagcaagtcaagcaatggaa

SEQ ID NO: 4434 - DNA, 22 bp, Artificial Sequence
  Synthetic Construct
aggtaaggtgtctgccttcaca

SEQ ID NO: 4435 - DNA, 21 bp, Artificial Sequence
  Synthetic Construct
agggcagcaccagaagctaga

SEQ ID NO: 4436 - DNA, 22 bp, Artificial Sequence
  Synthetic Construct
ggagagtggttgattgggctaa

SEQ ID NO: 4437 - DNA, 22 bp, Artificial Sequence
  Synthetic Construct
ctctgcccacattctggttcaa

SEQ ID NO: 4438 - DNA, 21 bp, Artificial Sequence
  Synthetic Construct
cgatcttcctgtcgcctttcc

SEQ ID NO: 4439 - DNA, 23 bp, Artificial Sequence
  Synthetic Construct
ggccaccatcacttgatacttca

SEQ ID NO: 4440 - DNA, 29 bp, Artificial Sequence
  Synthetic Construct
gagataatgggaatagaagccttcatcag

SEQ ID NO: 4441 - DNA, 24 bp, Artificial Sequence
  Synthetic Construct
gtgtctggaacacctaaggactca

SEQ ID NO: 4442 - DNA, 23 bp, Artificial Sequence
  Synthetic Construct
aggctgccatactccagttagca

SEQ ID NO: 4443 - DNA, 26 bp, Artificial Sequence
  Synthetic Construct
ttaagccttactctgagccactttat

SEQ ID NO: 4444 - DNA, 20 bp, Artificial Sequence
  Synthetic Construct
ttggtgcccctcccctctat

SEQ ID NO: 4445 - DNA, 23 bp, Artificial Sequence
  Synthetic Construct
ctgaataggagggaggactcaca

SEQ ID NO: 4446 - DNA, 21 bp, Artificial Sequence
  Synthetic Construct
tgactcgggccaactgaaatg

SEQ ID NO: 4447 - DNA, 27 bp, Artificial Sequence
  Synthetic Construct
cactgtgggccatattatgagagtata

SEQ ID NO: 4448 - DNA, 24 bp, Artificial Sequence
  Synthetic Construct
ggggattaactcagtcacggcaat

SEQ ID NO: 4449 - DNA, 24 bp, Artificial Sequence
  Synthetic Construct
cggtttgtgacagcactactctca

SEQ ID NO: 4450 - DNA, 21 bp, Artificial Sequence
  Synthetic Construct
aggacttcctgggcagtgaaa

SEQ ID NO: 4451 - DNA, 27 bp, Artificial Sequence
  Synthetic Construct
tccatggatccacatgtctatccttat

SEQ ID NO: 4452 - DNA, 26 bp, Artificial Sequence
  Synthetic Construct
ccctagctaaaaaggtgatgcatcca

SEQ ID NO: 4453 - DNA, 21 bp, Artificial Sequence
  Synthetic Construct
cccagtgcacaatcccaattg

SEQ ID NO: 4454 - DNA, 22 bp, Artificial Sequence
  Synthetic Construct
ccacaaagcaggcgacactaaa

SEQ ID NO: 4455 - DNA, 21 bp, Artificial Sequence
  Synthetic Construct
ggtcccaagatgactgcaaga

SEQ ID NO: 4456 - DNA, 23 bp, Artificial Sequence
  Synthetic Construct
cagtcactgcttgaacaccatgt

SEQ ID NO: 4457 - DNA, 23 bp, Artificial Sequence
  Synthetic Construct
cccaagttctcttgcccatttga

SEQ ID NO: 4458 - DNA, 19 bp, Artificial Sequence
  Synthetic Construct
tgcactgctgagccacaga

SEQ ID NO: 4459 - DNA, 21 bp, Artificial Sequence
  Synthetic Construct
cacacacagctgcacagattg

SEQ ID NO: 4460 - DNA, 23 bp, Artificial Sequence
  Synthetic Construct
cctgcttatcagtgcctggtgat

SEQ ID NO: 4461 - DNA, 25 bp, Artificial Sequence
  Synthetic Construct
gcaaatgcaaaggttctgaggcaaa

SEQ ID NO: 4462 - DNA, 20 bp, Artificial Sequence
  Synthetic Construct
tgagcagtcctggtgctgta

SEQ ID NO: 4463 - DNA, 23 bp, Artificial Sequence
  Synthetic Construct
agaggagcagtgagtcctagttg

SEQ ID NO: 4464 - DNA, 24 bp, Artificial Sequence
  Synthetic Construct
cacgtgaaatgaattgccttctgt

SEQ ID NO: 4465 - DNA, 23 bp, Artificial Sequence
  Synthetic Construct
gcccaggactctctgacttaagc

SEQ ID NO: 4466 - DNA, 22 bp, Artificial Sequence
  Synthetic Construct
ttccacctcacattggcttctg

SEQ ID NO: 4467 - DNA, 22 bp, Artificial Sequence
  Synthetic Construct
gttgaggtctgctgtggtctaa

SEQ ID NO: 4468 - DNA, 29 bp, Artificial Sequence
  Synthetic Construct
cgaaagtgagacattatcagcatatatgg

SEQ ID NO: 4469 - DNA, 21 bp, Artificial Sequence
  Synthetic Construct
gaagaatggggcagacatgga

SEQ ID NO: 4470 - DNA, 21 bp, Artificial Sequence
  Synthetic Construct
actcctgcagctctctagtca

SEQ ID NO: 4471 - DNA, 22 bp, Artificial Sequence
  Synthetic Construct
tggcaatacagcagggcttcaa

SEQ ID NO: 4472 - DNA, 26 bp, Artificial Sequence
  Synthetic Construct
cccgtgaaagtcaagctattgattgc

SEQ ID NO: 4473 - DNA, 21 bp, Artificial Sequence
  Synthetic Construct
tgctgtcctggaggtgttgaa

SEQ ID NO: 4474 - DNA, 22 bp, Artificial Sequence
  Synthetic Construct
tgggcgcctaaacttcatcaca

SEQ ID NO: 4475 - DNA, 23 bp, Artificial Sequence
  Synthetic Construct
gacatgcatcacttctgctcaca

SEQ ID NO: 4476 - DNA, 20 bp, Artificial Sequence
  Synthetic Construct
ctcccccgaaacacctctct

SEQ ID NO: 4477 - DNA, 24 bp, Artificial Sequence
  Synthetic Construct
agataaggactccacagggactct

SEQ ID NO: 4478 - DNA, 22 bp, Artificial Sequence
  Synthetic Construct
ttgcccctgtttcagtgatgct

SEQ ID NO: 4479 - DNA, 21 bp, Artificial Sequence
  Synthetic Construct
cctggcacaagctgacacttt

SEQ ID NO: 4480 - DNA, 22 bp, Artificial Sequence
  Synthetic Construct
gtggtaggcgatgcatcttcaa

SEQ ID NO: 4481 - DNA, 20 bp, Artificial Sequence
  Synthetic Construct
aagcggagggggctttgtct

SEQ ID NO: 4482 - DNA, 21 bp, Artificial Sequence
  Synthetic Construct
gctgggtagcactcccttact

SEQ ID NO: 4483 - DNA, 22 bp, Artificial Sequence
  Synthetic Construct
gagagcggacttttctcccaat

SEQ ID NO: 4484 - DNA, 28 bp, Artificial Sequence
  Synthetic Construct
agtatgcgttgttagatgtttcaattcc

SEQ ID NO: 4485 - DNA, 26 bp, Artificial Sequence
  Synthetic Construct
catcatggttcatcatggttctcctt

SEQ ID NO: 4486 - DNA, 22 bp, Artificial Sequence
  Synthetic Construct
caccaagtcaccttctcccttt

SEQ ID NO: 4487 - DNA, 24 bp, Artificial Sequence
  Synthetic Construct
ctccctcttaacccaaggatacca

SEQ ID NO: 4488 - DNA, 26 bp, Artificial Sequence
  Synthetic Construct
ggctaccctgacaacttaaacagtct

SEQ ID NO: 4489 - DNA, 24 bp, Artificial Sequence
  Synthetic Construct
acctgtgaaagaccactgcatacc

SEQ ID NO: 4490 - DNA, 24 bp, Artificial Sequence
  Synthetic Construct
agctagacagagctgcacaagatg

SEQ ID NO: 4491 - DNA, 20 bp, Artificial Sequence
  Synthetic Construct
caacctcatggctggcatgt

SEQ ID NO: 4492 - DNA, 18 bp, Artificial Sequence
  Synthetic Construct
tcttcacccgcccatcca

SEQ ID NO: 4493 - DNA, 26 bp, Artificial Sequence
  Synthetic Construct
ggtcttcacccttgagagatgtaggt

SEQ ID NO: 4494 - DNA, 22 bp, Artificial Sequence
  Synthetic Construct
gctccacaaatcttgcccctat

SEQ ID NO: 4495 - DNA, 21 bp, Artificial Sequence
  Synthetic Construct
agcgccctagtccaaagacaa

SEQ ID NO: 4496 - DNA, 22 bp, Artificial Sequence
  Synthetic Construct
gtgccaaacacagagcttcatg

SEQ ID NO: 4497 - DNA, 28 bp, Artificial Sequence
  Synthetic Construct
ctaatgtggtacttagctcacagtaagt

SEQ ID NO: 4498 - DNA, 25 bp, Artificial Sequence
  Synthetic Construct
acagaggaccacaataaccttatcc

SEQ ID NO: 4499 - DNA, 24 bp, Artificial Sequence
  Synthetic Construct
cagagattggcactcttccctctt

SEQ ID NO: 4500 - DNA, 20 bp, Artificial Sequence
  Synthetic Construct
ctgctgaggcctgagacatg

SEQ ID NO: 4501 - DNA, 21 bp, Artificial Sequence
  Synthetic Construct
accctgcagttgacaatttgc

SEQ ID NO: 4502 - DNA, 30 bp, Artificial Sequence
  Synthetic Construct
gggagaggaagtatatgagtgtgaattagg

SEQ ID NO: 4503 - DNA, 28 bp, Artificial Sequence
  Synthetic Construct
ccaactacaagtccctagctcttttctc

SEQ ID NO: 4504 - DNA, 25 bp, Artificial Sequence
  Synthetic Construct
actaatattcactggccaactgtga

SEQ ID NO: 4505 - DNA, 23 bp, Artificial Sequence
  Synthetic Construct
acctgtaactccctgaggcagaa

SEQ ID NO: 4506 - DNA, 22 bp, Artificial Sequence
  Synthetic Construct
agagatagcccatcccagttgt

SEQ ID NO: 4507 - DNA, 25 bp, Artificial Sequence
  Synthetic Construct
gtgagtagcatgccttcattgaatc

SEQ ID NO: 4508 - DNA, 19 bp, Artificial Sequence
  Synthetic Construct
tggagaggggtggcttgct

SEQ ID NO: 4509 - DNA, 23 bp, Artificial Sequence
  Synthetic Construct
aaaacaatgtccctgcactcaag

SEQ ID NO: 4510 - DNA, 24 bp, Artificial Sequence
  Synthetic Construct
gacatgaccaggaagcatctctca

SEQ ID NO: 4511 - DNA, 19 bp, Artificial Sequence
  Synthetic Construct
acccgctccacacacacaa

SEQ ID NO: 4512 - DNA, 23 bp, Artificial Sequence
  Synthetic Construct
aggcctctcattgatcttttgct

SEQ ID NO: 4513 - DNA, 24 bp, Artificial Sequence
  Synthetic Construct
ccgaggaactatacccacttggtt

SEQ ID NO: 4514 - DNA, 21 bp, Artificial Sequence
  Synthetic Construct
cgtctcactgctgtcttctgt

SEQ ID NO: 4515 - DNA, 22 bp, Artificial Sequence
  Synthetic Construct
gcaaccccctctttaactttgc

SEQ ID NO: 4516 - DNA, 24 bp, Artificial Sequence
  Synthetic Construct
aggggatgaccaaccctgatcata

SEQ ID NO: 4517 - DNA, 26 bp, Artificial Sequence
  Synthetic Construct
cccaggttaatgagtagtaagtgtca

SEQ ID NO: 4518 - DNA, 27 bp, Artificial Sequence
  Synthetic Construct
ggcttcattcatcacatgactctgtga

SEQ ID NO: 4519 - DNA, 19 bp, Artificial Sequence
  Synthetic Construct
acgtggctgccttcatcct

SEQ ID NO: 4520 - DNA, 26 bp, Artificial Sequence
  Synthetic Construct
cagagaaaaatagctgtccccattgg

SEQ ID NO: 4521 - DNA, 21 bp, Artificial Sequence
  Synthetic Construct
attaagctgcacccacacact

SEQ ID NO: 4522 - DNA, 22 bp, Artificial Sequence
  Synthetic Construct
gggcgtttttgtccttcttggt

SEQ ID NO: 4523 - DNA, 21 bp, Artificial Sequence
  Synthetic Construct
aaggtggatgtgctcagcaat

SEQ ID NO: 4524 - DNA, 24 bp, Artificial Sequence
  Synthetic Construct
catcttggtttcttccctttgcaa

SEQ ID NO: 4525 - DNA, 26 bp, Artificial Sequence
  Synthetic Construct
gacttattgcctcaaacctctacact

SEQ ID NO: 4526 - DNA, 24 bp, Artificial Sequence
  Synthetic Construct
cgctggagattgagggtggaatta

SEQ ID NO: 4527 - DNA, 24 bp, Artificial Sequence
  Synthetic Construct
tcttgccatcaccatcagtcataa

SEQ ID NO: 4528 - DNA, 20 bp, Artificial Sequence
  Synthetic Construct
atgggcttaagggggtggaa

SEQ ID NO: 4529 - DNA, 22 bp, Artificial Sequence
  Synthetic Construct
actgtcagaatcccaggcagta

SEQ ID NO: 4530 - DNA, 22 bp, Artificial Sequence
  Synthetic Construct
tccggggaagaacattttgaca

SEQ ID NO: 4531 - DNA, 23 bp, Artificial Sequence
  Synthetic Construct
ggtaggagatggagccaatgaag

SEQ ID NO: 4532 - DNA, 19 bp, Artificial Sequence
  Synthetic Construct
gcgcaagacagcagaaacc

SEQ ID NO: 4533 - DNA, 24 bp, Artificial Sequence
  Synthetic Construct
ctcagactgtggcttatgatgtct

SEQ ID NO: 4534 - DNA, 26 bp, Artificial Sequence
  Synthetic Construct
agtgacaacacaactttgaagatgag

SEQ ID NO: 4535 - DNA, 26 bp, Artificial Sequence
  Synthetic Construct
cgggcagtaagaaatttcttgccaat

SEQ ID NO: 4536 - DNA, 22 bp, Artificial Sequence
  Synthetic Construct
gtccgaaagagagcaaggagtt

SEQ ID NO: 4537 - DNA, 20 bp, Artificial Sequence
  Synthetic Construct
accaggcagaccccatcagt

SEQ ID NO: 4538 - DNA, 22 bp, Artificial Sequence
  Synthetic Construct
aaactccctgagtctccgtgaa

SEQ ID NO: 4539 - DNA, 22 bp, Artificial Sequence
  Synthetic Construct
gcatctggcacctttctcaagt

SEQ ID NO: 4540 - DNA, 24 bp, Artificial Sequence
  Synthetic Construct
ctttctaagcagggtggacatcag

SEQ ID NO: 4541 - DNA, 23 bp, Artificial Sequence
  Synthetic Construct
tgacaaacacccaaggtaaacca

SEQ ID NO: 4542 - DNA, 22 bp, Artificial Sequence
  Synthetic Construct
tctcatgtcccagaccctactg

SEQ ID NO: 4543 - DNA, 22 bp, Artificial Sequence
  Synthetic Construct
ggacccgctgcatggaaattaa

SEQ ID NO: 4544 - DNA, 26 bp, Artificial Sequence
  Synthetic Construct
tgtcagttaagcaagtgttcctatct

SEQ ID NO: 4545 - DNA, 24 bp, Artificial Sequence
  Synthetic Construct
gctcacttgaggctcacttactgt

SEQ ID NO: 4546 - DNA, 26 bp, Artificial Sequence
  Synthetic Construct
gtgtttaggccaagtaggagacttct

SEQ ID NO: 4547 - DNA, 20 bp, Artificial Sequence
  Synthetic Construct
caagggttgggtgcagagaa

SEQ ID NO: 4548 - DNA, 22 bp, Artificial Sequence
  Synthetic Construct
tccttatgggatggctgtgttg

SEQ ID NO: 4549 - DNA, 23 bp, Artificial Sequence
  Synthetic Construct
gttgtgtgagtgagccaaatcac

SEQ ID NO: 4550 - DNA, 25 bp, Artificial Sequence
  Synthetic Construct
gtctagatcctgactcactgcttag

SEQ ID NO: 4551 - DNA, 19 bp, Artificial Sequence
  Synthetic Construct
tgctgccccaagctcctta

SEQ ID NO: 4552 - DNA, 27 bp, Artificial Sequence
  Synthetic Construct
cctgaaatacctagatcctctctttgc

SEQ ID NO: 4553 - DNA, 28 bp, Artificial Sequence
  Synthetic Construct
ggctgagaggatgaaatacttgtagtca

SEQ ID NO: 4554 - DNA, 20 bp, Artificial Sequence
  Synthetic Construct
gtggtgccactcttggaact

SEQ ID NO: 4555 - DNA, 24 bp, Artificial Sequence
  Synthetic Construct
catcgtgggagcatttacctaagg

SEQ ID NO: 4556 - DNA, 23 bp, Artificial Sequence
  Synthetic Construct
tcagcatcactaacgaggtcttc

SEQ ID NO: 4557 - DNA, 25 bp, Artificial Sequence
  Synthetic Construct
caccatgggaatgatctgtgtactg

SEQ ID NO: 4558 - DNA, 22 bp, Artificial Sequence
  Synthetic Construct
cacttgtggcccccatgtttat

SEQ ID NO: 4559 - DNA, 25 bp, Artificial Sequence
  Synthetic Construct
tcctaagtattcaggaggctgaagt

SEQ ID NO: 4560 - DNA, 27 bp, Artificial Sequence
  Synthetic Construct
gggctgcacatttgattatcattgtgt

SEQ ID NO: 4561 - DNA, 22 bp, Artificial Sequence
  Synthetic Construct
aaagccatggtggggtgtgaga

SEQ ID NO: 4562 - DNA, 21 bp, Artificial Sequence
  Synthetic Construct
actgctggctgctcaaagcta

SEQ ID NO: 4563 - DNA, 24 bp, Artificial Sequence
  Synthetic Construct
agctggggagacttagtcagatga

SEQ ID NO: 4564 - DNA, 24 bp, Artificial Sequence
  Synthetic Construct
tgagctgaagttcttgctgagatt

SEQ ID NO: 4565 - DNA, 22 bp, Artificial Sequence
  Synthetic Construct
tgcaggaagccacacagaagtt

SEQ ID NO: 4566 - DNA, 30 bp, Artificial Sequence
  Synthetic Construct
gcctaaaatatttgctgtctggccttttac

SEQ ID NO: 4567 - DNA, 24 bp, Artificial Sequence
  Synthetic Construct
aggcatggtcagaagggttaagag

SEQ ID NO: 4568 - DNA, 23 bp, Artificial Sequence
  Synthetic Construct
tccagatgtcccatggagtagga

SEQ ID NO: 4569 - DNA, 22 bp, Artificial Sequence
  Synthetic Construct
gcttggctccatctgaaattcc

SEQ ID NO: 4570 - DNA, 19 bp, Artificial Sequence
  Synthetic Construct
cctgctcaggccattccaa

SEQ ID NO: 4571 - DNA, 21 bp, Artificial Sequence
  Synthetic Construct
aagccttccagactgggcaaa

SEQ ID NO: 4572 - DNA, 24 bp, Artificial Sequence
  Synthetic Construct
ggactcaacacccaattccagaga

SEQ ID NO: 4573 - DNA, 22 bp, Artificial Sequence
  Synthetic Construct
ctgagccacagaacacacaagt

SEQ ID NO: 4574 - DNA, 25 bp, Artificial Sequence
  Synthetic Construct
gcacgtatgtgtgttgatggacata

SEQ ID NO: 4575 - DNA, 26 bp, Artificial Sequence
  Synthetic Construct
gttgcactacaaggtagattgggtta

SEQ ID NO: 4576 - DNA, 22 bp, Artificial Sequence
  Synthetic Construct
gacaagggcttgaggttacaca

SEQ ID NO: 4577 - DNA, 22 bp, Artificial Sequence
  Synthetic Construct
tcgtggatttgtcgttctttgc

SEQ ID NO: 4578 - DNA, 26 bp, Artificial Sequence
  Synthetic Construct
actgtaacaatgttaagaggcacaga

SEQ ID NO: 4579 - DNA, 30 bp, Artificial Sequence
  Synthetic Construct
gttgtccttaatatgccatagtcattcatg

SEQ ID NO: 4580 - DNA, 22 bp, Artificial Sequence
  Synthetic Construct
tcacagacagcagatccctgat

SEQ ID NO: 4581 - DNA, 29 bp, Artificial Sequence
  Synthetic Construct
gaacttatgctgagattccattaattcca

SEQ ID NO: 4582 - DNA, 28 bp, Artificial Sequence
  Synthetic Construct
agtaaatcaatgtcactggatccatgaa

SEQ ID NO: 4583 - DNA, 24 bp, Artificial Sequence
  Synthetic Construct
ggtgaccaacttgtcctgaggaaa

SEQ ID NO: 4584 - DNA, 24 bp, Artificial Sequence
  Synthetic Construct
ggtaggagttgggggaaaatgaaa

SEQ ID NO: 4585 - DNA, 22 bp, Artificial Sequence
  Synthetic Construct
gatgtcaccgccacttttaagc

SEQ ID NO: 4586 - DNA, 22 bp, Artificial Sequence
  Synthetic Construct
tgcacacttcctcggaaaacag

SEQ ID NO: 4587 - DNA, 26 bp, Artificial Sequence
  Synthetic Construct
ggtgtcagatttcattcagagaggat

SEQ ID NO: 4588 - DNA, 28 bp, Artificial Sequence
  Synthetic Construct
ccaaggttcttttcactatgtcctagct

SEQ ID NO: 4589 - DNA, 19 bp, Artificial Sequence
  Synthetic Construct
agggccacatcccccacaa

SEQ ID NO: 4590 - DNA, 25 bp, Artificial Sequence
  Synthetic Construct
gtgggagctctaacttgacactatt

SEQ ID NO: 4591 - DNA, 22 bp, Artificial Sequence
  Synthetic Construct
cctacacctgcttcctgtcctt

SEQ ID NO: 4592 - DNA, 23 bp, Artificial Sequence
  Synthetic Construct
accaactctgcgtatctggaatg

SEQ ID NO: 4593 - DNA, 21 bp, Artificial Sequence
  Synthetic Construct
ggcctcctagaccacttcaga

SEQ ID NO: 4594 - DNA, 25 bp, Artificial Sequence
  Synthetic Construct
tgctcctagaataaggacacactca

SEQ ID NO: 4595 - DNA, 25 bp, Artificial Sequence
  Synthetic Construct
cccaaggaccatatgtaacctacca

SEQ ID NO: 4596 - DNA, 22 bp, Artificial Sequence
  Synthetic Construct
cctgaacaaagacagcccaatg

SEQ ID NO: 4597 - DNA, 22 bp, Artificial Sequence
  Synthetic Construct
aaatgtcctcccacaggcactt

SEQ ID NO: 4598 - DNA, 24 bp, Artificial Sequence
  Synthetic Construct
cacatcagttctgtgggagatacc

SEQ ID NO: 4599 - DNA, 20 bp, Artificial Sequence
  Synthetic Construct
cacgtggttgtggggaacaa

SEQ ID NO: 4600 - DNA, 25 bp, Artificial Sequence
  Synthetic Construct
tccccatcaccttattttgacaaga

SEQ ID NO: 4601 - DNA, 23 bp, Artificial Sequence
  Synthetic Construct
gtcaacccgaatagctcctttct

SEQ ID NO: 4602 - DNA, 28 bp, Artificial Sequence
  Synthetic Construct
agagaattgagttatgctgccataaatc

SEQ ID NO: 4603 - DNA, 20 bp, Artificial Sequence
  Synthetic Construct
ccatgtggcaggaagaacca

SEQ ID NO: 4604 - DNA, 26 bp, Artificial Sequence
  Synthetic Construct
ccttgaaaggaatggacctagacatg

SEQ ID NO: 4605 - DNA, 24 bp, Artificial Sequence
  Synthetic Construct
ctccttctccaagacaggaaatcc

SEQ ID NO: 4606 - DNA, 24 bp, Artificial Sequence
  Synthetic Construct
ggacgccactttaaaatccaactg

SEQ ID NO: 4607 - DNA, 23 bp, Artificial Sequence
  Synthetic Construct
ttcctagccaggtgaccatctag

SEQ ID NO: 4608 - DNA, 21 bp, Artificial Sequence
  Synthetic Construct
tcctacctcatgcctgtcact

SEQ ID NO: 4609 - DNA, 25 bp, Artificial Sequence
  Synthetic Construct
ggatgattgccattttcctgaacac

SEQ ID NO: 4610 - DNA, 23 bp, Artificial Sequence
  Synthetic Construct
agaaagccacaatgttggagaga

SEQ ID NO: 4611 - DNA, 24 bp, Artificial Sequence
  Synthetic Construct
cctggtcaccatattccaggagta

SEQ ID NO: 4612 - DNA, 24 bp, Artificial Sequence
  Synthetic Construct
agacctagccatgggtactaagaa

SEQ ID NO: 4613 - DNA, 22 bp, Artificial Sequence
  Synthetic Construct
ccatctttgcacctccaagttg

SEQ ID NO: 4614 - DNA, 22 bp, Artificial Sequence
  Synthetic Construct
agcaacccacagaagccatgag

SEQ ID NO: 4615 - DNA, 20 bp, Artificial Sequence
  Synthetic Construct
ggtgcaagccattggtggtt

SEQ ID NO: 4616 - DNA, 27 bp, Artificial Sequence
  Synthetic Construct
caaggcatgtttatacaacaacaacag

SEQ ID NO: 4617 - DNA, 19 bp, Artificial Sequence
  Synthetic Construct
cagggcatggagggatgga

SEQ ID NO: 4618 - DNA, 24 bp, Artificial Sequence
  Synthetic Construct
ggaggtttctaactggtgggatgt

SEQ ID NO: 4619 - DNA, 26 bp, Artificial Sequence
  Synthetic Construct
gggagtactcaagctatgctgatgtg

SEQ ID NO: 4620 - DNA, 25 bp, Artificial Sequence
  Synthetic Construct
gcagtcatcatcaagttgagtctct

SEQ ID NO: 4621 - DNA, 21 bp, Artificial Sequence
  Synthetic Construct
aggaacttccagtgccaagga

SEQ ID NO: 4622 - DNA, 26 bp, Artificial Sequence
  Synthetic Construct
gtttttcaacccaattacctggatgt

SEQ ID NO: 4623 - DNA, 28 bp, Artificial Sequence
  Synthetic Construct
catctattacctgcattggttacattgc

SEQ ID NO: 4624 - DNA, 22 bp, Artificial Sequence
  Synthetic Construct
tccagagaggataggggatgtg

SEQ ID NO: 4625 - DNA, 22 bp, Artificial Sequence
  Synthetic Construct
agccaggcatccatacgaccta

SEQ ID NO: 4626 - DNA, 22 bp, Artificial Sequence
  Synthetic Construct
tgtttttccacttggcctagca

SEQ ID NO: 4627 - DNA, 26 bp, Artificial Sequence
  Synthetic Construct
ctcaggtccctattgctatggtaaag

SEQ ID NO: 4628 - DNA, 27 bp, Artificial Sequence
  Synthetic Construct
cactgaagccaaataaaccagaaacac

SEQ ID NO: 4629 - DNA, 26 bp, Artificial Sequence
  Synthetic Construct
cgtacatatggctattctggaactga

SEQ ID NO: 4630 - DNA, 23 bp, Artificial Sequence
  Synthetic Construct
tgagagaccctagaggcagctat

SEQ ID NO: 4631 - DNA, 24 bp, Artificial Sequence
  Synthetic Construct
ccttgaaagtaggcctgaagtagt

SEQ ID NO: 4632 - DNA, 23 bp, Artificial Sequence
  Synthetic Construct
cacaaaaccactacacccttcca

SEQ ID NO: 4633 - DNA, 24 bp, Artificial Sequence
  Synthetic Construct
gacaaaacacctgaggtcattggt

SEQ ID NO: 4634 - DNA, 21 bp, Artificial Sequence
  Synthetic Construct
aaagacggtccacctgaggtt

SEQ ID NO: 4635 - DNA, 22 bp, Artificial Sequence
  Synthetic Construct
agcgaacatgctgacacctact

SEQ ID NO: 4636 - DNA, 21 bp, Artificial Sequence
  Synthetic Construct
ccagggagagcaactgggttt

SEQ ID NO: 4637 - DNA, 19 bp, Artificial Sequence
  Synthetic Construct
aggcaatgggctcccttca

SEQ ID NO: 4638 - DNA, 26 bp, Artificial Sequence
  Synthetic Construct
tgattagatggccacaatgaattagc

SEQ ID NO: 4639 - DNA, 27 bp, Artificial Sequence
  Synthetic Construct
tcattcaatatgcccctgtgtttaatg

SEQ ID NO: 4640 - DNA, 21 bp, Artificial Sequence
  Synthetic Construct
gctccacactggcctctacaa

SEQ ID NO: 4641 - DNA, 22 bp, Artificial Sequence
  Synthetic Construct
cttcagctcaaccctccctttt

SEQ ID NO: 4642 - DNA, 24 bp, Artificial Sequence
  Synthetic Construct
ggtgtttctgcaaatggagcaaca

SEQ ID NO: 4643 - DNA, 26 bp, Artificial Sequence
  Synthetic Construct
cactctggtctactagtctggtatca

SEQ ID NO: 4644 - DNA, 22 bp, Artificial Sequence
  Synthetic Construct
agggcaaggagaatcctgactt

SEQ ID NO: 4645 - DNA, 26 bp, Artificial Sequence
  Synthetic Construct
cgacaaattccttgaaacaagttgtg

SEQ ID NO: 4646 - DNA, 21 bp, Artificial Sequence
  Synthetic Construct
tgcagtcattgggcccattgt

SEQ ID NO: 4647 - DNA, 19 bp, Artificial Sequence
  Synthetic Construct
aaaggagctggggcaatgc

SEQ ID NO: 4648 - DNA, 21 bp, Artificial Sequence
  Synthetic Construct
tgggcaggcagcttagtacat

SEQ ID NO: 4649 - DNA, 25 bp, Artificial Sequence
  Synthetic Construct
actttcatctaccccttgacatctc

SEQ ID NO: 4650 - DNA, 28 bp, Artificial Sequence
  Synthetic Construct
ggcttacacactttactgtcacacttag

SEQ ID NO: 4651 - DNA, 18 bp, Artificial Sequence
  Synthetic Construct
ctggcctctgggggtaca

SEQ ID NO: 4652 - DNA, 22 bp, Artificial Sequence
  Synthetic Construct
gtgggaatccatgaagctagct

SEQ ID NO: 4653 - DNA, 22 bp, Artificial Sequence
  Synthetic Construct
cacctggcaggaatgatggttt

SEQ ID NO: 4654 - DNA, 25 bp, Artificial Sequence
  Synthetic Construct
aaatgcttcaacacatcccttgaaa

SEQ ID NO: 4655 - DNA, 20 bp, Artificial Sequence
  Synthetic Construct
gcctctgccacttgctctgt

SEQ ID NO: 4656 - DNA, 20 bp, Artificial Sequence
  Synthetic Construct
acaccatcccctgagtgaca

SEQ ID NO: 4657 - DNA, 23 bp, Artificial Sequence
  Synthetic Construct
tccttcccagaccctatgctctt

SEQ ID NO: 4658 - DNA, 20 bp, Artificial Sequence
  Synthetic Construct
aactggagctggagcagttg

SEQ ID NO: 4659 - DNA, 27 bp, Artificial Sequence
  Synthetic Construct
gcaaacatccagtgaccttacatattg

SEQ ID NO: 4660 - DNA, 25 bp, Artificial Sequence
  Synthetic Construct
cagagtctctgaccatggattacac

SEQ ID NO: 4661 - DNA, 26 bp, Artificial Sequence
  Synthetic Construct
agtaacaggacagatgtcaattccat

SEQ ID NO: 4662 - DNA, 23 bp, Artificial Sequence
  Synthetic Construct
ctctactttcccacaggctttct

SEQ ID NO: 4663 - DNA, 22 bp, Artificial Sequence
  Synthetic Construct
atgctcttaggcatgggaagtc

SEQ ID NO: 4664 - DNA, 20 bp, Artificial Sequence
  Synthetic Construct
cagctcaggactgcagaaca

SEQ ID NO: 4665 - DNA, 21 bp, Artificial Sequence
  Synthetic Construct
acccacccagcttggaaaagg

SEQ ID NO: 4666 - DNA, 25 bp, Artificial Sequence
  Synthetic Construct
accctatagcctttatcagcaagga

SEQ ID NO: 4667 - DNA, 21 bp, Artificial Sequence
  Synthetic Construct
agaaccctggaatggcttcct

SEQ ID NO: 4668 - DNA, 20 bp, Artificial Sequence
  Synthetic Construct
gcgggtgacgttaggagaca

SEQ ID NO: 4669 - DNA, 20 bp, Artificial Sequence
  Synthetic Construct
aaggcagggacttggtgact

SEQ ID NO: 4670 - DNA, 22 bp, Artificial Sequence
  Synthetic Construct
aagctggctccactgagagaat

SEQ ID NO: 4671 - DNA, 19 bp, Artificial Sequence
  Synthetic Construct
cccccagcagtttgcatca

SEQ ID NO: 4672 - DNA, 19 bp, Artificial Sequence
  Synthetic Construct
ggtgccagttctgctgcat

SEQ ID NO: 4673 - DNA, 25 bp, Artificial Sequence
  Synthetic Construct
gtgcactacagctactttctgaagt

SEQ ID NO: 4674 - DNA, 25 bp, Artificial Sequence
  Synthetic Construct
ttcctacaccctcattcagttgttt

SEQ ID NO: 4675 - DNA, 19 bp, Artificial Sequence
  Synthetic Construct
ccggtcctcactgcctctt

SEQ ID NO: 4676 - DNA, 22 bp, Artificial Sequence
  Synthetic Construct
tcagtggtcgctcatctttgaa

SEQ ID NO: 4677 - DNA, 23 bp, Artificial Sequence
  Synthetic Construct
cctagaaaacggcttgtcatgga

SEQ ID NO: 4678 - DNA, 22 bp, Artificial Sequence
  Synthetic Construct
gggtaagctcacatgctctcat

SEQ ID NO: 4679 - DNA, 21 bp, Artificial Sequence
  Synthetic Construct
ctgggagcactccttgtcttt

SEQ ID NO: 4680 - DNA, 21 bp, Artificial Sequence
  Synthetic Construct
acaggccacccagagtaagac

SEQ ID NO: 4681 - DNA, 22 bp, Artificial Sequence
  Synthetic Construct
aagccagttttgctccctttgc

SEQ ID NO: 4682 - DNA, 28 bp, Artificial Sequence
  Synthetic Construct
tgcttttacttgagttatagctcagtca

SEQ ID NO: 4683 - DNA, 21 bp, Artificial Sequence
  Synthetic Construct
tctgcccatcaaaaccaacca

SEQ ID NO: 4684 - DNA, 22 bp, Artificial Sequence
  Synthetic Construct
agctcacccaatacctgtggaa

SEQ ID NO: 4685 - DNA, 26 bp, Artificial Sequence
  Synthetic Construct
gcaggagtgcattaagagtcaactag

SEQ ID NO: 4686 - DNA, 26 bp, Artificial Sequence
  Synthetic Construct
ctgaaatcctattgagtgtggatgca

SEQ ID NO: 4687 - DNA, 26 bp, Artificial Sequence
  Synthetic Construct
ccactcttagggagccatttcttacc

SEQ ID NO: 4688 - DNA, 21 bp, Artificial Sequence
  Synthetic Construct
tccatcacctgctagctgtga

SEQ ID NO: 4689 - DNA, 23 bp, Artificial Sequence
  Synthetic Construct
catcagtgtcagtgcagaacttg

SEQ ID NO: 4690 - DNA, 20 bp, Artificial Sequence
  Synthetic Construct
tgcggctgtgtgttaacaga

SEQ ID NO: 4691 - DNA, 20 bp, Artificial Sequence
  Synthetic Construct
acaaaacaggggcccatgga

SEQ ID NO: 4692 - DNA, 26 bp, Artificial Sequence
  Synthetic Construct
gaatgatgggagacagttttttagca

SEQ ID NO: 4693 - DNA, 19 bp, Artificial Sequence
  Synthetic Construct
agtggctggccggatccta

SEQ ID NO: 4694 - DNA, 25 bp, Artificial Sequence
  Synthetic Construct
gctaggtaggaggcaaattgtctca

SEQ ID NO: 4695 - DNA, 22 bp, Artificial Sequence
  Synthetic Construct
tctgccacccctcatgttctct

SEQ ID NO: 4696 - DNA, 22 bp, Artificial Sequence
  Synthetic Construct
tgcagtgggtcttctgattctg

SEQ ID NO: 4697 - DNA, 20 bp, Artificial Sequence
  Synthetic Construct
ggagaccccggcataagtct

SEQ ID NO: 4698 - DNA, 18 bp, Artificial Sequence
  Synthetic Construct
aggaggggcccacgctaa

SEQ ID NO: 4699 - DNA, 24 bp, Artificial Sequence
  Synthetic Construct
tggccttatcacagtctcttctct

SEQ ID NO: 4700 - DNA, 25 bp, Artificial Sequence
  Synthetic Construct
cctgagagtgtacttgttagttggt

SEQ ID NO: 4701 - DNA, 21 bp, Artificial Sequence
  Synthetic Construct
cgggagcttacttgcttctgt

SEQ ID NO: 4702 - DNA, 25 bp, Artificial Sequence
  Synthetic Construct
tcacaaatacagtggctaggtcatg

SEQ ID NO: 4703 - DNA, 22 bp, Artificial Sequence
  Synthetic Construct
tcctgagggccagtgaccttat

SEQ ID NO: 4704 - DNA, 22 bp, Artificial Sequence
  Synthetic Construct
gagctcactcctctcttttgca

SEQ ID NO: 4705 - DNA, 30 bp, Artificial Sequence
  Synthetic Construct
gccagtatcccatgtgaaatagactattgg

SEQ ID NO: 4706 - DNA, 18 bp, Artificial Sequence
  Synthetic Construct
cctgacccaggccagtct

SEQ ID NO: 4707 - DNA, 24 bp, Artificial Sequence
  Synthetic Construct
cctgttgtggttcgatggtttagc

SEQ ID NO: 4708 - DNA, 22 bp, Artificial Sequence
  Synthetic Construct
gtctcctttgctgcaggctttt

SEQ ID NO: 4709 - DNA, 20 bp, Artificial Sequence
  Synthetic Construct
ggggctacctttccctttcc

SEQ ID NO: 4710 - DNA, 22 bp, Artificial Sequence
  Synthetic Construct
gcttgtggtgatcgcttaaagg

SEQ ID NO: 4711 - DNA, 22 bp, Artificial Sequence
  Synthetic Construct
gcaaatctgcaacctggaagga

SEQ ID NO: 4712 - DNA, 22 bp, Artificial Sequence
  Synthetic Construct
tgttcagggcatgatcctgttc

SEQ ID NO: 4713 - DNA, 22 bp, Artificial Sequence
  Synthetic Construct
accacggtgctttctggaatgt

SEQ ID NO: 4714 - DNA, 26 bp, Artificial Sequence
  Synthetic Construct
gtccacaatacagagagtctcttctc

SEQ ID NO: 4715 - DNA, 23 bp, Artificial Sequence
  Synthetic Construct
aggttccagcaggtgtagaatgg

SEQ ID NO: 4716 - DNA, 22 bp, Artificial Sequence
  Synthetic Construct
tcactcggtctcagcgttagat

SEQ ID NO: 4717 - DNA, 26 bp, Artificial Sequence
  Synthetic Construct
ccaataaaatctgggggcttctcagt

SEQ ID NO: 4718 - DNA, 24 bp, Artificial Sequence
  Synthetic Construct
acggagcaagatcagcttcagtag

SEQ ID NO: 4719 - DNA, 24 bp, Artificial Sequence
  Synthetic Construct
gcagtctctatggggtcatagttg

SEQ ID NO: 4720 - DNA, 24 bp, Artificial Sequence
  Synthetic Construct
acttttctgcagtgatctccatct

SEQ ID NO: 4721 - DNA, 23 bp, Artificial Sequence
  Synthetic Construct
gcccagtcaagtctgtacccttt

SEQ ID NO: 4722 - DNA, 27 bp, Artificial Sequence
  Synthetic Construct
cccatttggaggtgaggaaatgtagtc

SEQ ID NO: 4723 - DNA, 24 bp, Artificial Sequence
  Synthetic Construct
tgagagctgaaatcaacactgctt

SEQ ID NO: 4724 - DNA, 20 bp, Artificial Sequence
  Synthetic Construct
acctgggcctgcctgtatga

SEQ ID NO: 4725 - DNA, 25 bp, Artificial Sequence
  Synthetic Construct
tctccagtttatagtgggtgagact

SEQ ID NO: 4726 - DNA, 24 bp, Artificial Sequence
  Synthetic Construct
ggtcactctatgtccctctgtgta

SEQ ID NO: 4727 - DNA, 24 bp, Artificial Sequence
  Synthetic Construct
gctcagctgtaggagatttgttct

SEQ ID NO: 4728 - DNA, 22 bp, Artificial Sequence
  Synthetic Construct
actgtttctgtcagggccagat

SEQ ID NO: 4729 - DNA, 23 bp, Artificial Sequence
  Synthetic Construct
ccttgcttttggtctggttttgg

SEQ ID NO: 4730 - DNA, 20 bp, Artificial Sequence
  Synthetic Construct
tggcgtgggcgtgttagaag

SEQ ID NO: 4731 - DNA, 26 bp, Artificial Sequence
  Synthetic Construct
ggtaggtagagggtaggttttgtaca

SEQ ID NO: 4732 - DNA, 22 bp, Artificial Sequence
  Synthetic Construct
gctttaggaatgcctgggatga

SEQ ID NO: 4733 - DNA, 28 bp, Artificial Sequence
  Synthetic Construct
ccaaactcttcccctaggttttatttgg

SEQ ID NO: 4734 - DNA, 28 bp, Artificial Sequence
  Synthetic Construct
ccctctagaaacctgtcttcatgggtta

SEQ ID NO: 4735 - DNA, 22 bp, Artificial Sequence
  Synthetic Construct
gggtccaatggcatttcagtga

SEQ ID NO: 4736 - DNA, 26 bp, Artificial Sequence
  Synthetic Construct
cctcagggactaagttctccatttcc

SEQ ID NO: 4737 - DNA, 22 bp, Artificial Sequence
  Synthetic Construct
gtgggaaggaaatgggacagat

SEQ ID NO: 4738 - DNA, 23 bp, Artificial Sequence
  Synthetic Construct
ctctgttctgccttgctgaaagt

SEQ ID NO: 4739 - DNA, 22 bp, Artificial Sequence
  Synthetic Construct
tggggtcacttggaagattgga

SEQ ID NO: 4740 - DNA, 24 bp, Artificial Sequence
  Synthetic Construct
tgtagccatttcccctatctaggt

SEQ ID NO: 4741 - DNA, 25 bp, Artificial Sequence
  Synthetic Construct
cttcaggcttggactagaagtacac

SEQ ID NO: 4742 - DNA, 24 bp, Artificial Sequence
  Synthetic Construct
ccagatcttcattgcgcctctgat

SEQ ID NO: 4743 - DNA, 26 bp, Artificial Sequence
  Synthetic Construct
ccaaccagctatgctaccatttctac

SEQ ID NO: 4744 - DNA, 26 bp, Artificial Sequence
  Synthetic Construct
gagagatggttcctatctctgaagct

SEQ ID NO: 4745 - DNA, 25 bp, Artificial Sequence
  Synthetic Construct
ctgttgattggtgtgaatggtagga

SEQ ID NO: 4746 - DNA, 23 bp, Artificial Sequence
  Synthetic Construct
cacaatacctgaggcacctagtg

SEQ ID NO: 4747 - DNA, 19 bp, Artificial Sequence
  Synthetic Construct
gctgagccactgcctcaca

SEQ ID NO: 4748 - DNA, 20 bp, Artificial Sequence
  Synthetic Construct
aggccatcgttgaagccaat

SEQ ID NO: 4749 - DNA, 26 bp, Artificial Sequence
  Synthetic Construct
tggaaaacccttcattcaaagtctga

SEQ ID NO: 4750 - DNA, 20 bp, Artificial Sequence
  Synthetic Construct
cacccgagctgttgtttgga

SEQ ID NO: 4751 - DNA, 20 bp, Artificial Sequence
  Synthetic Construct
gtgtctgctcagcacatggt

SEQ ID NO: 4752 - DNA, 21 bp, Artificial Sequence
  Synthetic Construct
tctctctgggcctcagaccat

SEQ ID NO: 4753 - DNA, 22 bp, Artificial Sequence
  Synthetic Construct
acagcccaccacagagattcat

SEQ ID NO: 4754 - DNA, 19 bp, Artificial Sequence
  Synthetic Construct
accgcactgcactgtggtt

SEQ ID NO: 4755 - DNA, 24 bp, Artificial Sequence
  Synthetic Construct
gtgaacagtgtctagggttttggt

SEQ ID NO: 4756 - DNA, 21 bp, Artificial Sequence
  Synthetic Construct
cgctcctctctcaccacctaa

SEQ ID NO: 4757 - DNA, 19 bp, Artificial Sequence
  Synthetic Construct
agcaagcaagcagcacact

SEQ ID NO: 4758 - DNA, 18 bp, Artificial Sequence
  Synthetic Construct
aggtgcagccccaagtga

SEQ ID NO: 4759 - DNA, 23 bp, Artificial Sequence
  Synthetic Construct
gtcttctcttctcaccccctact

SEQ ID NO: 4760 - DNA, 21 bp, Artificial Sequence
  Synthetic Construct
tgcttctccgtcacagctaag

SEQ ID NO: 4761 - DNA, 25 bp, Artificial Sequence
  Synthetic Construct
gctggccctttaaatatcccagaga

SEQ ID NO: 4762 - DNA, 22 bp, Artificial Sequence
  Synthetic Construct
tccagcagctagtaaggaagca

SEQ ID NO: 4763 - DNA, 21 bp, Artificial Sequence
  Synthetic Construct
tccccatgcacacaccctcta

SEQ ID NO: 4764 - DNA, 24 bp, Artificial Sequence
  Synthetic Construct
ttacattgacagcagggaacagat

SEQ ID NO: 4765 - DNA, 23 bp, Artificial Sequence
  Synthetic Construct
ccgaatggcgtcattgatgattt

SEQ ID NO: 4766 - DNA, 25 bp, Artificial Sequence
  Synthetic Construct
aaacctgaagagtacgtttggtttc

SEQ ID NO: 4767 - DNA, 20 bp, Artificial Sequence
  Synthetic Construct
gagccccagtctcctcttct

SEQ ID NO: 4768 - DNA, 25 bp, Artificial Sequence
  Synthetic Construct
gaggcactatcttgctaggatgtag

SEQ ID NO: 4769 - DNA, 26 bp, Artificial Sequence
  Synthetic Construct
aggttgattagtctctgtagtttgca

SEQ ID NO: 4770 - DNA, 26 bp, Artificial Sequence
  Synthetic Construct
gcttccattataggcttagcatctct

SEQ ID NO: 4771 - DNA, 27 bp, Artificial Sequence
  Synthetic Construct
gggagagaatgatcatcacttcttctc

SEQ ID NO: 4772 - DNA, 22 bp, Artificial Sequence
  Synthetic Construct
ctgtcactgacagtgctttcct

SEQ ID NO: 4773 - DNA, 22 bp, Artificial Sequence
  Synthetic Construct
tccatgataggggtgcattgca

SEQ ID NO: 4774 - DNA, 24 bp, Artificial Sequence
  Synthetic Construct
gagttctgagaaatagggcttgct

SEQ ID NO: 4775 - DNA, 20 bp, Artificial Sequence
  Synthetic Construct
tgattgtgccagctgactgt

SEQ ID NO: 4776 - DNA, 22 bp, Artificial Sequence
  Synthetic Construct
tgtgtcttctgtcccagagtca

SEQ ID NO: 4777 - DNA, 30 bp, Artificial Sequence
  Synthetic Construct
ggagagtagggatttttaccttttgcattc

SEQ ID NO: 4778 - DNA, 28 bp, Artificial Sequence
  Synthetic Construct
gtcattgacatggccacagagattaata

SEQ ID NO: 4779 - DNA, 23 bp, Artificial Sequence
  Synthetic Construct
gatattgccaaacgtccctcagt

SEQ ID NO: 4780 - DNA, 22 bp, Artificial Sequence
  Synthetic Construct
cagtgaatccaatgggccattg

SEQ ID NO: 4781 - DNA, 23 bp, Artificial Sequence
  Synthetic Construct
tgtctctgattgcctaggatggt

SEQ ID NO: 4782 - DNA, 26 bp, Artificial Sequence
  Synthetic Construct
aggagttaaataacttgcctgagcta

SEQ ID NO: 4783 - DNA, 23 bp, Artificial Sequence
  Synthetic Construct
tgctccaaccccacagtaaagtc

SEQ ID NO: 4784 - DNA, 22 bp, Artificial Sequence
  Synthetic Construct
gcagacaaggatccagttgcaa

SEQ ID NO: 4785 - DNA, 26 bp, Artificial Sequence
  Synthetic Construct
cgtgaacttcatcaacaccgaagtct

SEQ ID NO: 4786 - DNA, 22 bp, Artificial Sequence
  Synthetic Construct
ttcagatccctctgctggtaca

SEQ ID NO: 4787 - DNA, 20 bp, Artificial Sequence
  Synthetic Construct
ccagcaacagaaccgtctct

SEQ ID NO: 4788 - DNA, 19 bp, Artificial Sequence
  Synthetic Construct
aggagcccgtgcatttgct

SEQ ID NO: 4789 - DNA, 28 bp, Artificial Sequence
  Synthetic Construct
ggagataaccagaagtaaccatgaagct

SEQ ID NO: 4790 - DNA, 24 bp, Artificial Sequence
  Synthetic Construct
gacaatcagatggacctggtcttg

SEQ ID NO: 4791 - DNA, 22 bp, Artificial Sequence
  Synthetic Construct
tgctgctcaagtgtttccttct

SEQ ID NO: 4792 - DNA, 23 bp, Artificial Sequence
  Synthetic Construct
gctactctgcaatgtgccaacta

SEQ ID NO: 4793 - DNA, 25 bp, Artificial Sequence
  Synthetic Construct
agaacatttgttacaggcagaagtg

SEQ ID NO: 4794 - DNA, 22 bp, Artificial Sequence
  Synthetic Construct
tccacaatgggtgttgcatgtg

SEQ ID NO: 4795 - DNA, 20 bp, Artificial Sequence
  Synthetic Construct
gcatcctgggctccgaatgt

SEQ ID NO: 4796 - DNA, 27 bp, Artificial Sequence
  Synthetic Construct
tgggattttggctttctatcctttttg

SEQ ID NO: 4797 - DNA, 24 bp, Artificial Sequence
  Synthetic Construct
tctcagccaacattgagaggaaat

SEQ ID NO: 4798 - DNA, 22 bp, Artificial Sequence
  Synthetic Construct
tcgagtaacttgccaagggttt

SEQ ID NO: 4799 - DNA, 22 bp, Artificial Sequence
  Synthetic Construct
cacatccctcacaacctgttct

SEQ ID NO: 4800 - DNA, 22 bp, Artificial Sequence
  Synthetic Construct
tccaacagcaggtaggcaaatg

SEQ ID NO: 4801 - DNA, 21 bp, Artificial Sequence
  Synthetic Construct
ctgccaggttctcaggcattt

SEQ ID NO: 4802 - DNA, 22 bp, Artificial Sequence
  Synthetic Construct
tcaggcaggaactcttgctgta

SEQ ID NO: 4803 - DNA, 21 bp, Artificial Sequence
  Synthetic Construct
gatgaacccccaccctattgc

SEQ ID NO: 4804 - DNA, 29 bp, Artificial Sequence
  Synthetic Construct
gtcctggatataatttcaagactttgctt

SEQ ID NO: 4805 - DNA, 21 bp, Artificial Sequence
  Synthetic Construct
tcccacatcctgtcccattcc

SEQ ID NO: 4806 - DNA, 22 bp, Artificial Sequence
  Synthetic Construct
agggtgtgaaagaggaattgca

SEQ ID NO: 4807 - DNA, 24 bp, Artificial Sequence
  Synthetic Construct
ggccttatgtatagggaggaatgg

SEQ ID NO: 4808 - DNA, 23 bp, Artificial Sequence
  Synthetic Construct
aggcagagtctctctaccctttt

SEQ ID NO: 4809 - DNA, 21 bp, Artificial Sequence
  Synthetic Construct
tcaggaccctgggtactctct

SEQ ID NO: 4810 - DNA, 26 bp, Artificial Sequence
  Synthetic Construct
ccatcttaggtaccacagaaccttct

SEQ ID NO: 4811 - DNA, 22 bp, Artificial Sequence
  Synthetic Construct
gaagattcagcgccaagactca

SEQ ID NO: 4812 - DNA, 21 bp, Artificial Sequence
  Synthetic Construct
cgggcaaagcagaaggattcg

SEQ ID NO: 4813 - DNA, 27 bp, Artificial Sequence
  Synthetic Construct
tctacagatggaagtattctggacaag

SEQ ID NO: 4814 - DNA, 20 bp, Artificial Sequence
  Synthetic Construct
aaagctgggtggtgacgttt

SEQ ID NO: 4815 - DNA, 23 bp, Artificial Sequence
  Synthetic Construct
tgtaggcaaaaagctcaccctaa

SEQ ID NO: 4816 - DNA, 19 bp, Artificial Sequence
  Synthetic Construct
agcaccaccaccacgcaat

SEQ ID NO: 4817 - DNA, 21 bp, Artificial Sequence
  Synthetic Construct
atggggaagacagaggctcat

SEQ ID NO: 4818 - DNA, 24 bp, Artificial Sequence
  Synthetic Construct
tccctacctatacaccccaaaagg

SEQ ID NO: 4819 - DNA, 26 bp, Artificial Sequence
  Synthetic Construct
caaagatctttcatcatggccttcaa

SEQ ID NO: 4820 - DNA, 27 bp, Artificial Sequence
  Synthetic Construct
cccagagtacctatatattggccaatg

SEQ ID NO: 4821 - DNA, 19 bp, Artificial Sequence
  Synthetic Construct
agcacttccctggcaagca

SEQ ID NO: 4822 - DNA, 21 bp, Artificial Sequence
  Synthetic Construct
cacctgaggtggagtctagca

SEQ ID NO: 4823 - DNA, 22 bp, Artificial Sequence
  Synthetic Construct
ttctccagcatcacgtctctgt

SEQ ID NO: 4824 - DNA, 20 bp, Artificial Sequence
  Synthetic Construct
tgaccacaccccatcaggtt

SEQ ID NO: 4825 - DNA, 22 bp, Artificial Sequence
  Synthetic Construct
tctgcacttctacccaggcaat

SEQ ID NO: 4826 - DNA, 20 bp, Artificial Sequence
  Synthetic Construct
agcagagcctgaagcaatgg

SEQ ID NO: 4827 - DNA, 24 bp, Artificial Sequence
  Synthetic Construct
gtgcttttaccttcccactatgga

SEQ ID NO: 4828 - DNA, 24 bp, Artificial Sequence
  Synthetic Construct
gtgcaggagggttgtagacaagat

SEQ ID NO: 4829 - DNA, 27 bp, Artificial Sequence
  Synthetic Construct
gggcagtgtacaggcaaataaatcatc

SEQ ID NO: 4830 - DNA, 27 bp, Artificial Sequence
  Synthetic Construct
ttcattgtcaatcctggatctaagtgt

SEQ ID NO: 4831 - DNA, 19 bp, Artificial Sequence
  Synthetic Construct
gaggctcctccctgacaca

SEQ ID NO: 4832 - DNA, 27 bp, Artificial Sequence
  Synthetic Construct
gtaaatccaccagttacaattcccaat

SEQ ID NO: 4833 - DNA, 25 bp, Artificial Sequence
  Synthetic Construct
agataaaatcctccccactgagtct

SEQ ID NO: 4834 - DNA, 20 bp, Artificial Sequence
  Synthetic Construct
agtgtgctgagccttgtgtt

SEQ ID NO: 4835 - DNA, 29 bp, Artificial Sequence
  Synthetic Construct
agggcatatttaggaggttatctattcct

SEQ ID NO: 4836 - DNA, 19 bp, Artificial Sequence
  Synthetic Construct
aagggcctggagggtttgg

SEQ ID NO: 4837 - DNA, 24 bp, Artificial Sequence
  Synthetic Construct
gattcaagtagacagacccaagct

SEQ ID NO: 4838 - DNA, 25 bp, Artificial Sequence
  Synthetic Construct
ctgtgcagtttgtcctcctcatata

SEQ ID NO: 4839 - DNA, 22 bp, Artificial Sequence
  Synthetic Construct
aggaagaacagaggctgcatct

SEQ ID NO: 4840 - DNA, 25 bp, Artificial Sequence
  Synthetic Construct
gatatccaaggcctgaggatttcaa

SEQ ID NO: 4841 - DNA, 25 bp, Artificial Sequence
  Synthetic Construct
tgtgttctgtatgcattttgtgtgt

SEQ ID NO: 4842 - DNA, 24 bp, Artificial Sequence
  Synthetic Construct
ttggatccttctttccctcagttc

SEQ ID NO: 4843 - DNA, 27 bp, Artificial Sequence
  Synthetic Construct
cttgtaatgtcaccattttgtgaggat

SEQ ID NO: 4844 - DNA, 25 bp, Artificial Sequence
  Synthetic Construct
tctagtgacccaaaaacagcctaat

SEQ ID NO: 4845 - DNA, 24 bp, Artificial Sequence
  Synthetic Construct
ggtctgctgttttgcatgtttgct

SEQ ID NO: 4846 - DNA, 26 bp, Artificial Sequence
  Synthetic Construct
gacactgggtattaatggaggatctg

SEQ ID NO: 4847 - DNA, 28 bp, Artificial Sequence
  Synthetic Construct
ggagacaaacctgactagagttgagttg

SEQ ID NO: 4848 - DNA, 25 bp, Artificial Sequence
  Synthetic Construct
ccaagtgtgcttgtagctcattgag

SEQ ID NO: 4849 - DNA, 24 bp, Artificial Sequence
  Synthetic Construct
gtcgtattaggtgactgacactgt

SEQ ID NO: 4850 - DNA, 23 bp, Artificial Sequence
  Synthetic Construct
gcatgactaagcatgtgtttgca

SEQ ID NO: 4851 - DNA, 26 bp, Artificial Sequence
  Synthetic Construct
ccaaaccattggcctgtaaactttgt

SEQ ID NO: 4852 - DNA, 21 bp, Artificial Sequence
  Synthetic Construct
gacaatgggactgccatttgc

SEQ ID NO: 4853 - DNA, 25 bp, Artificial Sequence
  Synthetic Construct
gactaccttcaacatcatgggatca

SEQ ID NO: 4854 - DNA, 24 bp, Artificial Sequence
  Synthetic Construct
gggggtgtaatcacagctctgaat

SEQ ID NO: 4855 - DNA, 24 bp, Artificial Sequence
  Synthetic Construct
tctgagacatctttcctcgtttgg

SEQ ID NO: 4856 - DNA, 19 bp, Artificial Sequence
  Synthetic Construct
gggtgaacctggggacaca

SEQ ID NO: 4857 - DNA, 23 bp, Artificial Sequence
  Synthetic Construct
tccctagctctgagggtgaatgt

SEQ ID NO: 4858 - DNA, 19 bp, Artificial Sequence
  Synthetic Construct
cgtggctgctccaggttaa

SEQ ID NO: 4859 - DNA, 24 bp, Artificial Sequence
  Synthetic Construct
cctaccagagtcctgtgtcttcag

SEQ ID NO: 4860 - DNA, 25 bp, Artificial Sequence
  Synthetic Construct
tgtggactttgctgagcataactag

SEQ ID NO: 4861 - DNA, 23 bp, Artificial Sequence
  Synthetic Construct
agtgggtggatagtcaaggaaga

SEQ ID NO: 4862 - DNA, 24 bp, Artificial Sequence
  Synthetic Construct
gggaaactgagagagaagctgagt

SEQ ID NO: 4863 - DNA, 20 bp, Artificial Sequence
  Synthetic Construct
gttgtgggctacgcttgtca

SEQ ID NO: 4864 - DNA, 22 bp, Artificial Sequence
  Synthetic Construct
gctcacaggtacacgaaaatgg

SEQ ID NO: 4865 - DNA, 23 bp, Artificial Sequence
  Synthetic Construct
agaggaggagagaacaggacagt

SEQ ID NO: 4866 - DNA, 22 bp, Artificial Sequence
  Synthetic Construct
aaatgcccctcttgcctatgca

SEQ ID NO: 4867 - DNA, 22 bp, Artificial Sequence
  Synthetic Construct
tgctctgggctgtcgctaaatt

SEQ ID NO: 4868 - DNA, 26 bp, Artificial Sequence
  Synthetic Construct
gcagtcctgtcatccctctgttaatg

SEQ ID NO: 4869 - DNA, 20 bp, Artificial Sequence
  Synthetic Construct
aaacccacccaagccaacct

SEQ ID NO: 4870 - DNA, 24 bp, Artificial Sequence
  Synthetic Construct
ggtgtgaatggcagcctctaaatg

SEQ ID NO: 4871 - DNA, 20 bp, Artificial Sequence
  Synthetic Construct
ttggagggtggccttttgct

SEQ ID NO: 4872 - DNA, 22 bp, Artificial Sequence
  Synthetic Construct
ccggcatttctgaacactgtgt

SEQ ID NO: 4873 - DNA, 27 bp, Artificial Sequence
  Synthetic Construct
ctgagccagtagaaatttagacctcat

SEQ ID NO: 4874 - DNA, 22 bp, Artificial Sequence
  Synthetic Construct
tggtgaacttctccagcagttg

SEQ ID NO: 4875 - DNA, 19 bp, Artificial Sequence
  Synthetic Construct
tgtgtccgggcagagactt

SEQ ID NO: 4876 - DNA, 28 bp, Artificial Sequence
  Synthetic Construct
gagatgatagtaacataggggcatttgt

SEQ ID NO: 4877 - DNA, 24 bp, Artificial Sequence
  Synthetic Construct
ctccagaccccactttgattagtc

SEQ ID NO: 4878 - DNA, 20 bp, Artificial Sequence
  Synthetic Construct
atcttggtggtggcccttct

SEQ ID NO: 4879 - DNA, 24 bp, Artificial Sequence
  Synthetic Construct
ccttgctggaaccacgaattaaca

SEQ ID NO: 4880 - DNA, 26 bp, Artificial Sequence
  Synthetic Construct
cacacagctcaaattattggcagaga

SEQ ID NO: 4881 - DNA, 27 bp, Artificial Sequence
  Synthetic Construct
aggaattcaggtgaatatgttccaaca

SEQ ID NO: 4882 - DNA, 26 bp, Artificial Sequence
  Synthetic Construct
agttgaaaagaatctcaggtctggtt

SEQ ID NO: 4883 - DNA, 24 bp, Artificial Sequence
  Synthetic Construct
agtctccctctagccaagtattcc

SEQ ID NO: 4884 - DNA, 23 bp, Artificial Sequence
  Synthetic Construct
ccagtgtgagggttccttttctt

SEQ ID NO: 4885 - DNA, 27 bp, Artificial Sequence
  Synthetic Construct
gactcatcagtaaatgcagtcaactga

SEQ ID NO: 4886 - DNA, 26 bp, Artificial Sequence
  Synthetic Construct
gtctcactttttatgccgtggtttaa

SEQ ID NO: 4887 - DNA, 22 bp, Artificial Sequence
  Synthetic Construct
ccatctcactgcggagaagttt

SEQ ID NO: 4888 - DNA, 21 bp, Artificial Sequence
  Synthetic Construct
tctgctaggaagggctgagtt

SEQ ID NO: 4889 - DNA, 23 bp, Artificial Sequence
  Synthetic Construct
tgacccagaagagtttggagttg

SEQ ID NO: 4890 - DNA, 22 bp, Artificial Sequence
  Synthetic Construct
caacttgggcatcacagagcaa

SEQ ID NO: 4891 - DNA, 24 bp, Artificial Sequence
  Synthetic Construct
cttggggaaatacagggtcattct

SEQ ID NO: 4892 - DNA, 24 bp, Artificial Sequence
  Synthetic Construct
ctcttatgcccttggccatactct

SEQ ID NO: 4893 - DNA, 25 bp, Artificial Sequence
  Synthetic Construct
ccatcctggtgactgtttcctttca

SEQ ID NO: 4894 - DNA, 24 bp, Artificial Sequence
  Synthetic Construct
tgcttctttccttcctagctacca

SEQ ID NO: 4895 - DNA, 25 bp, Artificial Sequence
  Synthetic Construct
aaaaagagagagaggaaagcattgc

SEQ ID NO: 4896 - DNA, 21 bp, Artificial Sequence
  Synthetic Construct
cttggtctttgcgctgagaga

SEQ ID NO: 4897 - DNA, 28 bp, Artificial Sequence
  Synthetic Construct
ggaccataaaccgtttatgaatccctaa

SEQ ID NO: 4898 - DNA, 22 bp, Artificial Sequence
  Synthetic Construct
tggtggtttgctgtgtgtttac

SEQ ID NO: 4899 - DNA, 21 bp, Artificial Sequence
  Synthetic Construct
agaagctaccctgagcacaga

SEQ ID NO: 4900 - DNA, 23 bp, Artificial Sequence
  Synthetic Construct
tctgttttgaggaatggctgaca

SEQ ID NO: 4901 - DNA, 24 bp, Artificial Sequence
  Synthetic Construct
ggtctctcaggtgtgttcagtaga

SEQ ID NO: 4902 - DNA, 20 bp, Artificial Sequence
  Synthetic Construct
agtgcagcttttcccatggt

SEQ ID NO: 4903 - DNA, 21 bp, Artificial Sequence
  Synthetic Construct
atgagtacagggtggggacat

SEQ ID NO: 4904 - DNA, 22 bp, Artificial Sequence
  Synthetic Construct
ggtgaggcccctttatcctttt

SEQ ID NO: 4905 - DNA, 22 bp, Artificial Sequence
  Synthetic Construct
gcctcggaaactgtcagatggt

SEQ ID NO: 4906 - DNA, 30 bp, Artificial Sequence
  Synthetic Construct
gctactatgtaacatttcatatggcaaaga

SEQ ID NO: 4907 - DNA, 28 bp, Artificial Sequence
  Synthetic Construct
tgtctgaatctaagcttttctgcataga

SEQ ID NO: 4908 - DNA, 21 bp, Artificial Sequence
  Synthetic Construct
caaacagctggtgtgctcatc

SEQ ID NO: 4909 - DNA, 19 bp, Artificial Sequence
  Synthetic Construct
gtggcaggtccagggatct

SEQ ID NO: 4910 - DNA, 23 bp, Artificial Sequence
  Synthetic Construct
aggcctcctaacaggtattcaga

SEQ ID NO: 4911 - DNA, 25 bp, Artificial Sequence
  Synthetic Construct
gccaccacaaatacacttagaactc

SEQ ID NO: 4912 - DNA, 25 bp, Artificial Sequence
  Synthetic Construct
cctgctgggtatctgtaacaatgca

SEQ ID NO: 4913 - DNA, 23 bp, Artificial Sequence
  Synthetic Construct
agggattggcttatctcctctga

SEQ ID NO: 4914 - DNA, 23 bp, Artificial Sequence
  Synthetic Construct
acaacaaaatagggcaggtgcta

SEQ ID NO: 4915 - DNA, 29 bp, Artificial Sequence
  Synthetic Construct
tgataactgttgactgttaattccacaga

SEQ ID NO: 4916 - DNA, 22 bp, Artificial Sequence
  Synthetic Construct
aaagcaggcgggagaactagat

SEQ ID NO: 4917 - DNA, 24 bp, Artificial Sequence
  Synthetic Construct
cctcacctgtctttgcaactttgg

SEQ ID NO: 4918 - DNA, 24 bp, Artificial Sequence
  Synthetic Construct
acccctgatgaaggaaagggattg

SEQ ID NO: 4919 - DNA, 24 bp, Artificial Sequence
  Synthetic Construct
cagtgtgctgacagctgtatagca

SEQ ID NO: 4920 - DNA, 20 bp, Artificial Sequence
  Synthetic Construct
tgggtggggctcagtgttga

SEQ ID NO: 4921 - DNA, 24 bp, Artificial Sequence
  Synthetic Construct
gcagctacctgtctgtcctagaat

SEQ ID NO: 4922 - DNA, 22 bp, Artificial Sequence
  Synthetic Construct
agccattcggatcctggatggt

SEQ ID NO: 4923 - DNA, 22 bp, Artificial Sequence
  Synthetic Construct
gccaagttatgcgatgcattcc

SEQ ID NO: 4924 - DNA, 25 bp, Artificial Sequence
  Synthetic Construct
gtttttctcttcctcatgccccata

SEQ ID NO: 4925 - DNA, 20 bp, Artificial Sequence
  Synthetic Construct
ggtgcccctagtgctgagaa

SEQ ID NO: 4926 - DNA, 26 bp, Artificial Sequence
  Synthetic Construct
gagcctgtctagaaacctaagtggat

SEQ ID NO: 4927 - DNA, 25 bp, Artificial Sequence
  Synthetic Construct
ccaataccttgtgtctgtgtgttac

SEQ ID NO: 4928 - DNA, 22 bp, Artificial Sequence
  Synthetic Construct
tctggaactggacacacatgga

SEQ ID NO: 4929 - DNA, 23 bp, Artificial Sequence
  Synthetic Construct
cccatttgtgcttccacatactc

SEQ ID NO: 4930 - DNA, 20 bp, Artificial Sequence
  Synthetic Construct
ctggcaccaggtgttgctaa

SEQ ID NO: 4931 - DNA, 21 bp, Artificial Sequence
  Synthetic Construct
agcccaggtcaccaagagact

SEQ ID NO: 4932 - DNA, 19 bp, Artificial Sequence
  Synthetic Construct
agccccagttgctcacagt

SEQ ID NO: 4933 - DNA, 27 bp, Artificial Sequence
  Synthetic Construct
ggctgtgaggttttagatacacccttt

SEQ ID NO: 4934 - DNA, 26 bp, Artificial Sequence
  Synthetic Construct
ccaaaacagggcacttgaacattttg

SEQ ID NO: 4935 - DNA, 24 bp, Artificial Sequence
  Synthetic Construct
gcaaagtacaggccatgtgaacct

SEQ ID NO: 4936 - DNA, 25 bp, Artificial Sequence
  Synthetic Construct
gcaagaggaatggacagtagagaag

SEQ ID NO: 4937 - DNA, 20 bp, Artificial Sequence
  Synthetic Construct
tgagcagcttgagcacttgt

SEQ ID NO: 4938 - DNA, 23 bp, Artificial Sequence
  Synthetic Construct
ccctctccaaagaaaaggcctat

SEQ ID NO: 4939 - DNA, 22 bp, Artificial Sequence
  Synthetic Construct
gagcggaattcccagacatcat

SEQ ID NO: 4940 - DNA, 23 bp, Artificial Sequence
  Synthetic Construct
ggcattgtgtaggaaaggagaga

SEQ ID NO: 4941 - DNA, 18 bp, Artificial Sequence
  Synthetic Construct
gcgcacagccgtggaaag

SEQ ID NO: 4942 - DNA, 25 bp, Artificial Sequence
  Synthetic Construct
actgttcccagttagaggtgtaaca

SEQ ID NO: 4943 - DNA, 20 bp, Artificial Sequence
  Synthetic Construct
atgggccatcctgacatgct

SEQ ID NO: 4944 - DNA, 26 bp, Artificial Sequence
  Synthetic Construct
gtagctccagaaacctttctcatcta

SEQ ID NO: 4945 - DNA, 24 bp, Artificial Sequence
  Synthetic Construct
tcctgattgtagtcagcacagaga

SEQ ID NO: 4946 - DNA, 26 bp, Artificial Sequence
  Synthetic Construct
aggagaagagaagtacatgggttttc

SEQ ID NO: 4947 - DNA, 26 bp, Artificial Sequence
  Synthetic Construct
cctgatgccttcataaatgtgttgtg

SEQ ID NO: 4948 - DNA, 23 bp, Artificial Sequence
  Synthetic Construct
gaaatttgggtatgccgttgtca

SEQ ID NO: 4949 - DNA, 25 bp, Artificial Sequence
  Synthetic Construct
gtctggaaagatgcatggaagtaag

SEQ ID NO: 4950 - DNA, 24 bp, Artificial Sequence
  Synthetic Construct
ggaaacttagtgcagtagcggatt

SEQ ID NO: 4951 - DNA, 29 bp, Artificial Sequence
  Synthetic Construct
acaaaaatgatatgtgcaaaatccagttg

SEQ ID NO: 4952 - DNA, 24 bp, Artificial Sequence
  Synthetic Construct
acctctttaacccttcctgtagga

SEQ ID NO: 4953 - DNA, 20 bp, Artificial Sequence
  Synthetic Construct
cccaggcaccctctattcca

SEQ ID NO: 4954 - DNA, 22 bp, Artificial Sequence
  Synthetic Construct
tggtgcctgaatgtgagttcct

SEQ ID NO: 4955 - DNA, 25 bp, Artificial Sequence
  Synthetic Construct
tttatggcctacgctctttttgttc

SEQ ID NO: 4956 - DNA, 27 bp, Artificial Sequence
  Synthetic Construct
gcaatgggaatttgaatcaggtccaat

SEQ ID NO: 4957 - DNA, 22 bp, Artificial Sequence
  Synthetic Construct
gcaggcacagtattggctcaaa

SEQ ID NO: 4958 - DNA, 20 bp, Artificial Sequence
  Synthetic Construct
tgttgatgtggggggaagga

SEQ ID NO: 4959 - DNA, 24 bp, Artificial Sequence
  Synthetic Construct
acaccgcctgaggtagtgcaaata

SEQ ID NO: 4960 - DNA, 26 bp, Artificial Sequence
  Synthetic Construct
ctgaagtccagtaaggctctcacctt

SEQ ID NO: 4961 - DNA, 24 bp, Artificial Sequence
  Synthetic Construct
gaccaagatgtgagacctctttgg

SEQ ID NO: 4962 - DNA, 22 bp, Artificial Sequence
  Synthetic Construct
gcccataaacaccctggactca

SEQ ID NO: 4963 - DNA, 24 bp, Artificial Sequence
  Synthetic Construct
gcaagagcttcctggttgatctag

SEQ ID NO: 4964 - DNA, 20 bp, Artificial Sequence
  Synthetic Construct
cactgtgccaaccccttacc

SEQ ID NO: 4965 - DNA, 22 bp, Artificial Sequence
  Synthetic Construct
tgctctgtctctgctccattcc

SEQ ID NO: 4966 - DNA, 24 bp, Artificial Sequence
  Synthetic Construct
ttgtagcctgatgaacttcacaca

SEQ ID NO: 4967 - DNA, 23 bp, Artificial Sequence
  Synthetic Construct
gctgagactttcacagtgttcac

SEQ ID NO: 4968 - DNA, 24 bp, Artificial Sequence
  Synthetic Construct
tctaggcaagctacctgtaacttg

SEQ ID NO: 4969 - DNA, 20 bp, Artificial Sequence
  Synthetic Construct
acagccgtgaactccctaga

SEQ ID NO: 4970 - DNA, 20 bp, Artificial Sequence
  Synthetic Construct
cagggggacagcctgtctta

SEQ ID NO: 4971 - DNA, 24 bp, Artificial Sequence
  Synthetic Construct
gagaattccccaggtgtaggtgtt

SEQ ID NO: 4972 - DNA, 21 bp, Artificial Sequence
  Synthetic Construct
aggagccttcaaagccctgaa

SEQ ID NO: 4973 - DNA, 25 bp, Artificial Sequence
  Synthetic Construct
acagagagaatccacttggtttcaa

SEQ ID NO: 4974 - DNA, 25 bp, Artificial Sequence
  Synthetic Construct
aagcgttagttgctttggttagaag

SEQ ID NO: 4975 - DNA, 20 bp, Artificial Sequence
  Synthetic Construct
gcgttgcttaggccatttgc

SEQ ID NO: 4976 - DNA, 25 bp, Artificial Sequence
  Synthetic Construct
ggacacatgtcattgtgcagagatc

SEQ ID NO: 4977 - DNA, 24 bp, Artificial Sequence
  Synthetic Construct
gtgtcgagaaccggctgtaaatca

SEQ ID NO: 4978 - DNA, 28 bp, Artificial Sequence
  Synthetic Construct
ggggtataccttgtcatatggcataagc

SEQ ID NO: 4979 - DNA, 22 bp, Artificial Sequence
  Synthetic Construct
tgtctactgagccattgcagtt

SEQ ID NO: 4980 - DNA, 26 bp, Artificial Sequence
  Synthetic Construct
ggcagggagcttattcagatctacag

SEQ ID NO: 4981 - DNA, 19 bp, Artificial Sequence
  Synthetic Construct
tgctcacagtgccgtttga

SEQ ID NO: 4982 - DNA, 22 bp, Artificial Sequence
  Synthetic Construct
gcagaacatcaaaggccaatgt

SEQ ID NO: 4983 - DNA, 21 bp, Artificial Sequence
  Synthetic Construct
tcaatgcgctccctggtattt

SEQ ID NO: 4984 - DNA, 25 bp, Artificial Sequence
  Synthetic Construct
gtagtgatttccaagacctcaccat

SEQ ID NO: 4985 - DNA, 22 bp, Artificial Sequence
  Synthetic Construct
aagcagctcaggtgatcttcag

SEQ ID NO: 4986 - DNA, 25 bp, Artificial Sequence
  Synthetic Construct
gccagatagggtacagtgcctttaa

SEQ ID NO: 4987 - DNA, 28 bp, Artificial Sequence
  Synthetic Construct
cagtacttttccagttaggttcgttacc

SEQ ID NO: 4988 - DNA, 25 bp, Artificial Sequence
  Synthetic Construct
cgaccaaagagtcttaggcatatgc

SEQ ID NO: 4989 - DNA, 22 bp, Artificial Sequence
  Synthetic Construct
tcccttctcatgggggattacc

SEQ ID NO: 4990 - DNA, 28 bp, Artificial Sequence
  Synthetic Construct
caactggaaatgatgaaaataggctgat

SEQ ID NO: 4991 - DNA, 23 bp, Artificial Sequence
  Synthetic Construct
agtacagcaggaagtgggatagg

SEQ ID NO: 4992 - DNA, 22 bp, Artificial Sequence
  Synthetic Construct
gggcttttccatgcttctgcta

SEQ ID NO: 4993 - DNA, 25 bp, Artificial Sequence
  Synthetic Construct
gctctgaactgtcattggtggctat

SEQ ID NO: 4994 - DNA, 21 bp, Artificial Sequence
  Synthetic Construct
tggccaaagctctcaggtcat

SEQ ID NO: 4995 - DNA, 22 bp, Artificial Sequence
  Synthetic Construct
cctccagttctgtatgcaacca

SEQ ID NO: 4996 - DNA, 18 bp, Artificial Sequence
  Synthetic Construct
gtgcgtggtgggcttcat

SEQ ID NO: 4997 - DNA, 20 bp, Artificial Sequence
  Synthetic Construct
agcaaggaagggagcatcct

SEQ ID NO: 4998 - DNA, 29 bp, Artificial Sequence
  Synthetic Construct
gaatttgtgttaagcactatcctctactc

SEQ ID NO: 4999 - DNA, 24 bp, Artificial Sequence
  Synthetic Construct
gggaggatgactttggagctatgt

SEQ ID NO: 5000 - DNA, 21 bp, Artificial Sequence
  Synthetic Construct
atgtcagaagggggactgcat

SEQ ID NO: 5001 - DNA, 22 bp, Artificial Sequence
  Synthetic Construct
tgatcaggtgaaggggctaact

SEQ ID NO: 5002 - DNA, 21 bp, Artificial Sequence
  Synthetic Construct
ccatcaggcagtcacaatgct

SEQ ID NO: 5003 - DNA, 22 bp, Artificial Sequence
  Synthetic Construct
tggctccttgtccacagcataa

SEQ ID NO: 5004 - DNA, 29 bp, Artificial Sequence
  Synthetic Construct
ggactaagtagaagtagggtatcctatgt

SEQ ID NO: 5005 - DNA, 21 bp, Artificial Sequence
  Synthetic Construct
aagtgaaagggtggcattcca

SEQ ID NO: 5006 - DNA, 22 bp, Artificial Sequence
  Synthetic Construct
ttatcagcccatggagcaactc

SEQ ID NO: 5007 - DNA, 20 bp, Artificial Sequence
  Synthetic Construct
cgctgatcgccttcatacca

SEQ ID NO: 5008 - DNA, 28 bp, Artificial Sequence
  Synthetic Construct
ccactagtaaagggatttttctcatagc

SEQ ID NO: 5009 - DNA, 24 bp, Artificial Sequence
  Synthetic Construct
gagctcaagttcaaggtgaagctt

SEQ ID NO: 5010 - DNA, 25 bp, Artificial Sequence
  Synthetic Construct
gtctggtctcagtcctgtttaggtt

SEQ ID NO: 5011 - DNA, 22 bp, Artificial Sequence
  Synthetic Construct
aggcagggagaagcagctcatt

SEQ ID NO: 5012 - DNA, 21 bp, Artificial Sequence
  Synthetic Construct
ggtccctgggtgcattttagg

SEQ ID NO: 5013 - DNA, 22 bp, Artificial Sequence
  Synthetic Construct
tcccagggtaagttgccaagga

SEQ ID NO: 5014 - DNA, 20 bp, Artificial Sequence
  Synthetic Construct
ggcatggaggagacgagtgt

SEQ ID NO: 5015 - DNA, 21 bp, Artificial Sequence
  Synthetic Construct
agccatccttgcattgacagt

SEQ ID NO: 5016 - DNA, 23 bp, Artificial Sequence
  Synthetic Construct
cctctcaacgaaggcataatgct

SEQ ID NO: 5017 - DNA, 23 bp, Artificial Sequence
  Synthetic Construct
gcatttgtgcccagctaaatctt

SEQ ID NO: 5018 - DNA, 24 bp, Artificial Sequence
  Synthetic Construct
caaatgcctctatctcagctcaca

SEQ ID NO: 5019 - DNA, 23 bp, Artificial Sequence
  Synthetic Construct
agcagaatggctgagatttcaga

SEQ ID NO: 5020 - DNA, 22 bp, Artificial Sequence
  Synthetic Construct
aacatgggacctgaacaaacca

SEQ ID NO: 5021 - DNA, 27 bp, Artificial Sequence
  Synthetic Construct
gcttccactggagtttgagtttatgag

SEQ ID NO: 5022 - DNA, 23 bp, Artificial Sequence
  Synthetic Construct
gaaaataggcagactcggagcat

SEQ ID NO: 5023 - DNA, 20 bp, Artificial Sequence
  Synthetic Construct
ttcagggccactctgaagga

SEQ ID NO: 5024 - DNA, 24 bp, Artificial Sequence
  Synthetic Construct
caactctctgccttgaacttctgt

SEQ ID NO: 5025 - DNA, 25 bp, Artificial Sequence
  Synthetic Construct
acatgtacactgggtcagaatttgt

SEQ ID NO: 5026 - DNA, 22 bp, Artificial Sequence
  Synthetic Construct
gggaagactgttgtctgaagct

SEQ ID NO: 5027 - DNA, 27 bp, Artificial Sequence
  Synthetic Construct
gctacccattagacctatcagcatgtt

SEQ ID NO: 5028 - DNA, 22 bp, Artificial Sequence
  Synthetic Construct
ttccaggggcctgaacatcttt

SEQ ID NO: 5029 - DNA, 20 bp, Artificial Sequence
  Synthetic Construct
ccaacagccccacagagaga

SEQ ID NO: 5030 - DNA, 25 bp, Artificial Sequence
  Synthetic Construct
gattcacccaactcctctattctgt

SEQ ID NO: 5031 - DNA, 22 bp, Artificial Sequence
  Synthetic Construct
ggcttggaatgcagaagaggta

SEQ ID NO: 5032 - DNA, 26 bp, Artificial Sequence
  Synthetic Construct
acagtttctggcaaattctagaagct

SEQ ID NO: 5033 - DNA, 27 bp, Artificial Sequence
  Synthetic Construct
cctcaacaacccagtttttcagaaacc

SEQ ID NO: 5034 - DNA, 26 bp, Artificial Sequence
  Synthetic Construct
ctctcaagcacataaaagcacttacc

SEQ ID NO: 5035 - DNA, 21 bp, Artificial Sequence
  Synthetic Construct
cgggcagcgtcctgacatagt

SEQ ID NO: 5036 - DNA, 20 bp, Artificial Sequence
  Synthetic Construct
cccccctggagccctctttt

SEQ ID NO: 5037 - DNA, 26 bp, Artificial Sequence
  Synthetic Construct
caggatattgagcagttcccaaactc

SEQ ID NO: 5038 - DNA, 20 bp, Artificial Sequence
  Synthetic Construct
gctccagaggaagcggtcta

SEQ ID NO: 5039 - DNA, 22 bp, Artificial Sequence
  Synthetic Construct
aagccccagtaatgaccattgc

SEQ ID NO: 5040 - DNA, 22 bp, Artificial Sequence
  Synthetic Construct
gctggtgggatggaatgaatga

SEQ ID NO: 5041 - DNA, 24 bp, Artificial Sequence
  Synthetic Construct
gggcagtacagacaccatctctat

SEQ ID NO: 5042 - DNA, 24 bp, Artificial Sequence
  Synthetic Construct
gctgcatttgggtcgttttgtttc

SEQ ID NO: 5043 - DNA, 24 bp, Artificial Sequence
  Synthetic Construct
gacatttccaggcctgttgttagg

SEQ ID NO: 5044 - DNA, 20 bp, Artificial Sequence
  Synthetic Construct
tctgcaccccagttgtcact

SEQ ID NO: 5045 - DNA, 21 bp, Artificial Sequence
  Synthetic Construct
accgtccacatgttcctttcc

SEQ ID NO: 5046 - DNA, 22 bp, Artificial Sequence
  Synthetic Construct
cccaataggtgctgacctttgg

SEQ ID NO: 5047 - DNA, 26 bp, Artificial Sequence
  Synthetic Construct
ctgttcagttactttcaactctgctt

SEQ ID NO: 5048 - DNA, 27 bp, Artificial Sequence
  Synthetic Construct
cctactttgtgcctagagttgtactca

SEQ ID NO: 5049 - DNA, 28 bp, Artificial Sequence
  Synthetic Construct
gactaggaaattatcaagctggtttgtg

SEQ ID NO: 5050 - DNA, 22 bp, Artificial Sequence
  Synthetic Construct
ttctccaatgaccgggtgacaa

SEQ ID NO: 5051 - DNA, 27 bp, Artificial Sequence
  Synthetic Construct
ctggcactgttacatattttcctgaga

SEQ ID NO: 5052 - DNA, 24 bp, Artificial Sequence
  Synthetic Construct
agtatctgactgcaaggctgttac

SEQ ID NO: 5053 - DNA, 26 bp, Artificial Sequence
  Synthetic Construct
tggttgagacctgttatttccagtac

SEQ ID NO: 5054 - DNA, 26 bp, Artificial Sequence
  Synthetic Construct
tcaatgggctcatcagtagatatcag

SEQ ID NO: 5055 - DNA, 27 bp, Artificial Sequence
  Synthetic Construct
aacctgactttaatacaaacccaactg

SEQ ID NO: 5056 - DNA, 19 bp, Artificial Sequence
  Synthetic Construct
ggctgcatgcgagttcgtt

SEQ ID NO: 5057 - DNA, 26 bp, Artificial Sequence
  Synthetic Construct
gcatgttattctctccaggtccagaa

SEQ ID NO: 5058 - DNA, 23 bp, Artificial Sequence
  Synthetic Construct
gggacttgcaattcgatgtgaga

SEQ ID NO: 5059 - DNA, 21 bp, Artificial Sequence
  Synthetic Construct
gtggaaggtgaagcagagaca

SEQ ID NO: 5060 - DNA, 27 bp, Artificial Sequence
  Synthetic Construct
cctgattggtattggctttcaggatca

SEQ ID NO: 5061 - DNA, 26 bp, Artificial Sequence
  Synthetic Construct
gcaacaatccacatgaatggactatg

SEQ ID NO: 5062 - DNA, 23 bp, Artificial Sequence
  Synthetic Construct
agaagctcactggaattgcagat

SEQ ID NO: 5063 - DNA, 22 bp, Artificial Sequence
  Synthetic Construct
ggagctgctgtttttctgcttt

SEQ ID NO: 5064 - DNA, 24 bp, Artificial Sequence
  Synthetic Construct
gagtggtggaagttacctctcaac

SEQ ID NO: 5065 - DNA, 24 bp, Artificial Sequence
  Synthetic Construct
acagtttaagttttgcctgcttgt

SEQ ID NO: 5066 - DNA, 22 bp, Artificial Sequence
  Synthetic Construct
ctcttgccatggttctgctcta

SEQ ID NO: 5067 - DNA, 26 bp, Artificial Sequence
  Synthetic Construct
gggaatcatggttctctgctattgct

SEQ ID NO: 5068 - DNA, 27 bp, Artificial Sequence
  Synthetic Construct
cgataatgtcagtgatcctgggaattc

SEQ ID NO: 5069 - DNA, 22 bp, Artificial Sequence
  Synthetic Construct
tgcctccctgcatgatgattgt

SEQ ID NO: 5070 - DNA, 27 bp, Artificial Sequence
  Synthetic Construct
catagttctgggaatggattcatttgc

SEQ ID NO: 5071 - DNA, 27 bp, Artificial Sequence
  Synthetic Construct
cctcatatacctggaggaaaggagcat

SEQ ID NO: 5072 - DNA, 22 bp, Artificial Sequence
  Synthetic Construct
tgagattggcagcgaccttaac

SEQ ID NO: 5073 - DNA, 22 bp, Artificial Sequence
  Synthetic Construct
aggaggacatcagatcctgcat

SEQ ID NO: 5074 - DNA, 22 bp, Artificial Sequence
  Synthetic Construct
tgatggtggcttggacttcagt

SEQ ID NO: 5075 - DNA, 21 bp, Artificial Sequence
  Synthetic Construct
aagtgggttctcagggctcaa

SEQ ID NO: 5076 - DNA, 20 bp, Artificial Sequence
  Synthetic Construct
gtgcagccaagttggggaaa

SEQ ID NO: 5077 - DNA, 30 bp, Artificial Sequence
  Synthetic Construct
caaagtagataaaggttttcttccagtgtt

SEQ ID NO: 5078 - DNA, 18 bp, Artificial Sequence
  Synthetic Construct
ggccgcaagcactccttt

SEQ ID NO: 5079 - DNA, 22 bp, Artificial Sequence
  Synthetic Construct
agagtctggagggtggatccaa

SEQ ID NO: 5080 - DNA, 27 bp, Artificial Sequence
  Synthetic Construct
gcatttgaaaagcattatcgtctcatc

SEQ ID NO: 5081 - DNA, 23 bp, Artificial Sequence
  Synthetic Construct
accccacacaaccatacacaaag

SEQ ID NO: 5082 - DNA, 21 bp, Artificial Sequence
  Synthetic Construct
accttcctggtgcctgtgatg

SEQ ID NO: 5083 - DNA, 24 bp, Artificial Sequence
  Synthetic Construct
acacccacccctttctctaagtag

SEQ ID NO: 5084 - DNA, 26 bp, Artificial Sequence
  Synthetic Construct
gcctgataacctgctgattctcaaac

SEQ ID NO: 5085 - DNA, 19 bp, Artificial Sequence
  Synthetic Construct
aggtgggcaactgcaagca

SEQ ID NO: 5086 - DNA, 26 bp, Artificial Sequence
  Synthetic Construct
cagctatactgacggtaattgtaagc

SEQ ID NO: 5087 - DNA, 22 bp, Artificial Sequence
  Synthetic Construct
aagggaatggagcctgctagtt

SEQ ID NO: 5088 - DNA, 22 bp, Artificial Sequence
  Synthetic Construct
accaacttcctggactgcaaag

SEQ ID NO: 5089 - DNA, 25 bp, Artificial Sequence
  Synthetic Construct
gcatgtctatggcttggaaggtagt

SEQ ID NO: 5090 - DNA, 26 bp, Artificial Sequence
  Synthetic Construct
ggtatttggctgtctcaagattacac

SEQ ID NO: 5091 - DNA, 22 bp, Artificial Sequence
  Synthetic Construct
acgagcagcatcttctgactct

SEQ ID NO: 5092 - DNA, 23 bp, Artificial Sequence
  Synthetic Construct
tccataggtcaggctgactatgc

SEQ ID NO: 5093 - DNA, 25 bp, Artificial Sequence
  Synthetic Construct
gtcaagaatgatgcctggtttttgg

SEQ ID NO: 5094 - DNA, 21 bp, Artificial Sequence
  Synthetic Construct
gtggtgcctgtgccacaagaa

SEQ ID NO: 5095 - DNA, 21 bp, Artificial Sequence
  Synthetic Construct
agcagtagcaaggaggtgaca

SEQ ID NO: 5096 - DNA, 27 bp, Artificial Sequence
  Synthetic Construct
gggaggttagacttttactctctcaga

SEQ ID NO: 5097 - DNA, 21 bp, Artificial Sequence
  Synthetic Construct
gctggaaactccactgccatt

SEQ ID NO: 5098 - DNA, 22 bp, Artificial Sequence
  Synthetic Construct
tcccagttgcagccataactgt

SEQ ID NO: 5099 - DNA, 28 bp, Artificial Sequence
  Synthetic Construct
cagcaactacttctcaatctgtctacag

SEQ ID NO: 5100 - DNA, 23 bp, Artificial Sequence
  Synthetic Construct
gcatgtacaaaacaagcccttga

SEQ ID NO: 5101 - DNA, 24 bp, Artificial Sequence
  Synthetic Construct
ggagggtgagaccaagtctgtttt

SEQ ID NO: 5102 - DNA, 25 bp, Artificial Sequence
  Synthetic Construct
tcatcatgggtctgtgattgattga

SEQ ID NO: 5103 - DNA, 21 bp, Artificial Sequence
  Synthetic Construct
tgggatggtggtgtgagaagt

SEQ ID NO: 5104 - DNA, 22 bp, Artificial Sequence
  Synthetic Construct
tcctgagtggatggttgactct

SEQ ID NO: 5105 - DNA, 25 bp, Artificial Sequence
  Synthetic Construct
gataatgttgggagaggcaatttgg

SEQ ID NO: 5106 - DNA, 22 bp, Artificial Sequence
  Synthetic Construct
tgagaggtgagtggagtttgct

SEQ ID NO: 5107 - DNA, 23 bp, Artificial Sequence
  Synthetic Construct
cctgaatcccttttgtgcatgtg

SEQ ID NO: 5108 - DNA, 23 bp, Artificial Sequence
  Synthetic Construct
ccacctctgtaaacatgcaagga

SEQ ID NO: 5109 - DNA, 24 bp, Artificial Sequence
  Synthetic Construct
gtaaagggctctgttcttcaggaa

SEQ ID NO: 5110 - DNA, 21 bp, Artificial Sequence
  Synthetic Construct
tccaagacaagggagccagaa

SEQ ID NO: 5111 - DNA, 23 bp, Artificial Sequence
  Synthetic Construct
caccaaaaatcactggggttggt

SEQ ID NO: 5112 - DNA, 22 bp, Artificial Sequence
  Synthetic Construct
gcgacctctttcagtcaccaaa

SEQ ID NO: 5113 - DNA, 22 bp, Artificial Sequence
  Synthetic Construct
ctgctcctgtgagacagtaacc

SEQ ID NO: 5114 - DNA, 27 bp, Artificial Sequence
  Synthetic Construct
gacccatgtacttattagctgtgaact

SEQ ID NO: 5115 - DNA, 19 bp, Artificial Sequence
  Synthetic Construct
tgccgctctgccagattct

SEQ ID NO: 5116 - DNA, 24 bp, Artificial Sequence
  Synthetic Construct
tgccagagactttgccagatttcc

SEQ ID NO: 5117 - DNA, 23 bp, Artificial Sequence
  Synthetic Construct
tgctgagagaaggtgctatctct

SEQ ID NO: 5118 - DNA, 22 bp, Artificial Sequence
  Synthetic Construct
tctccatgccccttgatagtca

SEQ ID NO: 5119 - DNA, 22 bp, Artificial Sequence
  Synthetic Construct
ggcaaggagacctttcagatga

SEQ ID NO: 5120 - DNA, 23 bp, Artificial Sequence
  Synthetic Construct
actccctgaatgcctccttaacc

SEQ ID NO: 5121 - DNA, 21 bp, Artificial Sequence
  Synthetic Construct
gctgtggtcatgtaggaagct

SEQ ID NO: 5122 - DNA, 22 bp, Artificial Sequence
  Synthetic Construct
tgctgccccattgtcactttca

SEQ ID NO: 5123 - DNA, 21 bp, Artificial Sequence
  Synthetic Construct
tccccagctgacaatcatgca

SEQ ID NO: 5124 - DNA, 24 bp, Artificial Sequence
  Synthetic Construct
tgccaacaaggtgaaatagcagat

SEQ ID NO: 5125 - DNA, 26 bp, Artificial Sequence
  Synthetic Construct
cgagctgatctgagtacaatcacaga

SEQ ID NO: 5126 - DNA, 24 bp, Artificial Sequence
  Synthetic Construct
actcttttgtctctggctgtagag

SEQ ID NO: 5127 - DNA, 27 bp, Artificial Sequence
  Synthetic Construct
gcaaagatgaaaactggaagctacaac

SEQ ID NO: 5128 - DNA, 26 bp, Artificial Sequence
  Synthetic Construct
acatgacaggaaagtaaagctttgac

SEQ ID NO: 5129 - DNA, 25 bp, Artificial Sequence
  Synthetic Construct
ggggatagatgaagtgtggcaaaat

SEQ ID NO: 5130 - DNA, 25 bp, Artificial Sequence
  Synthetic Construct
tgaagtagaaggatgcagagacctt

SEQ ID NO: 5131 - DNA, 25 bp, Artificial Sequence
  Synthetic Construct
gagtttcctgtgacctaaccatgtg

SEQ ID NO: 5132 - DNA, 20 bp, Artificial Sequence
  Synthetic Construct
acgtgcctcagctgtgaaat

SEQ ID NO: 5133 - DNA, 25 bp, Artificial Sequence
  Synthetic Construct
ggacagacactgattaagggcaact

SEQ ID NO: 5134 - DNA, 22 bp, Artificial Sequence
  Synthetic Construct
cccagcatctttgtgaggagaa

SEQ ID NO: 5135 - DNA, 21 bp, Artificial Sequence
  Synthetic Construct
aggctcagctgcatcagacaa

SEQ ID NO: 5136 - DNA, 24 bp, Artificial Sequence
  Synthetic Construct
cttggaaaagtgagagcgttttga

SEQ ID NO: 5137 - DNA, 26 bp, Artificial Sequence
  Synthetic Construct
tttcaggcaagaaacaaatgatctgt

SEQ ID NO: 5138 - DNA, 21 bp, Artificial Sequence
  Synthetic Construct
atcggctcaggcacacttagt

SEQ ID NO: 5139 - DNA, 21 bp, Artificial Sequence
  Synthetic Construct
agggagtgtgtgggtttggtt

SEQ ID NO: 5140 - DNA, 22 bp, Artificial Sequence
  Synthetic Construct
gaaacagtgcctgcccaactat

SEQ ID NO: 5141 - DNA, 27 bp, Artificial Sequence
  Synthetic Construct
gcactaacagcccatgtacactaacag

SEQ ID NO: 5142 - DNA, 22 bp, Artificial Sequence
  Synthetic Construct
gaacaataggctgcctgtggtt

SEQ ID NO: 5143 - DNA, 23 bp, Artificial Sequence
  Synthetic Construct
tgaatctaggctgcctctgtaca

SEQ ID NO: 5144 - DNA, 26 bp, Artificial Sequence
  Synthetic Construct
gcatgctgatttgaaggaaactgtct

SEQ ID NO: 5145 - DNA, 22 bp, Artificial Sequence
  Synthetic Construct
gcaacaactgccagctttactg

SEQ ID NO: 5146 - DNA, 24 bp, Artificial Sequence
  Synthetic Construct
ccctgctagatcccaactgttcta

SEQ ID NO: 5147 - DNA, 20 bp, Artificial Sequence
  Synthetic Construct
acctgcagaggatggaagga

SEQ ID NO: 5148 - DNA, 22 bp, Artificial Sequence
  Synthetic Construct
acaaggctcaggattccaagct

SEQ ID NO: 5149 - DNA, 23 bp, Artificial Sequence
  Synthetic Construct
ctcagctttggattggaccttct

SEQ ID NO: 5150 - DNA, 22 bp, Artificial Sequence
  Synthetic Construct
ccaaaggccaggaagagggtat

SEQ ID NO: 5151 - DNA, 20 bp, Artificial Sequence
  Synthetic Construct
actgcactcagggcttgtca

SEQ ID NO: 5152 - DNA, 26 bp, Artificial Sequence
  Synthetic Construct
tgatttgggtgtcaatctgaaatcac

SEQ ID NO: 5153 - DNA, 22 bp, Artificial Sequence
  Synthetic Construct
aggtttctcaccaccctcatct

SEQ ID NO: 5154 - DNA, 22 bp, Artificial Sequence
  Synthetic Construct
cacatccagcgaccatcaacat

SEQ ID NO: 5155 - DNA, 22 bp, Artificial Sequence
  Synthetic Construct
caggttgcttgtttccaaacca

SEQ ID NO: 5156 - DNA, 22 bp, Artificial Sequence
  Synthetic Construct
tgttcccctctctgctctaacc

SEQ ID NO: 5157 - DNA, 28 bp, Artificial Sequence
  Synthetic Construct
ggttggcactataatagccaccattaaa

SEQ ID NO: 5158 - DNA, 21 bp, Artificial Sequence
  Synthetic Construct
acatgcagcatggagcaatgt

SEQ ID NO: 5159 - DNA, 26 bp, Artificial Sequence
  Synthetic Construct
gtgatgattggaatgggttagacaga

SEQ ID NO: 5160 - DNA, 20 bp, Artificial Sequence
  Synthetic Construct
gcttgctgcaattccccaaa

SEQ ID NO: 5161 - DNA, 21 bp, Artificial Sequence
  Synthetic Construct
acctctgccaggaacccagaa

SEQ ID NO: 5162 - DNA, 22 bp, Artificial Sequence
  Synthetic Construct
gtcttgctttaccgcagactga

SEQ ID NO: 5163 - DNA, 19 bp, Artificial Sequence
  Synthetic Construct
aggctcctctgcaggacat

SEQ ID NO: 5164 - DNA, 25 bp, Artificial Sequence
  Synthetic Construct
acaagccactgttacgtttctagat

SEQ ID NO: 5165 - DNA, 25 bp, Artificial Sequence
  Synthetic Construct
cctccgattgctttttgtgttccta

SEQ ID NO: 5166 - DNA, 28 bp, Artificial Sequence
  Synthetic Construct
tctcattgtgtttcatcaagatcactct

SEQ ID NO: 5167 - DNA, 22 bp, Artificial Sequence
  Synthetic Construct
cagtcacccaatgagctcatca

SEQ ID NO: 5168 - DNA, 19 bp, Artificial Sequence
  Synthetic Construct
tcgaggtgtggctgttcct

SEQ ID NO: 5169 - DNA, 19 bp, Artificial Sequence
  Synthetic Construct
tgctagcggctcagagctt

SEQ ID NO: 5170 - DNA, 26 bp, Artificial Sequence
  Synthetic Construct
agaccccatatttctccctattgaac

SEQ ID NO: 5171 - DNA, 24 bp, Artificial Sequence
  Synthetic Construct
cccgatgacatcacttttgcatct

SEQ ID NO: 5172 - DNA, 24 bp, Artificial Sequence
  Synthetic Construct
ccaagattccagcacaggtaccat

SEQ ID NO: 5173 - DNA, 24 bp, Artificial Sequence
  Synthetic Construct
gggggttttgccagtcatctaagt

SEQ ID NO: 5174 - DNA, 22 bp, Artificial Sequence
  Synthetic Construct
ggccacatggaaggcatgttta

SEQ ID NO: 5175 - DNA, 24 bp, Artificial Sequence
  Synthetic Construct
gcaaagttagggcagaaccaacca

SEQ ID NO: 5176 - DNA, 26 bp, Artificial Sequence
  Synthetic Construct
gggttcaataattccaccctcaactc

SEQ ID NO: 5177 - DNA, 24 bp, Artificial Sequence
  Synthetic Construct
gaccaagacctttccatcatccat

SEQ ID NO: 5178 - DNA, 23 bp, Artificial Sequence
  Synthetic Construct
tgtggcctctaagacctgagtag

SEQ ID NO: 5179 - DNA, 24 bp, Artificial Sequence
  Synthetic Construct
gagcagctgaacagtacaatacca

SEQ ID NO: 5180 - DNA, 26 bp, Artificial Sequence
  Synthetic Construct
gtcatatccttagggttcctggttct

SEQ ID NO: 5181 - DNA, 24 bp, Artificial Sequence
  Synthetic Construct
cagccacagtggaataaagtacca

SEQ ID NO: 5182 - DNA, 24 bp, Artificial Sequence
  Synthetic Construct
gttctgtgacaccatcttccatca

SEQ ID NO: 5183 - DNA, 23 bp, Artificial Sequence
  Synthetic Construct
tgctctccaggatctccagtcat

SEQ ID NO: 5184 - DNA, 26 bp, Artificial Sequence
  Synthetic Construct
agaacaacagcaaaacttgtgatctg

SEQ ID NO: 5185 - DNA, 21 bp, Artificial Sequence
  Synthetic Construct
tcagccaaccttgacctgtga

SEQ ID NO: 5186 - DNA, 27 bp, Artificial Sequence
  Synthetic Construct
gagatcctaagtctgtgatatggcaat

SEQ ID NO: 5187 - DNA, 24 bp, Artificial Sequence
  Synthetic Construct
ttctctctggatgtcccccttaag

SEQ ID NO: 5188 - DNA, 20 bp, Artificial Sequence
  Synthetic Construct
cctaggctgggtggatggat

SEQ ID NO: 5189 - DNA, 27 bp, Artificial Sequence
  Synthetic Construct
gtgggtagaaagaacatttcacattgc

SEQ ID NO: 5190 - DNA, 24 bp, Artificial Sequence
  Synthetic Construct
gagttgcttggtagggctggaatt

SEQ ID NO: 5191 - DNA, 22 bp, Artificial Sequence
  Synthetic Construct
acagatggtacccctgctgact

SEQ ID NO: 5192 - DNA, 25 bp, Artificial Sequence
  Synthetic Construct
gcacctatattcatgccaagagaga

SEQ ID NO: 5193 - DNA, 24 bp, Artificial Sequence
  Synthetic Construct
cctgaagatacaggcttccttcct

SEQ ID NO: 5194 - DNA, 21 bp, Artificial Sequence
  Synthetic Construct
tgcagtgggagtctccatgaa

SEQ ID NO: 5195 - DNA, 20 bp, Artificial Sequence
  Synthetic Construct
ctgtgagagccaacccacat

SEQ ID NO: 5196 - DNA, 23 bp, Artificial Sequence
  Synthetic Construct
acttgccttctaaaacccagtca

SEQ ID NO: 5197 - DNA, 21 bp, Artificial Sequence
  Synthetic Construct
cccactgagcctctgtctgta

SEQ ID NO: 5198 - DNA, 24 bp, Artificial Sequence
  Synthetic Construct
gcccacctgaaagtgtcaactaac

SEQ ID NO: 5199 - DNA, 24 bp, Artificial Sequence
  Synthetic Construct
gtatttgggtgcatgagttggttt

SEQ ID NO: 5200 - DNA, 22 bp, Artificial Sequence
  Synthetic Construct
ggaaaggcaggccagagtttaa

SEQ ID NO: 5201 - DNA, 23 bp, Artificial Sequence
  Synthetic Construct
ccacacctgcagaattagtacca

SEQ ID NO: 5202 - DNA, 20 bp, Artificial Sequence
  Synthetic Construct
acagggcttggggcttagga

SEQ ID NO: 5203 - DNA, 19 bp, Artificial Sequence
  Synthetic Construct
gggaaggagctggcgtgta

SEQ ID NO: 5204 - DNA, 23 bp, Artificial Sequence
  Synthetic Construct
tggtgcctgtgatggttaattcc

SEQ ID NO: 5205 - DNA, 24 bp, Artificial Sequence
  Synthetic Construct
aattagaatcagctgggcttagca

SEQ ID NO: 5206 - DNA, 22 bp, Artificial Sequence
  Synthetic Construct
agcacctgaattttggcagaga

SEQ ID NO: 5207 - DNA, 21 bp, Artificial Sequence
  Synthetic Construct
tttggggtggcatttcctgaa

SEQ ID NO: 5208 - DNA, 24 bp, Artificial Sequence
  Synthetic Construct
tctgacaggggatttcagctagtg

SEQ ID NO: 5209 - DNA, 21 bp, Artificial Sequence
  Synthetic Construct
gccactagcagacacctgtgt

SEQ ID NO: 5210 - DNA, 21 bp, Artificial Sequence
  Synthetic Construct
tgctgagctgatgggttgtag

SEQ ID NO: 5211 - DNA, 21 bp, Artificial Sequence
  Synthetic Construct
agccagactccagggatagag

SEQ ID NO: 5212 - DNA, 21 bp, Artificial Sequence
  Synthetic Construct
tgggtgagtcactggattgct

SEQ ID NO: 5213 - DNA, 25 bp, Artificial Sequence
  Synthetic Construct
cagagttagatgagtgggcttcctt

SEQ ID NO: 5214 - DNA, 27 bp, Artificial Sequence
  Synthetic Construct
ggttgtgaccctacttacttactcctt

SEQ ID NO: 5215 - DNA, 26 bp, Artificial Sequence
  Synthetic Construct
gaggatttattgagaggcgattgtca

SEQ ID NO: 5216 - DNA, 26 bp, Artificial Sequence
  Synthetic Construct
cccccaagaatcttaccttcagacta

SEQ ID NO: 5217 - DNA, 24 bp, Artificial Sequence
  Synthetic Construct
ctcgtgggctcctttccttaaatg

SEQ ID NO: 5218 - DNA, 22 bp, Artificial Sequence
  Synthetic Construct
gccttgtgaagagggggtagga

SEQ ID NO: 5219 - DNA, 24 bp, Artificial Sequence
  Synthetic Construct
cctgccttgaccagagtacagttt

SEQ ID NO: 5220 - DNA, 19 bp, Artificial Sequence
  Synthetic Construct
ccagcaccggtgagtgttt

SEQ ID NO: 5221 - DNA, 27 bp, Artificial Sequence
  Synthetic Construct
gcaggatagggattaggttcctaacag

SEQ ID NO: 5222 - DNA, 21 bp, Artificial Sequence
  Synthetic Construct
tgtggactcgtagccttcaga

SEQ ID NO: 5223 - DNA, 21 bp, Artificial Sequence
  Synthetic Construct
agctggtaaggggcatccatt

SEQ ID NO: 5224 - DNA, 25 bp, Artificial Sequence
  Synthetic Construct
ggggtctcttgtcttagagatgagt

SEQ ID NO: 5225 - DNA, 18 bp, Artificial Sequence
  Synthetic Construct
tggggccacgtctgaaca

SEQ ID NO: 5226 - DNA, 22 bp, Artificial Sequence
  Synthetic Construct
gtctcatgcagagttggtgact

SEQ ID NO: 5227 - DNA, 19 bp, Artificial Sequence
  Synthetic Construct
tcagcccaggctcgaacca

SEQ ID NO: 5228 - DNA, 23 bp, Artificial Sequence
  Synthetic Construct
acagattttgcccttggacagtt

SEQ ID NO: 5229 - DNA, 21 bp, Artificial Sequence
  Synthetic Construct
ttcctccaacactgccattgt

SEQ ID NO: 5230 - DNA, 27 bp, Artificial Sequence
  Synthetic Construct
ggaggttgggtgcatctaaatgtaagg

SEQ ID NO: 5231 - DNA, 29 bp, Artificial Sequence
  Synthetic Construct
aagtaagggtgtgatggtgtttattattc

SEQ ID NO: 5232 - DNA, 22 bp, Artificial Sequence
  Synthetic Construct
ggcagtgtgaaaggtgactgta

SEQ ID NO: 5233 - DNA, 25 bp, Artificial Sequence
  Synthetic Construct
caggtatgtttaggaacagcaagga

SEQ ID NO: 5234 - DNA, 22 bp, Artificial Sequence
  Synthetic Construct
aaggagcagcagactccaaagg

SEQ ID NO: 5235 - DNA, 24 bp, Artificial Sequence
  Synthetic Construct
gccaaaaactgacaagtggtactg

SEQ ID NO: 5236 - DNA, 21 bp, Artificial Sequence
  Synthetic Construct
ctgagtgtgttaggggcttgt

SEQ ID NO: 5237 - DNA, 18 bp, Artificial Sequence
  Synthetic Construct
tgctgcagcaacgtctgt

SEQ ID NO: 5238 - DNA, 26 bp, Artificial Sequence
  Synthetic Construct
gcatgactccaatgcactaagtagga

SEQ ID NO: 5239 - DNA, 26 bp, Artificial Sequence
  Synthetic Construct
gcttgctttagaactgactagcaaag

SEQ ID NO: 5240 - DNA, 22 bp, Artificial Sequence
  Synthetic Construct
tgggcttcctattcagcatcag

SEQ ID NO: 5241 - DNA, 25 bp, Artificial Sequence
  Synthetic Construct
ctgtagactgaaatcagggaattgc

SEQ ID NO: 5242 - DNA, 27 bp, Artificial Sequence
  Synthetic Construct
ggaagaatgttgggatgaaaagaaggt

SEQ ID NO: 5243 - DNA, 22 bp, Artificial Sequence
  Synthetic Construct
ggaatttggagggcaacatgga

SEQ ID NO: 5244 - DNA, 18 bp, Artificial Sequence
  Synthetic Construct
cagtgcgcgctccctgaa

SEQ ID NO: 5245 - DNA, 25 bp, Artificial Sequence
  Synthetic Construct
ctgggtctttcagaagtgacccata

SEQ ID NO: 5246 - DNA, 22 bp, Artificial Sequence
  Synthetic Construct
ggagcttgcttcccatttttcc

SEQ ID NO: 5247 - DNA, 23 bp, Artificial Sequence
  Synthetic Construct
agggaaggagttgtgagattcca

SEQ ID NO: 5248 - DNA, 22 bp, Artificial Sequence
  Synthetic Construct
tgaactggaattgcagcaacag

SEQ ID NO: 5249 - DNA, 22 bp, Artificial Sequence
  Synthetic Construct
gcaaagccttctctcgcacatt

SEQ ID NO: 5250 - DNA, 29 bp, Artificial Sequence
  Synthetic Construct
cctgtccatttgtatttaggtatgagctt

SEQ ID NO: 5251 - DNA, 29 bp, Artificial Sequence
  Synthetic Construct
gggttagctaggagtgagtattactaagc

SEQ ID NO: 5252 - DNA, 24 bp, Artificial Sequence
  Synthetic Construct
ggtggttccaaagaagggatcaga

SEQ ID NO: 5253 - DNA, 24 bp, Artificial Sequence
  Synthetic Construct
gcagacactcagtgcatgtttgtg

SEQ ID NO: 5254 - DNA, 21 bp, Artificial Sequence
  Synthetic Construct
cctcaagccagtggtctcttc

SEQ ID NO: 5255 - DNA, 22 bp, Artificial Sequence
  Synthetic Construct
tggcctaaaagtggcctgctat

SEQ ID NO: 5256 - DNA, 24 bp, Artificial Sequence
  Synthetic Construct
ctgtagtccttgaagggagaagga

SEQ ID NO: 5257 - DNA, 22 bp, Artificial Sequence
  Synthetic Construct
gatgtgctgagaagggttcaga

SEQ ID NO: 5258 - DNA, 25 bp, Artificial Sequence
  Synthetic Construct
gcaactttgtgcttaaacctgaagt

SEQ ID NO: 5259 - DNA, 18 bp, Artificial Sequence
  Synthetic Construct
aggcgggagtgctagcat

SEQ ID NO: 5260 - DNA, 22 bp, Artificial Sequence
  Synthetic Construct
cctgcctcattggtatgtggtt

SEQ ID NO: 5261 - DNA, 22 bp, Artificial Sequence
  Synthetic Construct
gctgagattttgcccagtacgt

SEQ ID NO: 5262 - DNA, 28 bp, Artificial Sequence
  Synthetic Construct
tgtatcttttgcagttacctcttaaacc

SEQ ID NO: 5263 - DNA, 22 bp, Artificial Sequence
  Synthetic Construct
aggaccacaacctgatgaagtc

SEQ ID NO: 5264 - DNA, 20 bp, Artificial Sequence
  Synthetic Construct
acctcatgcgtcaggactca

SEQ ID NO: 5265 - DNA, 26 bp, Artificial Sequence
  Synthetic Construct
tctgaatccctgttacattctttcca

SEQ ID NO: 5266 - DNA, 26 bp, Artificial Sequence
  Synthetic Construct
ccagagtatttgtctccaagctatcc

SEQ ID NO: 5267 - DNA, 21 bp, Artificial Sequence
  Synthetic Construct
ggcagtaaggaggccctgcta

SEQ ID NO: 5268 - DNA, 22 bp, Artificial Sequence
  Synthetic Construct
aacctgtattggctgcgtgagt

SEQ ID NO: 5269 - DNA, 22 bp, Artificial Sequence
  Synthetic Construct
agtttctgctctgccactacca

SEQ ID NO: 5270 - DNA, 25 bp, Artificial Sequence
  Synthetic Construct
gggtctagaatggattgcagctgtt

SEQ ID NO: 5271 - DNA, 19 bp, Artificial Sequence
  Synthetic Construct
aggccaagtcccaggtcaa

SEQ ID NO: 5272 - DNA, 19 bp, Artificial Sequence
  Synthetic Construct
tgggcccaagcaggactgt

SEQ ID NO: 5273 - DNA, 20 bp, Artificial Sequence
  Synthetic Construct
tcagtgcatggcctctctct

SEQ ID NO: 5274 - DNA, 23 bp, Artificial Sequence
  Synthetic Construct
tgtggccttcgagacaattactg

SEQ ID NO: 5275 - DNA, 24 bp, Artificial Sequence
  Synthetic Construct
cctgcaaaccgttgacaatttagg

SEQ ID NO: 5276 - DNA, 27 bp, Artificial Sequence
  Synthetic Construct
aaaatccacatagatttccaggtgaga

SEQ ID NO: 5277 - DNA, 23 bp, Artificial Sequence
  Synthetic Construct
ccatagggatgctgacatttgct

SEQ ID NO: 5278 - DNA, 24 bp, Artificial Sequence
  Synthetic Construct
ctgaggctcaaagtgatacagcta

SEQ ID NO: 5279 - DNA, 23 bp, Artificial Sequence
  Synthetic Construct
gaaaagaacagagctcccatgct

SEQ ID NO: 5280 - DNA, 24 bp, Artificial Sequence
  Synthetic Construct
cacgaacatcaaactgaggagcta

SEQ ID NO: 5281 - DNA, 28 bp, Artificial Sequence
  Synthetic Construct
ggttgtaacggaaatacaggttcagttg

SEQ ID NO: 5282 - DNA, 21 bp, Artificial Sequence
  Synthetic Construct
ctggctccaagctctttcgaa

SEQ ID NO: 5283 - DNA, 22 bp, Artificial Sequence
  Synthetic Construct
aaggtctgcctggtttctatgg

SEQ ID NO: 5284 - DNA, 28 bp, Artificial Sequence
  Synthetic Construct
agagtgagacttaggaatcattcattgg

SEQ ID NO: 5285 - DNA, 27 bp, Artificial Sequence
  Synthetic Construct
cgctcagtttacatatatgggttagga

SEQ ID NO: 5286 - DNA, 21 bp, Artificial Sequence
  Synthetic Construct
agaagtgtgcctgacgacaag

SEQ ID NO: 5287 - DNA, 22 bp, Artificial Sequence
  Synthetic Construct
gagctgggggtttgtgatcata

SEQ ID NO: 5288 - DNA, 24 bp, Artificial Sequence
  Synthetic Construct
ggaccaggtttctagcagtgagaa

SEQ ID NO: 5289 - DNA, 22 bp, Artificial Sequence
  Synthetic Construct
gcagacctggtcaagaagacat

SEQ ID NO: 5290 - DNA, 20 bp, Artificial Sequence
  Synthetic Construct
gccatggccctctgaaagca

SEQ ID NO: 5291 - DNA, 22 bp, Artificial Sequence
  Synthetic Construct
ccagcgatgttcagggatgtaa

SEQ ID NO: 5292 - DNA, 22 bp, Artificial Sequence
  Synthetic Construct
gtggtccttccatgacttgtga

SEQ ID NO: 5293 - DNA, 20 bp, Artificial Sequence
  Synthetic Construct
aatggacccaaggccacatg

SEQ ID NO: 5294 - DNA, 21 bp, Artificial Sequence
  Synthetic Construct
ctgcagggggattagggaaga

SEQ ID NO: 5295 - DNA, 25 bp, Artificial Sequence
  Synthetic Construct
cgcttccacctcttttgactgattc

SEQ ID NO: 5296 - DNA, 24 bp, Artificial Sequence
  Synthetic Construct
ggctggtgcagtaggaaattaacc

SEQ ID NO: 5297 - DNA, 24 bp, Artificial Sequence
  Synthetic Construct
cacctaccttcagcctttttagca

SEQ ID NO: 5298 - DNA, 18 bp, Artificial Sequence
  Synthetic Construct
gtaggcagcccccttcca

SEQ ID NO: 5299 - DNA, 22 bp, Artificial Sequence
  Synthetic Construct
gctccttcctactggcattcct

SEQ ID NO: 5300 - DNA, 22 bp, Artificial Sequence
  Synthetic Construct
ttgatgctgtgactgggagatg

SEQ ID NO: 5301 - DNA, 22 bp, Artificial Sequence
  Synthetic Construct
tgggagtcttcagacctgtctt

SEQ ID NO: 5302 - DNA, 25 bp, Artificial Sequence
  Synthetic Construct
cattactccaccagtgcaaatctct

SEQ ID NO: 5303 - DNA, 20 bp, Artificial Sequence
  Synthetic Construct
cagcagctggcactgacaca

SEQ ID NO: 5304 - DNA, 22 bp, Artificial Sequence
  Synthetic Construct
cccaatcaaggagccctgaaat

SEQ ID NO: 5305 - DNA, 27 bp, Artificial Sequence
  Synthetic Construct
ccaaacaaggaggcagaaaatgtaacc

SEQ ID NO: 5306 - DNA, 21 bp, Artificial Sequence
  Synthetic Construct
aaggacttctcagggcaagtg

SEQ ID NO: 5307 - DNA, 26 bp, Artificial Sequence
  Synthetic Construct
cagtagctgtcaagtttttccagaag

SEQ ID NO: 5308 - DNA, 24 bp, Artificial Sequence
  Synthetic Construct
gttttccccctttaccaggaatca

SEQ ID NO: 5309 - DNA, 22 bp, Artificial Sequence
  Synthetic Construct
aactgccacagaactccaagag

SEQ ID NO: 5310 - DNA, 22 bp, Artificial Sequence
  Synthetic Construct
ctatggggagcagcacattctt

SEQ ID NO: 5311 - DNA, 22 bp, Artificial Sequence
  Synthetic Construct
gaaggaagagacatgggccatt

SEQ ID NO: 5312 - DNA, 22 bp, Artificial Sequence
  Synthetic Construct
agtcccagcactaatcccaaga

SEQ ID NO: 5313 - DNA, 21 bp, Artificial Sequence
  Synthetic Construct
tgaacccaggcatgtgttcga

SEQ ID NO: 5314 - DNA, 24 bp, Artificial Sequence
  Synthetic Construct
ggagatagtcaccagtagcatgga

SEQ ID NO: 5315 - DNA, 26 bp, Artificial Sequence
  Synthetic Construct
tggttgatagcaagtacttgaaacct

SEQ ID NO: 5316 - DNA, 25 bp, Artificial Sequence
  Synthetic Construct
caattttccatttgcctgactctca

SEQ ID NO: 5317 - DNA, 23 bp, Artificial Sequence
  Synthetic Construct
ggtcaggaccaagagtggacata

SEQ ID NO: 5318 - DNA, 19 bp, Artificial Sequence
  Synthetic Construct
gggtgagtcccgtgtaggt

SEQ ID NO: 5319 - DNA, 26 bp, Artificial Sequence
  Synthetic Construct
ccttgtgctagacatgaagcaagatc

SEQ ID NO: 5320 - DNA, 27 bp, Artificial Sequence
  Synthetic Construct
ggatgtttttctcaccactatttccat

SEQ ID NO: 5321 - DNA, 25 bp, Artificial Sequence
  Synthetic Construct
gctgaccatttggcttcttggtttc

SEQ ID NO: 5322 - DNA, 26 bp, Artificial Sequence
  Synthetic Construct
gacacttaatacacactgtccggatt

SEQ ID NO: 5323 - DNA, 20 bp, Artificial Sequence
  Synthetic Construct
cgaggcaggaggtacacatc

SEQ ID NO: 5324 - DNA, 29 bp, Artificial Sequence
  Synthetic Construct
ccaatttagcacgtttcaaactggatttt

SEQ ID NO: 5325 - DNA, 22 bp, Artificial Sequence
  Synthetic Construct
cagtaagtgcacagtccttgct

SEQ ID NO: 5326 - DNA, 23 bp, Artificial Sequence
  Synthetic Construct
cgagatggatcctcgagtctttc

SEQ ID NO: 5327 - DNA, 24 bp, Artificial Sequence
  Synthetic Construct
ggaatcattgtgtcccaggaattg

SEQ ID NO: 5328 - DNA, 22 bp, Artificial Sequence
  Synthetic Construct
gcacagactgcacagatacact

SEQ ID NO: 5329 - DNA, 19 bp, Artificial Sequence
  Synthetic Construct
ccctgcagggttgcttagg

SEQ ID NO: 5330 - DNA, 23 bp, Artificial Sequence
  Synthetic Construct
tggggaaggtatctgtggtacct

SEQ ID NO: 5331 - DNA, 20 bp, Artificial Sequence
  Synthetic Construct
accccaagaagcaccttcca

SEQ ID NO: 5332 - DNA, 22 bp, Artificial Sequence
  Synthetic Construct
aagtccttgctgctggagaaga

SEQ ID NO: 5333 - DNA, 21 bp, Artificial Sequence
  Synthetic Construct
ctgctgagcagtggtactgtt

SEQ ID NO: 5334 - DNA, 21 bp, Artificial Sequence
  Synthetic Construct
agcaactgaacagcccattcc

SEQ ID NO: 5335 - DNA, 23 bp, Artificial Sequence
  Synthetic Construct
gcagtttccccttccaaattcac

SEQ ID NO: 5336 - DNA, 19 bp, Artificial Sequence
  Synthetic Construct
gggtcccagggggctgtaa

SEQ ID NO: 5337 - DNA, 21 bp, Artificial Sequence
  Synthetic Construct
cccagacaagaacaccagctt

SEQ ID NO: 5338 - DNA, 18 bp, Artificial Sequence
  Synthetic Construct
agctctggggtcgttgga

SEQ ID NO: 5339 - DNA, 25 bp, Artificial Sequence
  Synthetic Construct
cttgggtggtctgaaaaatgtaggt

SEQ ID NO: 5340 - DNA, 24 bp, Artificial Sequence
  Synthetic Construct
ccagctacctaggaccaagtcata

SEQ ID NO: 5341 - DNA, 26 bp, Artificial Sequence
  Synthetic Construct
agtcccatatccagctgattttaacc

SEQ ID NO: 5342 - DNA, 23 bp, Artificial Sequence
  Synthetic Construct
cgccttacagtccctacttcttc

SEQ ID NO: 5343 - DNA, 20 bp, Artificial Sequence
  Synthetic Construct
catgggagccaacagtcagt

SEQ ID NO: 5344 - DNA, 24 bp, Artificial Sequence
  Synthetic Construct
tttgaaatgaggaccacggtactt

SEQ ID NO: 5345 - DNA, 20 bp, Artificial Sequence
  Synthetic Construct
tgcatggaggatggggaagt

SEQ ID NO: 5346 - DNA, 23 bp, Artificial Sequence
  Synthetic Construct
caccgacaaaccttcccctcttt

SEQ ID NO: 5347 - DNA, 25 bp, Artificial Sequence
  Synthetic Construct
cagggaaagtgctgagtcattttca

SEQ ID NO: 5348 - DNA, 25 bp, Artificial Sequence
  Synthetic Construct
gaagagaagcaggtcactgaagtct

SEQ ID NO: 5349 - DNA, 24 bp, Artificial Sequence
  Synthetic Construct
gcttaagaaaccaggggccataac

SEQ ID NO: 5350 - DNA, 22 bp, Artificial Sequence
  Synthetic Construct
gggcttgaaaaacctgggtgtt

SEQ ID NO: 5351 - DNA, 22 bp, Artificial Sequence
  Synthetic Construct
gcgctttatggtgtccatacct

SEQ ID NO: 5352 - DNA, 25 bp, Artificial Sequence
  Synthetic Construct
gcatttcctaggactttctgtttgc

SEQ ID NO: 5353 - DNA, 20 bp, Artificial Sequence
  Synthetic Construct
tgtgctcatggaggctccta

SEQ ID NO: 5354 - DNA, 22 bp, Artificial Sequence
  Synthetic Construct
gtctcccatctctggtctctgt

SEQ ID NO: 5355 - DNA, 24 bp, Artificial Sequence
  Synthetic Construct
gtctgttcaggcttttgctttttg

SEQ ID NO: 5356 - DNA, 21 bp, Artificial Sequence
  Synthetic Construct
agggatgacagagcccaagta

SEQ ID NO: 5357 - DNA, 24 bp, Artificial Sequence
  Synthetic Construct
ggaggaatggtttctgaggagctt

SEQ ID NO: 5358 - DNA, 21 bp, Artificial Sequence
  Synthetic Construct
tgcccagtgaggtccaacagt

SEQ ID NO: 5359 - DNA, 22 bp, Artificial Sequence
  Synthetic Construct
acactggctctggaacaatgag

SEQ ID NO: 5360 - DNA, 22 bp, Artificial Sequence
  Synthetic Construct
tgaggttagttagggccaaagc

SEQ ID NO: 5361 - DNA, 21 bp, Artificial Sequence
  Synthetic Construct
cgagtttgggcaggcataagc

SEQ ID NO: 5362 - DNA, 21 bp, Artificial Sequence
  Synthetic Construct
ccgtccacctacatcatgctt

SEQ ID NO: 5363 - DNA, 23 bp, Artificial Sequence
  Synthetic Construct
gtgtttcgtggcttaacgtaagg

SEQ ID NO: 5364 - DNA, 25 bp, Artificial Sequence
  Synthetic Construct
catgaggtctatctgtcttcttgct

SEQ ID NO: 5365 - DNA, 22 bp, Artificial Sequence
  Synthetic Construct
gtgtgggccaaaggttgtagaa

SEQ ID NO: 5366 - DNA, 24 bp, Artificial Sequence
  Synthetic Construct
acaggaacttcccacctgatcttc

SEQ ID NO: 5367 - DNA, 22 bp, Artificial Sequence
  Synthetic Construct
acatgcaagatggcctcattca

SEQ ID NO: 5368 - DNA, 24 bp, Artificial Sequence
  Synthetic Construct
cctttagggcccttagacaccttt

SEQ ID NO: 5369 - DNA, 24 bp, Artificial Sequence
  Synthetic Construct
gaggctaaggacattgtacactgt

SEQ ID NO: 5370 - DNA, 24 bp, Artificial Sequence
  Synthetic Construct
gcatcataggggcttagaggttgt

SEQ ID NO: 5371 - DNA, 20 bp, Artificial Sequence
  Synthetic Construct
aggcctccacccctacttct

SEQ ID NO: 5372 - DNA, 23 bp, Artificial Sequence
  Synthetic Construct
cttatagtgaggcaagccctgtt

SEQ ID NO: 5373 - DNA, 20 bp, Artificial Sequence
  Synthetic Construct
aaggggaggggtgggagaaa

SEQ ID NO: 5374 - DNA, 25 bp, Artificial Sequence
  Synthetic Construct
cacctgtcccttgttcagtaatgag

SEQ ID NO: 5375 - DNA, 28 bp, Artificial Sequence
  Synthetic Construct
ggtgatacttagtaggaagcactgcttt

SEQ ID NO: 5376 - DNA, 24 bp, Artificial Sequence
  Synthetic Construct
cttagctctcatgcccctacatag

SEQ ID NO: 5377 - DNA, 21 bp, Artificial Sequence
  Synthetic Construct
caagcggggatgtcaagaaac

SEQ ID NO: 5378 - DNA, 21 bp, Artificial Sequence
  Synthetic Construct
accctcactcccttcaaccaa

SEQ ID NO: 5379 - DNA, 30 bp, Artificial Sequence
  Synthetic Construct
tgaatggttataacgacataatctgacact

SEQ ID NO: 5380 - DNA, 23 bp, Artificial Sequence
  Synthetic Construct
tggaagtgggagtagagggtaag

SEQ ID NO: 5381 - DNA, 21 bp, Artificial Sequence
  Synthetic Construct
aaggccaggattccagtgaag

SEQ ID NO: 5382 - DNA, 25 bp, Artificial Sequence
  Synthetic Construct
acctaagggaaatgggagtttgaat

SEQ ID NO: 5383 - DNA, 20 bp, Artificial Sequence
  Synthetic Construct
tgccccaccccatcaagact

SEQ ID NO: 5384 - DNA, 20 bp, Artificial Sequence
  Synthetic Construct
aggagtcccttgcactgttg

SEQ ID NO: 5385 - DNA, 21 bp, Artificial Sequence
  Synthetic Construct
acgctcataggtcacctgtct

SEQ ID NO: 5386 - DNA, 22 bp, Artificial Sequence
  Synthetic Construct
gggcttccactggtagacaaga

SEQ ID NO: 5387 - DNA, 19 bp, Artificial Sequence
  Synthetic Construct
ggcccgaaatggtgcttct

SEQ ID NO: 5388 - DNA, 20 bp, Artificial Sequence
  Synthetic Construct
aatgtgagcctggggattgg

SEQ ID NO: 5389 - DNA, 26 bp, Artificial Sequence
  Synthetic Construct
ggatgggatcatcaactcaaatgcaa

SEQ ID NO: 5390 - DNA, 22 bp, Artificial Sequence
  Synthetic Construct
acctagcaatgagacagcaaca

SEQ ID NO: 5391 - DNA, 20 bp, Artificial Sequence
  Synthetic Construct
acagcttcagtggctttgca

SEQ ID NO: 5392 - DNA, 26 bp, Artificial Sequence
  Synthetic Construct
ggctgattcagacttatctagcatga

SEQ ID NO: 5393 - DNA, 24 bp, Artificial Sequence
  Synthetic Construct
gcacaacatggactattgggtgtt

SEQ ID NO: 5394 - DNA, 22 bp, Artificial Sequence
  Synthetic Construct
tcttctcccaatccctgcaact

SEQ ID NO: 5395 - DNA, 20 bp, Artificial Sequence
  Synthetic Construct
ccagagctggccacactaag

SEQ ID NO: 5396 - DNA, 22 bp, Artificial Sequence
  Synthetic Construct
ttgagttcccacctgtctgttc

SEQ ID NO: 5397 - DNA, 23 bp, Artificial Sequence
  Synthetic Construct
ctcatctgctattgtcccaacct

SEQ ID NO: 5398 - DNA, 23 bp, Artificial Sequence
  Synthetic Construct
ggatggagaatgtgggaatcgaa

SEQ ID NO: 5399 - DNA, 24 bp, Artificial Sequence
  Synthetic Construct
gcaatggcaggtgtgatggtagaa

SEQ ID NO: 5400 - DNA, 21 bp, Artificial Sequence
  Synthetic Construct
aggttgttagcagggctgtga

SEQ ID NO: 5401 - DNA, 22 bp, Artificial Sequence
  Synthetic Construct
catcatggcagggattcaggtt

SEQ ID NO: 5402 - DNA, 28 bp, Artificial Sequence
  Synthetic Construct
aagaaaccatcttttaagtgttgggaat

SEQ ID NO: 5403 - DNA, 26 bp, Artificial Sequence
  Synthetic Construct
cctgtgagtgtggttgtaacaagaga

SEQ ID NO: 5404 - DNA, 22 bp, Artificial Sequence
  Synthetic Construct
ttccccaaatctggcagaagga

SEQ ID NO: 5405 - DNA, 21 bp, Artificial Sequence
  Synthetic Construct
tcccttcactctccccctcta

SEQ ID NO: 5406 - DNA, 20 bp, Artificial Sequence
  Synthetic Construct
ggagagggccatgtgacaag

SEQ ID NO: 5407 - DNA, 22 bp, Artificial Sequence
  Synthetic Construct
agctgttttccccaaagtgcta

SEQ ID NO: 5408 - DNA, 21 bp, Artificial Sequence
  Synthetic Construct
gccagctgggtttcattggaa

SEQ ID NO: 5409 - DNA, 24 bp, Artificial Sequence
  Synthetic Construct
gatgaagtgggatgtaggcaatga

SEQ ID NO: 5410 - DNA, 24 bp, Artificial Sequence
  Synthetic Construct
aacggccaaatagaacatgtagga

SEQ ID NO: 5411 - DNA, 23 bp, Artificial Sequence
  Synthetic Construct
gggaccaaagtctgtcacaatga

SEQ ID NO: 5412 - DNA, 24 bp, Artificial Sequence
  Synthetic Construct
gcagtgggctttccaaactgaaga

SEQ ID NO: 5413 - DNA, 22 bp, Artificial Sequence
  Synthetic Construct
tggtggctgatacatggcaagt

SEQ ID NO: 5414 - DNA, 27 bp, Artificial Sequence
  Synthetic Construct
cctctcccctgtatctactcaaatagc

SEQ ID NO: 5415 - DNA, 22 bp, Artificial Sequence
  Synthetic Construct
gagagaaggggacactgactca

SEQ ID NO: 5416 - DNA, 21 bp, Artificial Sequence
  Synthetic Construct
acaaggagcccatgtctttgc

SEQ ID NO: 5417 - DNA, 22 bp, Artificial Sequence
  Synthetic Construct
tggaacacagtgggagtcagta

SEQ ID NO: 5418 - DNA, 24 bp, Artificial Sequence
  Synthetic Construct
tccatctgtcaaggtgccatattt

SEQ ID NO: 5419 - DNA, 19 bp, Artificial Sequence
  Synthetic Construct
acccacccactcactccat

SEQ ID NO: 5420 - DNA, 22 bp, Artificial Sequence
  Synthetic Construct
aagccttggtgccctacttaga

SEQ ID NO: 5421 - DNA, 24 bp, Artificial Sequence
  Synthetic Construct
gtgtgatgtgatgtgatccacaag

SEQ ID NO: 5422 - DNA, 24 bp, Artificial Sequence
  Synthetic Construct
gacttccagttagaagcccacctt

SEQ ID NO: 5423 - DNA, 22 bp, Artificial Sequence
  Synthetic Construct
tcccagggccaaactctgagaa

SEQ ID NO: 5424 - DNA, 23 bp, Artificial Sequence
  Synthetic Construct
ctgtgttcaggtacaggtctgaa

SEQ ID NO: 5425 - DNA, 21 bp, Artificial Sequence
  Synthetic Construct
gctacccatgccactgggaaa

SEQ ID NO: 5426 - DNA, 24 bp, Artificial Sequence
  Synthetic Construct
agttaggtgtgtcagcttttcaca

SEQ ID NO: 5427 - DNA, 25 bp, Artificial Sequence
  Synthetic Construct
gcatccccttcagaatcatgaatcg

SEQ ID NO: 5428 - DNA, 20 bp, Artificial Sequence
  Synthetic Construct
gcacaggccgtcttcatgga

SEQ ID NO: 5429 - DNA, 21 bp, Artificial Sequence
  Synthetic Construct
caccgcccaacttgattcagt

SEQ ID NO: 5430 - DNA, 19 bp, Artificial Sequence
  Synthetic Construct
aggccaggacaaggtgtgt

SEQ ID NO: 5431 - DNA, 26 bp, Artificial Sequence
  Synthetic Construct
ggactcgaggaatggacattcatctg

SEQ ID NO: 5432 - DNA, 25 bp, Artificial Sequence
  Synthetic Construct
ctttgggagactgggtaacttttgc

SEQ ID NO: 5433 - DNA, 23 bp, Artificial Sequence
  Synthetic Construct
agggacctctatgactcctacac

SEQ ID NO: 5434 - DNA, 21 bp, Artificial Sequence
  Synthetic Construct
ggtttgtgtgacaggcattcc

SEQ ID NO: 5435 - DNA, 24 bp, Artificial Sequence
  Synthetic Construct
ctccctcaatccaggatgttcttc

SEQ ID NO: 5436 - DNA, 24 bp, Artificial Sequence
  Synthetic Construct
gcaggtcatcctttctccttctac

SEQ ID NO: 5437 - DNA, 24 bp, Artificial Sequence
  Synthetic Construct
tgtccctgagtctgagttttgttg

SEQ ID NO: 5438 - DNA, 25 bp, Artificial Sequence
  Synthetic Construct
tgatgagtggaagaagatgcaaaga

SEQ ID NO: 5439 - DNA, 23 bp, Artificial Sequence
  Synthetic Construct
gcaacttccctaaatccctccaa

SEQ ID NO: 5440 - DNA, 27 bp, Artificial Sequence
  Synthetic Construct
gctccaaatatctgaagagctcatgtg

SEQ ID NO: 5441 - DNA, 22 bp, Artificial Sequence
  Synthetic Construct
ctgacttcccctaggagtccat

SEQ ID NO: 5442 - DNA, 22 bp, Artificial Sequence
  Synthetic Construct
ctgtctgctggcattcagttca

SEQ ID NO: 5443 - DNA, 22 bp, Artificial Sequence
  Synthetic Construct
gcattgtgagctctccaaaggt

SEQ ID NO: 5444 - DNA, 20 bp, Artificial Sequence
  Synthetic Construct
ccagctctggcacctagaga

SEQ ID NO: 5445 - DNA, 27 bp, Artificial Sequence
  Synthetic Construct
gggtacaagctcaagttagaagtacag

SEQ ID NO: 5446 - DNA, 27 bp, Artificial Sequence
  Synthetic Construct
ggtaagacagttttccctactcttctc

SEQ ID NO: 5447 - DNA, 22 bp, Artificial Sequence
  Synthetic Construct
tgatggcagagcaaaccacaaa

SEQ ID NO: 5448 - DNA, 20 bp, Artificial Sequence
  Synthetic Construct
caggggcctcacacttgcat

SEQ ID NO: 5449 - DNA, 21 bp, Artificial Sequence
  Synthetic Construct
agctgcagtggttggaattgg

SEQ ID NO: 5450 - DNA, 22 bp, Artificial Sequence
  Synthetic Construct
acagggtgaggagactttctga

SEQ ID NO: 5451 - DNA, 26 bp, Artificial Sequence
  Synthetic Construct
cggcaagaacatcagctatgttaacc

SEQ ID NO: 5452 - DNA, 26 bp, Artificial Sequence
  Synthetic Construct
gccccagatcctagaaagagaatgtg

SEQ ID NO: 5453 - DNA, 23 bp, Artificial Sequence
  Synthetic Construct
tgagttgagagcctcagacttct

SEQ ID NO: 5454 - DNA, 20 bp, Artificial Sequence
  Synthetic Construct
agagccctctacccctctct

SEQ ID NO: 5455 - DNA, 24 bp, Artificial Sequence
  Synthetic Construct
accaagaaggacactgaggttcac

SEQ ID NO: 5456 - DNA, 21 bp, Artificial Sequence
  Synthetic Construct
actgtcccctctgcatggtat

SEQ ID NO: 5457 - DNA, 21 bp, Artificial Sequence
  Synthetic Construct
ttggctgctggggagcattta

SEQ ID NO: 5458 - DNA, 22 bp, Artificial Sequence
  Synthetic Construct
aggacaggacagagcttttgag

SEQ ID NO: 5459 - DNA, 26 bp, Artificial Sequence
  Synthetic Construct
tgtgcattcatagaggtgaggataaa

SEQ ID NO: 5460 - DNA, 21 bp, Artificial Sequence
  Synthetic Construct
ttgggcatgaacagcctacct

SEQ ID NO: 5461 - DNA, 24 bp, Artificial Sequence
  Synthetic Construct
gcagcagatggcacaatgtaaagg

SEQ ID NO: 5462 - DNA, 28 bp, Artificial Sequence
  Synthetic Construct
gtggaatccattatagggtgtgatacct

SEQ ID NO: 5463 - DNA, 22 bp, Artificial Sequence
  Synthetic Construct
tcagagcgtgctggctatgtta

SEQ ID NO: 5464 - DNA, 25 bp, Artificial Sequence
  Synthetic Construct
gcacagaactgttcagctagaggat

SEQ ID NO: 5465 - DNA, 22 bp, Artificial Sequence
  Synthetic Construct
ccctcatctccagatggcagaa

SEQ ID NO: 5466 - DNA, 25 bp, Artificial Sequence
  Synthetic Construct
gtcccagtgatctgttagagaaagg

SEQ ID NO: 5467 - DNA, 26 bp, Artificial Sequence
  Synthetic Construct
gccccaatcctagctaatcaggatca

SEQ ID NO: 5468 - DNA, 24 bp, Artificial Sequence
  Synthetic Construct
ccctactgtgtggcaatgaagaga

SEQ ID NO: 5469 - DNA, 25 bp, Artificial Sequence
  Synthetic Construct
agctatggcagaattatcactgctt

SEQ ID NO: 5470 - DNA, 24 bp, Artificial Sequence
  Synthetic Construct
gcgcacttctctctcaaacacact

SEQ ID NO: 5471 - DNA, 19 bp, Artificial Sequence
  Synthetic Construct
ggcctggaagacggggttt

SEQ ID NO: 5472 - DNA, 30 bp, Artificial Sequence
  Synthetic Construct
tgtctgataattacaacatctgtgtcatct

SEQ ID NO: 5473 - DNA, 21 bp, Artificial Sequence
  Synthetic Construct
agtggctgtggtggaaatcca

SEQ ID NO: 5474 - DNA, 21 bp, Artificial Sequence
  Synthetic Construct
aaacgaggctcttgggaatgg

SEQ ID NO: 5475 - DNA, 23 bp, Artificial Sequence
  Synthetic Construct
tgtatgtggactgcaaggttagg

SEQ ID NO: 5476 - DNA, 20 bp, Artificial Sequence
  Synthetic Construct
cctccctgaagcccaacaca

SEQ ID NO: 5477 - DNA, 26 bp, Artificial Sequence
  Synthetic Construct
ggtttttgtttgatctcacctggaaa

SEQ ID NO: 5478 - DNA, 19 bp, Artificial Sequence
  Synthetic Construct
aaggcaggcctcagaagca

SEQ ID NO: 5479 - DNA, 19 bp, Artificial Sequence
  Synthetic Construct
tggggagtgcagggagaga

SEQ ID NO: 5480 - DNA, 24 bp, Artificial Sequence
  Synthetic Construct
ctgatttacaccccgtgtaatgga

SEQ ID NO: 5481 - DNA, 19 bp, Artificial Sequence
  Synthetic Construct
ccaccaagaggcccaatgc

SEQ ID NO: 5482 - DNA, 26 bp, Artificial Sequence
  Synthetic Construct
ctgagatgtgtgagaggagatatgtg

SEQ ID NO: 5483 - DNA, 19 bp, Artificial Sequence
  Synthetic Construct
tggagagggctggcaatct

SEQ ID NO: 5484 - DNA, 29 bp, Artificial Sequence
  Synthetic Construct
gctacaaataatctggattcctgacatca

SEQ ID NO: 5485 - DNA, 21 bp, Artificial Sequence
  Synthetic Construct
tctggaagctctcccctatgc

SEQ ID NO: 5486 - DNA, 21 bp, Artificial Sequence
  Synthetic Construct
gagcccccagcattcagtgtt

SEQ ID NO: 5487 - DNA, 22 bp, Artificial Sequence
  Synthetic Construct
tttgctcctgggtgaagcaaga

SEQ ID NO: 5488 - DNA, 22 bp, Artificial Sequence
  Synthetic Construct
ggggccaatcaggaaattccat

SEQ ID NO: 5489 - DNA, 22 bp, Artificial Sequence
  Synthetic Construct
ctcatctgagggcttgaaacct

SEQ ID NO: 5490 - DNA, 20 bp, Artificial Sequence
  Synthetic Construct
aggcaggggaaacagaacca

SEQ ID NO: 5491 - DNA, 24 bp, Artificial Sequence
  Synthetic Construct
gtgctacagtagagacctgggaaa

SEQ ID NO: 5492 - DNA, 19 bp, Artificial Sequence
  Synthetic Construct
tgctcccgggagtccattg

SEQ ID NO: 5493 - DNA, 26 bp, Artificial Sequence
  Synthetic Construct
cactaggatgtttatcactgccatca

SEQ ID NO: 5494 - DNA, 23 bp, Artificial Sequence
  Synthetic Construct
gcagggagccatctgaaggtact

SEQ ID NO: 5495 - DNA, 21 bp, Artificial Sequence
  Synthetic Construct
tggaaggggatgatggagtgt

SEQ ID NO: 5496 - DNA, 22 bp, Artificial Sequence
  Synthetic Construct
ctgccacaggacactcaaattg

SEQ ID NO: 5497 - DNA, 24 bp, Artificial Sequence
  Synthetic Construct
aggtctcaccagacacagattcca

SEQ ID NO: 5498 - DNA, 21 bp, Artificial Sequence
  Synthetic Construct
tgcctgggacttcagctagca

SEQ ID NO: 5499 - DNA, 24 bp, Artificial Sequence
  Synthetic Construct
cactgctttattgtgtccagttgt

SEQ ID NO: 5500 - DNA, 23 bp, Artificial Sequence
  Synthetic Construct
gggtggcaaagctacaaaggaat

SEQ ID NO: 5501 - DNA, 22 bp, Artificial Sequence
  Synthetic Construct
gcaatggccacgtcaatatcct

SEQ ID NO: 5502 - DNA, 20 bp, Artificial Sequence
  Synthetic Construct
agacccgaagcacgtggtat

SEQ ID NO: 5503 - DNA, 22 bp, Artificial Sequence
  Synthetic Construct
tggagcatgtacctaggggaaa

SEQ ID NO: 5504 - DNA, 20 bp, Artificial Sequence
  Synthetic Construct
aggccaccataccacatgct

SEQ ID NO: 5505 - DNA, 26 bp, Artificial Sequence
  Synthetic Construct
ggctacacagtccatgtcataaatgc

SEQ ID NO: 5506 - DNA, 22 bp, Artificial Sequence
  Synthetic Construct
agactggggacaagatggcata

SEQ ID NO: 5507 - DNA, 27 bp, Artificial Sequence
  Synthetic Construct
ggccactgttaaaaaccaagttatgca

SEQ ID NO: 5508 - DNA, 24 bp, Artificial Sequence
  Synthetic Construct
gtttcccctcttctcttgccataa

SEQ ID NO: 5509 - DNA, 21 bp, Artificial Sequence
  Synthetic Construct
gcttggcggttgttgattggt

SEQ ID NO: 5510 - DNA, 21 bp, Artificial Sequence
  Synthetic Construct
ttctacagggcccttgggaat

SEQ ID NO: 5511 - DNA, 21 bp, Artificial Sequence
  Synthetic Construct
actggaggagacagcctttct

SEQ ID NO: 5512 - DNA, 26 bp, Artificial Sequence
  Synthetic Construct
gggtagagagaccgtttccacaatac

SEQ ID NO: 5513 - DNA, 22 bp, Artificial Sequence
  Synthetic Construct
aacttgctccagatcccatgtg

SEQ ID NO: 5514 - DNA, 23 bp, Artificial Sequence
  Synthetic Construct
gtgtgccaaggaaaagagacact

SEQ ID NO: 5515 - DNA, 23 bp, Artificial Sequence
  Synthetic Construct
cttgggataaggctctggttctc

SEQ ID NO: 5516 - DNA, 24 bp, Artificial Sequence
  Synthetic Construct
gacagaggagaacacatccttctc

SEQ ID NO: 5517 - DNA, 24 bp, Artificial Sequence
  Synthetic Construct
aaggtggatttatcgctcatgtct

SEQ ID NO: 5518 - DNA, 20 bp, Artificial Sequence
  Synthetic Construct
tcctcatctggcacgatggt

SEQ ID NO: 5519 - DNA, 23 bp, Artificial Sequence
  Synthetic Construct
tgcatcattgagggagtgtcatt

SEQ ID NO: 5520 - DNA, 27 bp, Artificial Sequence
  Synthetic Construct
gctaccattgaacttagggtgaaagtc

SEQ ID NO: 5521 - DNA, 24 bp, Artificial Sequence
  Synthetic Construct
ccgtaggtccctactactacaagt

SEQ ID NO: 5522 - DNA, 22 bp, Artificial Sequence
  Synthetic Construct
ctccagactgaattggccaact

SEQ ID NO: 5523 - DNA, 26 bp, Artificial Sequence
  Synthetic Construct
gggagagtgatctcaacatgtatcat

SEQ ID NO: 5524 - DNA, 23 bp, Artificial Sequence
  Synthetic Construct
ctcatcaccattgacgtcctaca

SEQ ID NO: 5525 - DNA, 22 bp, Artificial Sequence
  Synthetic Construct
cctgagtgttgggttgtgtgat

SEQ ID NO: 5526 - DNA, 22 bp, Artificial Sequence
  Synthetic Construct
tgtacctttggggagtcatcct

SEQ ID NO: 5527 - DNA, 25 bp, Artificial Sequence
  Synthetic Construct
tccttctaagacctgagagtgagaa

SEQ ID NO: 5528 - DNA, 23 bp, Artificial Sequence
  Synthetic Construct
gggaacagcaaccttatccagtt

SEQ ID NO: 5529 - DNA, 20 bp, Artificial Sequence
  Synthetic Construct
agtgggtagctggcacttct

SEQ ID NO: 5530 - DNA, 24 bp, Artificial Sequence
  Synthetic Construct
gtgaggatcagtcaaccaaccaat

SEQ ID NO: 5531 - DNA, 22 bp, Artificial Sequence
  Synthetic Construct
cctcaggtgtgctctccttgct

SEQ ID NO: 5532 - DNA, 23 bp, Artificial Sequence
  Synthetic Construct
ttggacaggcccaggataacatc

SEQ ID NO: 5533 - DNA, 22 bp, Artificial Sequence
  Synthetic Construct
tgttcacaccaggcagtgatct

SEQ ID NO: 5534 - DNA, 24 bp, Artificial Sequence
  Synthetic Construct
gcaaaccaaatcctagcacagaga

SEQ ID NO: 5535 - DNA, 21 bp, Artificial Sequence
  Synthetic Construct
tctgtcccacagctggagaag

SEQ ID NO: 5536 - DNA, 23 bp, Artificial Sequence
  Synthetic Construct
ccacactgcatttggaatttggt

SEQ ID NO: 5537 - DNA, 24 bp, Artificial Sequence
  Synthetic Construct
agtttctgggggaaggagtaacag

SEQ ID NO: 5538 - DNA, 22 bp, Artificial Sequence
  Synthetic Construct
cgaggtcgctcctttctaacca

SEQ ID NO: 5539 - DNA, 24 bp, Artificial Sequence
  Synthetic Construct
gggaagatttcctgcattcacctt

SEQ ID NO: 5540 - DNA, 22 bp, Artificial Sequence
  Synthetic Construct
cttaaggcagcaggatggtcaa

SEQ ID NO: 5541 - DNA, 20 bp, Artificial Sequence
  Synthetic Construct
agagtcagcagcatgcatgt

SEQ ID NO: 5542 - DNA, 22 bp, Artificial Sequence
  Synthetic Construct
aggagagtgctgaatggctgat

SEQ ID NO: 5543 - DNA, 20 bp, Artificial Sequence
  Synthetic Construct
ttgggggtcaggtgctcagt

SEQ ID NO: 5544 - DNA, 26 bp, Artificial Sequence
  Synthetic Construct
agaacatgtctgtagtccagatgttt

SEQ ID NO: 5545 - DNA, 18 bp, Artificial Sequence
  Synthetic Construct
ctgccaggccctgtcaca

SEQ ID NO: 5546 - DNA, 25 bp, Artificial Sequence
  Synthetic Construct
gacaggacagaagagtaggtaagct

SEQ ID NO: 5547 - DNA, 27 bp, Artificial Sequence
  Synthetic Construct
ggtgagaaatacataggtctcaggatt

SEQ ID NO: 5548 - DNA, 19 bp, Artificial Sequence
  Synthetic Construct
ccaggcctgagtcctgtgt

SEQ ID NO: 5549 - DNA, 27 bp, Artificial Sequence
  Synthetic Construct
aggaaggcatcatgctatataattgct

SEQ ID NO: 5550 - DNA, 28 bp, Artificial Sequence
  Synthetic Construct
gcctaaccttcaaagatacttcagtgtt

SEQ ID NO: 5551 - DNA, 26 bp, Artificial Sequence
  Synthetic Construct
ggtggtttagtacaaacatgctgagt

SEQ ID NO: 5552 - DNA, 22 bp, Artificial Sequence
  Synthetic Construct
gtcacgagcagctgcctaattt

SEQ ID NO: 5553 - DNA, 22 bp, Artificial Sequence
  Synthetic Construct
ccttttgcctttcccacctctt

SEQ ID NO: 5554 - DNA, 22 bp, Artificial Sequence
  Synthetic Construct
tggaggtcaaagtctccagcat

SEQ ID NO: 5555 - DNA, 20 bp, Artificial Sequence
  Synthetic Construct
gcctagcgcctgttgacctt

SEQ ID NO: 5556 - DNA, 26 bp, Artificial Sequence
  Synthetic Construct
cccagcccttaatcttaagtctaagc

SEQ ID NO: 5557 - DNA, 21 bp, Artificial Sequence
  Synthetic Construct
actgtgccagactctctttgg

SEQ ID NO: 5558 - DNA, 20 bp, Artificial Sequence
  Synthetic Construct
caggccttccacagaacaca

SEQ ID NO: 5559 - DNA, 20 bp, Artificial Sequence
  Synthetic Construct
ggccatccatgtgccaatcc

SEQ ID NO: 5560 - DNA, 24 bp, Artificial Sequence
  Synthetic Construct
caggatgttccaaggactcagaga

SEQ ID NO: 5561 - DNA, 26 bp, Artificial Sequence
  Synthetic Construct
ctgtgtgacatgtacaggtgaaagtt

SEQ ID NO: 5562 - DNA, 25 bp, Artificial Sequence
  Synthetic Construct
tccatagcttgcctcttctcatact

SEQ ID NO: 5563 - DNA, 22 bp, Artificial Sequence
  Synthetic Construct
ttggtgcagatgagaggtttgc

SEQ ID NO: 5564 - DNA, 23 bp, Artificial Sequence
  Synthetic Construct
atgtagtctagcctgggattcca

SEQ ID NO: 5565 - DNA, 20 bp, Artificial Sequence
  Synthetic Construct
aagccccacaccctggtaga

SEQ ID NO: 5566 - DNA, 19 bp, Artificial Sequence
  Synthetic Construct
tgcttgagcgtggcaggtt

SEQ ID NO: 5567 - DNA, 19 bp, Artificial Sequence
  Synthetic Construct
agccgtcctgaagctgtgt

SEQ ID NO: 5568 - DNA, 20 bp, Artificial Sequence
  Synthetic Construct
ccactggctcaaccctcctt

SEQ ID NO: 5569 - DNA, 24 bp, Artificial Sequence
  Synthetic Construct
ggtctcattttcctgccccttgaa

SEQ ID NO: 5570 - DNA, 24 bp, Artificial Sequence
  Synthetic Construct
aggagagcaccactttcagttctc

SEQ ID NO: 5571 - DNA, 27 bp, Artificial Sequence
  Synthetic Construct
cagagtgtcttacttttctcactgtca

SEQ ID NO: 5572 - DNA, 24 bp, Artificial Sequence
  Synthetic Construct
gtgaagcagcagagttaacaagac

SEQ ID NO: 5573 - DNA, 21 bp, Artificial Sequence
  Synthetic Construct
agatccgtcaggctcaacact

SEQ ID NO: 5574 - DNA, 26 bp, Artificial Sequence
  Synthetic Construct
gctgggtcatgttaatcctgtttgtc

SEQ ID NO: 5575 - DNA, 22 bp, Artificial Sequence
  Synthetic Construct
cctgggccttgtcattgtcttt

SEQ ID NO: 5576 - DNA, 27 bp, Artificial Sequence
  Synthetic Construct
cccacaaaaattagctgtgtagtcttg

SEQ ID NO: 5577 - DNA, 28 bp, Artificial Sequence
  Synthetic Construct
gcatgatatgtctttcagtcacctgtga

SEQ ID NO: 5578 - DNA, 26 bp, Artificial Sequence
  Synthetic Construct
ttatatgcattcagctcttccaggat

SEQ ID NO: 5579 - DNA, 23 bp, Artificial Sequence
  Synthetic Construct
atcctgggaggcatcggtgacaa

SEQ ID NO: 5580 - DNA, 24 bp, Artificial Sequence
  Synthetic Construct
gccagttgttctctatggccttaa

SEQ ID NO: 5581 - DNA, 24 bp, Artificial Sequence
  Synthetic Construct
tgtacctagagagacctgggaact

SEQ ID NO: 5582 - DNA, 26 bp, Artificial Sequence
  Synthetic Construct
aggatgctgtaatacaatgtcaggat

SEQ ID NO: 5583 - DNA, 30 bp, Artificial Sequence
  Synthetic Construct
tgatggttttgttgtaaaattctgtaggta

SEQ ID NO: 5584 - DNA, 26 bp, Artificial Sequence
  Synthetic Construct
caacaacccacttttgacatcatctc

SEQ ID NO: 5585 - DNA, 21 bp, Artificial Sequence
  Synthetic Construct
ttacctggctccaccgaaaca

SEQ ID NO: 5586 - DNA, 22 bp, Artificial Sequence
  Synthetic Construct
actggaagttggggggatttca

SEQ ID NO: 5587 - DNA, 23 bp, Artificial Sequence
  Synthetic Construct
gacagcccctgtccattaatagg

SEQ ID NO: 5588 - DNA, 21 bp, Artificial Sequence
  Synthetic Construct
caggactaagcagccaagaca

SEQ ID NO: 5589 - DNA, 20 bp, Artificial Sequence
  Synthetic Construct
tttgcaccaaggccatgcat

SEQ ID NO: 5590 - DNA, 21 bp, Artificial Sequence
  Synthetic Construct
agggaggttccagctcaatcc

SEQ ID NO: 5591 - DNA, 26 bp, Artificial Sequence
  Synthetic Construct
agtgaactgagtttttgtacctacct

SEQ ID NO: 5592 - DNA, 25 bp, Artificial Sequence
  Synthetic Construct
tcactgtctgaaatgcttgttacca

SEQ ID NO: 5593 - DNA, 25 bp, Artificial Sequence
  Synthetic Construct
ccaaagtaagtgacagcaaacttct

SEQ ID NO: 5594 - DNA, 22 bp, Artificial Sequence
  Synthetic Construct
ctttaccattggagggcttcct

SEQ ID NO: 5595 - DNA, 24 bp, Artificial Sequence
  Synthetic Construct
ccttctcttctcatgggacagaag

SEQ ID NO: 5596 - DNA, 28 bp, Artificial Sequence
  Synthetic Construct
ggagtctgaatgaaaaacggttctctca

SEQ ID NO: 5597 - DNA, 21 bp, Artificial Sequence
  Synthetic Construct
tccccaccaaagttgcagaca

SEQ ID NO: 5598 - DNA, 19 bp, Artificial Sequence
  Synthetic Construct
ttaacccccgccagtcgta

SEQ ID NO: 5599 - DNA, 28 bp, Artificial Sequence
  Synthetic Construct
atgaagaaattcaatctagacccatcct

SEQ ID NO: 5600 - DNA, 29 bp, Artificial Sequence
  Synthetic Construct
cgggactatactctaccgtagttcatcag

SEQ ID NO: 5601 - DNA, 28 bp, Artificial Sequence
  Synthetic Construct
gtccctatccactaaactgatatcacaa

SEQ ID NO: 5602 - DNA, 20 bp, Artificial Sequence
  Synthetic Construct
gtgacagcaggcttctctgt

SEQ ID NO: 5603 - DNA, 21 bp, Artificial Sequence
  Synthetic Construct
aactggggttgaggtgggaat

SEQ ID NO: 5604 - DNA, 27 bp, Artificial Sequence
  Synthetic Construct
tggagaataaaccccagatttctagtg

SEQ ID NO: 5605 - DNA, 19 bp, Artificial Sequence
  Synthetic Construct
agctgtgtgggccgcaaaa

SEQ ID NO: 5606 - DNA, 28 bp, Artificial Sequence
  Synthetic Construct
gcaaagatcaatgtgaacccatcatctc

SEQ ID NO: 5607 - DNA, 24 bp, Artificial Sequence
  Synthetic Construct
ctggttctgcagtaatacgtggtt

SEQ ID NO: 5608 - DNA, 22 bp, Artificial Sequence
  Synthetic Construct
agcaaatgctccctctgtgcat

SEQ ID NO: 5609 - DNA, 21 bp, Artificial Sequence
  Synthetic Construct
acccagtcctgaagccattgc

SEQ ID NO: 5610 - DNA, 22 bp, Artificial Sequence
  Synthetic Construct
tcaagttgagcaggccagtgaa

SEQ ID NO: 5611 - DNA, 20 bp, Artificial Sequence
  Synthetic Construct
cccctggggattgaccttga

SEQ ID NO: 5612 - DNA, 21 bp, Artificial Sequence
  Synthetic Construct
tctcacccacacgagacaagt

SEQ ID NO: 5613 - DNA, 24 bp, Artificial Sequence
  Synthetic Construct
agacatggattcctgagccatacc

SEQ ID NO: 5614 - DNA, 20 bp, Artificial Sequence
  Synthetic Construct
gtcactgcgccagtcataca

SEQ ID NO: 5615 - DNA, 30 bp, Artificial Sequence
  Synthetic Construct
cccaaaagtaagagatctccatttcatcag

SEQ ID NO: 5616 - DNA, 29 bp, Artificial Sequence
  Synthetic Construct
cctgattcctagtattttggggaggaatg

SEQ ID NO: 5617 - DNA, 21 bp, Artificial Sequence
  Synthetic Construct
ttgccacccatcgcatcaaga

SEQ ID NO: 5618 - DNA, 23 bp, Artificial Sequence
  Synthetic Construct
tcgggaaaagaggcctttattgg

SEQ ID NO: 5619 - DNA, 24 bp, Artificial Sequence
  Synthetic Construct
gataggccccaagatgatggtaag

SEQ ID NO: 5620 - DNA, 24 bp, Artificial Sequence
  Synthetic Construct
ctgcctttgttgacctagaatgca

SEQ ID NO: 5621 - DNA, 23 bp, Artificial Sequence
  Synthetic Construct
agattgcccctgacattttgtga

SEQ ID NO: 5622 - DNA, 23 bp, Artificial Sequence
  Synthetic Construct
gctccttagaacaacctgtgtga

SEQ ID NO: 5623 - DNA, 22 bp, Artificial Sequence
  Synthetic Construct
ggcagggaaagagtggacattt

SEQ ID NO: 5624 - DNA, 25 bp, Artificial Sequence
  Synthetic Construct
atggaatgttgatcctcctttccat

SEQ ID NO: 5625 - DNA, 21 bp, Artificial Sequence
  Synthetic Construct
caatgcccaccacagatgtga

SEQ ID NO: 5626 - DNA, 23 bp, Artificial Sequence
  Synthetic Construct
gtggccaaggagatttcaatgca

SEQ ID NO: 5627 - DNA, 28 bp, Artificial Sequence
  Synthetic Construct
tcattcctgaatctgggtatttgtagtc

SEQ ID NO: 5628 - DNA, 21 bp, Artificial Sequence
  Synthetic Construct
gggcttcgcagagactgatct

SEQ ID NO: 5629 - DNA, 23 bp, Artificial Sequence
  Synthetic Construct
cctgactttgcccccttttgatt

SEQ ID NO: 5630 - DNA, 22 bp, Artificial Sequence
  Synthetic Construct
agtcaatcaacccaggaaagca

SEQ ID NO: 5631 - DNA, 30 bp, Artificial Sequence
  Synthetic Construct
gtgttttttacccagattcctaaagtttcc

SEQ ID NO: 5632 - DNA, 21 bp, Artificial Sequence
  Synthetic Construct
gcccagtgtacctgtgtctca

SEQ ID NO: 5633 - DNA, 26 bp, Artificial Sequence
  Synthetic Construct
gcctggagtaccaaagtcactttgac

SEQ ID NO: 5634 - DNA, 25 bp, Artificial Sequence
  Synthetic Construct
caagttactacttctggtggccaaa

SEQ ID NO: 5635 - DNA, 23 bp, Artificial Sequence
  Synthetic Construct
aaagccaaggcatcccttagaaa

SEQ ID NO: 5636 - DNA, 19 bp, Artificial Sequence
  Synthetic Construct
gcaacctgggagccttgct

SEQ ID NO: 5637 - DNA, 24 bp, Artificial Sequence
  Synthetic Construct
cctcacagagtagtttgggcacta

SEQ ID NO: 5638 - DNA, 25 bp, Artificial Sequence
  Synthetic Construct
gctagggaataagatgccacagctt

SEQ ID NO: 5639 - DNA, 24 bp, Artificial Sequence
  Synthetic Construct
ggggtttaaatcacagaggtgttg

SEQ ID NO: 5640 - DNA, 22 bp, Artificial Sequence
  Synthetic Construct
ctctgtctcactcagccatcgt

SEQ ID NO: 5641 - DNA, 20 bp, Artificial Sequence
  Synthetic Construct
tgcctccacactggccaaag

SEQ ID NO: 5642 - DNA, 23 bp, Artificial Sequence
  Synthetic Construct
acatggtgatgttggctgtatcc

SEQ ID NO: 5643 - DNA, 20 bp, Artificial Sequence
  Synthetic Construct
accaaggcagcctcacaatt

SEQ ID NO: 5644 - DNA, 21 bp, Artificial Sequence
  Synthetic Construct
aggaaccctcttcccaaacgt

SEQ ID NO: 5645 - DNA, 25 bp, Artificial Sequence
  Synthetic Construct
caaaacaagttgtagaccggatctg

SEQ ID NO: 5646 - DNA, 28 bp, Artificial Sequence
  Synthetic Construct
gtgaatctttaaagacccaacacttgac

SEQ ID NO: 5647 - DNA, 20 bp, Artificial Sequence
  Synthetic Construct
ctgactgcgtgggacttctg

SEQ ID NO: 5648 - DNA, 28 bp, Artificial Sequence
  Synthetic Construct
ggagcaatactcttccagttctttcttc

SEQ ID NO: 5649 - DNA, 24 bp, Artificial Sequence
  Synthetic Construct
acatccgaatacccagttcctctt

SEQ ID NO: 5650 - DNA, 24 bp, Artificial Sequence
  Synthetic Construct
ggcactgtatccaggtatgatgag

SEQ ID NO: 5651 - DNA, 26 bp, Artificial Sequence
  Synthetic Construct
gggagaaagggtgatgtaaagggtta

SEQ ID NO: 5652 - DNA, 24 bp, Artificial Sequence
  Synthetic Construct
gcacaaggggaaagcatgatttag

SEQ ID NO: 5653 - DNA, 24 bp, Artificial Sequence
  Synthetic Construct
gctagcacacagcaagttaattgg

SEQ ID NO: 5654 - DNA, 20 bp, Artificial Sequence
  Synthetic Construct
tgcccaaacttccgctactg

SEQ ID NO: 5655 - DNA, 25 bp, Artificial Sequence
  Synthetic Construct
ctgcatagaaaaggagtgaggaaca

SEQ ID NO: 5656 - DNA, 26 bp, Artificial Sequence
  Synthetic Construct
gaaaagagccttttccttctgttgac

SEQ ID NO: 5657 - DNA, 25 bp, Artificial Sequence
  Synthetic Construct
atgatctcaacaccaaactcttcct

SEQ ID NO: 5658 - DNA, 27 bp, Artificial Sequence
  Synthetic Construct
gagaagattttgtaagcaaggtgaact

SEQ ID NO: 5659 - DNA, 24 bp, Artificial Sequence
  Synthetic Construct
ggaccatccctgactcttacattc

SEQ ID NO: 5660 - DNA, 26 bp, Artificial Sequence
  Synthetic Construct
ttcctgaactaagtttggctctaaca

SEQ ID NO: 5661 - DNA, 21 bp, Artificial Sequence
  Synthetic Construct
tgtgctctgaggactctctgt

SEQ ID NO: 5662 - DNA, 21 bp, Artificial Sequence
  Synthetic Construct
agggcccagaccacattagat

SEQ ID NO: 5663 - DNA, 22 bp, Artificial Sequence
  Synthetic Construct
aggagtttgcagagccaatcag

SEQ ID NO: 5664 - DNA, 23 bp, Artificial Sequence
  Synthetic Construct
gtgagcagttgcaagtaggtgat

SEQ ID NO: 5665 - DNA, 28 bp, Artificial Sequence
  Synthetic Construct
ggtttgcatgatgagagttgatggatac

SEQ ID NO: 5666 - DNA, 25 bp, Artificial Sequence
  Synthetic Construct
catgcagctgataaaaagctttcca

SEQ ID NO: 5667 - DNA, 27 bp, Artificial Sequence
  Synthetic Construct
gcatggataaccagaaaaagcctttgg

SEQ ID NO: 5668 - DNA, 23 bp, Artificial Sequence
  Synthetic Construct
gtcactggccatcaaaagtcatc

SEQ ID NO: 5669 - DNA, 22 bp, Artificial Sequence
  Synthetic Construct
ttcagggttactggcctaccaa

SEQ ID NO: 5670 - DNA, 23 bp, Artificial Sequence
  Synthetic Construct
accttccagtccagcctctagtg

SEQ ID NO: 5671 - DNA, 18 bp, Artificial Sequence
  Synthetic Construct
aggaggccagcccttgag

SEQ ID NO: 5672 - DNA, 23 bp, Artificial Sequence
  Synthetic Construct
ctgtggtcatcactgtgaaatgc

SEQ ID NO: 5673 - DNA, 19 bp, Artificial Sequence
  Synthetic Construct
cagcctccccatgggatca

SEQ ID NO: 5674 - DNA, 22 bp, Artificial Sequence
  Synthetic Construct
cagctgcatggaaagaggaaga

SEQ ID NO: 5675 - DNA, 22 bp, Artificial Sequence
  Synthetic Construct
tccccagcttatcctgaagtga

SEQ ID NO: 5676 - DNA, 24 bp, Artificial Sequence
  Synthetic Construct
ccatggccatagttcccactgtaa

SEQ ID NO: 5677 - DNA, 23 bp, Artificial Sequence
  Synthetic Construct
tcaccaggaccatgtacctagaa

SEQ ID NO: 5678 - DNA, 24 bp, Artificial Sequence
  Synthetic Construct
caggtatctctgtgatcccagcat

SEQ ID NO: 5679 - DNA, 26 bp, Artificial Sequence
  Synthetic Construct
agcatagcatttccaaatctctctct

SEQ ID NO: 5680 - DNA, 27 bp, Artificial Sequence
  Synthetic Construct
ctgaattccagaggcatctttatctca

SEQ ID NO: 5681 - DNA, 22 bp, Artificial Sequence
  Synthetic Construct
tggaatggctggcccttcatac

SEQ ID NO: 5682 - DNA, 22 bp, Artificial Sequence
  Synthetic Construct
cagtgttctttggggcttttgg

SEQ ID NO: 5683 - DNA, 23 bp, Artificial Sequence
  Synthetic Construct
ggtaaacagcccttacacttgga

SEQ ID NO: 5684 - DNA, 22 bp, Artificial Sequence
  Synthetic Construct
cctacccagatccagtgaacca

SEQ ID NO: 5685 - DNA, 21 bp, Artificial Sequence
  Synthetic Construct
tgctcagaaccccttgagtct

SEQ ID NO: 5686 - DNA, 26 bp, Artificial Sequence
  Synthetic Construct
ccaccacactgatgtcaagagatctg

SEQ ID NO: 5687 - DNA, 27 bp, Artificial Sequence
  Synthetic Construct
gcaggtagtttagatttcagtctatgc

SEQ ID NO: 5688 - DNA, 22 bp, Artificial Sequence
  Synthetic Construct
cgaatcccatttggtcctggta

SEQ ID NO: 5689 - DNA, 24 bp, Artificial Sequence
  Synthetic Construct
cacaacagcctttctccatgaagt

SEQ ID NO: 5690 - DNA, 22 bp, Artificial Sequence
  Synthetic Construct
catgaggagggatcaccactga

SEQ ID NO: 5691 - DNA, 25 bp, Artificial Sequence
  Synthetic Construct
acagtgaattctgttccaagtcaac

SEQ ID NO: 5692 - DNA, 24 bp, Artificial Sequence
  Synthetic Construct
ggaaccttctcatgcatcgtttcc

SEQ ID NO: 5693 - DNA, 24 bp, Artificial Sequence
  Synthetic Construct
tctctgagaagacacctgctcttc

SEQ ID NO: 5694 - DNA, 24 bp, Artificial Sequence
  Synthetic Construct
ctcagccacaagtgctacaagatc

SEQ ID NO: 5695 - DNA, 21 bp, Artificial Sequence
  Synthetic Construct
agtctgcctttctgggatgca

SEQ ID NO: 5696 - DNA, 29 bp, Artificial Sequence
  Synthetic Construct
ccacaataagatgtctatccactaaacac

SEQ ID NO: 5697 - DNA, 22 bp, Artificial Sequence
  Synthetic Construct
ggaccagcagccaagaagatta

SEQ ID NO: 5698 - DNA, 23 bp, Artificial Sequence
  Synthetic Construct
aaagtgtgcacctgaagaatgtg

SEQ ID NO: 5699 - DNA, 22 bp, Artificial Sequence
  Synthetic Construct
cagcaaagatgtgtggcatgac

SEQ ID NO: 5700 - DNA, 23 bp, Artificial Sequence
  Synthetic Construct
gatactagctgccactggctaaa

SEQ ID NO: 5701 - DNA, 21 bp, Artificial Sequence
  Synthetic Construct
tgtggcttggttacccactga

SEQ ID NO: 5702 - DNA, 22 bp, Artificial Sequence
  Synthetic Construct
gcaagtgcaccctatttgttgt

SEQ ID NO: 5703 - DNA, 23 bp, Artificial Sequence
  Synthetic Construct
gagacccatttgcttgtgagaca

SEQ ID NO: 5704 - DNA, 23 bp, Artificial Sequence
  Synthetic Construct
ggctcaacattaggcactcaaca

SEQ ID NO: 5705 - DNA, 30 bp, Artificial Sequence
  Synthetic Construct
gaaccaagtaaatttcacataacctggtat

SEQ ID NO: 5706 - DNA, 18 bp, Artificial Sequence
  Synthetic Construct
ccctgtgtgccccatagc

SEQ ID NO: 5707 - DNA, 19 bp, Artificial Sequence
  Synthetic Construct
gcagcccagttggacagaa

SEQ ID NO: 5708 - DNA, 24 bp, Artificial Sequence
  Synthetic Construct
gtgattggccaagagactgatgag

SEQ ID NO: 5709 - DNA, 23 bp, Artificial Sequence
  Synthetic Construct
acgacaaccacatacacgtcatc

SEQ ID NO: 5710 - DNA, 22 bp, Artificial Sequence
  Synthetic Construct
aaatactctgcctccccttgtg

SEQ ID NO: 5711 - DNA, 24 bp, Artificial Sequence
  Synthetic Construct
ccaattggcaatacgttgggtaac

SEQ ID NO: 5712 - DNA, 25 bp, Artificial Sequence
  Synthetic Construct
gcctgtaacctcttcttccacattc

SEQ ID NO: 5713 - DNA, 22 bp, Artificial Sequence
  Synthetic Construct
gtgggcttcatgctagggtttt

SEQ ID NO: 5714 - DNA, 21 bp, Artificial Sequence
  Synthetic Construct
gcctggactgcaggaatgtct

SEQ ID NO: 5715 - DNA, 24 bp, Artificial Sequence
  Synthetic Construct
gggaacagggaaggagttaaagtc

SEQ ID NO: 5716 - DNA, 23 bp, Artificial Sequence
  Synthetic Construct
gccaagcacttgcatttctagca

SEQ ID NO: 5717 - DNA, 22 bp, Artificial Sequence
  Synthetic Construct
cctggggagctatggaactgaa

SEQ ID NO: 5718 - DNA, 24 bp, Artificial Sequence
  Synthetic Construct
caagcactggagatgcagagtatc

SEQ ID NO: 5719 - DNA, 24 bp, Artificial Sequence
  Synthetic Construct
ggttacagactgcatccatttcca

SEQ ID NO: 5720 - DNA, 25 bp, Artificial Sequence
  Synthetic Construct
ccctgtttttagtcggtccaaacac

SEQ ID NO: 5721 - DNA, 22 bp, Artificial Sequence
  Synthetic Construct
ttccaggccttgagaggagtgt

SEQ ID NO: 5722 - DNA, 23 bp, Artificial Sequence
  Synthetic Construct
gagcaaacattccaggtggatga

SEQ ID NO: 5723 - DNA, 25 bp, Artificial Sequence
  Synthetic Construct
gtctcctcactttacccttcagcta

SEQ ID NO: 5724 - DNA, 22 bp, Artificial Sequence
  Synthetic Construct
accaggtgctaggtactgtgtt

SEQ ID NO: 5725 - DNA, 24 bp, Artificial Sequence
  Synthetic Construct
gtgcagatcctcatgcatttagga

SEQ ID NO: 5726 - DNA, 24 bp, Artificial Sequence
  Synthetic Construct
gtcagaaggtcgatcatcctgtct

SEQ ID NO: 5727 - DNA, 27 bp, Artificial Sequence
  Synthetic Construct
gggaactatgcagagatgatgggtaaa

SEQ ID NO: 5728 - DNA, 21 bp, Artificial Sequence
  Synthetic Construct
gctgacagctgtggtcagaga

SEQ ID NO: 5729 - DNA, 23 bp, Artificial Sequence
  Synthetic Construct
tctatctgctccatgctcattgc

SEQ ID NO: 5730 - DNA, 25 bp, Artificial Sequence
  Synthetic Construct
agaggatgaagtaggctctaatcct

SEQ ID NO: 5731 - DNA, 22 bp, Artificial Sequence
  Synthetic Construct
tgggagaggctgtcagttgtga

SEQ ID NO: 5732 - DNA, 21 bp, Artificial Sequence
  Synthetic Construct
ttgggcccctcaagttctgtt

SEQ ID NO: 5733 - DNA, 22 bp, Artificial Sequence
  Synthetic Construct
ggacacagagctctcaattgca

SEQ ID NO: 5734 - DNA, 24 bp, Artificial Sequence
  Synthetic Construct
tccaggcacactgagatgcccata

SEQ ID NO: 5735 - DNA, 20 bp, Artificial Sequence
  Synthetic Construct
aacagctcacccctggattg

SEQ ID NO: 5736 - DNA, 25 bp, Artificial Sequence
  Synthetic Construct
acattgcagaaaggacaggttactc

SEQ ID NO: 5737 - DNA, 19 bp, Artificial Sequence
  Synthetic Construct
tgggcttgcggtagacact

SEQ ID NO: 5738 - DNA, 23 bp, Artificial Sequence
  Synthetic Construct
gccacattcaaagtccctgtagt

SEQ ID NO: 5739 - DNA, 19 bp, Artificial Sequence
  Synthetic Construct
acgcacatggaggctttcc

SEQ ID NO: 5740 - DNA, 20 bp, Artificial Sequence
  Synthetic Construct
agagcctcacagggaagcaa

SEQ ID NO: 5741 - DNA, 21 bp, Artificial Sequence
  Synthetic Construct
tgaggtcctgcttccggtatt

SEQ ID NO: 5742 - DNA, 23 bp, Artificial Sequence
  Synthetic Construct
actccagattggggatgatagct

SEQ ID NO: 5743 - DNA, 20 bp, Artificial Sequence
  Synthetic Construct
aagaccaaggcagtgcaagt

SEQ ID NO: 5744 - DNA, 26 bp, Artificial Sequence
  Synthetic Construct
gggctaagtttaagaagtgggattgg

SEQ ID NO: 5745 - DNA, 29 bp, Artificial Sequence
  Synthetic Construct
ggctacaatctacacacttcattcccaat

SEQ ID NO: 5746 - DNA, 22 bp, Artificial Sequence
  Synthetic Construct
agcccatacagccttccagaga

SEQ ID NO: 5747 - DNA, 21 bp, Artificial Sequence
  Synthetic Construct
tcccaggctgaggctatcctt

SEQ ID NO: 5748 - DNA, 23 bp, Artificial Sequence
  Synthetic Construct
cagactttcccttgcagaacagt

SEQ ID NO: 5749 - DNA, 24 bp, Artificial Sequence
  Synthetic Construct
ctgccatacaggaagctaaaatcg

SEQ ID NO: 5750 - DNA, 22 bp, Artificial Sequence
  Synthetic Construct
cacagtctctctcagcaatgca

SEQ ID NO: 5751 - DNA, 22 bp, Artificial Sequence
  Synthetic Construct
tgctgaccttgtcttcctacca

SEQ ID NO: 5752 - DNA, 20 bp, Artificial Sequence
  Synthetic Construct
tgactccagcacagggttga

SEQ ID NO: 5753 - DNA, 24 bp, Artificial Sequence
  Synthetic Construct
gtgaggaagctatggctcataagt

SEQ ID NO: 5754 - DNA, 19 bp, Artificial Sequence
  Synthetic Construct
ccgacgtaggctggaccaa

SEQ ID NO: 5755 - DNA, 21 bp, Artificial Sequence
  Synthetic Construct
cccagcatcacccagctttgc

SEQ ID NO: 5756 - DNA, 24 bp, Artificial Sequence
  Synthetic Construct
ggcgcttcctttagagtgtgtttc

SEQ ID NO: 5757 - DNA, 24 bp, Artificial Sequence
  Synthetic Construct
gaagcgagcttggaacttcttact

SEQ ID NO: 5758 - DNA, 25 bp, Artificial Sequence
  Synthetic Construct
actgggcctttatactccattactg

SEQ ID NO: 5759 - DNA, 18 bp, Artificial Sequence
  Synthetic Construct
caagcaccggcccatgtg

SEQ ID NO: 5760 - DNA, 25 bp, Artificial Sequence
  Synthetic Construct
gttaaccaagcacctccttatatgc

SEQ ID NO: 5761 - DNA, 18 bp, Artificial Sequence
  Synthetic Construct
agccccaggaggcaatgg

SEQ ID NO: 5762 - DNA, 25 bp, Artificial Sequence
  Synthetic Construct
ctgttttcacagttctctggcaaca

SEQ ID NO: 5763 - DNA, 24 bp, Artificial Sequence
  Synthetic Construct
gcagatgctcagtggatgtttgtg

SEQ ID NO: 5764 - DNA, 24 bp, Artificial Sequence
  Synthetic Construct
gggcttagtgatgctaaggatctg

SEQ ID NO: 5765 - DNA, 24 bp, Artificial Sequence
  Synthetic Construct
caccttaaccacagcatgatgttg

SEQ ID NO: 5766 - DNA, 30 bp, Artificial Sequence
  Synthetic Construct
ggagatagaagttagtttagcagttacctt

SEQ ID NO: 5767 - DNA, 23 bp, Artificial Sequence
  Synthetic Construct
ggcctgtttcaagacaagaagga

SEQ ID NO: 5768 - DNA, 26 bp, Artificial Sequence
  Synthetic Construct
cacaaacggtagggtagtaagtacct

SEQ ID NO: 5769 - DNA, 22 bp, Artificial Sequence
  Synthetic Construct
aaccaaagtccccaaccccttt

SEQ ID NO: 5770 - DNA, 25 bp, Artificial Sequence
  Synthetic Construct
aggggaaactatagagggggtaaac

SEQ ID NO: 5771 - DNA, 20 bp, Artificial Sequence
  Synthetic Construct
actccaagatgccacaacgt

SEQ ID NO: 5772 - DNA, 25 bp, Artificial Sequence
  Synthetic Construct
ggaacttatgggtcagatctggaaa

SEQ ID NO: 5773 - DNA, 26 bp, Artificial Sequence
  Synthetic Construct
ggtcattgagaaagtcatcccatctt

SEQ ID NO: 5774 - DNA, 22 bp, Artificial Sequence
  Synthetic Construct
aggtgggatccagttctgacaa

SEQ ID NO: 5775 - DNA, 22 bp, Artificial Sequence
  Synthetic Construct
cttccccttccctactctcctt

SEQ ID NO: 5776 - DNA, 24 bp, Artificial Sequence
  Synthetic Construct
atgtttgtgaacttggcagagaag

SEQ ID NO: 5777 - DNA, 28 bp, Artificial Sequence
  Synthetic Construct
agcaaatagacaaggtttttctcattcc

SEQ ID NO: 5778 - DNA, 24 bp, Artificial Sequence
  Synthetic Construct
ccctggtttagaggaatgctactc

SEQ ID NO: 5779 - DNA, 26 bp, Artificial Sequence
  Synthetic Construct
gtatgattccatgtacgtgagtttgg

SEQ ID NO: 5780 - DNA, 20 bp, Artificial Sequence
  Synthetic Construct
tgttggctgatggggggaaa

SEQ ID NO: 5781 - DNA, 22 bp, Artificial Sequence
  Synthetic Construct
gaatagagaggcccttgtgcat

SEQ ID NO: 5782 - DNA, 25 bp, Artificial Sequence
  Synthetic Construct
tttcagcccatagcatcatacttct

SEQ ID NO: 5783 - DNA, 24 bp, Artificial Sequence
  Synthetic Construct
tgtggttagacttcctgagaacca

SEQ ID NO: 5784 - DNA, 21 bp, Artificial Sequence
  Synthetic Construct
tggctagtgggcttgctttca

SEQ ID NO: 5785 - DNA, 22 bp, Artificial Sequence
  Synthetic Construct
gctcatgaatcctgctggctat

SEQ ID NO: 5786 - DNA, 24 bp, Artificial Sequence
  Synthetic Construct
tccctctctctccaacttttagct

SEQ ID NO: 5787 - DNA, 29 bp, Artificial Sequence
  Synthetic Construct
gctgattctgagatgtaataggctacaca

SEQ ID NO: 5788 - DNA, 24 bp, Artificial Sequence
  Synthetic Construct
ggttgggtttctgcatcctttgtg

SEQ ID NO: 5789 - DNA, 22 bp, Artificial Sequence
  Synthetic Construct
gcaatgccaagttcagccactt

SEQ ID NO: 5790 - DNA, 18 bp, Artificial Sequence
  Synthetic Construct
ggacaggcgagcgtatgg

SEQ ID NO: 5791 - DNA, 23 bp, Artificial Sequence
  Synthetic Construct
gaccaaggggctgacaaagttct

SEQ ID NO: 5792 - DNA, 25 bp, Artificial Sequence
  Synthetic Construct
gggtccaaatcagtgctggaaatga

SEQ ID NO: 5793 - DNA, 22 bp, Artificial Sequence
  Synthetic Construct
tcccttaatcggaaggcagtga

SEQ ID NO: 5794 - DNA, 24 bp, Artificial Sequence
  Synthetic Construct
aatgccacctggtaatgaagagaa

SEQ ID NO: 5795 - DNA, 23 bp, Artificial Sequence
  Synthetic Construct
gcatcagatgttccttggttcct

SEQ ID NO: 5796 - DNA, 22 bp, Artificial Sequence
  Synthetic Construct
agtggagctgggattctcaaca

SEQ ID NO: 5797 - DNA, 23 bp, Artificial Sequence
  Synthetic Construct
tccagattgggagagtgtttcct

SEQ ID NO: 5798 - DNA, 25 bp, Artificial Sequence
  Synthetic Construct
catttgttggtggctaattgaggat

SEQ ID NO: 5799 - DNA, 25 bp, Artificial Sequence
  Synthetic Construct
acaaatgatgccaacactgagatga

SEQ ID NO: 5800 - DNA, 24 bp, Artificial Sequence
  Synthetic Construct
ccatcagatgggtctattcacaca

SEQ ID NO: 5801 - DNA, 22 bp, Artificial Sequence
  Synthetic Construct
gctgttggagctgaatcaccta

SEQ ID NO: 5802 - DNA, 19 bp, Artificial Sequence
  Synthetic Construct
ggcaaggcctcgagaaagg

SEQ ID NO: 5803 - DNA, 23 bp, Artificial Sequence
  Synthetic Construct
ggctggggctatcttctcattca

SEQ ID NO: 5804 - DNA, 22 bp, Artificial Sequence
  Synthetic Construct
tccctgtgctgtcaatgagctt

SEQ ID NO: 5805 - DNA, 22 bp, Artificial Sequence
  Synthetic Construct
aacctgcatcctaggctctctt

SEQ ID NO: 5806 - DNA, 24 bp, Artificial Sequence
  Synthetic Construct
gacagcctattggtgaggataaca

SEQ ID NO: 5807 - DNA, 19 bp, Artificial Sequence
  Synthetic Construct
cccaggccctttgcttcct

SEQ ID NO: 5808 - DNA, 21 bp, Artificial Sequence
  Synthetic Construct
ttgatccgccctctctactca

SEQ ID NO: 5809 - DNA, 20 bp, Artificial Sequence
  Synthetic Construct
agactggggatggggcaaaa

SEQ ID NO: 5810 - DNA, 24 bp, Artificial Sequence
  Synthetic Construct
acctgaaaattgtcccgaatgtct

SEQ ID NO: 5811 - DNA, 26 bp, Artificial Sequence
  Synthetic Construct
ggacagttacataaaccagcagttac

SEQ ID NO: 5812 - DNA, 25 bp, Artificial Sequence
  Synthetic Construct
tctggatcttgaattccacactcaa

SEQ ID NO: 5813 - DNA, 21 bp, Artificial Sequence
  Synthetic Construct
tccgtcgtccccactgagtaa

SEQ ID NO: 5814 - DNA, 23 bp, Artificial Sequence
  Synthetic Construct
actatgtcactgaggctggagta

SEQ ID NO: 5815 - DNA, 24 bp, Artificial Sequence
  Synthetic Construct
gctgactttcttagccaccgtaca

SEQ ID NO: 5816 - DNA, 26 bp, Artificial Sequence
  Synthetic Construct
cccttgatctatctggagttcaccat

SEQ ID NO: 5817 - DNA, 22 bp, Artificial Sequence
  Synthetic Construct
ccgcccatgaaaatgcgatcat

SEQ ID NO: 5818 - DNA, 27 bp, Artificial Sequence
  Synthetic Construct
ctctgtcgaataatcatgtgtccacta

SEQ ID NO: 5819 - DNA, 24 bp, Artificial Sequence
  Synthetic Construct
cctcctaagtgttgcgttctttcg

SEQ ID NO: 5820 - DNA, 24 bp, Artificial Sequence
  Synthetic Construct
tgatccctgatgttggaggtaaga

SEQ ID NO: 5821 - DNA, 25 bp, Artificial Sequence
  Synthetic Construct
ggctgatgaattgcatgtgggtttc

SEQ ID NO: 5822 - DNA, 24 bp, Artificial Sequence
  Synthetic Construct
tctgacactgattcagggaaagag

SEQ ID NO: 5823 - DNA, 20 bp, Artificial Sequence
  Synthetic Construct
acagtgggccggtgtgataa

SEQ ID NO: 5824 - DNA, 26 bp, Artificial Sequence
  Synthetic Construct
gtcgtgaatcctagaatgtacatgct

SEQ ID NO: 5825 - DNA, 22 bp, Artificial Sequence
  Synthetic Construct
ctcatttcccacccaactccat

SEQ ID NO: 5826 - DNA, 20 bp, Artificial Sequence
  Synthetic Construct
atgccacacagcaagatcca

SEQ ID NO: 5827 - DNA, 20 bp, Artificial Sequence
  Synthetic Construct
tgtagctctccagccattgc

SEQ ID NO: 5828 - DNA, 18 bp, Artificial Sequence
  Synthetic Construct
ggcctgaggggagggaaa

SEQ ID NO: 5829 - DNA, 24 bp, Artificial Sequence
  Synthetic Construct
ctctggaatagaccgtgacaaagg

SEQ ID NO: 5830 - DNA, 25 bp, Artificial Sequence
  Synthetic Construct
cggagatttcaccattagcacttct

SEQ ID NO: 5831 - DNA, 20 bp, Artificial Sequence
  Synthetic Construct
ttgccccttcaggaagcaaa

SEQ ID NO: 5832 - DNA, 20 bp, Artificial Sequence
  Synthetic Construct
tggttgtggtgggggtggaa

SEQ ID NO: 5833 - DNA, 29 bp, Artificial Sequence
  Synthetic Construct
gcaaactaacacagcagtgaattgtaagt

SEQ ID NO: 5834 - DNA, 24 bp, Artificial Sequence
  Synthetic Construct
gggacatgggtaacagtcacattg

SEQ ID NO: 5835 - DNA, 24 bp, Artificial Sequence
  Synthetic Construct
ggaatcccagaagtctgacagtgt

SEQ ID NO: 5836 - DNA, 28 bp, Artificial Sequence
  Synthetic Construct
ccttttctactgacaaggggatatttgg

SEQ ID NO: 5837 - DNA, 23 bp, Artificial Sequence
  Synthetic Construct
ctcctagccaaacaaagcaagac

SEQ ID NO: 5838 - DNA, 21 bp, Artificial Sequence
  Synthetic Construct
tacctccactgccaccaccaa

SEQ ID NO: 5839 - DNA, 23 bp, Artificial Sequence
  Synthetic Construct
cccagtctgtgcttcctccttct

SEQ ID NO: 5840 - DNA, 24 bp, Artificial Sequence
  Synthetic Construct
ttgtaaaaaccaccctagcagtca

SEQ ID NO: 5841 - DNA, 22 bp, Artificial Sequence
  Synthetic Construct
tcacagccaagcatacctctgt

SEQ ID NO: 5842 - DNA, 23 bp, Artificial Sequence
  Synthetic Construct
aatcctggcaagatccccagatc

SEQ ID NO: 5843 - DNA, 20 bp, Artificial Sequence
  Synthetic Construct
gcccatctcaagtggctctt

SEQ ID NO: 5844 - DNA, 21 bp, Artificial Sequence
  Synthetic Construct
accgactgcagaaagctcaca

SEQ ID NO: 5845 - DNA, 24 bp, Artificial Sequence
  Synthetic Construct
ctgttgaatccacaagaccaaacc

SEQ ID NO: 5846 - DNA, 28 bp, Artificial Sequence
  Synthetic Construct
gactatactcacacacaaaattgctttg

SEQ ID NO: 5847 - DNA, 27 bp, Artificial Sequence
  Synthetic Construct
gcaaaagcaagatgactaagtgttcgt

SEQ ID NO: 5848 - DNA, 25 bp, Artificial Sequence
  Synthetic Construct
cctccagggtagtagacatatgtgt

SEQ ID NO: 5849 - DNA, 22 bp, Artificial Sequence
  Synthetic Construct
aggaagcttaggccttgttagc

SEQ ID NO: 5850 - DNA, 21 bp, Artificial Sequence
  Synthetic Construct
ggatgcaactgagggagcaaa

SEQ ID NO: 5851 - DNA, 19 bp, Artificial Sequence
  Synthetic Construct
aggcctgagtggggatgtc

SEQ ID NO: 5852 - DNA, 24 bp, Artificial Sequence
  Synthetic Construct
caccaagagatcgtgtcctcaaag

SEQ ID NO: 5853 - DNA, 28 bp, Artificial Sequence
  Synthetic Construct
gggaactccatcaatatttgtcctcgtt

SEQ ID NO: 5854 - DNA, 22 bp, Artificial Sequence
  Synthetic Construct
aggtctctaaagcccagtgcat

SEQ ID NO: 5855 - DNA, 24 bp, Artificial Sequence
  Synthetic Construct
aatgctgtatgtaggttggaagct

SEQ ID NO: 5856 - DNA, 24 bp, Artificial Sequence
  Synthetic Construct
gtgtttgagaaggtcagtctgaca

SEQ ID NO: 5857 - DNA, 25 bp, Artificial Sequence
  Synthetic Construct
ccttctgttaaagccagaactgtgt

SEQ ID NO: 5858 - DNA, 20 bp, Artificial Sequence
  Synthetic Construct
cccgcaatatgggcaacgtt

SEQ ID NO: 5859 - DNA, 27 bp, Artificial Sequence
  Synthetic Construct
ctaaaatagtatgtgagctgcattggt

SEQ ID NO: 5860 - DNA, 24 bp, Artificial Sequence
  Synthetic Construct
tgtaggtagttcccccaaactttc

SEQ ID NO: 5861 - DNA, 22 bp, Artificial Sequence
  Synthetic Construct
gtgagggaggtagggtttcaag

SEQ ID NO: 5862 - DNA, 24 bp, Artificial Sequence
  Synthetic Construct
caatctggtctcattgacgttgtc

SEQ ID NO: 5863 - DNA, 24 bp, Artificial Sequence
  Synthetic Construct
cccacattttacgggtgcatgttc

SEQ ID NO: 5864 - DNA, 22 bp, Artificial Sequence
  Synthetic Construct
ctatggagttttggcccacaga

SEQ ID NO: 5865 - DNA, 21 bp, Artificial Sequence
  Synthetic Construct
actgttctggatgggcaagtg

SEQ ID NO: 5866 - DNA, 28 bp, Artificial Sequence
  Synthetic Construct
ggcaatctactagctagaggtagttcag

SEQ ID NO: 5867 - DNA, 24 bp, Artificial Sequence
  Synthetic Construct
cctattttcctgcttgtggttacg

SEQ ID NO: 5868 - DNA, 20 bp, Artificial Sequence
  Synthetic Construct
atccacagccagcaaacagt

SEQ ID NO: 5869 - DNA, 22 bp, Artificial Sequence
  Synthetic Construct
aggttctgctctggcattttgg

SEQ ID NO: 5870 - DNA, 21 bp, Artificial Sequence
  Synthetic Construct
agagatgatggcagggacaga

SEQ ID NO: 5871 - DNA, 23 bp, Artificial Sequence
  Synthetic Construct
gcaatgctcccctattctgaaca

SEQ ID NO: 5872 - DNA, 27 bp, Artificial Sequence
  Synthetic Construct
cccaggtcaaaacccaaaatgttatcc

SEQ ID NO: 5873 - DNA, 24 bp, Artificial Sequence
  Synthetic Construct
cctccattaccctagtgagtacca

SEQ ID NO: 5874 - DNA, 25 bp, Artificial Sequence
  Synthetic Construct
ggcagtcattcaaacctaactctgt

SEQ ID NO: 5875 - DNA, 26 bp, Artificial Sequence
  Synthetic Construct
tggtaggaagtaagaggcaggttagg

SEQ ID NO: 5876 - DNA, 22 bp, Artificial Sequence
  Synthetic Construct
gcctagtgggttcagtcaagct

SEQ ID NO: 5877 - DNA, 23 bp, Artificial Sequence
  Synthetic Construct
ctggacttcaaagaaccgtgatg

SEQ ID NO: 5878 - DNA, 21 bp, Artificial Sequence
  Synthetic Construct
agccccacactactgatctca

SEQ ID NO: 5879 - DNA, 28 bp, Artificial Sequence
  Synthetic Construct
cccagaacacatgttaaatttcccctta

SEQ ID NO: 5880 - DNA, 24 bp, Artificial Sequence
  Synthetic Construct
acctgagcctacatctgagctctt

SEQ ID NO: 5881 - DNA, 26 bp, Artificial Sequence
  Synthetic Construct
tctccaactgaaaaccaatgtaaggt

SEQ ID NO: 5882 - DNA, 21 bp, Artificial Sequence
  Synthetic Construct
gcaaaaccctgaggcccttca

SEQ ID NO: 5883 - DNA, 21 bp, Artificial Sequence
  Synthetic Construct
gctgatttgcattggctcaca

SEQ ID NO: 5884 - DNA, 24 bp, Artificial Sequence
  Synthetic Construct
gtgcaggaagatggggagattaca

SEQ ID NO: 5885 - DNA, 21 bp, Artificial Sequence
  Synthetic Construct
tgctagattccgaggctggaa

SEQ ID NO: 5886 - DNA, 22 bp, Artificial Sequence
  Synthetic Construct
tggcatggctttaaaggttgga

SEQ ID NO: 5887 - DNA, 19 bp, Artificial Sequence
  Synthetic Construct
gcctggtgaatggcaaggt

SEQ ID NO: 5888 - DNA, 23 bp, Artificial Sequence
  Synthetic Construct
ccaacctgacaagtggagatctg

SEQ ID NO: 5889 - DNA, 21 bp, Artificial Sequence
  Synthetic Construct
acgaacccacatcagccagta

SEQ ID NO: 5890 - DNA, 24 bp, Artificial Sequence
  Synthetic Construct
tcctgctacctatgaagggtagga

SEQ ID NO: 5891 - DNA, 23 bp, Artificial Sequence
  Synthetic Construct
tgtcctggcctgataaggaagga

SEQ ID NO: 5892 - DNA, 29 bp, Artificial Sequence
  Synthetic Construct
tgatatcctgtgtcttggtgttaatacag

SEQ ID NO: 5893 - DNA, 27 bp, Artificial Sequence
  Synthetic Construct
ggactgcagagtaaatttttggctttg

SEQ ID NO: 5894 - DNA, 26 bp, Artificial Sequence
  Synthetic Construct
aagtgttgcagtaaaagaccatacag

SEQ ID NO: 5895 - DNA, 25 bp, Artificial Sequence
  Synthetic Construct
aggatgctgttgattgtatgtagca

SEQ ID NO: 5896 - DNA, 22 bp, Artificial Sequence
  Synthetic Construct
cacaagctcacctcactgctta

SEQ ID NO: 5897 - DNA, 24 bp, Artificial Sequence
  Synthetic Construct
tgtacccccttcttcctacagcta

SEQ ID NO: 5898 - DNA, 24 bp, Artificial Sequence
  Synthetic Construct
gctgttatagtcgtggtggttgtg

SEQ ID NO: 5899 - DNA, 21 bp, Artificial Sequence
  Synthetic Construct
tgctctgctcactccccattc

SEQ ID NO: 5900 - DNA, 23 bp, Artificial Sequence
  Synthetic Construct
ctaggaaaggccctacactgttc

SEQ ID NO: 5901 - DNA, 20 bp, Artificial Sequence
  Synthetic Construct
aactgaaaggccacgtgcaa

SEQ ID NO: 5902 - DNA, 20 bp, Artificial Sequence
  Synthetic Construct
ttcctggtggctggaatgct

SEQ ID NO: 5903 - DNA, 25 bp, Artificial Sequence
  Synthetic Construct
cgacttgactgaacaggtcttagac

SEQ ID NO: 5904 - DNA, 21 bp, Artificial Sequence
  Synthetic Construct
agctgagctcttcgccaggta

SEQ ID NO: 5905 - DNA, 22 bp, Artificial Sequence
  Synthetic Construct
gcttcagcagcatcatccagaa

SEQ ID NO: 5906 - DNA, 21 bp, Artificial Sequence
  Synthetic Construct
aatgcctggaggggtgtgtca

SEQ ID NO: 5907 - DNA, 20 bp, Artificial Sequence
  Synthetic Construct
aggggggttgggaacttcca

SEQ ID NO: 5908 - DNA, 22 bp, Artificial Sequence
  Synthetic Construct
tctcaaccaaggggtacagaga

SEQ ID NO: 5909 - DNA, 24 bp, Artificial Sequence
  Synthetic Construct
cctttgtgctcaggctttgaaggt

SEQ ID NO: 5910 - DNA, 24 bp, Artificial Sequence
  Synthetic Construct
ctgtcttgccatttttgcccaata

SEQ ID NO: 5911 - DNA, 25 bp, Artificial Sequence
  Synthetic Construct
gaaaggctcagtacagctttttagc

SEQ ID NO: 5912 - DNA, 20 bp, Artificial Sequence
  Synthetic Construct
ggcttggccacaatgttgct

SEQ ID NO: 5913 - DNA, 19 bp, Artificial Sequence
  Synthetic Construct
aaccaccagtgcctttgca

SEQ ID NO: 5914 - DNA, 22 bp, Artificial Sequence
  Synthetic Construct
ggggagcctcacatttgacatt

SEQ ID NO: 5915 - DNA, 22 bp, Artificial Sequence
  Synthetic Construct
gacaatggcagagaaggcagtt

SEQ ID NO: 5916 - DNA, 22 bp, Artificial Sequence
  Synthetic Construct
ccttggtttgcactgtgtttgg

SEQ ID NO: 5917 - DNA, 22 bp, Artificial Sequence
  Synthetic Construct
tgccctttttgtgctggtaggt

SEQ ID NO: 5918 - DNA, 20 bp, Artificial Sequence
  Synthetic Construct
ttccccaggctggcctttaa

SEQ ID NO: 5919 - DNA, 25 bp, Artificial Sequence
  Synthetic Construct
tgatgttgagtagaggtgtgatgtc

SEQ ID NO: 5920 - DNA, 22 bp, Artificial Sequence
  Synthetic Construct
caaaccccacccagtttagctt

SEQ ID NO: 5921 - DNA, 22 bp, Artificial Sequence
  Synthetic Construct
gtgtcctggtatgtggaacgtt

SEQ ID NO: 5922 - DNA, 26 bp, Artificial Sequence
  Synthetic Construct
tcaaaagtttttagcctgccttagtc

SEQ ID NO: 5923 - DNA, 25 bp, Artificial Sequence
  Synthetic Construct
cgtgaagcttgggttaacagttcca

SEQ ID NO: 5924 - DNA, 22 bp, Artificial Sequence
  Synthetic Construct
ggcaaaaacctgctggaatgct

SEQ ID NO: 5925 - DNA, 23 bp, Artificial Sequence
  Synthetic Construct
cccaggatgcaggatctactgta

SEQ ID NO: 5926 - DNA, 25 bp, Artificial Sequence
  Synthetic Construct
gggaatggagaacactcttcttgct

SEQ ID NO: 5927 - DNA, 22 bp, Artificial Sequence
  Synthetic Construct
tgcagctggacaaactcccatt

SEQ ID NO: 5928 - DNA, 24 bp, Artificial Sequence
  Synthetic Construct
agctgaaagaaaacccactttgtc

SEQ ID NO: 5929 - DNA, 24 bp, Artificial Sequence
  Synthetic Construct
cgcgtagggtgttggattcttttg

SEQ ID NO: 5930 - DNA, 26 bp, Artificial Sequence
  Synthetic Construct
atttgggaagtaagacttgcaatctg

SEQ ID NO: 5931 - DNA, 26 bp, Artificial Sequence
  Synthetic Construct
gggttaataatgtggaggtcactgaa

SEQ ID NO: 5932 - DNA, 25 bp, Artificial Sequence
  Synthetic Construct
catttacatcctcgaagtcctgtgt

SEQ ID NO: 5933 - DNA, 23 bp, Artificial Sequence
  Synthetic Construct
ggatgagtttggccctgattttc

SEQ ID NO: 5934 - DNA, 24 bp, Artificial Sequence
  Synthetic Construct
cactccttggcattcaggtaacac

SEQ ID NO: 5935 - DNA, 25 bp, Artificial Sequence
  Synthetic Construct
gtttccaccattgctttcacaatct

SEQ ID NO: 5936 - DNA, 25 bp, Artificial Sequence
  Synthetic Construct
ctgttaccttgactcatctcaggtt

SEQ ID NO: 5937 - DNA, 24 bp, Artificial Sequence
  Synthetic Construct
tggtgctattacaggcataaacca

SEQ ID NO: 5938 - DNA, 22 bp, Artificial Sequence
  Synthetic Construct
agtttcagcagctaagccagaa

SEQ ID NO: 5939 - DNA, 25 bp, Artificial Sequence
  Synthetic Construct
ctgaaaagttgcatagctggaatcc

SEQ ID NO: 5940 - DNA, 23 bp, Artificial Sequence
  Synthetic Construct
gataccagagcaagccttcatga

SEQ ID NO: 5941 - DNA, 22 bp, Artificial Sequence
  Synthetic Construct
tggactggatgaggacagcatt

SEQ ID NO: 5942 - DNA, 24 bp, Artificial Sequence
  Synthetic Construct
gggggtcttttatctccaggaaag

SEQ ID NO: 5943 - DNA, 20 bp, Artificial Sequence
  Synthetic Construct
tctcacccgacaccccatat

SEQ ID NO: 5944 - DNA, 24 bp, Artificial Sequence
  Synthetic Construct
aataacctgttgcactggttctct

SEQ ID NO: 5945 - DNA, 22 bp, Artificial Sequence
  Synthetic Construct
tcacagtggaagaggcaaaggt

SEQ ID NO: 5946 - DNA, 25 bp, Artificial Sequence
  Synthetic Construct
ggttgcaccggaaaagaacagattc

SEQ ID NO: 5947 - DNA, 26 bp, Artificial Sequence
  Synthetic Construct
ggtcacagaaatgggcagaaattgtt

SEQ ID NO: 5948 - DNA, 28 bp, Artificial Sequence
  Synthetic Construct
ggtttgggtcatgacaatagatccctta

SEQ ID NO: 5949 - DNA, 22 bp, Artificial Sequence
  Synthetic Construct
ttctcacttgccagtggtgact

SEQ ID NO: 5950 - DNA, 20 bp, Artificial Sequence
  Synthetic Construct
tgcagtggctgagttgctaa

SEQ ID NO: 5951 - DNA, 22 bp, Artificial Sequence
  Synthetic Construct
agtagagtttctcgccctctga

SEQ ID NO: 5952 - DNA, 22 bp, Artificial Sequence
  Synthetic Construct
actccagtactggcactatcca

SEQ ID NO: 5953 - DNA, 22 bp, Artificial Sequence
  Synthetic Construct
agcagtatgcactggggaaagg

SEQ ID NO: 5954 - DNA, 21 bp, Artificial Sequence
  Synthetic Construct
tgccttcgttccccggtacta

SEQ ID NO: 5955 - DNA, 19 bp, Artificial Sequence
  Synthetic Construct
tgtgcctggtggggagaca

SEQ ID NO: 5956 - DNA, 28 bp, Artificial Sequence
  Synthetic Construct
gcagatcttggtgaaatacatggatgct

SEQ ID NO: 5957 - DNA, 22 bp, Artificial Sequence
  Synthetic Construct
tgagctcaggtgtgggaaattc

SEQ ID NO: 5958 - DNA, 26 bp, Artificial Sequence
  Synthetic Construct
cttgggaaatacacaaatacgtggaa

SEQ ID NO: 5959 - DNA, 22 bp, Artificial Sequence
  Synthetic Construct
agaagaagtccccgtcaaacct

SEQ ID NO: 5960 - DNA, 27 bp, Artificial Sequence
  Synthetic Construct
gactcagacagcgaagtaaattgttca

SEQ ID NO: 5961 - DNA, 28 bp, Artificial Sequence
  Synthetic Construct
agtctaatcggtctgaagtgaaagtaaa

SEQ ID NO: 5962 - DNA, 24 bp, Artificial Sequence
  Synthetic Construct
ttctcaaaaccccaaatcctgagt

SEQ ID NO: 5963 - DNA, 25 bp, Artificial Sequence
  Synthetic Construct
cagaagttactgctggtcctttcag

SEQ ID NO: 5964 - DNA, 24 bp, Artificial Sequence
  Synthetic Construct
ccttagggaaagccatgcaagaag

SEQ ID NO: 5965 - DNA, 25 bp, Artificial Sequence
  Synthetic Construct
gttgctatccatgcagaaactgttg

SEQ ID NO: 5966 - DNA, 27 bp, Artificial Sequence
  Synthetic Construct
ccaaacttttcctacttaggtgcaatt

SEQ ID NO: 5967 - DNA, 23 bp, Artificial Sequence
  Synthetic Construct
ggtttggcatccttcagctcata

SEQ ID NO: 5968 - DNA, 29 bp, Artificial Sequence
  Synthetic Construct
cctttttggactgctggcttatattaaat

SEQ ID NO: 5969 - DNA, 23 bp, Artificial Sequence
  Synthetic Construct
caagccctgcattttgttactga

SEQ ID NO: 5970 - DNA, 22 bp, Artificial Sequence
  Synthetic Construct
ttggagcacaccagtttaagct

SEQ ID NO: 5971 - DNA, 25 bp, Artificial Sequence
  Synthetic Construct
ggagtctggggaggtactaataaca

SEQ ID NO: 5972 - DNA, 22 bp, Artificial Sequence
  Synthetic Construct
ttgccagtgggaggatgaagta

SEQ ID NO: 5973 - DNA, 25 bp, Artificial Sequence
  Synthetic Construct
cctccatgcagattagacacttgtg

SEQ ID NO: 5974 - DNA, 20 bp, Artificial Sequence
  Synthetic Construct
ttacaggcgtcaggcattgt

SEQ ID NO: 5975 - DNA, 24 bp, Artificial Sequence
  Synthetic Construct
caggggatcagggaagtgagtaaa

SEQ ID NO: 5976 - DNA, 20 bp, Artificial Sequence
  Synthetic Construct
actggttggttggctggttt

SEQ ID NO: 5977 - DNA, 22 bp, Artificial Sequence
  Synthetic Construct
ggtgaaagtgttgggaggcttt

SEQ ID NO: 5978 - DNA, 27 bp, Artificial Sequence
  Synthetic Construct
caagactgttttagaaacgggattaca

SEQ ID NO: 5979 - DNA, 28 bp, Artificial Sequence
  Synthetic Construct
aaaagatctgttctatcagtaccaaggt

SEQ ID NO: 5980 - DNA, 29 bp, Artificial Sequence
  Synthetic Construct
tggtaatgaagggttatcttaacagttca

SEQ ID NO: 5981 - DNA, 27 bp, Artificial Sequence
  Synthetic Construct
ccctgacaatgtattcattctcaagca

SEQ ID NO: 5982 - DNA, 24 bp, Artificial Sequence
  Synthetic Construct
gcaggtaggctttgaggtgtgaat

SEQ ID NO: 5983 - DNA, 21 bp, Artificial Sequence
  Synthetic Construct
ggagtggggaggtgtgtgaat

SEQ ID NO: 5984 - DNA, 22 bp, Artificial Sequence
  Synthetic Construct
tgagctgtatgggtgcctagta

SEQ ID NO: 5985 - DNA, 19 bp, Artificial Sequence
  Synthetic Construct
ggctcgttctgcccacttg

SEQ ID NO: 5986 - DNA, 27 bp, Artificial Sequence
  Synthetic Construct
tctgttaaaaatctgcatgttggatca

SEQ ID NO: 5987 - DNA, 22 bp, Artificial Sequence
  Synthetic Construct
cccgatggtttcctttgctctt

SEQ ID NO: 5988 - DNA, 23 bp, Artificial Sequence
  Synthetic Construct
ctggcatgaatgtcactcaggtt

SEQ ID NO: 5989 - DNA, 27 bp, Artificial Sequence
  Synthetic Construct
gtgagaccatcaaaaagaaaggagtgt

SEQ ID NO: 5990 - DNA, 24 bp, Artificial Sequence
  Synthetic Construct
ctgcctattgttgccatcaacttg

SEQ ID NO: 5991 - DNA, 29 bp, Artificial Sequence
  Synthetic Construct
ggcaagaaatgacttccaatgacattgta

SEQ ID NO: 5992 - DNA, 26 bp, Artificial Sequence
  Synthetic Construct
tgcgagagtataggttacaggatttg

SEQ ID NO: 5993 - DNA, 24 bp, Artificial Sequence
  Synthetic Construct
tgttcggaggttgtctgagatcac

SEQ ID NO: 5994 - DNA, 25 bp, Artificial Sequence
  Synthetic Construct
gagcccgagttactggtttaatagt

SEQ ID NO: 5995 - DNA, 22 bp, Artificial Sequence
  Synthetic Construct
aggatgtctgttgggtccctta

SEQ ID NO: 5996 - DNA, 26 bp, Artificial Sequence
  Synthetic Construct
gggagtagcatacttcctttcaggat

SEQ ID NO: 5997 - DNA, 27 bp, Artificial Sequence
  Synthetic Construct
catggacaaaagcttgatggaagtatt

SEQ ID NO: 5998 - DNA, 25 bp, Artificial Sequence
  Synthetic Construct
gttcaggtaagtcaaatgggtctga

SEQ ID NO: 5999 - DNA, 23 bp, Artificial Sequence
  Synthetic Construct
gccttggcaggtgtgaatgtgat

SEQ ID NO: 6000 - DNA, 21 bp, Artificial Sequence
  Synthetic Construct
gttcttccaggccaccgttgt

SEQ ID NO: 6001 - DNA, 22 bp, Artificial Sequence
  Synthetic Construct
ctctgaacctccctgagacaga

SEQ ID NO: 6002 - DNA, 20 bp, Artificial Sequence
  Synthetic Construct
tgggaccaggaacaggcatt

SEQ ID NO: 6003 - DNA, 19 bp, Artificial Sequence
  Synthetic Construct
tgcctggccgaggggttca

SEQ ID NO: 6004 - DNA, 25 bp, Artificial Sequence
  Synthetic Construct
cagacccacaatgcagcaatttagg

SEQ ID NO: 6005 - DNA, 21 bp, Artificial Sequence
  Synthetic Construct
tcacccatcagcgtgtagtga

SEQ ID NO: 6006 - DNA, 21 bp, Artificial Sequence
  Synthetic Construct
agcactgtccaggccaaacat

SEQ ID NO: 6007 - DNA, 21 bp, Artificial Sequence
  Synthetic Construct
tgtgtggggagagcctgtctt

SEQ ID NO: 6008 - DNA, 24 bp, Artificial Sequence
  Synthetic Construct
cggaccttagagacaagctagaca

SEQ ID NO: 6009 - DNA, 24 bp, Artificial Sequence
  Synthetic Construct
cccatttgttctcagaaagcaagt

SEQ ID NO: 6010 - DNA, 21 bp, Artificial Sequence
  Synthetic Construct
ctggccttggatgtcttcagt

SEQ ID NO: 6011 - DNA, 21 bp, Artificial Sequence
  Synthetic Construct
tggagtcttcccagtctgtga

SEQ ID NO: 6012 - DNA, 24 bp, Artificial Sequence
  Synthetic Construct
gagttggaatggggtaggtacttc

SEQ ID NO: 6013 - DNA, 22 bp, Artificial Sequence
  Synthetic Construct
cctttcagttccagagcaagca

SEQ ID NO: 6014 - DNA, 22 bp, Artificial Sequence
  Synthetic Construct
gctgagcacacctgagaacata

SEQ ID NO: 6015 - DNA, 20 bp, Artificial Sequence
  Synthetic Construct
tgtgtgcaaagcaggagaca

SEQ ID NO: 6016 - DNA, 24 bp, Artificial Sequence
  Synthetic Construct
gactcagtacccagttcttttcca

SEQ ID NO: 6017 - DNA, 22 bp, Artificial Sequence
  Synthetic Construct
aggatgcctcggctaaagaaga

SEQ ID NO: 6018 - DNA, 24 bp, Artificial Sequence
  Synthetic Construct
tggtacccctaatgactgtcagaa

SEQ ID NO: 6019 - DNA, 23 bp, Artificial Sequence
  Synthetic Construct
gttcctctgtccagatcttgtgt

SEQ ID NO: 6020 - DNA, 26 bp, Artificial Sequence
  Synthetic Construct
caaggatagtggttcaacactagtga

SEQ ID NO: 6021 - DNA, 19 bp, Artificial Sequence
  Synthetic Construct
gggacaggtcaggcttcct

SEQ ID NO: 6022 - DNA, 26 bp, Artificial Sequence
  Synthetic Construct
atggaacaatgaaacgatgatgaaca

SEQ ID NO: 6023 - DNA, 19 bp, Artificial Sequence
  Synthetic Construct
acagtgcagccaccccatt

SEQ ID NO: 6024 - DNA, 25 bp, Artificial Sequence
  Synthetic Construct
cagaactgctggaaccactactttg

SEQ ID NO: 6025 - DNA, 19 bp, Artificial Sequence
  Synthetic Construct
aggaacagagcggcagaga

SEQ ID NO: 6026 - DNA, 24 bp, Artificial Sequence
  Synthetic Construct
acaacacagatctaccaccaacag

SEQ ID NO: 6027 - DNA, 25 bp, Artificial Sequence
  Synthetic Construct
gtggtgtatctgggcattgatttct

SEQ ID NO: 6028 - DNA, 25 bp, Artificial Sequence
  Synthetic Construct
gagatctcctttcagctcctaatgg

SEQ ID NO: 6029 - DNA, 24 bp, Artificial Sequence
  Synthetic Construct
ccagccaccagtagcaatattgtg

SEQ ID NO: 6030 - DNA, 22 bp, Artificial Sequence
  Synthetic Construct
tcaccagcagagatccttcact

SEQ ID NO: 6031 - DNA, 21 bp, Artificial Sequence
  Synthetic Construct
tgggtctgcttctgggaactg

SEQ ID NO: 6032 - DNA, 24 bp, Artificial Sequence
  Synthetic Construct
tcgtccctacatttgagggctcta

SEQ ID NO: 6033 - DNA, 22 bp, Artificial Sequence
  Synthetic Construct
tccagggctttgggtgttcaat

SEQ ID NO: 6034 - DNA, 22 bp, Artificial Sequence
  Synthetic Construct
atggctcacctcttctccaatg

SEQ ID NO: 6035 - DNA, 25 bp, Artificial Sequence
  Synthetic Construct
caggaattgattctcggattgcatt

SEQ ID NO: 6036 - DNA, 21 bp, Artificial Sequence
  Synthetic Construct
aggcccatcctctcactagac

SEQ ID NO: 6037 - DNA, 22 bp, Artificial Sequence
  Synthetic Construct
tgagaactggagtgtgcaagca

SEQ ID NO: 6038 - DNA, 23 bp, Artificial Sequence
  Synthetic Construct
ctggcccaggtaatgtccataaa

SEQ ID NO: 6039 - DNA, 26 bp, Artificial Sequence
  Synthetic Construct
gacacccctctcacttgtaatgatac

SEQ ID NO: 6040 - DNA, 20 bp, Artificial Sequence
  Synthetic Construct
cctttcagcccagcatctgt

SEQ ID NO: 6041 - DNA, 24 bp, Artificial Sequence
  Synthetic Construct
ggtcaggaacatgcatgagccata

SEQ ID NO: 6042 - DNA, 23 bp, Artificial Sequence
  Synthetic Construct
gggaaatggtgagactcagtgat

SEQ ID NO: 6043 - DNA, 26 bp, Artificial Sequence
  Synthetic Construct
ttatgctagattgcaaaacccaagag

SEQ ID NO: 6044 - DNA, 22 bp, Artificial Sequence
  Synthetic Construct
agcacctaggaggagagatgtg

SEQ ID NO: 6045 - DNA, 22 bp, Artificial Sequence
  Synthetic Construct
ccaaggacagagggtgaggtat

SEQ ID NO: 6046 - DNA, 23 bp, Artificial Sequence
  Synthetic Construct
agcatggacaacctgcatttttc

SEQ ID NO: 6047 - DNA, 24 bp, Artificial Sequence
  Synthetic Construct
gggaagaagacagcaatggtaagc

SEQ ID NO: 6048 - DNA, 25 bp, Artificial Sequence
  Synthetic Construct
tgtctaccctgccttagtattttgc

SEQ ID NO: 6049 - DNA, 23 bp, Artificial Sequence
  Synthetic Construct
gcactgagttcaatgccaattcc

SEQ ID NO: 6050 - DNA, 24 bp, Artificial Sequence
  Synthetic Construct
acctgtctaggggttaggctatct

SEQ ID NO: 6051 - DNA, 24 bp, Artificial Sequence
  Synthetic Construct
tcggctgttagcaactctgttagc

SEQ ID NO: 6052 - DNA, 25 bp, Artificial Sequence
  Synthetic Construct
gggctcagaacttaacttcacatct

SEQ ID NO: 6053 - DNA, 25 bp, Artificial Sequence
  Synthetic Construct
gctggatatctatggatggctgcat

SEQ ID NO: 6054 - DNA, 21 bp, Artificial Sequence
  Synthetic Construct
tcccttgggcatgactttctg

SEQ ID NO: 6055 - DNA, 24 bp, Artificial Sequence
  Synthetic Construct
gtgaacagtatcccaaagcagttc

SEQ ID NO: 6056 - DNA, 23 bp, Artificial Sequence
  Synthetic Construct
tgggtaggagttaggcagagagt

SEQ ID NO: 6057 - DNA, 21 bp, Artificial Sequence
  Synthetic Construct
gctggcttttgggactggtta

SEQ ID NO: 6058 - DNA, 22 bp, Artificial Sequence
  Synthetic Construct
aggaaggctgctgttccatgaa

SEQ ID NO: 6059 - DNA, 25 bp, Artificial Sequence
  Synthetic Construct
ggctatcatggtggctagatttcac

SEQ ID NO: 6060 - DNA, 20 bp, Artificial Sequence
  Synthetic Construct
tggatctgggatgggcaaca

SEQ ID NO: 6061 - DNA, 24 bp, Artificial Sequence
  Synthetic Construct
gtcctggagctgctatatgctaga

SEQ ID NO: 6062 - DNA, 23 bp, Artificial Sequence
  Synthetic Construct
gctgattctgccatatcctgtga

SEQ ID NO: 6063 - DNA, 28 bp, Artificial Sequence
  Synthetic Construct
cactgctttgaaggttagaaggaagtag

SEQ ID NO: 6064 - DNA, 20 bp, Artificial Sequence
  Synthetic Construct
accaactcatgccgccttca

SEQ ID NO: 6065 - DNA, 25 bp, Artificial Sequence
  Synthetic Construct
gacttgcttaggaattgctgtcttt

SEQ ID NO: 6066 - DNA, 25 bp, Artificial Sequence
  Synthetic Construct
caacagatgtttggtgtgattagca

SEQ ID NO: 6067 - DNA, 24 bp, Artificial Sequence
  Synthetic Construct
gagtttttgtcctacctccaggaa

SEQ ID NO: 6068 - DNA, 23 bp, Artificial Sequence
  Synthetic Construct
cagtcacacagagcgtaaatgga

SEQ ID NO: 6069 - DNA, 24 bp, Artificial Sequence
  Synthetic Construct
ctgctttcactcctcctattagca

SEQ ID NO: 6070 - DNA, 26 bp, Artificial Sequence
  Synthetic Construct
aggaccaggtaattttcttcaagtca

SEQ ID NO: 6071 - DNA, 22 bp, Artificial Sequence
  Synthetic Construct
gagctgagatcaggatggcatt

SEQ ID NO: 6072 - DNA, 25 bp, Artificial Sequence
  Synthetic Construct
cttggggaaactttgctctctctaa

SEQ ID NO: 6073 - DNA, 23 bp, Artificial Sequence
  Synthetic Construct
tggatggtgccctttcaaaaact

SEQ ID NO: 6074 - DNA, 26 bp, Artificial Sequence
  Synthetic Construct
gttgcattgaattaaggggagaacac

SEQ ID NO: 6075 - DNA, 26 bp, Artificial Sequence
  Synthetic Construct
tcacagggtattatgtatggaaagca

SEQ ID NO: 6076 - DNA, 24 bp, Artificial Sequence
  Synthetic Construct
agtggggttagggaaagaactact

SEQ ID NO: 6077 - DNA, 20 bp, Artificial Sequence
  Synthetic Construct
tcaacagtgcccggcaatat

SEQ ID NO: 6078 - DNA, 21 bp, Artificial Sequence
  Synthetic Construct
gtgctattgggatggcatgga

SEQ ID NO: 6079 - DNA, 28 bp, Artificial Sequence
  Synthetic Construct
gaagagagttttcccagttcagtttaag

SEQ ID NO: 6080 - DNA, 29 bp, Artificial Sequence
  Synthetic Construct
agtagagtgaaattgtgattctctctcat

SEQ ID NO: 6081 - DNA, 25 bp, Artificial Sequence
  Synthetic Construct
ctgagctccttctctggaattaacc

SEQ ID NO: 6082 - DNA, 21 bp, Artificial Sequence
  Synthetic Construct
tgagcccaccagtaagcaaaa

SEQ ID NO: 6083 - DNA, 27 bp, Artificial Sequence
  Synthetic Construct
atcaccctctttgaaagtaaactacct

SEQ ID NO: 6084 - DNA, 23 bp, Artificial Sequence
  Synthetic Construct
gaagggtactgcatgtacaggaa

SEQ ID NO: 6085 - DNA, 25 bp, Artificial Sequence
  Synthetic Construct
gcctctgcctagtgtgtcaataatc

SEQ ID NO: 6086 - DNA, 25 bp, Artificial Sequence
  Synthetic Construct
gcagccatctgaacttttgattcag

SEQ ID NO: 6087 - DNA, 24 bp, Artificial Sequence
  Synthetic Construct
ctggagactgcctaagactaccaa

SEQ ID NO: 6088 - DNA, 22 bp, Artificial Sequence
  Synthetic Construct
gcggccattaggaagtgatgaa

SEQ ID NO: 6089 - DNA, 20 bp, Artificial Sequence
  Synthetic Construct
acctccaaggtcccagcatt

SEQ ID NO: 6090 - DNA, 23 bp, Artificial Sequence
  Synthetic Construct
gactgaaaccagcctcattgtct

SEQ ID NO: 6091 - DNA, 24 bp, Artificial Sequence
  Synthetic Construct
tccttggacagaggctggtatagg

SEQ ID NO: 6092 - DNA, 24 bp, Artificial Sequence
  Synthetic Construct
cccctctctggttcatgtagacaa

SEQ ID NO: 6093 - DNA, 22 bp, Artificial Sequence
  Synthetic Construct
acagtggccaaagcttcctact

SEQ ID NO: 6094 - DNA, 20 bp, Artificial Sequence
  Synthetic Construct
tgcagtagccaccagtcaca

SEQ ID NO: 6095 - DNA, 23 bp, Artificial Sequence
  Synthetic Construct
gcccagttttcactcacaatgaa

SEQ ID NO: 6096 - DNA, 22 bp, Artificial Sequence
  Synthetic Construct
agggcttcaggtgaaggttaca

SEQ ID NO: 6097 - DNA, 29 bp, Artificial Sequence
  Synthetic Construct
ggaatggctgtaaaagtaagaggaaaacc

SEQ ID NO: 6098 - DNA, 22 bp, Artificial Sequence
  Synthetic Construct
tcctgctaagagtgggaatcca

SEQ ID NO: 6099 - DNA, 28 bp, Artificial Sequence
  Synthetic Construct
atatgtgaaatcctgtgctgtaagtttt

SEQ ID NO: 6100 - DNA, 21 bp, Artificial Sequence
  Synthetic Construct
agggctgccatttctggttgt

SEQ ID NO: 6101 - DNA, 22 bp, Artificial Sequence
  Synthetic Construct
ggctgacactgtgtcacatgaa

SEQ ID NO: 6102 - DNA, 25 bp, Artificial Sequence
  Synthetic Construct
ggcatccttcaatccagtcaacaac

SEQ ID NO: 6103 - DNA, 25 bp, Artificial Sequence
  Synthetic Construct
ggactcagtgagaattggacaaacg

SEQ ID NO: 6104 - DNA, 24 bp, Artificial Sequence
  Synthetic Construct
ggactatgtcctgtaccagatgtg

SEQ ID NO: 6105 - DNA, 25 bp, Artificial Sequence
  Synthetic Construct
ccacattttccatctgctcctggaa

SEQ ID NO: 6106 - DNA, 23 bp, Artificial Sequence
  Synthetic Construct
actcaaggccatagaccctttca

SEQ ID NO: 6107 - DNA, 25 bp, Artificial Sequence
  Synthetic Construct
tgtggaaataagggagggattaagg

SEQ ID NO: 6108 - DNA, 22 bp, Artificial Sequence
  Synthetic Construct
tcagatggactgccaaggtcaa

SEQ ID NO: 6109 - DNA, 21 bp, Artificial Sequence
  Synthetic Construct
gcctcatctcatgggcaagac

SEQ ID NO: 6110 - DNA, 25 bp, Artificial Sequence
  Synthetic Construct
ctaaacctaggactcaacagtcgtt

SEQ ID NO: 6111 - DNA, 24 bp, Artificial Sequence
  Synthetic Construct
gttgtatcagtggagggaaagtct

SEQ ID NO: 6112 - DNA, 27 bp, Artificial Sequence
  Synthetic Construct
tctttgctatttgggctagttattcca

SEQ ID NO: 6113 - DNA, 26 bp, Artificial Sequence
  Synthetic Construct
aactaagagacttggctttcaaatcg

SEQ ID NO: 6114 - DNA, 21 bp, Artificial Sequence
  Synthetic Construct
tccaggagtcagggagtcaca

SEQ ID NO: 6115 - DNA, 27 bp, Artificial Sequence
  Synthetic Construct
tgggtaactacacctactactttcaag

SEQ ID NO: 6116 - DNA, 24 bp, Artificial Sequence
  Synthetic Construct
gtataaggcatgcttagccattgc

SEQ ID NO: 6117 - DNA, 23 bp, Artificial Sequence
  Synthetic Construct
acagaaattggaggaagcaggaa

SEQ ID NO: 6118 - DNA, 25 bp, Artificial Sequence
  Synthetic Construct
gcagacctatgtcttgcaaagcttt

SEQ ID NO: 6119 - DNA, 22 bp, Artificial Sequence
  Synthetic Construct
ttctggctcctgctaagttgga

SEQ ID NO: 6120 - DNA, 26 bp, Artificial Sequence
  Synthetic Construct
ggttgtcaaaagtcagggatgataag

SEQ ID NO: 6121 - DNA, 24 bp, Artificial Sequence
  Synthetic Construct
cttgctgtttctaaggtcgtgaag

SEQ ID NO: 6122 - DNA, 22 bp, Artificial Sequence
  Synthetic Construct
ggaacacaatggaggtgaggtt

SEQ ID NO: 6123 - DNA, 25 bp, Artificial Sequence
  Synthetic Construct
ctcccgaatggatcaaagcttactg

SEQ ID NO: 6124 - DNA, 28 bp, Artificial Sequence
  Synthetic Construct
gggaaaaacatttctctgtgctcatttc

SEQ ID NO: 6125 - DNA, 22 bp, Artificial Sequence
  Synthetic Construct
cctccatttcaggccatagctt

SEQ ID NO: 6126 - DNA, 25 bp, Artificial Sequence
  Synthetic Construct
caatttctgcaaaatctgggtccaa

SEQ ID NO: 6127 - DNA, 23 bp, Artificial Sequence
  Synthetic Construct
tgggaagaattcactcccaacct

SEQ ID NO: 6128 - DNA, 24 bp, Artificial Sequence
  Synthetic Construct
ggctttcttcatagcccaagtaca

SEQ ID NO: 6129 - DNA, 26 bp, Artificial Sequence
  Synthetic Construct
gcagagagcctggaattaacaagact

SEQ ID NO: 6130 - DNA, 26 bp, Artificial Sequence
  Synthetic Construct
cagcgttatgactcatgcctgaatta

SEQ ID NO: 6131 - DNA, 28 bp, Artificial Sequence
  Synthetic Construct
tggtctgggttttatagttttgtattgc

SEQ ID NO: 6132 - DNA, 21 bp, Artificial Sequence
  Synthetic Construct
tgcatctgcagccttcattcc

SEQ ID NO: 6133 - DNA, 20 bp, Artificial Sequence
  Synthetic Construct
atggccagctgttgggttga

SEQ ID NO: 6134 - DNA, 21 bp, Artificial Sequence
  Synthetic Construct
tcaactgggcgcatagttcaa

SEQ ID NO: 6135 - DNA, 22 bp, Artificial Sequence
  Synthetic Construct
gtggtcagcaagacaagaccat

SEQ ID NO: 6136 - DNA, 22 bp, Artificial Sequence
  Synthetic Construct
gacatgctcactgagtgccatt

SEQ ID NO: 6137 - DNA, 21 bp, Artificial Sequence
  Synthetic Construct
aacaggtttccggcagagttt

SEQ ID NO: 6138 - DNA, 24 bp, Artificial Sequence
  Synthetic Construct
ctccaggaatcagtgatggatgaa

SEQ ID NO: 6139 - DNA, 27 bp, Artificial Sequence
  Synthetic Construct
cccaaggaagatagtcagactcttctc

SEQ ID NO: 6140 - DNA, 22 bp, Artificial Sequence
  Synthetic Construct
tccaaggaaacgtcaccaggaa

SEQ ID NO: 6141 - DNA, 21 bp, Artificial Sequence
  Synthetic Construct
atgtggaggaagggcaaaacc

SEQ ID NO: 6142 - DNA, 26 bp, Artificial Sequence
  Synthetic Construct
ggaggactgataacaaatgccatttt

SEQ ID NO: 6143 - DNA, 23 bp, Artificial Sequence
  Synthetic Construct
gcaggttttagctgcatggtctt

SEQ ID NO: 6144 - DNA, 23 bp, Artificial Sequence
  Synthetic Construct
gtggctgctgttttcatggaaga

SEQ ID NO: 6145 - DNA, 28 bp, Artificial Sequence
  Synthetic Construct
agcaggaaaatgataatttgtaggcaaa

SEQ ID NO: 6146 - DNA, 26 bp, Artificial Sequence
  Synthetic Construct
ccaaaaaaaggtcatggtcagtttgt

SEQ ID NO: 6147 - DNA, 24 bp, Artificial Sequence
  Synthetic Construct
ggctcacagaaacagatggtttgg

SEQ ID NO: 6148 - DNA, 25 bp, Artificial Sequence
  Synthetic Construct
agccttgataaaacgtcatctccat

SEQ ID NO: 6149 - DNA, 24 bp, Artificial Sequence
  Synthetic Construct
ggtcacctaaacacagccaatctc

SEQ ID NO: 6150 - DNA, 26 bp, Artificial Sequence
  Synthetic Construct
ctgaattggtaaacacaatggatgca

SEQ ID NO: 6151 - DNA, 29 bp, Artificial Sequence
  Synthetic Construct
tgtgtttatggttaaacaggaaagtagga

SEQ ID NO: 6152 - DNA, 24 bp, Artificial Sequence
  Synthetic Construct
tgcttttggacctcattcttttcc

SEQ ID NO: 6153 - DNA, 30 bp, Artificial Sequence
  Synthetic Construct
cttccattgtagagtggtagtctaattttc

SEQ ID NO: 6154 - DNA, 26 bp, Artificial Sequence
  Synthetic Construct
cagaagtttctctgccatagtcattg

SEQ ID NO: 6155 - DNA, 27 bp, Artificial Sequence
  Synthetic Construct
gccacaccctaaaattctaataatgca

SEQ ID NO: 6156 - DNA, 22 bp, Artificial Sequence
  Synthetic Construct
tctggtgagtgctgctctctat

SEQ ID NO: 6157 - DNA, 27 bp, Artificial Sequence
  Synthetic Construct
ctgagtctgtgttcaggaatgaactag

SEQ ID NO: 6158 - DNA, 21 bp, Artificial Sequence
  Synthetic Construct
agccacttccaaggtgagcta

SEQ ID NO: 6159 - DNA, 24 bp, Artificial Sequence
  Synthetic Construct
caccaagcagatagcactaagcaa

SEQ ID NO: 6160 - DNA, 20 bp, Artificial Sequence
  Synthetic Construct
ccattgctgccaccattgct

SEQ ID NO: 6161 - DNA, 27 bp, Artificial Sequence
  Synthetic Construct
gtcttccaactacctgaatctgaaagc

SEQ ID NO: 6162 - DNA, 22 bp, Artificial Sequence
  Synthetic Construct
ctatgcccagttctgccttagg

SEQ ID NO: 6163 - DNA, 23 bp, Artificial Sequence
  Synthetic Construct
catgccccttctttaaggtgctt

SEQ ID NO: 6164 - DNA, 27 bp, Artificial Sequence
  Synthetic Construct
ggagaaagcaacaaatgaattctcctt

SEQ ID NO: 6165 - DNA, 27 bp, Artificial Sequence
  Synthetic Construct
gttcagtaatggaaaatggttgtcagt

SEQ ID NO: 6166 - DNA, 29 bp, Artificial Sequence
  Synthetic Construct
caccctataaaaatcaatcagggtattcc

SEQ ID NO: 6167 - DNA, 25 bp, Artificial Sequence
  Synthetic Construct
catggtgccctatactagctttcac

SEQ ID NO: 6168 - DNA, 24 bp, Artificial Sequence
  Synthetic Construct
cccaaaaagagggaatcagaccat

SEQ ID NO: 6169 - DNA, 26 bp, Artificial Sequence
  Synthetic Construct
ggtaatgagaatctcagctgggactt

SEQ ID NO: 6170 - DNA, 29 bp, Artificial Sequence
  Synthetic Construct
catacaatttatcattgtcacaccaccta

SEQ ID NO: 6171 - DNA, 24 bp, Artificial Sequence
  Synthetic Construct
agaagcccctggtaaaggaagaag

SEQ ID NO: 6172 - DNA, 22 bp, Artificial Sequence
  Synthetic Construct
gctctaagtcaagggaggcttt

SEQ ID NO: 6173 - DNA, 24 bp, Artificial Sequence
  Synthetic Construct
gcaggcatgaattcatagcttcca

SEQ ID NO: 6174 - DNA, 22 bp, Artificial Sequence
  Synthetic Construct
agggccctcttcctggttgata

SEQ ID NO: 6175 - DNA, 27 bp, Artificial Sequence
  Synthetic Construct
gtgggtaaatgaggttttgaaaactct

SEQ ID NO: 6176 - DNA, 25 bp, Artificial Sequence
  Synthetic Construct
aagcaaagtagttaaggccaagaac

SEQ ID NO: 6177 - DNA, 24 bp, Artificial Sequence
  Synthetic Construct
gaagtgctggtctgttgttttgtt

SEQ ID NO: 6178 - DNA, 28 bp, Artificial Sequence
  Synthetic Construct
aggttacaagagaagacttacaccttag

SEQ ID NO: 6179 - DNA, 25 bp, Artificial Sequence
  Synthetic Construct
cagggggaaactttgaagagacttc

SEQ ID NO: 6180 - DNA, 22 bp, Artificial Sequence
  Synthetic Construct
tgacagcaccagtgacagaaat

SEQ ID NO: 6181 - DNA, 28 bp, Artificial Sequence
  Synthetic Construct
tcaaaatcctactcatatgtcagttgga

SEQ ID NO: 6182 - DNA, 29 bp, Artificial Sequence
  Synthetic Construct
gggctacaaatcaaggttaattccacttc

SEQ ID NO: 6183 - DNA, 27 bp, Artificial Sequence
  Synthetic Construct
cctattttcacagcaccttttgatgac

SEQ ID NO: 6184 - DNA, 26 bp, Artificial Sequence
  Synthetic Construct
ctctcccatgactaggattgtaaagg

SEQ ID NO: 6185 - DNA, 24 bp, Artificial Sequence
  Synthetic Construct
gcatctcagaagttaccactccat

SEQ ID NO: 6186 - DNA, 22 bp, Artificial Sequence
  Synthetic Construct
gcccaggaagtcaaaccactta

SEQ ID NO: 6187 - DNA, 26 bp, Artificial Sequence
  Synthetic Construct
gacaagttttgagtttaccactgcta

SEQ ID NO: 6188 - DNA, 22 bp, Artificial Sequence
  Synthetic Construct
ggggtcatgaagcattgccttt

SEQ ID NO: 6189 - DNA, 26 bp, Artificial Sequence
  Synthetic Construct
tcgtgattatgtgagtcagcaatttg

SEQ ID NO: 6190 - DNA, 28 bp, Artificial Sequence
  Synthetic Construct
ggagtctccatttcaaaccacatttcag

SEQ ID NO: 6191 - DNA, 28 bp, Artificial Sequence
  Synthetic Construct
ctcaatgaaaatgagggggtatttttgt

SEQ ID NO: 6192 - DNA, 25 bp, Artificial Sequence
  Synthetic Construct
gtgaaatatgctgcctccaaaatct

SEQ ID NO: 6193 - DNA, 26 bp, Artificial Sequence
  Synthetic Construct
ctttaccagttgtcaagtgaaacgta

SEQ ID NO: 6194 - DNA, 28 bp, Artificial Sequence
  Synthetic Construct
ggtcctgaggaaatgctatatatggaat

SEQ ID NO: 6195 - DNA, 23 bp, Artificial Sequence
  Synthetic Construct
cacacttgccctatctgatgtca

SEQ ID NO: 6196 - DNA, 21 bp, Artificial Sequence
  Synthetic Construct
ccactcccacaggaccctaaa

SEQ ID NO: 6197 - DNA, 27 bp, Artificial Sequence
  Synthetic Construct
cgtctatggaattcgagggagatcata

SEQ ID NO: 6198 - DNA, 20 bp, Artificial Sequence
  Synthetic Construct
cggctgttgatcctgacgta

SEQ ID NO: 6199 - DNA, 22 bp, Artificial Sequence
  Synthetic Construct
tggggatcatggggattatgga

SEQ ID NO: 6200 - DNA, 27 bp, Artificial Sequence
  Synthetic Construct
ctactcgctctaaattggattgattcc

SEQ ID NO: 6201 - DNA, 20 bp, Artificial Sequence
  Synthetic Construct
gccacacccaccagtgttct

SEQ ID NO: 6202 - DNA, 29 bp, Artificial Sequence
  Synthetic Construct
cactgtctggaattatttatacccatcct

SEQ ID NO: 6203 - DNA, 24 bp, Artificial Sequence
  Synthetic Construct
gggtctcatctttgcaagcagata

SEQ ID NO: 6204 - DNA, 22 bp, Artificial Sequence
  Synthetic Construct
cctgaagccgtatgacaagaca

SEQ ID NO: 6205 - DNA, 22 bp, Artificial Sequence
  Synthetic Construct
tcctctggcccatctcttctag

SEQ ID NO: 6206 - DNA, 24 bp, Artificial Sequence
  Synthetic Construct
gccctctctacagtaagtgagttc

SEQ ID NO: 6207 - DNA, 27 bp, Artificial Sequence
  Synthetic Construct
gggatgaactgtgatgttggagatagc

SEQ ID NO: 6208 - DNA, 24 bp, Artificial Sequence
  Synthetic Construct
actccatcactgttacctgttgtg

SEQ ID NO: 6209 - DNA, 26 bp, Artificial Sequence
  Synthetic Construct
ctgagttcagtgtaaacttccccatt

SEQ ID NO: 6210 - DNA, 28 bp, Artificial Sequence
  Synthetic Construct
aacatccatttcctccagatttatgaac

SEQ ID NO: 6211 - DNA, 28 bp, Artificial Sequence
  Synthetic Construct
ctcatgcaagagttttcttaaagcctta

SEQ ID NO: 6212 - DNA, 27 bp, Artificial Sequence
  Synthetic Construct
gtcagtgggtctctgaaacttttagtg

SEQ ID NO: 6213 - DNA, 26 bp, Artificial Sequence
  Synthetic Construct
actgactgaaaattggcttgaaaagg

SEQ ID NO: 6214 - DNA, 28 bp, Artificial Sequence
  Synthetic Construct
gcttcttgcttataccattgcagtaagc

SEQ ID NO: 6215 - DNA, 26 bp, Artificial Sequence
  Synthetic Construct
caacaaaactgtaatactggcactgt

SEQ ID NO: 6216 - DNA, 23 bp, Artificial Sequence
  Synthetic Construct
tggtaaggccatgttttccttga

SEQ ID NO: 6217 - DNA, 25 bp, Artificial Sequence
  Synthetic Construct
ccctcacttcaatgaatccaagaca

SEQ ID NO: 6218 - DNA, 24 bp, Artificial Sequence
  Synthetic Construct
tcctcagaaatgtgccaaaactct

SEQ ID NO: 6219 - DNA, 25 bp, Artificial Sequence
  Synthetic Construct
acagctatttcactgccacaatttg

SEQ ID NO: 6220 - DNA, 24 bp, Artificial Sequence
  Synthetic Construct
cagtctggaagtccgtgttaattg

SEQ ID NO: 6221 - DNA, 24 bp, Artificial Sequence
  Synthetic Construct
cacttttttggtgccagagagaag

SEQ ID NO: 6222 - DNA, 24 bp, Artificial Sequence
  Synthetic Construct
ttatgggggaggagaaagtgattg

SEQ ID NO: 6223 - DNA, 22 bp, Artificial Sequence
  Synthetic Construct
acccatgccttgtgtgtgcata

SEQ ID NO: 6224 - DNA, 22 bp, Artificial Sequence
  Synthetic Construct
cctgcttgcttggtgatgtgtt

SEQ ID NO: 6225 - DNA, 25 bp, Artificial Sequence
  Synthetic Construct
gctgagtcctgtcaattacccagta

SEQ ID NO: 6226 - DNA, 20 bp, Artificial Sequence
  Synthetic Construct
gggcgattccagcactctct

SEQ ID NO: 6227 - DNA, 24 bp, Artificial Sequence
  Synthetic Construct
cattcaataagggccacctctttg

SEQ ID NO: 6228 - DNA, 28 bp, Artificial Sequence
  Synthetic Construct
ctgtaaccgcatagtatagtttcaagct

SEQ ID NO: 6229 - DNA, 22 bp, Artificial Sequence
  Synthetic Construct
tgtgtcaggtctccttgtgtct

SEQ ID NO: 6230 - DNA, 27 bp, Artificial Sequence
  Synthetic Construct
ccaaggttaaatgactcacctgaagtc

SEQ ID NO: 6231 - DNA, 27 bp, Artificial Sequence
  Synthetic Construct
cctgcctctatggttgtaactttaaag

SEQ ID NO: 6232 - DNA, 26 bp, Artificial Sequence
  Synthetic Construct
gagggagggtaagttactacaagtca

SEQ ID NO: 6233 - DNA, 30 bp, Artificial Sequence
  Synthetic Construct
cccaaaatttctttgttaccaattggcaaa

SEQ ID NO: 6234 - DNA, 28 bp, Artificial Sequence
  Synthetic Construct
ctcctgattcctatgcaaagaatttgag

SEQ ID NO: 6235 - DNA, 24 bp, Artificial Sequence
  Synthetic Construct
ccctccaggcctcataaaaactag

SEQ ID NO: 6236 - DNA, 27 bp, Artificial Sequence
  Synthetic Construct
gggcaatacttccaaggttatcccata

SEQ ID NO: 6237 - DNA, 22 bp, Artificial Sequence
  Synthetic Construct
cttgccactgtgagttcaagtg

SEQ ID NO: 6238 - DNA, 30 bp, Artificial Sequence
  Synthetic Construct
acaaactaaataaacgacccattctgttat

SEQ ID NO: 6239 - DNA, 22 bp, Artificial Sequence
  Synthetic Construct
tggagacaagtggcacgtaaaa

SEQ ID NO: 6240 - DNA, 30 bp, Artificial Sequence
  Synthetic Construct
gtgtccctctaaatacaactattgcttacc

SEQ ID NO: 6241 - DNA, 22 bp, Artificial Sequence
  Synthetic Construct
gtcgccgaagtactgagatgaa

SEQ ID NO: 6242 - DNA, 21 bp, Artificial Sequence
  Synthetic Construct
aaagctgcctgggagggaaaa

SEQ ID NO: 6243 - DNA, 23 bp, Artificial Sequence
  Synthetic Construct
ctcctagcaaacctgtgaggaaa

SEQ ID NO: 6244 - DNA, 25 bp, Artificial Sequence
  Synthetic Construct
ggcattgctaagagttgtaactgtt

SEQ ID NO: 6245 - DNA, 26 bp, Artificial Sequence
  Synthetic Construct
aacatctgtcagactgtaatcaccat

SEQ ID NO: 6246 - DNA, 22 bp, Artificial Sequence
  Synthetic Construct
tcctgctccactctcactctgt

SEQ ID NO: 6247 - DNA, 29 bp, Artificial Sequence
  Synthetic Construct
ggttgggtagaatactttagctttgattc

SEQ ID NO: 6248 - DNA, 26 bp, Artificial Sequence
  Synthetic Construct
ggtcaacactcagaattgaccctgat

SEQ ID NO: 6249 - DNA, 27 bp, Artificial Sequence
  Synthetic Construct
gtgatagataaccctcttcctcattgt

SEQ ID NO: 6250 - DNA, 23 bp, Artificial Sequence
  Synthetic Construct
actggatgtcctcccatgctaaa

SEQ ID NO: 6251 - DNA, 29 bp, Artificial Sequence
  Synthetic Construct
agaactttattcccagtaggatacacaaa

SEQ ID NO: 6252 - DNA, 28 bp, Artificial Sequence
  Synthetic Construct
aagctgtaataaaactctgccagtaatg

SEQ ID NO: 6253 - DNA, 26 bp, Artificial Sequence
  Synthetic Construct
gcctttaaagcaggtgtgtaccaatc

SEQ ID NO: 6254 - DNA, 29 bp, Artificial Sequence
  Synthetic Construct
cctgtagatagaccctaaccattgtaacc

SEQ ID NO: 6255 - DNA, 21 bp, Artificial Sequence
  Synthetic Construct
ctaagcgataaggcggcaaac

SEQ ID NO: 6256 - DNA, 28 bp, Artificial Sequence
  Synthetic Construct
gcgatgtgcttttcagatagatggtatc

SEQ ID NO: 6257 - DNA, 26 bp, Artificial Sequence
  Synthetic Construct
ccatggaactaagacagagaccaact

SEQ ID NO: 6258 - DNA, 22 bp, Artificial Sequence
  Synthetic Construct
gtccctaacctctgcaatttgc

SEQ ID NO: 6259 - DNA, 28 bp, Artificial Sequence
  Synthetic Construct
aatacttatgcaagcttttcatgaaacg

SEQ ID NO: 6260 - DNA, 20 bp, Artificial Sequence
  Synthetic Construct
agaaaggctgcctgcagatg

SEQ ID NO: 6261 - DNA, 26 bp, Artificial Sequence
  Synthetic Construct
ggctttgagttaacctttgaagtctt

SEQ ID NO: 6262 - DNA, 27 bp, Artificial Sequence
  Synthetic Construct
ggaaagtttgaccacaaattgacaatc

SEQ ID NO: 6263 - DNA, 26 bp, Artificial Sequence
  Synthetic Construct
ggctgattaccctgggtaaaggtatc

SEQ ID NO: 6264 - DNA, 28 bp, Artificial Sequence
  Synthetic Construct
gcttgaatagtgaaagcaatcctaatcc

SEQ ID NO: 6265 - DNA, 26 bp, Artificial Sequence
  Synthetic Construct
ctgtgttgtgtttcttttggttgaca

SEQ ID NO: 6266 - DNA, 23 bp, Artificial Sequence
  Synthetic Construct
ggcagaagagtaatggactgcat

SEQ ID NO: 6267 - DNA, 25 bp, Artificial Sequence
  Synthetic Construct
ctcagttcacacaaaggatcttcca

SEQ ID NO: 6268 - DNA, 29 bp, Artificial Sequence
  Synthetic Construct
gtgattaccacaccagttaaagaaagaac

SEQ ID NO: 6269 - DNA, 22 bp, Artificial Sequence
  Synthetic Construct
aactgagctgatggcagttagg

SEQ ID NO: 6270 - DNA, 27 bp, Artificial Sequence
  Synthetic Construct
ctattggcaggatctttctgtttgtag

SEQ ID NO: 6271 - DNA, 26 bp, Artificial Sequence
  Synthetic Construct
ttaatctgtcttacactctgctgaca

SEQ ID NO: 6272 - DNA, 21 bp, Artificial Sequence
  Synthetic Construct
ggaggccctccattctttgtt

SEQ ID NO: 6273 - DNA, 30 bp, Artificial Sequence
  Synthetic Construct
cacaataatagcttcttacttgtgcatttc

SEQ ID NO: 6274 - DNA, 21 bp, Artificial Sequence
  Synthetic Construct
agccttccagatccccttgtt

SEQ ID NO: 6275 - DNA, 30 bp, Artificial Sequence
  Synthetic Construct
ccagttgactaccatcacagatacaagatg

SEQ ID NO: 6276 - DNA, 26 bp, Artificial Sequence
  Synthetic Construct
gcatataactgtggtgggtaattgtg

SEQ ID NO: 6277 - DNA, 28 bp, Artificial Sequence
  Synthetic Construct
ccactagaatacaaatccacttctgaca

SEQ ID NO: 6278 - DNA, 22 bp, Artificial Sequence
  Synthetic Construct
agggtgacatgcttcacagatc

SEQ ID NO: 6279 - DNA, 28 bp, Artificial Sequence
  Synthetic Construct
aggttagtagtcaaggcctatgttttac

SEQ ID NO: 6280 - DNA, 22 bp, Artificial Sequence
  Synthetic Construct
gcaacctatagcagcctggatt

SEQ ID NO: 6281 - DNA, 21 bp, Artificial Sequence
  Synthetic Construct
aaaggccccaaaccctttgct

SEQ ID NO: 6282 - DNA, 28 bp, Artificial Sequence
  Synthetic Construct
ccctcattctatggtattgattccacaa

SEQ ID NO: 6283 - DNA, 24 bp, Artificial Sequence
  Synthetic Construct
ggggatcacaaaactgtcattctg

SEQ ID NO: 6284 - DNA, 29 bp, Artificial Sequence
  Synthetic Construct
gcattattcggatactacaaccagacgaa

SEQ ID NO: 6285 - DNA, 26 bp, Artificial Sequence
  Synthetic Construct
tgaaagacaatttgccggtatgttac

SEQ ID NO: 6286 - DNA, 26 bp, Artificial Sequence
  Synthetic Construct
cctgaggtccccatgaagagctataa

SEQ ID NO: 6287 - DNA, 22 bp, Artificial Sequence
  Synthetic Construct
tcgggaatgctgaggaaaagag

SEQ ID NO: 6288 - DNA, 21 bp, Artificial Sequence
  Synthetic Construct
gagccctctccgtttgtcaca

SEQ ID NO: 6289 - DNA, 22 bp, Artificial Sequence
  Synthetic Construct
gctggacaaactactgcctctt

SEQ ID NO: 6290 - DNA, 22 bp, Artificial Sequence
  Synthetic Construct
cagcttccctcttttgctctgt

SEQ ID NO: 6291 - DNA, 23 bp, Artificial Sequence
  Synthetic Construct
gaactcaaatggcctgtgaagtc

SEQ ID NO: 6292 - DNA, 22 bp, Artificial Sequence
  Synthetic Construct
caacggatggagatgcaaccat

SEQ ID NO: 6293 - DNA, 20 bp, Artificial Sequence
  Synthetic Construct
atctggggcccatcctttgg

SEQ ID NO: 6294 - DNA, 22 bp, Artificial Sequence
  Synthetic Construct
gcctggagaagaggtagatgtg

SEQ ID NO: 6295 - DNA, 25 bp, Artificial Sequence
  Synthetic Construct
cgatctccttgtttcacctctttcc

SEQ ID NO: 6296 - DNA, 20 bp, Artificial Sequence
  Synthetic Construct
agccccatgtctgtgatggt

SEQ ID NO: 6297 - DNA, 18 bp, Artificial Sequence
  Synthetic Construct
ctcgccagcatggtgaca

SEQ ID NO: 6298 - DNA, 20 bp, Artificial Sequence
  Synthetic Construct
tccactgggcccatctctct

SEQ ID NO: 6299 - DNA, 22 bp, Artificial Sequence
  Synthetic Construct
ggtggacaaggtggaaaagtct

SEQ ID NO: 6300 - DNA, 30 bp, Artificial Sequence
  Synthetic Construct
ctagtcttaagagtataaggtagggtgaga

SEQ ID NO: 6301 - DNA, 22 bp, Artificial Sequence
  Synthetic Construct
tttgcccttcccagacaagaca

SEQ ID NO: 6302 - DNA, 20 bp, Artificial Sequence
  Synthetic Construct
ccaccgagctcctcctgtct

SEQ ID NO: 6303 - DNA, 20 bp, Artificial Sequence
  Synthetic Construct
tgcagggaaggactgttgtc

SEQ ID NO: 6304 - DNA, 22 bp, Artificial Sequence
  Synthetic Construct
tcacccaccattcatgcaagag

SEQ ID NO: 6305 - DNA, 23 bp, Artificial Sequence
  Synthetic Construct
gggaatacagtgcaaagcaagga

SEQ ID NO: 6306 - DNA, 24 bp, Artificial Sequence
  Synthetic Construct
gcgcagtagagaagaggcttttag

SEQ ID NO: 6307 - DNA, 25 bp, Artificial Sequence
  Synthetic Construct
caagctaattctgcagcaagtatga

SEQ ID NO: 6308 - DNA, 26 bp, Artificial Sequence
  Synthetic Construct
actcttagttaacacagccatggtat

SEQ ID NO: 6309 - DNA, 21 bp, Artificial Sequence
  Synthetic Construct
attgtggaggcctgaaatgct

SEQ ID NO: 6310 - DNA, 26 bp, Artificial Sequence
  Synthetic Construct
gggctgtttccataatcatcctacct

SEQ ID NO: 6311 - DNA, 23 bp, Artificial Sequence
  Synthetic Construct
tcacaaccagttttcaccaacca

SEQ ID NO: 6312 - DNA, 23 bp, Artificial Sequence
  Synthetic Construct
gagctgagtaaagccatgtgtca

SEQ ID NO: 6313 - DNA, 25 bp, Artificial Sequence
  Synthetic Construct
gtcacccatcccacctatttacttg

SEQ ID NO: 6314 - DNA, 27 bp, Artificial Sequence
  Synthetic Construct
aaggaaatagacccatttagcttcagt

SEQ ID NO: 6315 - DNA, 25 bp, Artificial Sequence
  Synthetic Construct
ggaagttctggctctgtacctgaaa

SEQ ID NO: 6316 - DNA, 20 bp, Artificial Sequence
  Synthetic Construct
tccgtgtgctcagcttgact

SEQ ID NO: 6317 - DNA, 27 bp, Artificial Sequence
  Synthetic Construct
gttttagtcctccttatagcccattgg

SEQ ID NO: 6318 - DNA, 22 bp, Artificial Sequence
  Synthetic Construct
tttggtcaccagcagtggaagt

SEQ ID NO: 6319 - DNA, 23 bp, Artificial Sequence
  Synthetic Construct
gccagtggtggattcaaaaagca

SEQ ID NO: 6320 - DNA, 23 bp, Artificial Sequence
  Synthetic Construct
gctgctggcccttatgcctgaag

SEQ ID NO: 6321 - DNA, 23 bp, Artificial Sequence
  Synthetic Construct
agtctctcaaagcctgacgtttc

SEQ ID NO: 6322 - DNA, 24 bp, Artificial Sequence
  Synthetic Construct
gtggaataagatggaagccacact

SEQ ID NO: 6323 - DNA, 28 bp, Artificial Sequence
  Synthetic Construct
aatattactagccacactgctattcctt

SEQ ID NO: 6324 - DNA, 19 bp, Artificial Sequence
  Synthetic Construct
cgaggacccaccacagtct

SEQ ID NO: 6325 - DNA, 28 bp, Artificial Sequence
  Synthetic Construct
gagtgggataaataaaggctgtaaagag

SEQ ID NO: 6326 - DNA, 22 bp, Artificial Sequence
  Synthetic Construct
tccaatcccacctctgacaatg

SEQ ID NO: 6327 - DNA, 24 bp, Artificial Sequence
  Synthetic Construct
cctgcttagtggcctatgtgatca

SEQ ID NO: 6328 - DNA, 20 bp, Artificial Sequence
  Synthetic Construct
ttgtccccccaacccattca

SEQ ID NO: 6329 - DNA, 22 bp, Artificial Sequence
  Synthetic Construct
ggcaacactccgcttcactatt

SEQ ID NO: 6330 - DNA, 28 bp, Artificial Sequence
  Synthetic Construct
ggtagtaagattaagagctctgattgca

SEQ ID NO: 6331 - DNA, 23 bp, Artificial Sequence
  Synthetic Construct
ccaggaaaagacacccccataca

SEQ ID NO: 6332 - DNA, 25 bp, Artificial Sequence
  Synthetic Construct
gaatggttggtatctaggcatcact

SEQ ID NO: 6333 - DNA, 22 bp, Artificial Sequence
  Synthetic Construct
gagtgccaacagctcagctaat

SEQ ID NO: 6334 - DNA, 27 bp, Artificial Sequence
  Synthetic Construct
gcatcaaactcaactcaaatggaatgt

SEQ ID NO: 6335 - DNA, 21 bp, Artificial Sequence
  Synthetic Construct
tccacatcccctttccacctt

SEQ ID NO: 6336 - DNA, 22 bp, Artificial Sequence
  Synthetic Construct
aggcacccacctctagacagta

SEQ ID NO: 6337 - DNA, 24 bp, Artificial Sequence
  Synthetic Construct
gagtgatggtcaggcagttcatat

SEQ ID NO: 6338 - DNA, 21 bp, Artificial Sequence
  Synthetic Construct
tgcttcctgggcctgttttgt

SEQ ID NO: 6339 - DNA, 20 bp, Artificial Sequence
  Synthetic Construct
tcggcagggagggaagcttt

SEQ ID NO: 6340 - DNA, 20 bp, Artificial Sequence
  Synthetic Construct
ccagggtgcactctcttcct

SEQ ID NO: 6341 - DNA, 21 bp, Artificial Sequence
  Synthetic Construct
agcccctgctgagcttatcca

SEQ ID NO: 6342 - DNA, 27 bp, Artificial Sequence
  Synthetic Construct
cacacctgttatcacagtcttcctagt

SEQ ID NO: 6343 - DNA, 23 bp, Artificial Sequence
  Synthetic Construct
aagtagcctagatttgcctgctt

SEQ ID NO: 6344 - DNA, 23 bp, Artificial Sequence
  Synthetic Construct
atttcctcgaaccactcgctaaa

SEQ ID NO: 6345 - DNA, 22 bp, Artificial Sequence
  Synthetic Construct
caaagccctccttgacttgctt

SEQ ID NO: 6346 - DNA, 21 bp, Artificial Sequence
  Synthetic Construct
ttggctgacccctggtgtagt

SEQ ID NO: 6347 - DNA, 22 bp, Artificial Sequence
  Synthetic Construct
tgcccttagtctagcacagctt

SEQ ID NO: 6348 - DNA, 21 bp, Artificial Sequence
  Synthetic Construct
cccatcaggaaggctgagatg

SEQ ID NO: 6349 - DNA, 26 bp, Artificial Sequence
  Synthetic Construct
gctacttcccctgcatatctattagg

SEQ ID NO: 6350 - DNA, 28 bp, Artificial Sequence
  Synthetic Construct
ggaaattaggtaagcatttcctgaatgg

SEQ ID NO: 6351 - DNA, 27 bp, Artificial Sequence
  Synthetic Construct
ccaaggaacaattttctgtcagtgaga

SEQ ID NO: 6352 - DNA, 26 bp, Artificial Sequence
  Synthetic Construct
gtgatcatcaactggattgcacaaag

SEQ ID NO: 6353 - DNA, 22 bp, Artificial Sequence
  Synthetic Construct
caggcatgctctccaaattctg

SEQ ID NO: 6354 - DNA, 23 bp, Artificial Sequence
  Synthetic Construct
tgggagtctttgccagtggacta

SEQ ID NO: 6355 - DNA, 27 bp, Artificial Sequence
  Synthetic Construct
ctgggggaatagctatatctagttggt

SEQ ID NO: 6356 - DNA, 21 bp, Artificial Sequence
  Synthetic Construct
agatgggcctctcctgtcttc

SEQ ID NO: 6357 - DNA, 20 bp, Artificial Sequence
  Synthetic Construct
gagcccccattgctgtgaat

SEQ ID NO: 6358 - DNA, 21 bp, Artificial Sequence
  Synthetic Construct
agactctggggctctccactt

SEQ ID NO: 6359 - DNA, 20 bp, Artificial Sequence
  Synthetic Construct
cgatggcaggtgcttcagaa

SEQ ID NO: 6360 - DNA, 24 bp, Artificial Sequence
  Synthetic Construct
gactggcaagactgttcacttctg

SEQ ID NO: 6361 - DNA, 20 bp, Artificial Sequence
  Synthetic Construct
ctctccctccctgactgaca

SEQ ID NO: 6362 - DNA, 22 bp, Artificial Sequence
  Synthetic Construct
ggtagcttggggtagcaatgga

SEQ ID NO: 6363 - DNA, 24 bp, Artificial Sequence
  Synthetic Construct
tcctctcaccccctctgataaaag

SEQ ID NO: 6364 - DNA, 25 bp, Artificial Sequence
  Synthetic Construct
gtggtagatttccacgggtcatttg

SEQ ID NO: 6365 - DNA, 20 bp, Artificial Sequence
  Synthetic Construct
agccagcagaagcctccaaa

SEQ ID NO: 6366 - DNA, 22 bp, Artificial Sequence
  Synthetic Construct
tctgaccctcggcaaaaatctg

SEQ ID NO: 6367 - DNA, 25 bp, Artificial Sequence
  Synthetic Construct
cactgaagcaggtaagtgtgaacag

SEQ ID NO: 6368 - DNA, 21 bp, Artificial Sequence
  Synthetic Construct
ccccagcataatgagggtgtt

SEQ ID NO: 6369 - DNA, 18 bp, Artificial Sequence
  Synthetic Construct
agccccgggacagacact

SEQ ID NO: 6370 - DNA, 27 bp, Artificial Sequence
  Synthetic Construct
gaacagtttatgggaatagacgatgtc

SEQ ID NO: 6371 - DNA, 29 bp, Artificial Sequence
  Synthetic Construct
gaaccggaaatatgtaggattatgattgc

SEQ ID NO: 6372 - DNA, 23 bp, Artificial Sequence
  Synthetic Construct
agccgagaatctcagaggatcca

SEQ ID NO: 6373 - DNA, 24 bp, Artificial Sequence
  Synthetic Construct
ctggtcaacgtagtgaggtacaga

SEQ ID NO: 6374 - DNA, 24 bp, Artificial Sequence
  Synthetic Construct
gctagaattcacaggacacagaga

SEQ ID NO: 6375 - DNA, 23 bp, Artificial Sequence
  Synthetic Construct
tctcctccctaaccccctctcaa

SEQ ID NO: 6376 - DNA, 22 bp, Artificial Sequence
  Synthetic Construct
ggagtccaagctccactactca

SEQ ID NO: 6377 - DNA, 25 bp, Artificial Sequence
  Synthetic Construct
ccaccagcaattctcgatgataagg

SEQ ID NO: 6378 - DNA, 21 bp, Artificial Sequence
  Synthetic Construct
tcaggcttccactgcatcttc

SEQ ID NO: 6379 - DNA, 18 bp, Artificial Sequence
  Synthetic Construct
tggctcgcagggtcaaag

SEQ ID NO: 6380 - DNA, 21 bp, Artificial Sequence
  Synthetic Construct
cagaggaagggggcttctctt

SEQ ID NO: 6381 - DNA, 20 bp, Artificial Sequence
  Synthetic Construct
ccagcctcgtggagttttgt

SEQ ID NO: 6382 - DNA, 19 bp, Artificial Sequence
  Synthetic Construct
aggtgggaggcaggaagaa

SEQ ID NO: 6383 - DNA, 25 bp, Artificial Sequence
  Synthetic Construct
agagactcagagagaaactgttcca

SEQ ID NO: 6384 - DNA, 20 bp, Artificial Sequence
  Synthetic Construct
agccggttgttcctctctga

SEQ ID NO: 6385 - DNA, 20 bp, Artificial Sequence
  Synthetic Construct
agcagctcctccaaccttga

SEQ ID NO: 6386 - DNA, 22 bp, Artificial Sequence
  Synthetic Construct
ccaaggctttgtgtccccaaaa

SEQ ID NO: 6387 - DNA, 24 bp, Artificial Sequence
  Synthetic Construct
acctagctatccttccagcatttc

SEQ ID NO: 6388 - DNA, 25 bp, Artificial Sequence
  Synthetic Construct
catcttgtgaaatgccagcattacc

SEQ ID NO: 6389 - DNA, 24 bp, Artificial Sequence
  Synthetic Construct
aagggatgaaagcaatgcattgag

SEQ ID NO: 6390 - DNA, 23 bp, Artificial Sequence
  Synthetic Construct
ggctgtcagtgttcaatctgagt

SEQ ID NO: 6391 - DNA, 23 bp, Artificial Sequence
  Synthetic Construct
cccagaaacacagagtcattgca

SEQ ID NO: 6392 - DNA, 24 bp, Artificial Sequence
  Synthetic Construct
ccatgttacccaagctggaatcct

SEQ ID NO: 6393 - DNA, 18 bp, Artificial Sequence
  Synthetic Construct
ccgtgcccggccattaga

SEQ ID NO: 6394 - DNA, 24 bp, Artificial Sequence
  Synthetic Construct
tggactactacatgtccagaagga

SEQ ID NO: 6395 - DNA, 26 bp, Artificial Sequence
  Synthetic Construct
gccatttaggtaaacacctgggttgt

SEQ ID NO: 6396 - DNA, 25 bp, Artificial Sequence
  Synthetic Construct
ctcaatagtgagggtgggatctaac

SEQ ID NO: 6397 - DNA, 19 bp, Artificial Sequence
  Synthetic Construct
accgtggtggcagcttgat

SEQ ID NO: 6398 - DNA, 25 bp, Artificial Sequence
  Synthetic Construct
caactcctgcttgtttttcctttgg

SEQ ID NO: 6399 - DNA, 24 bp, Artificial Sequence
  Synthetic Construct
gagaaaacatccagtgcagaggaa

SEQ ID NO: 6400 - DNA, 20 bp, Artificial Sequence
  Synthetic Construct
tgccaggaagggagtggatt

SEQ ID NO: 6401 - DNA, 24 bp, Artificial Sequence
  Synthetic Construct
cgtagccccagtggtagcaattaa

SEQ ID NO: 6402 - DNA, 20 bp, Artificial Sequence
  Synthetic Construct
accccaccctctcacaatgt

SEQ ID NO: 6403 - DNA, 22 bp, Artificial Sequence
  Synthetic Construct
gccacctagggaaacaagaaca

SEQ ID NO: 6404 - DNA, 24 bp, Artificial Sequence
  Synthetic Construct
gggagagaaaactgggttctgagt

SEQ ID NO: 6405 - DNA, 18 bp, Artificial Sequence
  Synthetic Construct
cagaagccctgcctgcat

SEQ ID NO: 6406 - DNA, 22 bp, Artificial Sequence
  Synthetic Construct
gagttccagttctggccctttt

SEQ ID NO: 6407 - DNA, 21 bp, Artificial Sequence
  Synthetic Construct
ggacacaagcttgctgaagga

SEQ ID NO: 6408 - DNA, 20 bp, Artificial Sequence
  Synthetic Construct
tgtgttccagagcagttgca

SEQ ID NO: 6409 - DNA, 21 bp, Artificial Sequence
  Synthetic Construct
ggccatagtctcatgcagtgt

SEQ ID NO: 6410 - DNA, 19 bp, Artificial Sequence
  Synthetic Construct
agcagtcacggaaggcaaa

SEQ ID NO: 6411 - DNA, 23 bp, Artificial Sequence
  Synthetic Construct
gctgagttttgagtgcgatatgc

SEQ ID NO: 6412 - DNA, 25 bp, Artificial Sequence
  Synthetic Construct
gcccatagtacactctcactttctg

SEQ ID NO: 6413 - DNA, 24 bp, Artificial Sequence
  Synthetic Construct
cagacgggaagatgggttttgatg

SEQ ID NO: 6414 - DNA, 24 bp, Artificial Sequence
  Synthetic Construct
gggaaaggagaatgttcccagtga

SEQ ID NO: 6415 - DNA, 22 bp, Artificial Sequence
  Synthetic Construct
ctggccataagacacagaagct

SEQ ID NO: 6416 - DNA, 24 bp, Artificial Sequence
  Synthetic Construct
ggaggggatcagtagtgcagataa

SEQ ID NO: 6417 - DNA, 22 bp, Artificial Sequence
  Synthetic Construct
gcgacagagtgagactgagaca

SEQ ID NO: 6418 - DNA, 24 bp, Artificial Sequence
  Synthetic Construct
catcaatggcaaatagcagttgca

SEQ ID NO: 6419 - DNA, 24 bp, Artificial Sequence
  Synthetic Construct
gggaatttaaggagcccgagtgat

SEQ ID NO: 6420 - DNA, 20 bp, Artificial Sequence
  Synthetic Construct
tggaaacccagccaaagtgt

SEQ ID NO: 6421 - DNA, 22 bp, Artificial Sequence
  Synthetic Construct
cagcttccttcaccatgacctt

SEQ ID NO: 6422 - DNA, 23 bp, Artificial Sequence
  Synthetic Construct
gcctatgccaatttgatgccaaa

SEQ ID NO: 6423 - DNA, 27 bp, Artificial Sequence
  Synthetic Construct
ggcaaaggaggatgacaaataggtatt

SEQ ID NO: 6424 - DNA, 19 bp, Artificial Sequence
  Synthetic Construct
agagctgctggcctatgct

SEQ ID NO: 6425 - DNA, 25 bp, Artificial Sequence
  Synthetic Construct
agtggcagaagtgtggatatattgt

SEQ ID NO: 6426 - DNA, 21 bp, Artificial Sequence
  Synthetic Construct
gccttggatggctgagtactg

SEQ ID NO: 6427 - DNA, 24 bp, Artificial Sequence
  Synthetic Construct
gctcagggcttatgagttgtctgt

SEQ ID NO: 6428 - DNA, 26 bp, Artificial Sequence
  Synthetic Construct
ggaggccagaacattttagaggtttg

SEQ ID NO: 6429 - DNA, 20 bp, Artificial Sequence
  Synthetic Construct
gctgggcaggaaggtaccat

SEQ ID NO: 6430 - DNA, 23 bp, Artificial Sequence
  Synthetic Construct
gaggactgaatgaatcggaacca

SEQ ID NO: 6431 - DNA, 19 bp, Artificial Sequence
  Synthetic Construct
cctgctggtgcctgtactg

SEQ ID NO: 6432 - DNA, 20 bp, Artificial Sequence
  Synthetic Construct
gggcctgtggttccagtgat

SEQ ID NO: 6433 - DNA, 20 bp, Artificial Sequence
  Synthetic Construct
tgtttgcaggctgcttggtt

SEQ ID NO: 6434 - DNA, 22 bp, Artificial Sequence
  Synthetic Construct
ggcttcccaaggtcacatctaa

SEQ ID NO: 6435 - DNA, 21 bp, Artificial Sequence
  Synthetic Construct
ctgcctgtgccaatcatcaag

SEQ ID NO: 6436 - DNA, 26 bp, Artificial Sequence
  Synthetic Construct
cactctagtgaaccaagagtgaaggt

SEQ ID NO: 6437 - DNA, 20 bp, Artificial Sequence
  Synthetic Construct
tgagcatccactcccacact

SEQ ID NO: 6438 - DNA, 18 bp, Artificial Sequence
  Synthetic Construct
acgcagctctggggtaca

SEQ ID NO: 6439 - DNA, 27 bp, Artificial Sequence
  Synthetic Construct
cagtgcctgataaagtaagcagtatgg

SEQ ID NO: 6440 - DNA, 20 bp, Artificial Sequence
  Synthetic Construct
atgttgcggtcaccttctgt

SEQ ID NO: 6441 - DNA, 21 bp, Artificial Sequence
  Synthetic Construct
acgggccaagatgctttcagt

SEQ ID NO: 6442 - DNA, 22 bp, Artificial Sequence
  Synthetic Construct
aacttccagcctccactaggaa

SEQ ID NO: 6443 - DNA, 20 bp, Artificial Sequence
  Synthetic Construct
agggcagcgcatgtaagatg

SEQ ID NO: 6444 - DNA, 20 bp, Artificial Sequence
  Synthetic Construct
caccccttcgtgaagcatga

SEQ ID NO: 6445 - DNA, 28 bp, Artificial Sequence
  Synthetic Construct
cccatcatcatataaatctaggcagtct

SEQ ID NO: 6446 - DNA, 23 bp, Artificial Sequence
  Synthetic Construct
catcgatccagagaaccccatag

SEQ ID NO: 6447 - DNA, 22 bp, Artificial Sequence
  Synthetic Construct
cacgtgtttgtcagctccagaa

SEQ ID NO: 6448 - DNA, 26 bp, Artificial Sequence
  Synthetic Construct
caacttcatagtagggagggattctg

SEQ ID NO: 6449 - DNA, 25 bp, Artificial Sequence
  Synthetic Construct
aattctacgagacaacaacccatct

SEQ ID NO: 6450 - DNA, 22 bp, Artificial Sequence
  Synthetic Construct
ctgcagcgaaactggtatccaa

SEQ ID NO: 6451 - DNA, 29 bp, Artificial Sequence
  Synthetic Construct
caccatacttacatgtcatatgccattgt

SEQ ID NO: 6452 - DNA, 28 bp, Artificial Sequence
  Synthetic Construct
gcctctgaattaattcctggcataactc

SEQ ID NO: 6453 - DNA, 22 bp, Artificial Sequence
  Synthetic Construct
tggtatgtcactggtggctttt

SEQ ID NO: 6454 - DNA, 25 bp, Artificial Sequence
  Synthetic Construct
gagtgatgacaacttgctgtttacc

SEQ ID NO: 6455 - DNA, 24 bp, Artificial Sequence
  Synthetic Construct
gccagaggactcgttctctttgtt

SEQ ID NO: 6456 - DNA, 20 bp, Artificial Sequence
  Synthetic Construct
tggaaagaggggtgccaaac

SEQ ID NO: 6457 - DNA, 22 bp, Artificial Sequence
  Synthetic Construct
gccaatgagatcctgcagactt

SEQ ID NO: 6458 - DNA, 27 bp, Artificial Sequence
  Synthetic Construct
gcagtcaatagatatcccgctgttagg

SEQ ID NO: 6459 - DNA, 20 bp, Artificial Sequence
  Synthetic Construct
cactccacctgcacctgaag

SEQ ID NO: 6460 - DNA, 25 bp, Artificial Sequence
  Synthetic Construct
cttccaattgtacagaggggaaaca

SEQ ID NO: 6461 - DNA, 20 bp, Artificial Sequence
  Synthetic Construct
cacgggcaggacagatcaaa

SEQ ID NO: 6462 - DNA, 27 bp, Artificial Sequence
  Synthetic Construct
gacttctgctaaacttgacttgactca

SEQ ID NO: 6463 - DNA, 21 bp, Artificial Sequence
  Synthetic Construct
tcctgggccagttcaatgcat

SEQ ID NO: 6464 - DNA, 21 bp, Artificial Sequence
  Synthetic Construct
gctcccaagccatcactatcc

SEQ ID NO: 6465 - DNA, 22 bp, Artificial Sequence
  Synthetic Construct
gtgtgtcaggtaggcattgcat

SEQ ID NO: 6466 - DNA, 26 bp, Artificial Sequence
  Synthetic Construct
ggtgtatcttgcaaaatcgaccatca

SEQ ID NO: 6467 - DNA, 20 bp, Artificial Sequence
  Synthetic Construct
gtggagggcctaggcaaaat

SEQ ID NO: 6468 - DNA, 26 bp, Artificial Sequence
  Synthetic Construct
ctgaggagtcaggcatagatctacac

SEQ ID NO: 6469 - DNA, 29 bp, Artificial Sequence
  Synthetic Construct
ggatgcaatgagaaagaactaatggtttg

SEQ ID NO: 6470 - DNA, 22 bp, Artificial Sequence
  Synthetic Construct
tgcagtagtggttggagtcaac

SEQ ID NO: 6471 - DNA, 23 bp, Artificial Sequence
  Synthetic Construct
caaagatgcctcccttctcaaga

SEQ ID NO: 6472 - DNA, 27 bp, Artificial Sequence
  Synthetic Construct
ggacatattttgagggtggaacaaacc

SEQ ID NO: 6473 - DNA, 22 bp, Artificial Sequence
  Synthetic Construct
tccaaagtgctgtgctcttcct

SEQ ID NO: 6474 - DNA, 22 bp, Artificial Sequence
  Synthetic Construct
cccattcactcccctcttctga

SEQ ID NO: 6475 - DNA, 23 bp, Artificial Sequence
  Synthetic Construct
caacacagagtaggggttcagtt

SEQ ID NO: 6476 - DNA, 22 bp, Artificial Sequence
  Synthetic Construct
acagcttctgcagggaggttta

SEQ ID NO: 6477 - DNA, 27 bp, Artificial Sequence
  Synthetic Construct
gaggagctaacaattctctagttcaca

SEQ ID NO: 6478 - DNA, 20 bp, Artificial Sequence
  Synthetic Construct
tgtcacggctccatcacagt

SEQ ID NO: 6479 - DNA, 28 bp, Artificial Sequence
  Synthetic Construct
cacactctgcaagctaataaatattcct

SEQ ID NO: 6480 - DNA, 20 bp, Artificial Sequence
  Synthetic Construct
agagccctggagcagacaga

SEQ ID NO: 6481 - DNA, 22 bp, Artificial Sequence
  Synthetic Construct
ggtgggcagagagggtcattta

SEQ ID NO: 6482 - DNA, 26 bp, Artificial Sequence
  Synthetic Construct
cagaaacttgcaatgagttgatctgt

SEQ ID NO: 6483 - DNA, 23 bp, Artificial Sequence
  Synthetic Construct
gagatcgtactgagcctgacaaa

SEQ ID NO: 6484 - DNA, 21 bp, Artificial Sequence
  Synthetic Construct
gcctatgacccaggaccatgt

SEQ ID NO: 6485 - DNA, 23 bp, Artificial Sequence
  Synthetic Construct
acagaactgaggcatggtctttt

SEQ ID NO: 6486 - DNA, 20 bp, Artificial Sequence
  Synthetic Construct
tgacaggtggccttcactca

SEQ ID NO: 6487 - DNA, 27 bp, Artificial Sequence
  Synthetic Construct
aaaactcagctatctttgttcccaaaa

SEQ ID NO: 6488 - DNA, 22 bp, Artificial Sequence
  Synthetic Construct
ctgcttccagttgcttccaagt

SEQ ID NO: 6489 - DNA, 23 bp, Artificial Sequence
  Synthetic Construct
caagaggaaagtgcagtcactga

SEQ ID NO: 6490 - DNA, 22 bp, Artificial Sequence
  Synthetic Construct
tggaacagggtagacagttggt

SEQ ID NO: 6491 - DNA, 22 bp, Artificial Sequence
  Synthetic Construct
ggtcaggaaattgggagtggtt

SEQ ID NO: 6492 - DNA, 30 bp, Artificial Sequence
  Synthetic Construct
ggtgtttgcattaatggaagataggaaacc

SEQ ID NO: 6493 - DNA, 24 bp, Artificial Sequence
  Synthetic Construct
tgatggcagcatattcttcctgtt

SEQ ID NO: 6494 - DNA, 23 bp, Artificial Sequence
  Synthetic Construct
acacctcaaattccacaggacaa

SEQ ID NO: 6495 - DNA, 28 bp, Artificial Sequence
  Synthetic Construct
ccactaaatagtcttcgaaaaccagaag

SEQ ID NO: 6496 - DNA, 20 bp, Artificial Sequence
  Synthetic Construct
tcttgtggcagaagcatcgt

SEQ ID NO: 6497 - DNA, 24 bp, Artificial Sequence
  Synthetic Construct
ggtcacaccagactggaattcagt

SEQ ID NO: 6498 - DNA, 21 bp, Artificial Sequence
  Synthetic Construct
aggttttagcctggcctggta

SEQ ID NO: 6499 - DNA, 22 bp, Artificial Sequence
  Synthetic Construct
agcttacctggggaaggatgct

SEQ ID NO: 6500 - DNA, 21 bp, Artificial Sequence
  Synthetic Construct
tgaggaatgggcatggaagtc

SEQ ID NO: 6501 - DNA, 23 bp, Artificial Sequence
  Synthetic Construct
agcagaggagggaagagtgtgtt

SEQ ID NO: 6502 - DNA, 25 bp, Artificial Sequence
  Synthetic Construct
cacacacacctcatagttccatcct

SEQ ID NO: 6503 - DNA, 23 bp, Artificial Sequence
  Synthetic Construct
gaatgctgtgcatctctgtacac

SEQ ID NO: 6504 - DNA, 20 bp, Artificial Sequence
  Synthetic Construct
aacacccaggctgagaagca

SEQ ID NO: 6505 - DNA, 25 bp, Artificial Sequence
  Synthetic Construct
ctaccctctcttagccctagtaagt

SEQ ID NO: 6506 - DNA, 24 bp, Artificial Sequence
  Synthetic Construct
ccccgattcagagagggaacagat

SEQ ID NO: 6507 - DNA, 25 bp, Artificial Sequence
  Synthetic Construct
ggactgttggccttattttctcact

SEQ ID NO: 6508 - DNA, 24 bp, Artificial Sequence
  Synthetic Construct
gccaattagcttcgagcatttcac

SEQ ID NO: 6509 - DNA, 21 bp, Artificial Sequence
  Synthetic Construct
gcagcaggggttcatgactga

SEQ ID NO: 6510 - DNA, 22 bp, Artificial Sequence
  Synthetic Construct
gggatcagccacactgtacaat

SEQ ID NO: 6511 - DNA, 20 bp, Artificial Sequence
  Synthetic Construct
cacaggagctgcccctcttg

SEQ ID NO: 6512 - DNA, 23 bp, Artificial Sequence
  Synthetic Construct
agggaggcagagctacagagatt

SEQ ID NO: 6513 - DNA, 24 bp, Artificial Sequence
  Synthetic Construct
cctctcgactactctcagctttgt

SEQ ID NO: 6514 - DNA, 19 bp, Artificial Sequence
  Synthetic Construct
ctccccaggaacccacaga

SEQ ID NO: 6515 - DNA, 24 bp, Artificial Sequence
  Synthetic Construct
ggcttgtcatcgaagtggaaatgg

SEQ ID NO: 6516 - DNA, 26 bp, Artificial Sequence
  Synthetic Construct
ggaacaactgaggagactacttggat

SEQ ID NO: 6517 - DNA, 23 bp, Artificial Sequence
  Synthetic Construct
cagagtgctacgtctttggaaga

SEQ ID NO: 6518 - DNA, 25 bp, Artificial Sequence
  Synthetic Construct
ccactgaaagatgtcaggctaaact

SEQ ID NO: 6519 - DNA, 24 bp, Artificial Sequence
  Synthetic Construct
tctgcctccatctgttagcttacc

SEQ ID NO: 6520 - DNA, 26 bp, Artificial Sequence
  Synthetic Construct
gcctccgatgagcttatcatagcatt

SEQ ID NO: 6521 - DNA, 21 bp, Artificial Sequence
  Synthetic Construct
tgcacctcctcctgcttcaat

SEQ ID NO: 6522 - DNA, 19 bp, Artificial Sequence
  Synthetic Construct
tcaccacggccacctgtct

SEQ ID NO: 6523 - DNA, 24 bp, Artificial Sequence
  Synthetic Construct
gacatggccctttgatcactcaaa

SEQ ID NO: 6524 - DNA, 21 bp, Artificial Sequence
  Synthetic Construct
tggctgggagcttagaaacag

SEQ ID NO: 6525 - DNA, 24 bp, Artificial Sequence
  Synthetic Construct
ggtgagtctgaggcaaaacttcat

SEQ ID NO: 6526 - DNA, 23 bp, Artificial Sequence
  Synthetic Construct
cactgagtatgtgccttggtcaa

SEQ ID NO: 6527 - DNA, 23 bp, Artificial Sequence
  Synthetic Construct
cccaggtttgtggtagggtagaa

SEQ ID NO: 6528 - DNA, 27 bp, Artificial Sequence
  Synthetic Construct
ggtgagctttagggaggaaagatagag

SEQ ID NO: 6529 - DNA, 23 bp, Artificial Sequence
  Synthetic Construct
tcagatgccaaatgtagcaccat

SEQ ID NO: 6530 - DNA, 20 bp, Artificial Sequence
  Synthetic Construct
gcagccatgccatcgttagg

SEQ ID NO: 6531 - DNA, 22 bp, Artificial Sequence
  Synthetic Construct
gtaacagaccctcctcccagat

SEQ ID NO: 6532 - DNA, 21 bp, Artificial Sequence
  Synthetic Construct
tgtgcattggcccttactgat

SEQ ID NO: 6533 - DNA, 21 bp, Artificial Sequence
  Synthetic Construct
aagcagccctgattcccatga

SEQ ID NO: 6534 - DNA, 22 bp, Artificial Sequence
  Synthetic Construct
gcctctggtaggagaagccaaa

SEQ ID NO: 6535 - DNA, 26 bp, Artificial Sequence
  Synthetic Construct
gggatttctctgtggctaagcttctg

SEQ ID NO: 6536 - DNA, 23 bp, Artificial Sequence
  Synthetic Construct
cttcccaagcaacccgggactat

SEQ ID NO: 6537 - DNA, 22 bp, Artificial Sequence
  Synthetic Construct
atgctctggctactgctattgg

SEQ ID NO: 6538 - DNA, 22 bp, Artificial Sequence
  Synthetic Construct
aggacaggccaggggtagataa

SEQ ID NO: 6539 - DNA, 22 bp, Artificial Sequence
  Synthetic Construct
acagaatgctgctctccatcca

SEQ ID NO: 6540 - DNA, 23 bp, Artificial Sequence
  Synthetic Construct
gttttggttgtgcaagggtagga

SEQ ID NO: 6541 - DNA, 23 bp, Artificial Sequence
  Synthetic Construct
cctagctccaggatacctcaaca

SEQ ID NO: 6542 - DNA, 21 bp, Artificial Sequence
  Synthetic Construct
gctgtctgtgggagagagaga

SEQ ID NO: 6543 - DNA, 23 bp, Artificial Sequence
  Synthetic Construct
caaatgattttggccccacttct

SEQ ID NO: 6544 - DNA, 25 bp, Artificial Sequence
  Synthetic Construct
ggccaatgactaaagtgtgggaaac

SEQ ID NO: 6545 - DNA, 26 bp, Artificial Sequence
  Synthetic Construct
ggagttagagtgagaacaggaagcaa

SEQ ID NO: 6546 - DNA, 25 bp, Artificial Sequence
  Synthetic Construct
gcagtgaggtataatggcaccatta

SEQ ID NO: 6547 - DNA, 22 bp, Artificial Sequence
  Synthetic Construct
tgagccaagacgagaaccaaac

SEQ ID NO: 6548 - DNA, 21 bp, Artificial Sequence
  Synthetic Construct
cctgccccctgagttcctagt

SEQ ID NO: 6549 - DNA, 26 bp, Artificial Sequence
  Synthetic Construct
ggctctgaggaatcgtgactatgttg

SEQ ID NO: 6550 - DNA, 24 bp, Artificial Sequence
  Synthetic Construct
agaaggctgtacctcctactctag

SEQ ID NO: 6551 - DNA, 27 bp, Artificial Sequence
  Synthetic Construct
gggacagttcttccgactcttacattc

SEQ ID NO: 6552 - DNA, 27 bp, Artificial Sequence
  Synthetic Construct
agttaactacaaacactgagcagtttg

SEQ ID NO: 6553 - DNA, 25 bp, Artificial Sequence
  Synthetic Construct
ccaggattactgcatatcccaagtg

SEQ ID NO: 6554 - DNA, 19 bp, Artificial Sequence
  Synthetic Construct
tgctgtcagtccccaaagc

SEQ ID NO: 6555 - DNA, 22 bp, Artificial Sequence
  Synthetic Construct
gaattctgctggggaggagaaa

SEQ ID NO: 6556 - DNA, 25 bp, Artificial Sequence
  Synthetic Construct
gggagagttgtactgtttccaggtt

SEQ ID NO: 6557 - DNA, 21 bp, Artificial Sequence
  Synthetic Construct
tcatggcctcagcacagtgaa

SEQ ID NO: 6558 - DNA, 25 bp, Artificial Sequence
  Synthetic Construct
agagacaagttgacaagttggatca

SEQ ID NO: 6559 - DNA, 24 bp, Artificial Sequence
  Synthetic Construct
tccacaacgtctcagtctgagtct

SEQ ID NO: 6560 - DNA, 20 bp, Artificial Sequence
  Synthetic Construct
gtggccagtttgcaacatgt

SEQ ID NO: 6561 - DNA, 22 bp, Artificial Sequence
  Synthetic Construct
ccatggccatcctctactgaga

SEQ ID NO: 6562 - DNA, 22 bp, Artificial Sequence
  Synthetic Construct
gccacttagtgaagccttttgc

SEQ ID NO: 6563 - DNA, 25 bp, Artificial Sequence
  Synthetic Construct
agtgacttgtctacttgccttttca

SEQ ID NO: 6564 - DNA, 22 bp, Artificial Sequence
  Synthetic Construct
gatggggaaacaagcacagact

SEQ ID NO: 6565 - DNA, 22 bp, Artificial Sequence
  Synthetic Construct
cgtggccttagaggatcacaga

SEQ ID NO: 6566 - DNA, 19 bp, Artificial Sequence
  Synthetic Construct
ccagggtccactcccatct

SEQ ID NO: 6567 - DNA, 24 bp, Artificial Sequence
  Synthetic Construct
gagcaactggcagagtatgacaag

SEQ ID NO: 6568 - DNA, 24 bp, Artificial Sequence
  Synthetic Construct
gcaagatgaaagatgtggcattgt

SEQ ID NO: 6569 - DNA, 24 bp, Artificial Sequence
  Synthetic Construct
gtcctaaagcactgcaagtagttc

SEQ ID NO: 6570 - DNA, 23 bp, Artificial Sequence
  Synthetic Construct
gggatacagtttggggaacagtt

SEQ ID NO: 6571 - DNA, 20 bp, Artificial Sequence
  Synthetic Construct
gcctgaaagaccgagctcaa

SEQ ID NO: 6572 - DNA, 21 bp, Artificial Sequence
  Synthetic Construct
ccggccttgtccccaatttta

SEQ ID NO: 6573 - DNA, 21 bp, Artificial Sequence
  Synthetic Construct
tgcagtcttcagtcccttcgt

SEQ ID NO: 6574 - DNA, 22 bp, Artificial Sequence
  Synthetic Construct
gcacagggtgacaatcacttct

SEQ ID NO: 6575 - DNA, 24 bp, Artificial Sequence
  Synthetic Construct
accttcctcttcccaagtctcgtt

SEQ ID NO: 6576 - DNA, 22 bp, Artificial Sequence
  Synthetic Construct
tttgggggaagttttggtggaa

SEQ ID NO: 6577 - DNA, 22 bp, Artificial Sequence
  Synthetic Construct
gctgagcagggacatcttttga

SEQ ID NO: 6578 - DNA, 22 bp, Artificial Sequence
  Synthetic Construct
gccccctctgaggcttatttcc

SEQ ID NO: 6579 - DNA, 24 bp, Artificial Sequence
  Synthetic Construct
gagggattgtggatctgcttgatg

SEQ ID NO: 6580 - DNA, 21 bp, Artificial Sequence
  Synthetic Construct
cgaggggtgatgaaggattgg

SEQ ID NO: 6581 - DNA, 28 bp, Artificial Sequence
  Synthetic Construct
ccttgtcctacaattagaggcaaaattg

SEQ ID NO: 6582 - DNA, 24 bp, Artificial Sequence
  Synthetic Construct
ggtccttcaacatgaggagctttc

SEQ ID NO: 6583 - DNA, 22 bp, Artificial Sequence
  Synthetic Construct
aaggggtccaggtgacataacg

SEQ ID NO: 6584 - DNA, 21 bp, Artificial Sequence
  Synthetic Construct
tccatctcaggggcagatcca

SEQ ID NO: 6585 - DNA, 20 bp, Artificial Sequence
  Synthetic Construct
tgcccgggagcaaaatcagt

SEQ ID NO: 6586 - DNA, 24 bp, Artificial Sequence
  Synthetic Construct
tcaggggagtatgatggagagcta

SEQ ID NO: 6587 - DNA, 27 bp, Artificial Sequence
  Synthetic Construct
gctaaaaccaataactacggtcaagtc

SEQ ID NO: 6588 - DNA, 21 bp, Artificial Sequence
  Synthetic Construct
agatggggccactgtattgct

SEQ ID NO: 6589 - DNA, 25 bp, Artificial Sequence
  Synthetic Construct
gagtgaatacattgagggccttgac

SEQ ID NO: 6590 - DNA, 24 bp, Artificial Sequence
  Synthetic Construct
cgctaagcatgatgccaggttttg

SEQ ID NO: 6591 - DNA, 20 bp, Artificial Sequence
  Synthetic Construct
catcagacagcctcgtgcat

SEQ ID NO: 6592 - DNA, 25 bp, Artificial Sequence
  Synthetic Construct
ccaagcagcttagctatagcattcc

SEQ ID NO: 6593 - DNA, 25 bp, Artificial Sequence
  Synthetic Construct
gtagcttccatccagttaacctcaa

SEQ ID NO: 6594 - DNA, 27 bp, Artificial Sequence
  Synthetic Construct
gaggaaatacaactggaatctggttga

SEQ ID NO: 6595 - DNA, 24 bp, Artificial Sequence
  Synthetic Construct
aggctccagttttgaggtgacaag

SEQ ID NO: 6596 - DNA, 27 bp, Artificial Sequence
  Synthetic Construct
ggtgagaagagagaagtaatggttcac

SEQ ID NO: 6597 - DNA, 24 bp, Artificial Sequence
  Synthetic Construct
ctgactagggtactgtctcctgat

SEQ ID NO: 6598 - DNA, 24 bp, Artificial Sequence
  Synthetic Construct
accaatcttgacctggggaaactg

SEQ ID NO: 6599 - DNA, 21 bp, Artificial Sequence
  Synthetic Construct
atggccagtaagggggctact

SEQ ID NO: 6600 - DNA, 23 bp, Artificial Sequence
  Synthetic Construct
accttctgcagagtcctggatgt

SEQ ID NO: 6601 - DNA, 24 bp, Artificial Sequence
  Synthetic Construct
agttggggaggtagatgtgtttcc

SEQ ID NO: 6602 - DNA, 24 bp, Artificial Sequence
  Synthetic Construct
ccatttacaccagggatcgagaca

SEQ ID NO: 6603 - DNA, 22 bp, Artificial Sequence
  Synthetic Construct
agtccgtccaggttcaaaagtg

SEQ ID NO: 6604 - DNA, 25 bp, Artificial Sequence
  Synthetic Construct
tctagtccttctgtttggagtttgg

SEQ ID NO: 6605 - DNA, 24 bp, Artificial Sequence
  Synthetic Construct
agacatcagttccttgaagctgaa

SEQ ID NO: 6606 - DNA, 23 bp, Artificial Sequence
  Synthetic Construct
tgcagatgtctaggctccactca

SEQ ID NO: 6607 - DNA, 27 bp, Artificial Sequence
  Synthetic Construct
aaagtattgtagccatggagagatcaa

SEQ ID NO: 6608 - DNA, 20 bp, Artificial Sequence
  Synthetic Construct
atgggttctgggctgacaga

SEQ ID NO: 6609 - DNA, 22 bp, Artificial Sequence
  Synthetic Construct
gccttggcctcaatatgagctt

SEQ ID NO: 6610 - DNA, 21 bp, Artificial Sequence
  Synthetic Construct
agcaggtgaggactgaggatt

SEQ ID NO: 6611 - DNA, 21 bp, Artificial Sequence
  Synthetic Construct
gtggagaaggtaggcctgact

SEQ ID NO: 6612 - DNA, 23 bp, Artificial Sequence
  Synthetic Construct
gccatcccatctgagatgctaga

SEQ ID NO: 6613 - DNA, 29 bp, Artificial Sequence
  Synthetic Construct
cacagtagatactaactggtcttactgtt

SEQ ID NO: 6614 - DNA, 22 bp, Artificial Sequence
  Synthetic Construct
ttctgggacgccagcagaactt

SEQ ID NO: 6615 - DNA, 26 bp, Artificial Sequence
  Synthetic Construct
gaaaaatcaatccctccttccatgag

SEQ ID NO: 6616 - DNA, 26 bp, Artificial Sequence
  Synthetic Construct
cgtcacatcgtttatgctaacagtct

SEQ ID NO: 6617 - DNA, 23 bp, Artificial Sequence
  Synthetic Construct
aacttcgtgggatccctcttctg

SEQ ID NO: 6618 - DNA, 26 bp, Artificial Sequence
  Synthetic Construct
tgacaatttttggcactagagacact

SEQ ID NO: 6619 - DNA, 22 bp, Artificial Sequence
  Synthetic Construct
tcattcctggacccagctttct

SEQ ID NO: 6620 - DNA, 26 bp, Artificial Sequence
  Synthetic Construct
ggtacttcctgaacatcactctgtac

SEQ ID NO: 6621 - DNA, 22 bp, Artificial Sequence
  Synthetic Construct
gtgggctttggtgtgtaattgg

SEQ ID NO: 6622 - DNA, 19 bp, Artificial Sequence
  Synthetic Construct
ccagcgtggctccgagcaa

SEQ ID NO: 6623 - DNA, 24 bp, Artificial Sequence
  Synthetic Construct
ggaaatctcagtagggcattttgc

SEQ ID NO: 6624 - DNA, 22 bp, Artificial Sequence
  Synthetic Construct
acactatgtctcctgcctggaa

SEQ ID NO: 6625 - DNA, 26 bp, Artificial Sequence
  Synthetic Construct
cctacctactacacttctgtgcagtt

SEQ ID NO: 6626 - DNA, 21 bp, Artificial Sequence
  Synthetic Construct
agggacccattggtgaacagt

SEQ ID NO: 6627 - DNA, 22 bp, Artificial Sequence
  Synthetic Construct
tcctgtgcccaaaagacctaga

SEQ ID NO: 6628 - DNA, 22 bp, Artificial Sequence
  Synthetic Construct
ggtcacagccataacacagaca

SEQ ID NO: 6629 - DNA, 24 bp, Artificial Sequence
  Synthetic Construct
aggttcctgggagctgaatataca

SEQ ID NO: 6630 - DNA, 21 bp, Artificial Sequence
  Synthetic Construct
atgggggttatggtggcaaga

SEQ ID NO: 6631 - DNA, 23 bp, Artificial Sequence
  Synthetic Construct
tggatgtgttttgtgtccaccaa

SEQ ID NO: 6632 - DNA, 18 bp, Artificial Sequence
  Synthetic Construct
agcatggaggccgatgtg

SEQ ID NO: 6633 - DNA, 26 bp, Artificial Sequence
  Synthetic Construct
ccttcctgtcagatttacctgattgc

SEQ ID NO: 6634 - DNA, 24 bp, Artificial Sequence
  Synthetic Construct
aaaagcctgccctatagtcagtac

SEQ ID NO: 6635 - DNA, 25 bp, Artificial Sequence
  Synthetic Construct
agatatagactggctgctgtctaga

SEQ ID NO: 6636 - DNA, 24 bp, Artificial Sequence
  Synthetic Construct
gcctccacagcagtgattctcaaa

SEQ ID NO: 6637 - DNA, 26 bp, Artificial Sequence
  Synthetic Construct
cccactacccatctcattgcttaagc

SEQ ID NO: 6638 - DNA, 24 bp, Artificial Sequence
  Synthetic Construct
ggcaacggagtgattcagttctct

SEQ ID NO: 6639 - DNA, 27 bp, Artificial Sequence
  Synthetic Construct
gttttactcttacgtactgctgattgc

SEQ ID NO: 6640 - DNA, 22 bp, Artificial Sequence
  Synthetic Construct
agcagcaccacactgtagtagt

SEQ ID NO: 6641 - DNA, 22 bp, Artificial Sequence
  Synthetic Construct
gagagcctacgacaacattcca

SEQ ID NO: 6642 - DNA, 25 bp, Artificial Sequence
  Synthetic Construct
gctgataaaccggatacagctttcc

SEQ ID NO: 6643 - DNA, 24 bp, Artificial Sequence
  Synthetic Construct
cctggctctcctgtgtagcaaata

SEQ ID NO: 6644 - DNA, 20 bp, Artificial Sequence
  Synthetic Construct
tgccatcactgtggtgcatt

SEQ ID NO: 6645 - DNA, 21 bp, Artificial Sequence
  Synthetic Construct
tccgtgagtcagctaccatgt

SEQ ID NO: 6646 - DNA, 20 bp, Artificial Sequence
  Synthetic Construct
accccacgaccatgagtcaa

SEQ ID NO: 6647 - DNA, 18 bp, Artificial Sequence
  Synthetic Construct
aggggctgcgagcagttg

SEQ ID NO: 6648 - DNA, 22 bp, Artificial Sequence
  Synthetic Construct
tgaccaggtacccttgttcagt

SEQ ID NO: 6649 - DNA, 23 bp, Artificial Sequence
  Synthetic Construct
gacttggtaatcccactcccaaa

SEQ ID NO: 6650 - DNA, 22 bp, Artificial Sequence
  Synthetic Construct
agattggagttgccatcaagca

SEQ ID NO: 6651 - DNA, 24 bp, Artificial Sequence
  Synthetic Construct
tgtgttaccatggaatctcttgca

SEQ ID NO: 6652 - DNA, 28 bp, Artificial Sequence
  Synthetic Construct
gaatgaaacaagaaggtctaggcttttc

SEQ ID NO: 6653 - DNA, 20 bp, Artificial Sequence
  Synthetic Construct
tggccaggtcctcacagcat

SEQ ID NO: 6654 - DNA, 22 bp, Artificial Sequence
  Synthetic Construct
gatggcagctgagattctgtca

SEQ ID NO: 6655 - DNA, 21 bp, Artificial Sequence
  Synthetic Construct
aagtccgcacagagctttgga

SEQ ID NO: 6656 - DNA, 22 bp, Artificial Sequence
  Synthetic Construct
tcagagggcctgatctcaatgt

SEQ ID NO: 6657 - DNA, 24 bp, Artificial Sequence
  Synthetic Construct
gacccacagactgatacacttgtg

SEQ ID NO: 6658 - DNA, 18 bp, Artificial Sequence
  Synthetic Construct
ccaggacctggccatcct

SEQ ID NO: 6659 - DNA, 27 bp, Artificial Sequence
  Synthetic Construct
gggaaaaggaatgcttgatggaagttc

SEQ ID NO: 6660 - DNA, 21 bp, Artificial Sequence
  Synthetic Construct
ttgcgggaccagcatccaaat

SEQ ID NO: 6661 - DNA, 24 bp, Artificial Sequence
  Synthetic Construct
cacctccctggttgttggaaaatc

SEQ ID NO: 6662 - DNA, 20 bp, Artificial Sequence
  Synthetic Construct
tcaccagggtagggcaatgt

SEQ ID NO: 6663 - DNA, 25 bp, Artificial Sequence
  Synthetic Construct
ctgaagagatgacctaaagctcaca

SEQ ID NO: 6664 - DNA, 22 bp, Artificial Sequence
  Synthetic Construct
ggcagaatttagcaccggagta

SEQ ID NO: 6665 - DNA, 24 bp, Artificial Sequence
  Synthetic Construct
gaagaaatttggatggctcagctt

SEQ ID NO: 6666 - DNA, 22 bp, Artificial Sequence
  Synthetic Construct
ttggccgaccagagtatgaatc

SEQ ID NO: 6667 - DNA, 21 bp, Artificial Sequence
  Synthetic Construct
aggtggaggccatctgctttt

SEQ ID NO: 6668 - DNA, 25 bp, Artificial Sequence
  Synthetic Construct
cgttcagattgggagcaagaaagac

SEQ ID NO: 6669 - DNA, 25 bp, Artificial Sequence
  Synthetic Construct
gttgttggttgggttggtttattgg

SEQ ID NO: 6670 - DNA, 21 bp, Artificial Sequence
  Synthetic Construct
cagcctcctcacctttcactt

SEQ ID NO: 6671 - DNA, 28 bp, Artificial Sequence
  Synthetic Construct
gaactcacactgtaacacttttagtcaa

SEQ ID NO: 6672 - DNA, 22 bp, Artificial Sequence
  Synthetic Construct
gatatgggctgcaggaaacctt

SEQ ID NO: 6673 - DNA, 20 bp, Artificial Sequence
  Synthetic Construct
tcccccaacctctccttcca

SEQ ID NO: 6674 - DNA, 22 bp, Artificial Sequence
  Synthetic Construct
ttgggcttgagtgtggatagct

SEQ ID NO: 6675 - DNA, 20 bp, Artificial Sequence
  Synthetic Construct
cctcgctgtggcttatgaca

SEQ ID NO: 6676 - DNA, 22 bp, Artificial Sequence
  Synthetic Construct
gcacaggaaaaaggtggtttcc

SEQ ID NO: 6677 - DNA, 20 bp, Artificial Sequence
  Synthetic Construct
ggggctagggcaaaggaaaa

SEQ ID NO: 6678 - DNA, 19 bp, Artificial Sequence
  Synthetic Construct
gtggcctgaggtcatgctt

SEQ ID NO: 6679 - DNA, 25 bp, Artificial Sequence
  Synthetic Construct
tcactccactttacaggcacatatt

SEQ ID NO: 6680 - DNA, 24 bp, Artificial Sequence
  Synthetic Construct
gacctgtggattggctcaatttcc

SEQ ID NO: 6681 - DNA, 22 bp, Artificial Sequence
  Synthetic Construct
ccattgccacctgattctttgc

SEQ ID NO: 6682 - DNA, 22 bp, Artificial Sequence
  Synthetic Construct
ctcatcctgactgcctttgcta

SEQ ID NO: 6683 - DNA, 19 bp, Artificial Sequence
  Synthetic Construct
agtgctgtggcctcattgc

SEQ ID NO: 6684 - DNA, 26 bp, Artificial Sequence
  Synthetic Construct
catcagttcaaagcctagactctctt

SEQ ID NO: 6685 - DNA, 19 bp, Artificial Sequence
  Synthetic Construct
ccttctggcctggcccaaa

SEQ ID NO: 6686 - DNA, 24 bp, Artificial Sequence
  Synthetic Construct
tgttcccactttctttcccttctg

SEQ ID NO: 6687 - DNA, 24 bp, Artificial Sequence
  Synthetic Construct
ggaaaggagaatagcagtgaagga

SEQ ID NO: 6688 - DNA, 22 bp, Artificial Sequence
  Synthetic Construct
cctggaacaataggcccatgat

SEQ ID NO: 6689 - DNA, 22 bp, Artificial Sequence
  Synthetic Construct
aaggtagctggggcaagagtaa

SEQ ID NO: 6690 - DNA, 21 bp, Artificial Sequence
  Synthetic Construct
cagcaaagccagcagtagtca

SEQ ID NO: 6691 - DNA, 21 bp, Artificial Sequence
  Synthetic Construct
gactgtgtgcccattcactgt

SEQ ID NO: 6692 - DNA, 27 bp, Artificial Sequence
  Synthetic Construct
gttggtagaccttagagatcaatgagt

SEQ ID NO: 6693 - DNA, 26 bp, Artificial Sequence
  Synthetic Construct
ccctatcttccactgcctgttaactc

SEQ ID NO: 6694 - DNA, 22 bp, Artificial Sequence
  Synthetic Construct
gctgcttttgctcccctttgat

SEQ ID NO: 6695 - DNA, 30 bp, Artificial Sequence
  Synthetic Construct
aaatacatgtgttagataggcttctttcag

SEQ ID NO: 6696 - DNA, 21 bp, Artificial Sequence
  Synthetic Construct
gcaactgtgcccaatcatgct

SEQ ID NO: 6697 - DNA, 23 bp, Artificial Sequence
  Synthetic Construct
ggcttccttgtttttccctccaa

SEQ ID NO: 6698 - DNA, 19 bp, Artificial Sequence
  Synthetic Construct
aggccgcaccctcccacat

SEQ ID NO: 6699 - DNA, 24 bp, Artificial Sequence
  Synthetic Construct
ggttgccattgtgtccatttttga

SEQ ID NO: 6700 - DNA, 22 bp, Artificial Sequence
  Synthetic Construct
ctgctcagaagctgcctgattt

SEQ ID NO: 6701 - DNA, 21 bp, Artificial Sequence
  Synthetic Construct
ttgctccacaggacagaacag

SEQ ID NO: 6702 - DNA, 24 bp, Artificial Sequence
  Synthetic Construct
tgtcttctggacaggatggtcttc

SEQ ID NO: 6703 - DNA, 22 bp, Artificial Sequence
  Synthetic Construct
ttcccaggatgaccttgtgtga

SEQ ID NO: 6704 - DNA, 24 bp, Artificial Sequence
  Synthetic Construct
agtcttctttgggtggactttctg

SEQ ID NO: 6705 - DNA, 28 bp, Artificial Sequence
  Synthetic Construct
gtaaaatgattcaaaaggggttctgagt

SEQ ID NO: 6706 - DNA, 22 bp, Artificial Sequence
  Synthetic Construct
ctccagtgggggtgggtgtcat

SEQ ID NO: 6707 - DNA, 26 bp, Artificial Sequence
  Synthetic Construct
ctttagagcaaattccttcccattcc

SEQ ID NO: 6708 - DNA, 24 bp, Artificial Sequence
  Synthetic Construct
gcaggttaaatccctggtctcaag

SEQ ID NO: 6709 - DNA, 20 bp, Artificial Sequence
  Synthetic Construct
agcttgtgctcctcccaact

SEQ ID NO: 6710 - DNA, 22 bp, Artificial Sequence
  Synthetic Construct
gctccattctctctgcagacaa

SEQ ID NO: 6711 - DNA, 27 bp, Artificial Sequence
  Synthetic Construct
gctcttcaaatacgatctcctgtaagc

SEQ ID NO: 6712 - DNA, 24 bp, Artificial Sequence
  Synthetic Construct
acgcagctggagatgagagatagt

SEQ ID NO: 6713 - DNA, 22 bp, Artificial Sequence
  Synthetic Construct
gacttgttccctgtgtgaagca

SEQ ID NO: 6714 - DNA, 22 bp, Artificial Sequence
  Synthetic Construct
aatggcacagttgtccagagaa

SEQ ID NO: 6715 - DNA, 20 bp, Artificial Sequence
  Synthetic Construct
ctgcacctggaggactctga

SEQ ID NO: 6716 - DNA, 22 bp, Artificial Sequence
  Synthetic Construct
gtccacaagttcaagccaacag

SEQ ID NO: 6717 - DNA, 24 bp, Artificial Sequence
  Synthetic Construct
attcacatgacaccttgtgatcct

SEQ ID NO: 6718 - DNA, 20 bp, Artificial Sequence
  Synthetic Construct
aggaacagaggcccagagaa

SEQ ID NO: 6719 - DNA, 24 bp, Artificial Sequence
  Synthetic Construct
ttcaacctggcatagcctcatgag

SEQ ID NO: 6720 - DNA, 22 bp, Artificial Sequence
  Synthetic Construct
aagagccgtcaaagggatgatc

SEQ ID NO: 6721 - DNA, 19 bp, Artificial Sequence
  Synthetic Construct
gctaccacctgcccaaagt

SEQ ID NO: 6722 - DNA, 22 bp, Artificial Sequence
  Synthetic Construct
ccaggtgttgctagcagtactc

SEQ ID NO: 6723 - DNA, 26 bp, Artificial Sequence
  Synthetic Construct
acagtgacagttaagaggtctttgtc

SEQ ID NO: 6724 - DNA, 22 bp, Artificial Sequence
  Synthetic Construct
agggtggggatcaaaggaagtt

SEQ ID NO: 6725 - DNA, 21 bp, Artificial Sequence
  Synthetic Construct
tgggacagggatccacaggta

SEQ ID NO: 6726 - DNA, 20 bp, Artificial Sequence
  Synthetic Construct
ctgtgaaaccctgccacaca

SEQ ID NO: 6727 - DNA, 20 bp, Artificial Sequence
  Synthetic Construct
tggtgtcctgggagccattt

SEQ ID NO: 6728 - DNA, 23 bp, Artificial Sequence
  Synthetic Construct
gagggaccacttgacagtattgt

SEQ ID NO: 6729 - DNA, 28 bp, Artificial Sequence
  Synthetic Construct
tcaataagatttttaagcaacccaccat

SEQ ID NO: 6730 - DNA, 24 bp, Artificial Sequence
  Synthetic Construct
aatgagctgtgatttgctgtgttt

SEQ ID NO: 6731 - DNA, 22 bp, Artificial Sequence
  Synthetic Construct
ccattcgtgaaggtggagttgt

SEQ ID NO: 6732 - DNA, 22 bp, Artificial Sequence
  Synthetic Construct
tgagacgaggtctggttctgtt

SEQ ID NO: 6733 - DNA, 22 bp, Artificial Sequence
  Synthetic Construct
gcctgtccagcaatggcctaga

SEQ ID NO: 6734 - DNA, 26 bp, Artificial Sequence
  Synthetic Construct
ggcctatcagtcaggttgtttaagtg

SEQ ID NO: 6735 - DNA, 21 bp, Artificial Sequence
  Synthetic Construct
ttggccttctgcagcaaggat

SEQ ID NO: 6736 - DNA, 22 bp, Artificial Sequence
  Synthetic Construct
gattttacaggcaccccagctt

SEQ ID NO: 6737 - DNA, 22 bp, Artificial Sequence
  Synthetic Construct
tgaggaggagttgagggaatga

SEQ ID NO: 6738 - DNA, 21 bp, Artificial Sequence
  Synthetic Construct
agcctctgggaccaggacaaa

SEQ ID NO: 6739 - DNA, 21 bp, Artificial Sequence
  Synthetic Construct
agcatggaggctctgggatga

SEQ ID NO: 6740 - DNA, 23 bp, Artificial Sequence
  Synthetic Construct
gcagcttcctcaaacgtaacatg

SEQ ID NO: 6741 - DNA, 21 bp, Artificial Sequence
  Synthetic Construct
agctcacagatctgggtctgt

SEQ ID NO: 6742 - DNA, 23 bp, Artificial Sequence
  Synthetic Construct
cctgtgggaggagaggtcaccat

SEQ ID NO: 6743 - DNA, 22 bp, Artificial Sequence
  Synthetic Construct
ggcagcgtttgtgaatgtacag

SEQ ID NO: 6744 - DNA, 21 bp, Artificial Sequence
  Synthetic Construct
attcacagcttggcacagagt

SEQ ID NO: 6745 - DNA, 24 bp, Artificial Sequence
  Synthetic Construct
ccaaaacaggcagaccatgtcctt

SEQ ID NO: 6746 - DNA, 20 bp, Artificial Sequence
  Synthetic Construct
aagggcaggggaaggaaagg

SEQ ID NO: 6747 - DNA, 24 bp, Artificial Sequence
  Synthetic Construct
tgccaatgggaggatagggatact

SEQ ID NO: 6748 - DNA, 22 bp, Artificial Sequence
  Synthetic Construct
gctgtctccagaattccatggt

SEQ ID NO: 6749 - DNA, 19 bp, Artificial Sequence
  Synthetic Construct
gggaaccccaggcatgtga

SEQ ID NO: 6750 - DNA, 19 bp, Artificial Sequence
  Synthetic Construct
cccatgtgtgcccatttgc

SEQ ID NO: 6751 - DNA, 19 bp, Artificial Sequence
  Synthetic Construct
tgcccctgccatccgtcat

SEQ ID NO: 6752 - DNA, 23 bp, Artificial Sequence
  Synthetic Construct
cccataaagagatggtgccagtt

SEQ ID NO: 6753 - DNA, 22 bp, Artificial Sequence
  Synthetic Construct
cggaggaaaccacaaggtcctt

SEQ ID NO: 6754 - DNA, 23 bp, Artificial Sequence
  Synthetic Construct
gcttcgtgcttttacctgactgt

SEQ ID NO: 6755 - DNA, 21 bp, Artificial Sequence
  Synthetic Construct
attcctgcctcctggtaacgt

SEQ ID NO: 6756 - DNA, 25 bp, Artificial Sequence
  Synthetic Construct
ccagtaaaagcagctctgacttgga

SEQ ID NO: 6757 - DNA, 25 bp, Artificial Sequence
  Synthetic Construct
gccggatacagtgagattcgtaatc

SEQ ID NO: 6758 - DNA, 26 bp, Artificial Sequence
  Synthetic Construct
ctcactgttctctgtcactcactttt

SEQ ID NO: 6759 - DNA, 24 bp, Artificial Sequence
  Synthetic Construct
gcactggaggagtctacataacca

SEQ ID NO: 6760 - DNA, 20 bp, Artificial Sequence
  Synthetic Construct
tccagtggcaatggcagact

SEQ ID NO: 6761 - DNA, 23 bp, Artificial Sequence
  Synthetic Construct
tttctagctggttggttggaact

SEQ ID NO: 6762 - DNA, 24 bp, Artificial Sequence
  Synthetic Construct
tgcatgtcctagaagagggtacag

SEQ ID NO: 6763 - DNA, 26 bp, Artificial Sequence
  Synthetic Construct
cctagtctcctcactgggaaatagga

SEQ ID NO: 6764 - DNA, 22 bp, Artificial Sequence
  Synthetic Construct
actgcccatagctcacaatctc

SEQ ID NO: 6765 - DNA, 30 bp, Artificial Sequence
  Synthetic Construct
ccttgatactgaataagttctgatccactt

SEQ ID NO: 6766 - DNA, 28 bp, Artificial Sequence
  Synthetic Construct
ccaaaatgttacccatagtaaagacgtt

SEQ ID NO: 6767 - DNA, 24 bp, Artificial Sequence
  Synthetic Construct
gtgagtggtccaaagtgacttgat

SEQ ID NO: 6768 - DNA, 21 bp, Artificial Sequence
  Synthetic Construct
aagcaaggctggatcctgtct

SEQ ID NO: 6769 - DNA, 21 bp, Artificial Sequence
  Synthetic Construct
ctcccagggttggcattacag

SEQ ID NO: 6770 - DNA, 20 bp, Artificial Sequence
  Synthetic Construct
tgggtagtggtggtgaggaa

SEQ ID NO: 6771 - DNA, 24 bp, Artificial Sequence
  Synthetic Construct
tgggtagccctagacctttacttc

SEQ ID NO: 6772 - DNA, 24 bp, Artificial Sequence
  Synthetic Construct
aggattgcaatgactcccatatgg

SEQ ID NO: 6773 - DNA, 24 bp, Artificial Sequence
  Synthetic Construct
tggaaacagccagggatggtacat

SEQ ID NO: 6774 - DNA, 19 bp, Artificial Sequence
  Synthetic Construct
tctggcaaggggacagtgt

SEQ ID NO: 6775 - DNA, 22 bp, Artificial Sequence
  Synthetic Construct
tgcctagtgctctgtggtgtct

SEQ ID NO: 6776 - DNA, 24 bp, Artificial Sequence
  Synthetic Construct
agtgctacaagagtcattgttgct

SEQ ID NO: 6777 - DNA, 22 bp, Artificial Sequence
  Synthetic Construct
cttgaaatgaccccccattcct

SEQ ID NO: 6778 - DNA, 18 bp, Artificial Sequence
  Synthetic Construct
ggggttgtggccgtgctt

SEQ ID NO: 6779 - DNA, 25 bp, Artificial Sequence
  Synthetic Construct
cccaaactcctttgcaactaaatgg

SEQ ID NO: 6780 - DNA, 21 bp, Artificial Sequence
  Synthetic Construct
ccatggcaatgacctggaagt

SEQ ID NO: 6781 - DNA, 21 bp, Artificial Sequence
  Synthetic Construct
tggagagcagggggacacaat

SEQ ID NO: 6782 - DNA, 22 bp, Artificial Sequence
  Synthetic Construct
gcaaagggaggcacagttcatt

SEQ ID NO: 6783 - DNA, 26 bp, Artificial Sequence
  Synthetic Construct
gtaccagttttcattaatgggaagca

SEQ ID NO: 6784 - DNA, 25 bp, Artificial Sequence
  Synthetic Construct
gcactgctggattcatcatcaagga

SEQ ID NO: 6785 - DNA, 20 bp, Artificial Sequence
  Synthetic Construct
ggagatgggacctgcttgct

SEQ ID NO: 6786 - DNA, 21 bp, Artificial Sequence
  Synthetic Construct
acacagagagcagaggggttt

SEQ ID NO: 6787 - DNA, 23 bp, Artificial Sequence
  Synthetic Construct
caatagccgccttcttgaaacac

SEQ ID NO: 6788 - DNA, 22 bp, Artificial Sequence
  Synthetic Construct
ttcctatgatgcccccatgtgt

SEQ ID NO: 6789 - DNA, 18 bp, Artificial Sequence
  Synthetic Construct
caactggccagcctgtca

SEQ ID NO: 6790 - DNA, 23 bp, Artificial Sequence
  Synthetic Construct
tggaatttctccctggggtatgc

SEQ ID NO: 6791 - DNA, 18 bp, Artificial Sequence
  Synthetic Construct
gccactgctgctgctaca

SEQ ID NO: 6792 - DNA, 25 bp, Artificial Sequence
  Synthetic Construct
accttttttcctccatgcagctaat

SEQ ID NO: 6793 - DNA, 21 bp, Artificial Sequence
  Synthetic Construct
tctccagtcgaggccaaaact

SEQ ID NO: 6794 - DNA, 24 bp, Artificial Sequence
  Synthetic Construct
gggagctactgttacaggtgttag

SEQ ID NO: 6795 - DNA, 26 bp, Artificial Sequence
  Synthetic Construct
ccacagaaaataccactgctctgaac

SEQ ID NO: 6796 - DNA, 25 bp, Artificial Sequence
  Synthetic Construct
gctggaaaggtaatggtgtcaccta

SEQ ID NO: 6797 - DNA, 25 bp, Artificial Sequence
  Synthetic Construct
cacaaatctccagtatcctgttgct

SEQ ID NO: 6798 - DNA, 25 bp, Artificial Sequence
  Synthetic Construct
gcccaaatgattgacacagctttct

SEQ ID NO: 6799 - DNA, 22 bp, Artificial Sequence
  Synthetic Construct
acccagatcctccttcgagtga

SEQ ID NO: 6800 - DNA, 25 bp, Artificial Sequence
  Synthetic Construct
cagagaacattcactgccttactct

SEQ ID NO: 6801 - DNA, 25 bp, Artificial Sequence
  Synthetic Construct
ccataaccccggttgtaagtaaaca

SEQ ID NO: 6802 - DNA, 21 bp, Artificial Sequence
  Synthetic Construct
atgggtccagtgggtaaaggt

SEQ ID NO: 6803 - DNA, 28 bp, Artificial Sequence
  Synthetic Construct
caagcacaaatcagaaatatgtggtttg

SEQ ID NO: 6804 - DNA, 21 bp, Artificial Sequence
  Synthetic Construct
gtgactgtgggagccttttca

SEQ ID NO: 6805 - DNA, 21 bp, Artificial Sequence
  Synthetic Construct
agggtgaagccagggatcagt

SEQ ID NO: 6806 - DNA, 25 bp, Artificial Sequence
  Synthetic Construct
cgcttcttcccttactgcatttagg

SEQ ID NO: 6807 - DNA, 23 bp, Artificial Sequence
  Synthetic Construct
ggactaaaggggttcctgagaca

SEQ ID NO: 6808 - DNA, 21 bp, Artificial Sequence
  Synthetic Construct
aggtgcctacaggacatttgg

SEQ ID NO: 6809 - DNA, 25 bp, Artificial Sequence
  Synthetic Construct
ccagcagagcataccatacaataga

SEQ ID NO: 6810 - DNA, 22 bp, Artificial Sequence
  Synthetic Construct
tctctctccaccctgtctgttt

SEQ ID NO: 6811 - DNA, 26 bp, Artificial Sequence
  Synthetic Construct
aatccccaaagcctacttagaaactt

SEQ ID NO: 6812 - DNA, 20 bp, Artificial Sequence
  Synthetic Construct
cccccttgtctacccttcca

SEQ ID NO: 6813 - DNA, 25 bp, Artificial Sequence
  Synthetic Construct
gcagagagctctcgggtgtaaatta

SEQ ID NO: 6814 - DNA, 24 bp, Artificial Sequence
  Synthetic Construct
ctttctacccatgactgtgagcat

SEQ ID NO: 6815 - DNA, 22 bp, Artificial Sequence
  Synthetic Construct
tgcagcaggactctcaccttga

SEQ ID NO: 6816 - DNA, 24 bp, Artificial Sequence
  Synthetic Construct
cgttgctacactgacatgcactac

SEQ ID NO: 6817 - DNA, 22 bp, Artificial Sequence
  Synthetic Construct
aagtggcaaatgagcaggaaac

SEQ ID NO: 6818 - DNA, 24 bp, Artificial Sequence
  Synthetic Construct
cagcctggatttctagcagctatc

SEQ ID NO: 6819 - DNA, 23 bp, Artificial Sequence
  Synthetic Construct
ggtggacatttgtgggttttcag

SEQ ID NO: 6820 - DNA, 25 bp, Artificial Sequence
  Synthetic Construct
cccagcctaatacaaagcccatgtt

SEQ ID NO: 6821 - DNA, 20 bp, Artificial Sequence
  Synthetic Construct
gtcagcaccgggaagatgag

SEQ ID NO: 6822 - DNA, 27 bp, Artificial Sequence
  Synthetic Construct
ggttccctgacaatgaaatgagggata

SEQ ID NO: 6823 - DNA, 21 bp, Artificial Sequence
  Synthetic Construct
aactcaggcagtctgggaatg

SEQ ID NO: 6824 - DNA, 22 bp, Artificial Sequence
  Synthetic Construct
ctggaagaatgcacagctttgg

SEQ ID NO: 6825 - DNA, 24 bp, Artificial Sequence
  Synthetic Construct
ggtgggagggtaaatccaaactgt

SEQ ID NO: 6826 - DNA, 24 bp, Artificial Sequence
  Synthetic Construct
ctccagtctcctctgaaacacact

SEQ ID NO: 6827 - DNA, 22 bp, Artificial Sequence
  Synthetic Construct
ctgctactgcaaggggtgataa

SEQ ID NO: 6828 - DNA, 22 bp, Artificial Sequence
  Synthetic Construct
agcagccggtttggattgtact

SEQ ID NO: 6829 - DNA, 22 bp, Artificial Sequence
  Synthetic Construct
aatgaagccagtgttgctacct

SEQ ID NO: 6830 - DNA, 24 bp, Artificial Sequence
  Synthetic Construct
cttcagaaccatttccctctctga

SEQ ID NO: 6831 - DNA, 22 bp, Artificial Sequence
  Synthetic Construct
tcagctatgagtcggcccttct

SEQ ID NO: 6832 - DNA, 23 bp, Artificial Sequence
  Synthetic Construct
gctgagtaggagctttctgtctt

SEQ ID NO: 6833 - DNA, 24 bp, Artificial Sequence
  Synthetic Construct
cactccagaaccctgatgatacag

SEQ ID NO: 6834 - DNA, 23 bp, Artificial Sequence
  Synthetic Construct
accctgactgcatttcccagaag

SEQ ID NO: 6835 - DNA, 26 bp, Artificial Sequence
  Synthetic Construct
actcttaactctgaacgtgatggtaa

SEQ ID NO: 6836 - DNA, 21 bp, Artificial Sequence
  Synthetic Construct
tgctgtcacgccatccttagg

SEQ ID NO: 6837 - DNA, 25 bp, Artificial Sequence
  Synthetic Construct
caggacaggtctagattgcattagg

SEQ ID NO: 6838 - DNA, 22 bp, Artificial Sequence
  Synthetic Construct
acagacatgaccagggacttca

SEQ ID NO: 6839 - DNA, 20 bp, Artificial Sequence
  Synthetic Construct
agccattcagccccttttgt

SEQ ID NO: 6840 - DNA, 22 bp, Artificial Sequence
  Synthetic Construct
tctaggggctcttccaatccat

SEQ ID NO: 6841 - DNA, 21 bp, Artificial Sequence
  Synthetic Construct
gaaatggaggcccagagaaca

SEQ ID NO: 6842 - DNA, 24 bp, Artificial Sequence
  Synthetic Construct
gggaagagagaagcacttggtcaa

SEQ ID NO: 6843 - DNA, 26 bp, Artificial Sequence
  Synthetic Construct
actcactaagttacccctaccaaaga

SEQ ID NO: 6844 - DNA, 26 bp, Artificial Sequence
  Synthetic Construct
gtgtaagagaggatgttggcactatc

SEQ ID NO: 6845 - DNA, 24 bp, Artificial Sequence
  Synthetic Construct
cctcactcctgatctggtgaatgt

SEQ ID NO: 6846 - DNA, 24 bp, Artificial Sequence
  Synthetic Construct
cccccaagttgtagcactctagtt

SEQ ID NO: 6847 - DNA, 22 bp, Artificial Sequence
  Synthetic Construct
gcccaggaaaagaatggcatga

SEQ ID NO: 6848 - DNA, 22 bp, Artificial Sequence
  Synthetic Construct
gggtctgggtggagaaaattca

SEQ ID NO: 6849 - DNA, 22 bp, Artificial Sequence
  Synthetic Construct
acctcccagtagtgcttcagaa

SEQ ID NO: 6850 - DNA, 19 bp, Artificial Sequence
  Synthetic Construct
agcccctgactggtggtta

SEQ ID NO: 6851 - DNA, 21 bp, Artificial Sequence
  Synthetic Construct
ccaacctgctctcctgattcc

SEQ ID NO: 6852 - DNA, 19 bp, Artificial Sequence
  Synthetic Construct
aggctcccgtctctgtcat

SEQ ID NO: 6853 - DNA, 21 bp, Artificial Sequence
  Synthetic Construct
gctggcctgctctcattgact

SEQ ID NO: 6854 - DNA, 24 bp, Artificial Sequence
  Synthetic Construct
agggtctgatttttcccagtatcc

SEQ ID NO: 6855 - DNA, 25 bp, Artificial Sequence
  Synthetic Construct
ctgtaatgggtgtagatgtcagaca

SEQ ID NO: 6856 - DNA, 29 bp, Artificial Sequence
  Synthetic Construct
gcattattttcctagtggcttttgttcct

SEQ ID NO: 6857 - DNA, 22 bp, Artificial Sequence
  Synthetic Construct
gtctttcctagggactgcacaa

SEQ ID NO: 6858 - DNA, 19 bp, Artificial Sequence
  Synthetic Construct
agccctggtggtgcctgta

SEQ ID NO: 6859 - DNA, 27 bp, Artificial Sequence
  Synthetic Construct
tgacctactttacacataacagtccaa

SEQ ID NO: 6860 - DNA, 28 bp, Artificial Sequence
  Synthetic Construct
cactaaaccctccaattagacagacttc

SEQ ID NO: 6861 - DNA, 20 bp, Artificial Sequence
  Synthetic Construct
acagaccacctgctctgagt

SEQ ID NO: 6862 - DNA, 23 bp, Artificial Sequence
  Synthetic Construct
ctccacagactgagagagctagt

SEQ ID NO: 6863 - DNA, 23 bp, Artificial Sequence
  Synthetic Construct
agacgtggtaagtcccaggaagt

SEQ ID NO: 6864 - DNA, 18 bp, Artificial Sequence
  Synthetic Construct
ggggcttcaggggggttt

SEQ ID NO: 6865 - DNA, 22 bp, Artificial Sequence
  Synthetic Construct
acttgggcaaaatgcagtgatc

SEQ ID NO: 6866 - DNA, 27 bp, Artificial Sequence
  Synthetic Construct
ctcattggtcaatctgaaatgggatac

SEQ ID NO: 6867 - DNA, 20 bp, Artificial Sequence
  Synthetic Construct
acacgtgtgtcctgctttgt

SEQ ID NO: 6868 - DNA, 21 bp, Artificial Sequence
  Synthetic Construct
ggcagatcctctccacctaga

SEQ ID NO: 6869 - DNA, 19 bp, Artificial Sequence
  Synthetic Construct
tccctgccaacagcctcat

SEQ ID NO: 6870 - DNA, 24 bp, Artificial Sequence
  Synthetic Construct
actcaaagcatagcctcctcattt

SEQ ID NO: 6871 - DNA, 23 bp, Artificial Sequence
  Synthetic Construct
gaggaaggcaaagttctgttgct

SEQ ID NO: 6872 - DNA, 22 bp, Artificial Sequence
  Synthetic Construct
gctttgtcctccacctcctaag

SEQ ID NO: 6873 - DNA, 24 bp, Artificial Sequence
  Synthetic Construct
cccagatagctctccatcttctga

SEQ ID NO: 6874 - DNA, 21 bp, Artificial Sequence
  Synthetic Construct
agtcgccatcctttcttgctt

SEQ ID NO: 6875 - DNA, 20 bp, Artificial Sequence
  Synthetic Construct
tggctggagtgactgggatt

SEQ ID NO: 6876 - DNA, 22 bp, Artificial Sequence
  Synthetic Construct
agcacatggggatgacatgtct

SEQ ID NO: 6877 - DNA, 24 bp, Artificial Sequence
  Synthetic Construct
tgaatcaaatcttctggcgtagga

SEQ ID NO: 6878 - DNA, 22 bp, Artificial Sequence
  Synthetic Construct
tctttcaccaaggggccaatca

SEQ ID NO: 6879 - DNA, 21 bp, Artificial Sequence
  Synthetic Construct
tgccctgtgcaaaggaaacca

SEQ ID NO: 6880 - DNA, 20 bp, Artificial Sequence
  Synthetic Construct
agggctctgatgcagcaaag

SEQ ID NO: 6881 - DNA, 26 bp, Artificial Sequence
  Synthetic Construct
gccaatcacatgtggggagtattacc

SEQ ID NO: 6882 - DNA, 24 bp, Artificial Sequence
  Synthetic Construct
ccaagttagctctagggcttagga

SEQ ID NO: 6883 - DNA, 22 bp, Artificial Sequence
  Synthetic Construct
caggatgctggcagaaatatgc

SEQ ID NO: 6884 - DNA, 24 bp, Artificial Sequence
  Synthetic Construct
agaagggttcaaggtccataaagg

SEQ ID NO: 6885 - DNA, 19 bp, Artificial Sequence
  Synthetic Construct
gtgcacacccacccataca

SEQ ID NO: 6886 - DNA, 26 bp, Artificial Sequence
  Synthetic Construct
accactgtcctagatcaatgagtttc

SEQ ID NO: 6887 - DNA, 22 bp, Artificial Sequence
  Synthetic Construct
tgtcaaccaaggtgcattctgt

SEQ ID NO: 6888 - DNA, 25 bp, Artificial Sequence
  Synthetic Construct
gcttgtggtttacaacattgtggtt

SEQ ID NO: 6889 - DNA, 26 bp, Artificial Sequence
  Synthetic Construct
gtcaatatgcatgaccaggacctaga

SEQ ID NO: 6890 - DNA, 22 bp, Artificial Sequence
  Synthetic Construct
ctgcaagccaccctctactaag

SEQ ID NO: 6891 - DNA, 21 bp, Artificial Sequence
  Synthetic Construct
ccagccttcccttacctgtct

SEQ ID NO: 6892 - DNA, 24 bp, Artificial Sequence
  Synthetic Construct
caaatacaacccctagagccacat

SEQ ID NO: 6893 - DNA, 24 bp, Artificial Sequence
  Synthetic Construct
gccacgctgagtaattatgccatt

SEQ ID NO: 6894 - DNA, 18 bp, Artificial Sequence
  Synthetic Construct
agcctcgcacgccaacga

SEQ ID NO: 6895 - DNA, 22 bp, Artificial Sequence
  Synthetic Construct
tgagacctggaagacgagaaga

SEQ ID NO: 6896 - DNA, 23 bp, Artificial Sequence
  Synthetic Construct
gcaatttgggaattgggctccat

SEQ ID NO: 6897 - DNA, 27 bp, Artificial Sequence
  Synthetic Construct
acatagtcactcatttgacaagtgttc

SEQ ID NO: 6898 - DNA, 21 bp, Artificial Sequence
  Synthetic Construct
gctgggcaacaggactgtagt

SEQ ID NO: 6899 - DNA, 21 bp, Artificial Sequence
  Synthetic Construct
tgactgctaccaaggctgaga

SEQ ID NO: 6900 - DNA, 24 bp, Artificial Sequence
  Synthetic Construct
tgcaacccttgggtcagaatatcc

SEQ ID NO: 6901 - DNA, 19 bp, Artificial Sequence
  Synthetic Construct
cccctgcttcccactgagt

SEQ ID NO: 6902 - DNA, 24 bp, Artificial Sequence
  Synthetic Construct
gaagttaagagagggggcttcatt

SEQ ID NO: 6903 - DNA, 23 bp, Artificial Sequence
  Synthetic Construct
gatgaaggaagcgatgaggtgtt

SEQ ID NO: 6904 - DNA, 22 bp, Artificial Sequence
  Synthetic Construct
aggacagtggcaagctcagatt

SEQ ID NO: 6905 - DNA, 22 bp, Artificial Sequence
  Synthetic Construct
acggataatggatcgcctgctt

SEQ ID NO: 6906 - DNA, 24 bp, Artificial Sequence
  Synthetic Construct
gggttggttcagcattccattagg

SEQ ID NO: 6907 - DNA, 23 bp, Artificial Sequence
  Synthetic Construct
gccttttgttctgggccaataag

SEQ ID NO: 6908 - DNA, 24 bp, Artificial Sequence
  Synthetic Construct
ggatgtgatagctggatcctgaag

SEQ ID NO: 6909 - DNA, 26 bp, Artificial Sequence
  Synthetic Construct
ctcataaagtaagacacaccgtacca

SEQ ID NO: 6910 - DNA, 20 bp, Artificial Sequence
  Synthetic Construct
accacacttgagcccttgag

SEQ ID NO: 6911 - DNA, 27 bp, Artificial Sequence
  Synthetic Construct
agacctagaagtgatctagtggaatga

SEQ ID NO: 6912 - DNA, 25 bp, Artificial Sequence
  Synthetic Construct
gtgttatgtgtcaagccttctgttc

SEQ ID NO: 6913 - DNA, 23 bp, Artificial Sequence
  Synthetic Construct
ggttgccaaaatgtcagccttaa

SEQ ID NO: 6914 - DNA, 22 bp, Artificial Sequence
  Synthetic Construct
gctgttttgtctgtcgctgaac

SEQ ID NO: 6915 - DNA, 22 bp, Artificial Sequence
  Synthetic Construct
acctctgggaaatgggtcttca

SEQ ID NO: 6916 - DNA, 25 bp, Artificial Sequence
  Synthetic Construct
ctactaagtgctcagaccatttgga

SEQ ID NO: 6917 - DNA, 20 bp, Artificial Sequence
  Synthetic Construct
cctcctccctccggaatcct

SEQ ID NO: 6918 - DNA, 24 bp, Artificial Sequence
  Synthetic Construct
agagaacactctgagagcttgatg

SEQ ID NO: 6919 - DNA, 23 bp, Artificial Sequence
  Synthetic Construct
cagagaacattctgccactctct

SEQ ID NO: 6920 - DNA, 22 bp, Artificial Sequence
  Synthetic Construct
acagtagcctgttcctcttcca

SEQ ID NO: 6921 - DNA, 23 bp, Artificial Sequence
  Synthetic Construct
ggcctgtagttccagcttattgg

SEQ ID NO: 6922 - DNA, 22 bp, Artificial Sequence
  Synthetic Construct
cccctggctgactatttgaact

SEQ ID NO: 6923 - DNA, 24 bp, Artificial Sequence
  Synthetic Construct
gactttatgttgggggaggaagaa

SEQ ID NO: 6924 - DNA, 20 bp, Artificial Sequence
  Synthetic Construct
ttgcccctcctggtgagttt

SEQ ID NO: 6925 - DNA, 26 bp, Artificial Sequence
  Synthetic Construct
agatggaggtctgaaacataaacagt

SEQ ID NO: 6926 - DNA, 25 bp, Artificial Sequence
  Synthetic Construct
gcccatgatttcttccatggggaaa

SEQ ID NO: 6927 - DNA, 22 bp, Artificial Sequence
  Synthetic Construct
tcctgaacacacctggcctgta

SEQ ID NO: 6928 - DNA, 19 bp, Artificial Sequence
  Synthetic Construct
ccagctgccacagaactga

SEQ ID NO: 6929 - DNA, 20 bp, Artificial Sequence
  Synthetic Construct
acgagcctgcctttttcagt

SEQ ID NO: 6930 - DNA, 20 bp, Artificial Sequence
  Synthetic Construct
tgacattgggcaaggcatca

SEQ ID NO: 6931 - DNA, 27 bp, Artificial Sequence
  Synthetic Construct
gctgtataaagttgatctcagcttgtg

SEQ ID NO: 6932 - DNA, 20 bp, Artificial Sequence
  Synthetic Construct
aggtgctgttcctgcttctg

SEQ ID NO: 6933 - DNA, 20 bp, Artificial Sequence
  Synthetic Construct
acctgcccctaaagcctcat

SEQ ID NO: 6934 - DNA, 23 bp, Artificial Sequence
  Synthetic Construct
tgccagaggtggagatacatcca

SEQ ID NO: 6935 - DNA, 25 bp, Artificial Sequence
  Synthetic Construct
caatactgactttctgtcccactgt

SEQ ID NO: 6936 - DNA, 23 bp, Artificial Sequence
  Synthetic Construct
cttcagaggagcaagtcacttgt

SEQ ID NO: 6937 - DNA, 22 bp, Artificial Sequence
  Synthetic Construct
ccacaccaccctgaagtcatct

SEQ ID NO: 6938 - DNA, 22 bp, Artificial Sequence
  Synthetic Construct
cccactctgctccattgacaag

SEQ ID NO: 6939 - DNA, 27 bp, Artificial Sequence
  Synthetic Construct
gctctcactaaagtaccaacaactgat

SEQ ID NO: 6940 - DNA, 26 bp, Artificial Sequence
  Synthetic Construct
agtcaactttacatagctgctagaca

SEQ ID NO: 6941 - DNA, 22 bp, Artificial Sequence
  Synthetic Construct
gcattgacctgatggcagaagt

SEQ ID NO: 6942 - DNA, 24 bp, Artificial Sequence
  Synthetic Construct
tgggggcttgaaagaggtactatc

SEQ ID NO: 6943 - DNA, 27 bp, Artificial Sequence
  Synthetic Construct
ccccttcttagcttgatcatctgcttt

SEQ ID NO: 6944 - DNA, 22 bp, Artificial Sequence
  Synthetic Construct
cctcaggctgtcttgctaggat

SEQ ID NO: 6945 - DNA, 26 bp, Artificial Sequence
  Synthetic Construct
gatagggtttctccaaggattcttga

SEQ ID NO: 6946 - DNA, 22 bp, Artificial Sequence
  Synthetic Construct
tgagaggcattgggagatagca

SEQ ID NO: 6947 - DNA, 25 bp, Artificial Sequence
  Synthetic Construct
caaaagaattcccagcagcaaagaa

SEQ ID NO: 6948 - DNA, 27 bp, Artificial Sequence
  Synthetic Construct
gcgacacaaaatttttcaagtgtgtgt

SEQ ID NO: 6949 - DNA, 28 bp, Artificial Sequence
  Synthetic Construct
gcttgaagtaatgaaatttgtgcttgga

SEQ ID NO: 6950 - DNA, 23 bp, Artificial Sequence
  Synthetic Construct
actcaaccacaactgcctttagt

SEQ ID NO: 6951 - DNA, 20 bp, Artificial Sequence
  Synthetic Construct
ttgccagcccagcatctatg

SEQ ID NO: 6952 - DNA, 24 bp, Artificial Sequence
  Synthetic Construct
ggctggctttgtaatgaccatagt

SEQ ID NO: 6953 - DNA, 25 bp, Artificial Sequence
  Synthetic Construct
aaggcagaggtagagtaaagaactg

SEQ ID NO: 6954 - DNA, 25 bp, Artificial Sequence
  Synthetic Construct
ccactaaactgaggtttggcacaga

SEQ ID NO: 6955 - DNA, 24 bp, Artificial Sequence
  Synthetic Construct
gtgaaatgtagccttttgcccttt

SEQ ID NO: 6956 - DNA, 23 bp, Artificial Sequence
  Synthetic Construct
aatcctacctgcaaaaccaagga

SEQ ID NO: 6957 - DNA, 24 bp, Artificial Sequence
  Synthetic Construct
ccaactaatcagccttttgcacat

SEQ ID NO: 6958 - DNA, 21 bp, Artificial Sequence
  Synthetic Construct
ggtgaggcttagaacgttgga

SEQ ID NO: 6959 - DNA, 22 bp, Artificial Sequence
  Synthetic Construct
catggtcctggtgactctttgg

SEQ ID NO: 6960 - DNA, 23 bp, Artificial Sequence
  Synthetic Construct
aggaatggtgaagtacccaatgg

SEQ ID NO: 6961 - DNA, 25 bp, Artificial Sequence
  Synthetic Construct
ccttcctttcttgggattgcttgtc

SEQ ID NO: 6962 - DNA, 22 bp, Artificial Sequence
  Synthetic Construct
agagtccatccaggcagagaga

SEQ ID NO: 6963 - DNA, 24 bp, Artificial Sequence
  Synthetic Construct
ctcagtgcaagacaactctaaagc

SEQ ID NO: 6964 - DNA, 26 bp, Artificial Sequence
  Synthetic Construct
ccctggatctatttcccacaaaactc

SEQ ID NO: 6965 - DNA, 21 bp, Artificial Sequence
  Synthetic Construct
tgcctcgcccaacaattccaa

SEQ ID NO: 6966 - DNA, 26 bp, Artificial Sequence
  Synthetic Construct
ccgtgtttaggtattcttccttccat

SEQ ID NO: 6967 - DNA, 22 bp, Artificial Sequence
  Synthetic Construct
aagcaaacctggaggaccatac

SEQ ID NO: 6968 - DNA, 22 bp, Artificial Sequence
  Synthetic Construct
ctgctgctgggaattctacaca

SEQ ID NO: 6969 - DNA, 18 bp, Artificial Sequence
  Synthetic Construct
tcctgggcgctctgtgat

SEQ ID NO: 6970 - DNA, 25 bp, Artificial Sequence
  Synthetic Construct
cttttgatctaaactcggcccatac

SEQ ID NO: 6971 - DNA, 29 bp, Artificial Sequence
  Synthetic Construct
cctctgcactaaatcaaatgtgtcttgtc

SEQ ID NO: 6972 - DNA, 23 bp, Artificial Sequence
  Synthetic Construct
agccaggactgtagaaccaggat

SEQ ID NO: 6973 - DNA, 21 bp, Artificial Sequence
  Synthetic Construct
tgctcttctttctgccccaaa

SEQ ID NO: 6974 - DNA, 21 bp, Artificial Sequence
  Synthetic Construct
tgcaggtgccttggatgtctt

SEQ ID NO: 6975 - DNA, 18 bp, Artificial Sequence
  Synthetic Construct
tgccaccctcccaatggt

SEQ ID NO: 6976 - DNA, 23 bp, Artificial Sequence
  Synthetic Construct
agcatctctctcaaggacctgaa

SEQ ID NO: 6977 - DNA, 22 bp, Artificial Sequence
  Synthetic Construct
ggtgtggctgcaactatagaca

SEQ ID NO: 6978 - DNA, 22 bp, Artificial Sequence
  Synthetic Construct
cagaacaaccgacctccatctt

SEQ ID NO: 6979 - DNA, 20 bp, Artificial Sequence
  Synthetic Construct
agccagccaggtgagacaga

SEQ ID NO: 6980 - DNA, 22 bp, Artificial Sequence
  Synthetic Construct
gccagagcttggggtaatcact

SEQ ID NO: 6981 - DNA, 19 bp, Artificial Sequence
  Synthetic Construct
agccagctgcagttccaaa

SEQ ID NO: 6982 - DNA, 23 bp, Artificial Sequence
  Synthetic Construct
ggagacccaaactgttgcaattc

SEQ ID NO: 6983 - DNA, 21 bp, Artificial Sequence
  Synthetic Construct
acagccagtcgaatggaagca

SEQ ID NO: 6984 - DNA, 24 bp, Artificial Sequence
  Synthetic Construct
tgggctttagggactctactctct

SEQ ID NO: 6985 - DNA, 25 bp, Artificial Sequence
  Synthetic Construct
tcctaccccataggatcaagatggt

SEQ ID NO: 6986 - DNA, 23 bp, Artificial Sequence
  Synthetic Construct
ctcactgaacaatgggggagaaa

SEQ ID NO: 6987 - DNA, 22 bp, Artificial Sequence
  Synthetic Construct
tctggagttcagcctagacagt

SEQ ID NO: 6988 - DNA, 22 bp, Artificial Sequence
  Synthetic Construct
tctaacaccggcaggtcactct

SEQ ID NO: 6989 - DNA, 20 bp, Artificial Sequence
  Synthetic Construct
agtggggctgtcaggaaaac

SEQ ID NO: 6990 - DNA, 19 bp, Artificial Sequence
  Synthetic Construct
gccccaggtgtcagaagca

SEQ ID NO: 6991 - DNA, 23 bp, Artificial Sequence
  Synthetic Construct
tctgcagaatatgggcactaagg

SEQ ID NO: 6992 - DNA, 22 bp, Artificial Sequence
  Synthetic Construct
accttgcccaaagccatacatc

SEQ ID NO: 6993 - DNA, 21 bp, Artificial Sequence
  Synthetic Construct
aagcccagaaagccttcttgt

SEQ ID NO: 6994 - DNA, 26 bp, Artificial Sequence
  Synthetic Construct
gacctcaaatagtcttggtcattgtg

SEQ ID NO: 6995 - DNA, 21 bp, Artificial Sequence
  Synthetic Construct
cccctgggagaggtcttgaac

SEQ ID NO: 6996 - DNA, 23 bp, Artificial Sequence
  Synthetic Construct
ctgtcctcactacaacccagttt

SEQ ID NO: 6997 - DNA, 26 bp, Artificial Sequence
  Synthetic Construct
gcctttgcctttgaactgtagccata

SEQ ID NO: 6998 - DNA, 21 bp, Artificial Sequence
  Synthetic Construct
gcctgagaaactcgtgatgca

SEQ ID NO: 6999 - DNA, 25 bp, Artificial Sequence
  Synthetic Construct
ccaagtatgccatagtctgttttgg

SEQ ID NO: 7000 - DNA, 23 bp, Artificial Sequence
  Synthetic Construct
caagggctgcaaaagtaactgtt

SEQ ID NO: 7001 - DNA, 21 bp, Artificial Sequence
  Synthetic Construct
aggcagatgctcagaggcatt

SEQ ID NO: 7002 - DNA, 25 bp, Artificial Sequence
  Synthetic Construct
ctgaatgaaacccaactctgacaca

SEQ ID NO: 7003 - DNA, 25 bp, Artificial Sequence
  Synthetic Construct
gaccacaaagtgctgtgtgttattc

SEQ ID NO: 7004 - DNA, 22 bp, Artificial Sequence
  Synthetic Construct
ttcctgcctttcctccagttgt

SEQ ID NO: 7005 - DNA, 23 bp, Artificial Sequence
  Synthetic Construct
gcaatgaagagactcccgtatga

SEQ ID NO: 7006 - DNA, 26 bp, Artificial Sequence
  Synthetic Construct
gaagtcactgtagctagaaagtgtga

SEQ ID NO: 7007 - DNA, 20 bp, Artificial Sequence
  Synthetic Construct
tgccctccctcctgagacaa

SEQ ID NO: 7008 - DNA, 26 bp, Artificial Sequence
  Synthetic Construct
cattaaaacagttggcttccctgtat

SEQ ID NO: 7009 - DNA, 22 bp, Artificial Sequence
  Synthetic Construct
acttcacaccgctctgcactaa

SEQ ID NO: 7010 - DNA, 22 bp, Artificial Sequence
  Synthetic Construct
tgagagagtggagggagtttgg

SEQ ID NO: 7011 - DNA, 28 bp, Artificial Sequence
  Synthetic Construct
ggtttgtaaatttctgaaggcagtggtt

SEQ ID NO: 7012 - DNA, 22 bp, Artificial Sequence
  Synthetic Construct
agattcctcccttgccatcact

SEQ ID NO: 7013 - DNA, 20 bp, Artificial Sequence
  Synthetic Construct
ggagcaactgatggcagcaa

SEQ ID NO: 7014 - DNA, 21 bp, Artificial Sequence
  Synthetic Construct
agtgctctgtgcccacaacta

SEQ ID NO: 7015 - DNA, 22 bp, Artificial Sequence
  Synthetic Construct
tgccaagtagggaggtgtgaga

SEQ ID NO: 7016 - DNA, 22 bp, Artificial Sequence
  Synthetic Construct
catcctgcctgcgtaactactt

SEQ ID NO: 7017 - DNA, 23 bp, Artificial Sequence
  Synthetic Construct
ctcaactcctcgtggcagtgact

SEQ ID NO: 7018 - DNA, 25 bp, Artificial Sequence
  Synthetic Construct
cccaggaattcatcacaaaactgtt

SEQ ID NO: 7019 - DNA, 18 bp, Artificial Sequence
  Synthetic Construct
tgcttccttgcgcacaca

SEQ ID NO: 7020 - DNA, 24 bp, Artificial Sequence
  Synthetic Construct
ctgtctcttggctgttcgtttcct

SEQ ID NO: 7021 - DNA, 25 bp, Artificial Sequence
  Synthetic Construct
cacggaaaagcaaaagctgataacg

SEQ ID NO: 7022 - DNA, 27 bp, Artificial Sequence
  Synthetic Construct
aaagcaaaactactcctccatttacac

SEQ ID NO: 7023 - DNA, 20 bp, Artificial Sequence
  Synthetic Construct
ttgccttcctcagcccttct

SEQ ID NO: 7024 - DNA, 25 bp, Artificial Sequence
  Synthetic Construct
ggtcctcttagaagtcacctttctg

SEQ ID NO: 7025 - DNA, 21 bp, Artificial Sequence
  Synthetic Construct
actgcagcatggctttccatt

SEQ ID NO: 7026 - DNA, 24 bp, Artificial Sequence
  Synthetic Construct
tgggaacactctggcatacattgc

SEQ ID NO: 7027 - DNA, 23 bp, Artificial Sequence
  Synthetic Construct
tttgaacagggcatagtgcagat

SEQ ID NO: 7028 - DNA, 25 bp, Artificial Sequence
  Synthetic Construct
gctacaagctctactccactcagat

SEQ ID NO: 7029 - DNA, 20 bp, Artificial Sequence
  Synthetic Construct
tgttaccccctggacattgc

SEQ ID NO: 7030 - DNA, 19 bp, Artificial Sequence
  Synthetic Construct
cccagcctccttccacact

SEQ ID NO: 7031 - DNA, 23 bp, Artificial Sequence
  Synthetic Construct
cataccctcttgtcccagcatac

SEQ ID NO: 7032 - DNA, 24 bp, Artificial Sequence
  Synthetic Construct
acctacaggttcttcccctacatg

SEQ ID NO: 7033 - DNA, 22 bp, Artificial Sequence
  Synthetic Construct
agctgggtgggaacttattctg

SEQ ID NO: 7034 - DNA, 21 bp, Artificial Sequence
  Synthetic Construct
cattgccctgcttgcaagtag

SEQ ID NO: 7035 - DNA, 26 bp, Artificial Sequence
  Synthetic Construct
aaggcttcaaagaagaactagaacct

SEQ ID NO: 7036 - DNA, 22 bp, Artificial Sequence
  Synthetic Construct
gcggtagggctgagaaaatcca

SEQ ID NO: 7037 - DNA, 24 bp, Artificial Sequence
  Synthetic Construct
acattacggcatcatagctttcct

SEQ ID NO: 7038 - DNA, 25 bp, Artificial Sequence
  Synthetic Construct
gcatacctcattcccctttttgaag

SEQ ID NO: 7039 - DNA, 22 bp, Artificial Sequence
  Synthetic Construct
atgtctggtctccctcctttct

SEQ ID NO: 7040 - DNA, 20 bp, Artificial Sequence
  Synthetic Construct
tctcctccagccacactgaa

SEQ ID NO: 7041 - DNA, 25 bp, Artificial Sequence
  Synthetic Construct
gagtctcgatccacaaaagctatcc

SEQ ID NO: 7042 - DNA, 27 bp, Artificial Sequence
  Synthetic Construct
ccataataggttttttggtgcctacag

SEQ ID NO: 7043 - DNA, 23 bp, Artificial Sequence
  Synthetic Construct
cgtaggtgacacacattcatcca

SEQ ID NO: 7044 - DNA, 25 bp, Artificial Sequence
  Synthetic Construct
gcacgcctcacactttactaatagg

SEQ ID NO: 7045 - DNA, 25 bp, Artificial Sequence
  Synthetic Construct
agggaagctgtgtcttagacttact

SEQ ID NO: 7046 - DNA, 23 bp, Artificial Sequence
  Synthetic Construct
tcctgatgacctgctgattgaag

SEQ ID NO: 7047 - DNA, 20 bp, Artificial Sequence
  Synthetic Construct
agtggttggcagcaggtaac

SEQ ID NO: 7048 - DNA, 26 bp, Artificial Sequence
  Synthetic Construct
actaccccaggaagattagaatgtgt

SEQ ID NO: 7049 - DNA, 22 bp, Artificial Sequence
  Synthetic Construct
agaaagcggcaatgctgagatg

SEQ ID NO: 7050 - DNA, 21 bp, Artificial Sequence
  Synthetic Construct
gctgcccgagaaaacttagct

SEQ ID NO: 7051 - DNA, 28 bp, Artificial Sequence
  Synthetic Construct
aacacaattctgaaatccatctatgcat

SEQ ID NO: 7052 - DNA, 26 bp, Artificial Sequence
  Synthetic Construct
tcaataaagtccccccttacctaact

SEQ ID NO: 7053 - DNA, 22 bp, Artificial Sequence
  Synthetic Construct
tccctgaacaggctgtgcataa

SEQ ID NO: 7054 - DNA, 22 bp, Artificial Sequence
  Synthetic Construct
gccttccatcactctaccacaa

SEQ ID NO: 7055 - DNA, 25 bp, Artificial Sequence
  Synthetic Construct
aagtcaaggcaattgatgaaacaca

SEQ ID NO: 7056 - DNA, 22 bp, Artificial Sequence
  Synthetic Construct
tgcaacatgcacactcttttgc

SEQ ID NO: 7057 - DNA, 22 bp, Artificial Sequence
  Synthetic Construct
gtaatgagggcctgctttagct

SEQ ID NO: 7058 - DNA, 24 bp, Artificial Sequence
  Synthetic Construct
tggatacaaaactcttggctggaa

SEQ ID NO: 7059 - DNA, 24 bp, Artificial Sequence
  Synthetic Construct
gaagcttaagtgccatccttgtct

SEQ ID NO: 7060 - DNA, 22 bp, Artificial Sequence
  Synthetic Construct
ggggcagaagatggaagacttc

SEQ ID NO: 7061 - DNA, 21 bp, Artificial Sequence
  Synthetic Construct
agcccagtgaagcaggaaatg

SEQ ID NO: 7062 - DNA, 27 bp, Artificial Sequence
  Synthetic Construct
gagtttgacaaataattggaggagctt

SEQ ID NO: 7063 - DNA, 27 bp, Artificial Sequence
  Synthetic Construct
aggcaaaggtttgtaggtatgtagatc

SEQ ID NO: 7064 - DNA, 24 bp, Artificial Sequence
  Synthetic Construct
ggactaaactccacgaagaacaca

SEQ ID NO: 7065 - DNA, 19 bp, Artificial Sequence
  Synthetic Construct
acgggactcccagcacaaa

SEQ ID NO: 7066 - DNA, 24 bp, Artificial Sequence
  Synthetic Construct
ccctagacatccacatgtgtgctt

SEQ ID NO: 7067 - DNA, 25 bp, Artificial Sequence
  Synthetic Construct
gtcccaattctgcaactaactctgt

SEQ ID NO: 7068 - DNA, 24 bp, Artificial Sequence
  Synthetic Construct
cctgtgcaaaactttggtctttgc

SEQ ID NO: 7069 - DNA, 26 bp, Artificial Sequence
  Synthetic Construct
gagactgtctccttcatacacattcc

SEQ ID NO: 7070 - DNA, 22 bp, Artificial Sequence
  Synthetic Construct
tgggcaggagttcctaatgaca

SEQ ID NO: 7071 - DNA, 20 bp, Artificial Sequence
  Synthetic Construct
caggggtcgagtggagatga

SEQ ID NO: 7072 - DNA, 26 bp, Artificial Sequence
  Synthetic Construct
gcatgaatcacgcttgttgtactaac

SEQ ID NO: 7073 - DNA, 25 bp, Artificial Sequence
  Synthetic Construct
ccttgatgtaaccaagtcctgagtt

SEQ ID NO: 7074 - DNA, 18 bp, Artificial Sequence
  Synthetic Construct
agtgccctggtgctagca

SEQ ID NO: 7075 - DNA, 25 bp, Artificial Sequence
  Synthetic Construct
cactgattgagttggactctttgga

SEQ ID NO: 7076 - DNA, 26 bp, Artificial Sequence
  Synthetic Construct
cacctgacaaggaatcgaagatgttc

SEQ ID NO: 7077 - DNA, 21 bp, Artificial Sequence
  Synthetic Construct
tgcccatagaccatgcaagtg

SEQ ID NO: 7078 - DNA, 21 bp, Artificial Sequence
  Synthetic Construct
tggagcttccacgtgatcctt

SEQ ID NO: 7079 - DNA, 23 bp, Artificial Sequence
  Synthetic Construct
tgctgaggacactgaaatatgca

SEQ ID NO: 7080 - DNA, 22 bp, Artificial Sequence
  Synthetic Construct
ggcctcagcgataaacacagaa

SEQ ID NO: 7081 - DNA, 19 bp, Artificial Sequence
  Synthetic Construct
gctgctggctgtgaatgca

SEQ ID NO: 7082 - DNA, 22 bp, Artificial Sequence
  Synthetic Construct
agccccagctgtctaaaatgtc

SEQ ID NO: 7083 - DNA, 20 bp, Artificial Sequence
  Synthetic Construct
aaagcacgagggggaaaggt

SEQ ID NO: 7084 - DNA, 20 bp, Artificial Sequence
  Synthetic Construct
ccagctgcaggtgacatagg

SEQ ID NO: 7085 - DNA, 28 bp, Artificial Sequence
  Synthetic Construct
gccattgtaagaactttggcttttactc

SEQ ID NO: 7086 - DNA, 22 bp, Artificial Sequence
  Synthetic Construct
aggtgtgactacgagaccaaga

SEQ ID NO: 7087 - DNA, 26 bp, Artificial Sequence
  Synthetic Construct
caagttggaccctatcataggaagga

SEQ ID NO: 7088 - DNA, 24 bp, Artificial Sequence
  Synthetic Construct
gggagtctgacacatggaacttct

SEQ ID NO: 7089 - DNA, 23 bp, Artificial Sequence
  Synthetic Construct
gtatgtgccttgggagctttagt

SEQ ID NO: 7090 - DNA, 25 bp, Artificial Sequence
  Synthetic Construct
ggacatgctcggtataccaatctag

SEQ ID NO: 7091 - DNA, 25 bp, Artificial Sequence
  Synthetic Construct
ctgctgttcaccaaattagccatga

SEQ ID NO: 7092 - DNA, 24 bp, Artificial Sequence
  Synthetic Construct
gtgtggtgcttctttgtgtaatgg

SEQ ID NO: 7093 - DNA, 20 bp, Artificial Sequence
  Synthetic Construct
agccactctgacctctgtga

SEQ ID NO: 7094 - DNA, 23 bp, Artificial Sequence
  Synthetic Construct
ggggggatgaaaacaaatttgct

SEQ ID NO: 7095 - DNA, 20 bp, Artificial Sequence
  Synthetic Construct
ccaaggtgggtgtgcatctt

SEQ ID NO: 7096 - DNA, 23 bp, Artificial Sequence
  Synthetic Construct
acggggaatgagctttacaatct

SEQ ID NO: 7097 - DNA, 23 bp, Artificial Sequence
  Synthetic Construct
actgcctcccgattcactattct

SEQ ID NO: 7098 - DNA, 25 bp, Artificial Sequence
  Synthetic Construct
gcaatatagaagggtgcaagtggaa

SEQ ID NO: 7099 - DNA, 22 bp, Artificial Sequence
  Synthetic Construct
ggccccattttatctcctgtgt

SEQ ID NO: 7100 - DNA, 26 bp, Artificial Sequence
  Synthetic Construct
ctctcaaagagattccaagtgagctt

SEQ ID NO: 7101 - DNA, 27 bp, Artificial Sequence
  Synthetic Construct
ccatctgtattggaaagtgtggttcac

SEQ ID NO: 7102 - DNA, 24 bp, Artificial Sequence
  Synthetic Construct
cgcagtttccacagcaatcctttg

SEQ ID NO: 7103 - DNA, 20 bp, Artificial Sequence
  Synthetic Construct
tgatccagggcgctgtcaca

SEQ ID NO: 7104 - DNA, 22 bp, Artificial Sequence
  Synthetic Construct
gggatcagtgctgtgatgtgta

SEQ ID NO: 7105 - DNA, 22 bp, Artificial Sequence
  Synthetic Construct
gcaaactccctctgtgttccaa

SEQ ID NO: 7106 - DNA, 25 bp, Artificial Sequence
  Synthetic Construct
gaatcaatttcatcaaggcctggaa

SEQ ID NO: 7107 - DNA, 24 bp, Artificial Sequence
  Synthetic Construct
caccttttccaagaagtgttgctt

SEQ ID NO: 7108 - DNA, 25 bp, Artificial Sequence
  Synthetic Construct
tgactgcttgttaccacaatatgca

SEQ ID NO: 7109 - DNA, 23 bp, Artificial Sequence
  Synthetic Construct
ggtgttggcacatactgtactca

SEQ ID NO: 7110 - DNA, 25 bp, Artificial Sequence
  Synthetic Construct
gagtctaatttagcgtggggtaact

SEQ ID NO: 7111 - DNA, 24 bp, Artificial Sequence
  Synthetic Construct
ctcattaggcagtcctcccataca

SEQ ID NO: 7112 - DNA, 22 bp, Artificial Sequence
  Synthetic Construct
aaagggggcctctgctctaata

SEQ ID NO: 7113 - DNA, 22 bp, Artificial Sequence
  Synthetic Construct
acaacctggcaaagaaggcatt

SEQ ID NO: 7114 - DNA, 22 bp, Artificial Sequence
  Synthetic Construct
gaggctggaggaaaatgtgagt

SEQ ID NO: 7115 - DNA, 24 bp, Artificial Sequence
  Synthetic Construct
aattgctagccacagtttgcttac

SEQ ID NO: 7116 - DNA, 24 bp, Artificial Sequence
  Synthetic Construct
agactagcctcattcctcccagat

SEQ ID NO: 7117 - DNA, 26 bp, Artificial Sequence
  Synthetic Construct
ggtgaagaagacttaggagtgacatg

SEQ ID NO: 7118 - DNA, 24 bp, Artificial Sequence
  Synthetic Construct
agctcacattctggcaatacatgt

SEQ ID NO: 7119 - DNA, 20 bp, Artificial Sequence
  Synthetic Construct
attgctgctcctggggacaa

SEQ ID NO: 7120 - DNA, 26 bp, Artificial Sequence
  Synthetic Construct
tttattgcccccttcactaaaacatg

SEQ ID NO: 7121 - DNA, 22 bp, Artificial Sequence
  Synthetic Construct
tgctccttcgaggggtctagag

SEQ ID NO: 7122 - DNA, 24 bp, Artificial Sequence
  Synthetic Construct
ctccagggagtgtgaatctgattc

SEQ ID NO: 7123 - DNA, 25 bp, Artificial Sequence
  Synthetic Construct
gctgtagcaagagccactaatatcc

SEQ ID NO: 7124 - DNA, 21 bp, Artificial Sequence
  Synthetic Construct
agggagaaggcactctgagtt

SEQ ID NO: 7125 - DNA, 22 bp, Artificial Sequence
  Synthetic Construct
aggtcctgttttgggagtgcaa

SEQ ID NO: 7126 - DNA, 27 bp, Artificial Sequence
  Synthetic Construct
tgaagtcctaaaattggttttcatgca

SEQ ID NO: 7127 - DNA, 24 bp, Artificial Sequence
  Synthetic Construct
cttcacagtggacccattcattca

SEQ ID NO: 7128 - DNA, 20 bp, Artificial Sequence
  Synthetic Construct
attcagggccaagggctgaa

SEQ ID NO: 7129 - DNA, 23 bp, Artificial Sequence
  Synthetic Construct
gctgtagtgagctgcatgattgt

SEQ ID NO: 7130 - DNA, 24 bp, Artificial Sequence
  Synthetic Construct
tgggggaaattgtcaaacttgtct

SEQ ID NO: 7131 - DNA, 19 bp, Artificial Sequence
  Synthetic Construct
gctgacatgcaggcccaat

SEQ ID NO: 7132 - DNA, 23 bp, Artificial Sequence
  Synthetic Construct
agaaacagaagccagggatcaag

SEQ ID NO: 7133 - DNA, 20 bp, Artificial Sequence
  Synthetic Construct
accaggcagttctccttgtg

SEQ ID NO: 7134 - DNA, 26 bp, Artificial Sequence
  Synthetic Construct
ccaaactcggttatatctcacaaacc

SEQ ID NO: 7135 - DNA, 28 bp, Artificial Sequence
  Synthetic Construct
cctttccaagatcttagcatctctcctt

SEQ ID NO: 7136 - DNA, 22 bp, Artificial Sequence
  Synthetic Construct
tccccagcattgtcgtatcaca

SEQ ID NO: 7137 - DNA, 24 bp, Artificial Sequence
  Synthetic Construct
gctacgataaccaaggcagtctga

SEQ ID NO: 7138 - DNA, 23 bp, Artificial Sequence
  Synthetic Construct
tgggggagagaaggataggagat

SEQ ID NO: 7139 - DNA, 23 bp, Artificial Sequence
  Synthetic Construct
ccagatggaaggaggctaaagga

SEQ ID NO: 7140 - DNA, 24 bp, Artificial Sequence
  Synthetic Construct
ccccgtgtaaacagtccattccaa

SEQ ID NO: 7141 - DNA, 22 bp, Artificial Sequence
  Synthetic Construct
ttgagaaacgtctgtggacaca

SEQ ID NO: 7142 - DNA, 28 bp, Artificial Sequence
  Synthetic Construct
ggacatttgggtttaaccagcctaattc

SEQ ID NO: 7143 - DNA, 21 bp, Artificial Sequence
  Synthetic Construct
tgtacccaggctcccatctca

SEQ ID NO: 7144 - DNA, 25 bp, Artificial Sequence
  Synthetic Construct
cctatgtactgttccttggatccaa

SEQ ID NO: 7145 - DNA, 22 bp, Artificial Sequence
  Synthetic Construct
agcctgcttgagactggatgga

SEQ ID NO: 7146 - DNA, 21 bp, Artificial Sequence
  Synthetic Construct
gggccaggcttttgggaaata

SEQ ID NO: 7147 - DNA, 22 bp, Artificial Sequence
  Synthetic Construct
ccctgtctcttggttgttcctt

SEQ ID NO: 7148 - DNA, 27 bp, Artificial Sequence
  Synthetic Construct
cccctgcttaactaactttgagtcaac

SEQ ID NO: 7149 - DNA, 26 bp, Artificial Sequence
  Synthetic Construct
tgactgtagtgaatggaatgagcatt

SEQ ID NO: 7150 - DNA, 19 bp, Artificial Sequence
  Synthetic Construct
aggggcgtctacgatcact

SEQ ID NO: 7151 - DNA, 18 bp, Artificial Sequence
  Synthetic Construct
gtgcacagccgggatgga

SEQ ID NO: 7152 - DNA, 25 bp, Artificial Sequence
  Synthetic Construct
cagagctctgattggccaagattgg

SEQ ID NO: 7153 - DNA, 22 bp, Artificial Sequence
  Synthetic Construct
catgcccagccactggttatta

SEQ ID NO: 7154 - DNA, 22 bp, Artificial Sequence
  Synthetic Construct
caagactccttcagcagtgaca

SEQ ID NO: 7155 - DNA, 27 bp, Artificial Sequence
  Synthetic Construct
gactcacctccttaagctaatcttacc

SEQ ID NO: 7156 - DNA, 20 bp, Artificial Sequence
  Synthetic Construct
tgccctggcactctctgctt

SEQ ID NO: 7157 - DNA, 24 bp, Artificial Sequence
  Synthetic Construct
tgagaagtagacccagcctgtaac

SEQ ID NO: 7158 - DNA, 24 bp, Artificial Sequence
  Synthetic Construct
cagtgggcaatagattcagcagat

SEQ ID NO: 7159 - DNA, 22 bp, Artificial Sequence
  Synthetic Construct
gtcaccacccattggattgttg

SEQ ID NO: 7160 - DNA, 26 bp, Artificial Sequence
  Synthetic Construct
ctgtaacatgctcttgggatgaagag

SEQ ID NO: 7161 - DNA, 25 bp, Artificial Sequence
  Synthetic Construct
ggtttggctacataacttgctttgg

SEQ ID NO: 7162 - DNA, 23 bp, Artificial Sequence
  Synthetic Construct
agcaagtctcatttcccctttgg

SEQ ID NO: 7163 - DNA, 23 bp, Artificial Sequence
  Synthetic Construct
tcactggacacctgttcatttgg

SEQ ID NO: 7164 - DNA, 24 bp, Artificial Sequence
  Synthetic Construct
aagttttggcagtcaccactttac

SEQ ID NO: 7165 - DNA, 23 bp, Artificial Sequence
  Synthetic Construct
gagactcctgggtcagagatgaa

SEQ ID NO: 7166 - DNA, 22 bp, Artificial Sequence
  Synthetic Construct
ctgaattcacgagcctgtgtca

SEQ ID NO: 7167 - DNA, 24 bp, Artificial Sequence
  Synthetic Construct
atgctacggagggaggtgtataca

SEQ ID NO: 7168 - DNA, 20 bp, Artificial Sequence
  Synthetic Construct
acccatggggcacacattca

SEQ ID NO: 7169 - DNA, 26 bp, Artificial Sequence
  Synthetic Construct
gtgacaatagagaaagcaccatcatc

SEQ ID NO: 7170 - DNA, 24 bp, Artificial Sequence
  Synthetic Construct
cctgaggctgtttcttccagacaa

SEQ ID NO: 7171 - DNA, 25 bp, Artificial Sequence
  Synthetic Construct
ggcttgcttcaataggtgagctact

SEQ ID NO: 7172 - DNA, 29 bp, Artificial Sequence
  Synthetic Construct
gcaaaaccacaatgacaaaaatcaggtat

SEQ ID NO: 7173 - DNA, 22 bp, Artificial Sequence
  Synthetic Construct
gcaagggggagctgtaattgtt

SEQ ID NO: 7174 - DNA, 25 bp, Artificial Sequence
  Synthetic Construct
gttcaaattcaacccccatctgaga

SEQ ID NO: 7175 - DNA, 30 bp, Artificial Sequence
  Synthetic Construct
ggggccaatatttaccagaattatgatggt

SEQ ID NO: 7176 - DNA, 22 bp, Artificial Sequence
  Synthetic Construct
gaggtgaggcagtgaaaccaat

SEQ ID NO: 7177 - DNA, 23 bp, Artificial Sequence
  Synthetic Construct
tcagtctggaacactccttgact

SEQ ID NO: 7178 - DNA, 20 bp, Artificial Sequence
  Synthetic Construct
ggtctggggctagcaattgc

SEQ ID NO: 7179 - DNA, 23 bp, Artificial Sequence
  Synthetic Construct
accctctatcctgggctgaatcc

SEQ ID NO: 7180 - DNA, 27 bp, Artificial Sequence
  Synthetic Construct
aattgagatcagtgttctcttcattcg

SEQ ID NO: 7181 - DNA, 20 bp, Artificial Sequence
  Synthetic Construct
ggagcgtccaggtcacagat

SEQ ID NO: 7182 - DNA, 22 bp, Artificial Sequence
  Synthetic Construct
agggtgacatgtcccaattgca

SEQ ID NO: 7183 - DNA, 25 bp, Artificial Sequence
  Synthetic Construct
gaataccaaccagacaacagacaca

SEQ ID NO: 7184 - DNA, 22 bp, Artificial Sequence
  Synthetic Construct
gaacatgcagcagtttggtgat

SEQ ID NO: 7185 - DNA, 28 bp, Artificial Sequence
  Synthetic Construct
ggtcattttttttccagtggaggatgtg

SEQ ID NO: 7186 - DNA, 24 bp, Artificial Sequence
  Synthetic Construct
ggtgcaccagtacttgatcatagg

SEQ ID NO: 7187 - DNA, 26 bp, Artificial Sequence
  Synthetic Construct
caaggccaatgtctagttaagaagca

SEQ ID NO: 7188 - DNA, 24 bp, Artificial Sequence
  Synthetic Construct
cagcctcattcaccctcatactct

SEQ ID NO: 7189 - DNA, 25 bp, Artificial Sequence
  Synthetic Construct
gtcgtttgcttgctgttttaactgt

SEQ ID NO: 7190 - DNA, 28 bp, Artificial Sequence
  Synthetic Construct
ggctaagctaacgatattccatctctca

SEQ ID NO: 7191 - DNA, 26 bp, Artificial Sequence
  Synthetic Construct
gctatcgatgttgtgaaaggttctgt

SEQ ID NO: 7192 - DNA, 24 bp, Artificial Sequence
  Synthetic Construct
gagggagacttggtaaacaatcca

SEQ ID NO: 7193 - DNA, 26 bp, Artificial Sequence
  Synthetic Construct
gagtctgggaaatgcacaattatggt

SEQ ID NO: 7194 - DNA, 22 bp, Artificial Sequence
  Synthetic Construct
aggctcaggtctcaaccacagt

SEQ ID NO: 7195 - DNA, 26 bp, Artificial Sequence
  Synthetic Construct
ccacatggcacttgatttttgacagt

SEQ ID NO: 7196 - DNA, 20 bp, Artificial Sequence
  Synthetic Construct
gcttcatgctgcacttgctt

SEQ ID NO: 7197 - DNA, 25 bp, Artificial Sequence
  Synthetic Construct
tggttcaacactatagcagaactgt

SEQ ID NO: 7198 - DNA, 23 bp, Artificial Sequence
  Synthetic Construct
gctcaataaccaagcagcacaga

SEQ ID NO: 7199 - DNA, 23 bp, Artificial Sequence
  Synthetic Construct
cattggcaaattggctcactttg

SEQ ID NO: 7200 - DNA, 22 bp, Artificial Sequence
  Synthetic Construct
ggaaggactcccagggaaaaca

SEQ ID NO: 7201 - DNA, 19 bp, Artificial Sequence
  Synthetic Construct
agacgtgtgagggctgtgt

SEQ ID NO: 7202 - DNA, 23 bp, Artificial Sequence
  Synthetic Construct
tcttgttgctcttgaaggcattg

SEQ ID NO: 7203 - DNA, 23 bp, Artificial Sequence
  Synthetic Construct
cagagaggcctgaattcaaacct

SEQ ID NO: 7204 - DNA, 19 bp, Artificial Sequence
  Synthetic Construct
ggcctcactgctggtttca

SEQ ID NO: 7205 - DNA, 21 bp, Artificial Sequence
  Synthetic Construct
tcagtccacagcactcaccat

SEQ ID NO: 7206 - DNA, 23 bp, Artificial Sequence
  Synthetic Construct
ggggagtaatgtgctcttacgtt

SEQ ID NO: 7207 - DNA, 25 bp, Artificial Sequence
  Synthetic Construct
ggagttggttcattctctcgaatgg

SEQ ID NO: 7208 - DNA, 22 bp, Artificial Sequence
  Synthetic Construct
caagatggctgaactgcaaacg

SEQ ID NO: 7209 - DNA, 22 bp, Artificial Sequence
  Synthetic Construct
gcccaaccttgtctgtatcact

SEQ ID NO: 7210 - DNA, 28 bp, Artificial Sequence
  Synthetic Construct
caaacaacttgatttctccaatccaaca

SEQ ID NO: 7211 - DNA, 25 bp, Artificial Sequence
  Synthetic Construct
gcctgaaagtgtacatgcctcttct

SEQ ID NO: 7212 - DNA, 21 bp, Artificial Sequence
  Synthetic Construct
cccacttggccttttctgaca

SEQ ID NO: 7213 - DNA, 24 bp, Artificial Sequence
  Synthetic Construct
cctataggaaacacatggcaagga

SEQ ID NO: 7214 - DNA, 22 bp, Artificial Sequence
  Synthetic Construct
aagtcacagtgcttgacaacct

SEQ ID NO: 7215 - DNA, 21 bp, Artificial Sequence
  Synthetic Construct
tgtggaaagctgccttttggt

SEQ ID NO: 7216 - DNA, 27 bp, Artificial Sequence
  Synthetic Construct
gctgtaatagtaagaggcaccttcttg

SEQ ID NO: 7217 - DNA, 25 bp, Artificial Sequence
  Synthetic Construct
gactgtcagaatgaataggctcctt

SEQ ID NO: 7218 - DNA, 24 bp, Artificial Sequence
  Synthetic Construct
gagagtgacctagggaaactgcta

SEQ ID NO: 7219 - DNA, 24 bp, Artificial Sequence
  Synthetic Construct
gggtaagctgaggcaagtttagga

SEQ ID NO: 7220 - DNA, 22 bp, Artificial Sequence
  Synthetic Construct
tgttcattccccccgtgtacta

SEQ ID NO: 7221 - DNA, 26 bp, Artificial Sequence
  Synthetic Construct
ggatcacaattgtaactcacctttgg

SEQ ID NO: 7222 - DNA, 20 bp, Artificial Sequence
  Synthetic Construct
gcagggagtagcagcaagtt

SEQ ID NO: 7223 - DNA, 24 bp, Artificial Sequence
  Synthetic Construct
gggatgctttagaactgtgcagat

SEQ ID NO: 7224 - DNA, 25 bp, Artificial Sequence
  Synthetic Construct
ggatggagagaagaaatgacccttt

SEQ ID NO: 7225 - DNA, 23 bp, Artificial Sequence
  Synthetic Construct
gcctggaagatgtgtgaattgca

SEQ ID NO: 7226 - DNA, 25 bp, Artificial Sequence
  Synthetic Construct
caccccactagtcactgatacaaag

SEQ ID NO: 7227 - DNA, 22 bp, Artificial Sequence
  Synthetic Construct
accctggagactacacatgtct

SEQ ID NO: 7228 - DNA, 18 bp, Artificial Sequence
  Synthetic Construct
gccttcccgctgcacatg

SEQ ID NO: 7229 - DNA, 18 bp, Artificial Sequence
  Synthetic Construct
caagccacgggggacatg

SEQ ID NO: 7230 - DNA, 22 bp, Artificial Sequence
  Synthetic Construct
accccttccatccgagaatcct

SEQ ID NO: 7231 - DNA, 27 bp, Artificial Sequence
  Synthetic Construct
attataccctgtttgaggtcaaatcct

SEQ ID NO: 7232 - DNA, 22 bp, Artificial Sequence
  Synthetic Construct
gtggaacttgggcagataccaa

SEQ ID NO: 7233 - DNA, 21 bp, Artificial Sequence
  Synthetic Construct
ctcttcctcgttcagccactt

SEQ ID NO: 7234 - DNA, 22 bp, Artificial Sequence
  Synthetic Construct
gggcctagaaacaacagcaatg

SEQ ID NO: 7235 - DNA, 26 bp, Artificial Sequence
  Synthetic Construct
cagaacctattttccaaatgggcatt

SEQ ID NO: 7236 - DNA, 23 bp, Artificial Sequence
  Synthetic Construct
ccacagtctaaggcaagacatgt

SEQ ID NO: 7237 - DNA, 27 bp, Artificial Sequence
  Synthetic Construct
gcaaaggtatggttagaaaagctacgt

SEQ ID NO: 7238 - DNA, 24 bp, Artificial Sequence
  Synthetic Construct
ggaggtgtcaattgggtgctaaga

SEQ ID NO: 7239 - DNA, 27 bp, Artificial Sequence
  Synthetic Construct
acatgtagaatgatcatccaggaccta

SEQ ID NO: 7240 - DNA, 26 bp, Artificial Sequence
  Synthetic Construct
cctttgtataccagttccttctgcat

SEQ ID NO: 7241 - DNA, 22 bp, Artificial Sequence
  Synthetic Construct
gcaaccatccaaggactctgat

SEQ ID NO: 7242 - DNA, 22 bp, Artificial Sequence
  Synthetic Construct
tccaccctgagctcttcctgtt

SEQ ID NO: 7243 - DNA, 24 bp, Artificial Sequence
  Synthetic Construct
gcatggccaagtcactccagaaaa

SEQ ID NO: 7244 - DNA, 24 bp, Artificial Sequence
  Synthetic Construct
tgttgccaaaagttgctcagtaag

SEQ ID NO: 7245 - DNA, 21 bp, Artificial Sequence
  Synthetic Construct
tcgtcctcctgagctcaagga

SEQ ID NO: 7246 - DNA, 26 bp, Artificial Sequence
  Synthetic Construct
agggatacacaacaccatttaaacct

SEQ ID NO: 7247 - DNA, 22 bp, Artificial Sequence
  Synthetic Construct
agcttccccaagggcatctgaa

SEQ ID NO: 7248 - DNA, 23 bp, Artificial Sequence
  Synthetic Construct
ccaaggccaagagcaacttatgg

SEQ ID NO: 7249 - DNA, 20 bp, Artificial Sequence
  Synthetic Construct
accagccttggggaaatgga

SEQ ID NO: 7250 - DNA, 22 bp, Artificial Sequence
  Synthetic Construct
ggtttccccaatacccagttca

SEQ ID NO: 7251 - DNA, 22 bp, Artificial Sequence
  Synthetic Construct
agaacctggccatctcttccat

SEQ ID NO: 7252 - DNA, 21 bp, Artificial Sequence
  Synthetic Construct
ccaggggttggcaaacttgtt

SEQ ID NO: 7253 - DNA, 25 bp, Artificial Sequence
  Synthetic Construct
ggaggtaaacaccatccctgattag

SEQ ID NO: 7254 - DNA, 25 bp, Artificial Sequence
  Synthetic Construct
ggtaaaagctcctctctctcgtaga

SEQ ID NO: 7255 - DNA, 19 bp, Artificial Sequence
  Synthetic Construct
agcctgggatgctccacta

SEQ ID NO: 7256 - DNA, 21 bp, Artificial Sequence
  Synthetic Construct
tgggaggtgcaaaggctttgt

SEQ ID NO: 7257 - DNA, 22 bp, Artificial Sequence
  Synthetic Construct
cgaatgccacacatgtcatggt

SEQ ID NO: 7258 - DNA, 21 bp, Artificial Sequence
  Synthetic Construct
actccatgccatccagactct

SEQ ID NO: 7259 - DNA, 22 bp, Artificial Sequence
  Synthetic Construct
tgagaaaggctggcatgactct

SEQ ID NO: 7260 - DNA, 26 bp, Artificial Sequence
  Synthetic Construct
cagcaactcaatttttattggccaaa

SEQ ID NO: 7261 - DNA, 26 bp, Artificial Sequence
  Synthetic Construct
gattggcctactgcataattccctat

SEQ ID NO: 7262 - DNA, 24 bp, Artificial Sequence
  Synthetic Construct
ggaactagccaggctggaatatca

SEQ ID NO: 7263 - DNA, 22 bp, Artificial Sequence
  Synthetic Construct
ggaatggggcttctcgttcatt

SEQ ID NO: 7264 - DNA, 25 bp, Artificial Sequence
  Synthetic Construct
ctaattcaccccaatgtcagaggaa

SEQ ID NO: 7265 - DNA, 22 bp, Artificial Sequence
  Synthetic Construct
cggctaacacattgcaggaatg

SEQ ID NO: 7266 - DNA, 22 bp, Artificial Sequence
  Synthetic Construct
gcagcaaccatcttcacaaggt

SEQ ID NO: 7267 - DNA, 21 bp, Artificial Sequence
  Synthetic Construct
ggaggagcaagggtggaagta

SEQ ID NO: 7268 - DNA, 24 bp, Artificial Sequence
  Synthetic Construct
tgtggcagaaatagatcccatgtc

SEQ ID NO: 7269 - DNA, 26 bp, Artificial Sequence
  Synthetic Construct
ccatctgcttatgtgacagagaccaa

SEQ ID NO: 7270 - DNA, 21 bp, Artificial Sequence
  Synthetic Construct
cccattgcctacaacggtcat

SEQ ID NO: 7271 - DNA, 26 bp, Artificial Sequence
  Synthetic Construct
cgctagtccagattttagtgtaatgc

SEQ ID NO: 7272 - DNA, 22 bp, Artificial Sequence
  Synthetic Construct
tgaaaaaccctggttgccagtt

SEQ ID NO: 7273 - DNA, 20 bp, Artificial Sequence
  Synthetic Construct
gcctcacagggctgacatgt

SEQ ID NO: 7274 - DNA, 25 bp, Artificial Sequence
  Synthetic Construct
tgatggtttaaaacgtggaggaaac

SEQ ID NO: 7275 - DNA, 23 bp, Artificial Sequence
  Synthetic Construct
gcaggctgtcgctacgttttctt

SEQ ID NO: 7276 - DNA, 24 bp, Artificial Sequence
  Synthetic Construct
ggggtaaaaggaggttatcaagca

SEQ ID NO: 7277 - DNA, 22 bp, Artificial Sequence
  Synthetic Construct
gcctgcctggaaatctcagtct

SEQ ID NO: 7278 - DNA, 25 bp, Artificial Sequence
  Synthetic Construct
gtgatgagcacaggttattctgaca

SEQ ID NO: 7279 - DNA, 22 bp, Artificial Sequence
  Synthetic Construct
gccatgctttcattggcaaagg

SEQ ID NO: 7280 - DNA, 25 bp, Artificial Sequence
  Synthetic Construct
gatgactaagttgccttgtgagtct

SEQ ID NO: 7281 - DNA, 24 bp, Artificial Sequence
  Synthetic Construct
ctgtgagcaagtggagaggtatca

SEQ ID NO: 7282 - DNA, 21 bp, Artificial Sequence
  Synthetic Construct
tggcagcttttcgctctggtt

SEQ ID NO: 7283 - DNA, 20 bp, Artificial Sequence
  Synthetic Construct
cccgcctgtgtgactcaaac

SEQ ID NO: 7284 - DNA, 24 bp, Artificial Sequence
  Synthetic Construct
ccgtaggtgggagttcatgtctta

SEQ ID NO: 7285 - DNA, 20 bp, Artificial Sequence
  Synthetic Construct
ccccatggcaccaacttaca

SEQ ID NO: 7286 - DNA, 21 bp, Artificial Sequence
  Synthetic Construct
aggtggcacataggagctgaa

SEQ ID NO: 7287 - DNA, 25 bp, Artificial Sequence
  Synthetic Construct
caaaaggagaggtaaaccctgttct

SEQ ID NO: 7288 - DNA, 20 bp, Artificial Sequence
  Synthetic Construct
aggttctgatggcccagaga

SEQ ID NO: 7289 - DNA, 24 bp, Artificial Sequence
  Synthetic Construct
gggtaagtggcttatccaagttca

SEQ ID NO: 7290 - DNA, 24 bp, Artificial Sequence
  Synthetic Construct
cctgatccatcttgctcccttttc

SEQ ID NO: 7291 - DNA, 21 bp, Artificial Sequence
  Synthetic Construct
ttcacccccatgacccagaca

SEQ ID NO: 7292 - DNA, 24 bp, Artificial Sequence
  Synthetic Construct
tccaagggtcctgagtgtatccta

SEQ ID NO: 7293 - DNA, 28 bp, Artificial Sequence
  Synthetic Construct
gtgaaacaattcaagggtcattgatctg

SEQ ID NO: 7294 - DNA, 23 bp, Artificial Sequence
  Synthetic Construct
ctgagttgccctggacaacagtt

SEQ ID NO: 7295 - DNA, 26 bp, Artificial Sequence
  Synthetic Construct
caaggttcttcagctgacacttaaag

SEQ ID NO: 7296 - DNA, 18 bp, Artificial Sequence
  Synthetic Construct
ctggagcccaccctctgt

SEQ ID NO: 7297 - DNA, 22 bp, Artificial Sequence
  Synthetic Construct
gtgggggtgttatttggtgtca

SEQ ID NO: 7298 - DNA, 23 bp, Artificial Sequence
  Synthetic Construct
tggacacagaatcagcattccat

SEQ ID NO: 7299 - DNA, 26 bp, Artificial Sequence
  Synthetic Construct
tttactggtggtagattagccaagag

SEQ ID NO: 7300 - DNA, 23 bp, Artificial Sequence
  Synthetic Construct
ccacctgcatttctttgctgtgt

SEQ ID NO: 7301 - DNA, 21 bp, Artificial Sequence
  Synthetic Construct
agctgtgggaaaagggtcctt

SEQ ID NO: 7302 - DNA, 19 bp, Artificial Sequence
  Synthetic Construct
atgcccggcttgttgttgt

SEQ ID NO: 7303 - DNA, 22 bp, Artificial Sequence
  Synthetic Construct
ctcttccgtcctttggagttga

SEQ ID NO: 7304 - DNA, 22 bp, Artificial Sequence
  Synthetic Construct
gctgcccggtgtcaagataata

SEQ ID NO: 7305 - DNA, 26 bp, Artificial Sequence
  Synthetic Construct
agtcttggttatcaggtccttaggat

SEQ ID NO: 7306 - DNA, 22 bp, Artificial Sequence
  Synthetic Construct
atgcaaagaactctgggaagct

SEQ ID NO: 7307 - DNA, 25 bp, Artificial Sequence
  Synthetic Construct
ctgaaggatgattgggaaaggttga

SEQ ID NO: 7308 - DNA, 23 bp, Artificial Sequence
  Synthetic Construct
cgattttgccaagggaaattgct

SEQ ID NO: 7309 - DNA, 26 bp, Artificial Sequence
  Synthetic Construct
gctttgtgtatgcaagagtggtacca

SEQ ID NO: 7310 - DNA, 25 bp, Artificial Sequence
  Synthetic Construct
tctcacatagtgttgtgcctttact

SEQ ID NO: 7311 - DNA, 26 bp, Artificial Sequence
  Synthetic Construct
gagtaagtggagcaggttttaaatgg

SEQ ID NO: 7312 - DNA, 22 bp, Artificial Sequence
  Synthetic Construct
cacacattggcacatggtcaca

SEQ ID NO: 7313 - DNA, 22 bp, Artificial Sequence
  Synthetic Construct
atagcctcctcacctcatctgt

SEQ ID NO: 7314 - DNA, 25 bp, Artificial Sequence
  Synthetic Construct
gggtacacagcaaacttctcttgtc

SEQ ID NO: 7315 - DNA, 22 bp, Artificial Sequence
  Synthetic Construct
agcgtggagaggatctgtaagt

SEQ ID NO: 7316 - DNA, 27 bp, Artificial Sequence
  Synthetic Construct
actggttgctgagtatatccactatac

SEQ ID NO: 7317 - DNA, 24 bp, Artificial Sequence
  Synthetic Construct
acgtacactaaggatgggatagct

SEQ ID NO: 7318 - DNA, 24 bp, Artificial Sequence
  Synthetic Construct
gatccatacctgtgagggaggtaa

SEQ ID NO: 7319 - DNA, 24 bp, Artificial Sequence
  Synthetic Construct
tctactcttgccactgaaattgct

SEQ ID NO: 7320 - DNA, 21 bp, Artificial Sequence
  Synthetic Construct
gggggaggaaatgagcttcaa

SEQ ID NO: 7321 - DNA, 19 bp, Artificial Sequence
  Synthetic Construct
accccctgcccatatcaca

SEQ ID NO: 7322 - DNA, 23 bp, Artificial Sequence
  Synthetic Construct
cctgccctattctgtaactgcaa

SEQ ID NO: 7323 - DNA, 26 bp, Artificial Sequence
  Synthetic Construct
gctttcagacaacagttctagacaca

SEQ ID NO: 7324 - DNA, 22 bp, Artificial Sequence
  Synthetic Construct
cataatgcttgcatggctgtca

SEQ ID NO: 7325 - DNA, 27 bp, Artificial Sequence
  Synthetic Construct
ggctagtcaaaagaaaggtaggaatgg

SEQ ID NO: 7326 - DNA, 22 bp, Artificial Sequence
  Synthetic Construct
aagcatcgcagaagaggcatct

SEQ ID NO: 7327 - DNA, 24 bp, Artificial Sequence
  Synthetic Construct
gcttggaaaggaggggttggaaaa

SEQ ID NO: 7328 - DNA, 26 bp, Artificial Sequence
  Synthetic Construct
tggagagcttattcaatctccactac

SEQ ID NO: 7329 - DNA, 23 bp, Artificial Sequence
  Synthetic Construct
agaagcatcagaacaggttcaca

SEQ ID NO: 7330 - DNA, 19 bp, Artificial Sequence
  Synthetic Construct
ccccggcttgagaactgtt

SEQ ID NO: 7331 - DNA, 21 bp, Artificial Sequence
  Synthetic Construct
agctgagagaatggggacagt

SEQ ID NO: 7332 - DNA, 29 bp, Artificial Sequence
  Synthetic Construct
tcacggtaatcagtcatttacatttctct

SEQ ID NO: 7333 - DNA, 25 bp, Artificial Sequence
  Synthetic Construct
cacatacaacaggctgttagaggaa

SEQ ID NO: 7334 - DNA, 21 bp, Artificial Sequence
  Synthetic Construct
tggacttctggacccagcttt

SEQ ID NO: 7335 - DNA, 25 bp, Artificial Sequence
  Synthetic Construct
tcaaggtcataatgcacacttttgc

SEQ ID NO: 7336 - DNA, 26 bp, Artificial Sequence
  Synthetic Construct
gagatttcatgacaatggtcctcagt

SEQ ID NO: 7337 - DNA, 26 bp, Artificial Sequence
  Synthetic Construct
attacattgatggggattgttttgca

SEQ ID NO: 7338 - DNA, 24 bp, Artificial Sequence
  Synthetic Construct
aggacccaaactaggtctctttct

SEQ ID NO: 7339 - DNA, 23 bp, Artificial Sequence
  Synthetic Construct
cattggtccttcaaccttgcttt

SEQ ID NO: 7340 - DNA, 25 bp, Artificial Sequence
  Synthetic Construct
gacagacaaaagtctatggcatcca

SEQ ID NO: 7341 - DNA, 22 bp, Artificial Sequence
  Synthetic Construct
caggtgtgcatggagatgtttg

SEQ ID NO: 7342 - DNA, 23 bp, Artificial Sequence
  Synthetic Construct
ttggagctagggaagtggaggat

SEQ ID NO: 7343 - DNA, 24 bp, Artificial Sequence
  Synthetic Construct
ggggatacaagaaggcacaaagct

SEQ ID NO: 7344 - DNA, 19 bp, Artificial Sequence
  Synthetic Construct
tgcacagcctcagcatcct

SEQ ID NO: 7345 - DNA, 24 bp, Artificial Sequence
  Synthetic Construct
gcaaggaagtttgtccagtatgca

SEQ ID NO: 7346 - DNA, 21 bp, Artificial Sequence
  Synthetic Construct
aaggccaaaggtgggagcaat

SEQ ID NO: 7347 - DNA, 25 bp, Artificial Sequence
  Synthetic Construct
gtctgagagaggagcagtctatact

SEQ ID NO: 7348 - DNA, 24 bp, Artificial Sequence
  Synthetic Construct
gctccaccccaagatgttgttgaa

SEQ ID NO: 7349 - DNA, 23 bp, Artificial Sequence
  Synthetic Construct
cccatgagtgacattctgcagta

SEQ ID NO: 7350 - DNA, 21 bp, Artificial Sequence
  Synthetic Construct
accagtgggtatgctcagtct

SEQ ID NO: 7351 - DNA, 25 bp, Artificial Sequence
  Synthetic Construct
cagttagagaaaagtgtggcttcct

SEQ ID NO: 7352 - DNA, 21 bp, Artificial Sequence
  Synthetic Construct
aacccacactgccacgtttct

SEQ ID NO: 7353 - DNA, 25 bp, Artificial Sequence
  Synthetic Construct
gagagtgacaggaagtgaagtctga

SEQ ID NO: 7354 - DNA, 22 bp, Artificial Sequence
  Synthetic Construct
accaaggcctactggtttttcc

SEQ ID NO: 7355 - DNA, 24 bp, Artificial Sequence
  Synthetic Construct
ggttttaagcactggcaggaccat

SEQ ID NO: 7356 - DNA, 24 bp, Artificial Sequence
  Synthetic Construct
catgtctgtttgcctagtcaccaa

SEQ ID NO: 7357 - DNA, 23 bp, Artificial Sequence
  Synthetic Construct
gcactagaacatcaacgcatctg

SEQ ID NO: 7358 - DNA, 24 bp, Artificial Sequence
  Synthetic Construct
ggcctagagttgcaaccttacgaa

SEQ ID NO: 7359 - DNA, 22 bp, Artificial Sequence
  Synthetic Construct
agttccctctctgctcttttgc

SEQ ID NO: 7360 - DNA, 25 bp, Artificial Sequence
  Synthetic Construct
gggacatatgttgcaggtagagcta

SEQ ID NO: 7361 - DNA, 21 bp, Artificial Sequence
  Synthetic Construct
tcagcctaccacactcacact

SEQ ID NO: 7362 - DNA, 22 bp, Artificial Sequence
  Synthetic Construct
ccacaccagtttttgcggcaaa

SEQ ID NO: 7363 - DNA, 24 bp, Artificial Sequence
  Synthetic Construct
agactagggggagacagaaaagtc

SEQ ID NO: 7364 - DNA, 24 bp, Artificial Sequence
  Synthetic Construct
caaggagaatgtgccccttctaaa

SEQ ID NO: 7365 - DNA, 23 bp, Artificial Sequence
  Synthetic Construct
gaggtgtgttgattgtgctacct

SEQ ID NO: 7366 - DNA, 22 bp, Artificial Sequence
  Synthetic Construct
cgtggcaagtacctcacaactt

SEQ ID NO: 7367 - DNA, 27 bp, Artificial Sequence
  Synthetic Construct
cgcttttatctggaatcaggaatgttg

SEQ ID NO: 7368 - DNA, 22 bp, Artificial Sequence
  Synthetic Construct
cagcgcttaaccagacctaagt

SEQ ID NO: 7369 - DNA, 23 bp, Artificial Sequence
  Synthetic Construct
gggccttatcaaagcctttcaca

SEQ ID NO: 7370 - DNA, 24 bp, Artificial Sequence
  Synthetic Construct
gctctttgagaagacagcctccat

SEQ ID NO: 7371 - DNA, 24 bp, Artificial Sequence
  Synthetic Construct
agctggagcacttgagtcatatcc

SEQ ID NO: 7372 - DNA, 25 bp, Artificial Sequence
  Synthetic Construct
caacagtgcctatttcaaggtgttg

SEQ ID NO: 7373 - DNA, 25 bp, Artificial Sequence
  Synthetic Construct
gatgaagccaacattattgctagct

SEQ ID NO: 7374 - DNA, 24 bp, Artificial Sequence
  Synthetic Construct
ggacattggggggattggaaaaag

SEQ ID NO: 7375 - DNA, 20 bp, Artificial Sequence
  Synthetic Construct
gggctctgatggcattgtga

SEQ ID NO: 7376 - DNA, 22 bp, Artificial Sequence
  Synthetic Construct
cctgtgacaaagaggcaatgct

SEQ ID NO: 7377 - DNA, 22 bp, Artificial Sequence
  Synthetic Construct
ccacaagcagtttgagctacct

SEQ ID NO: 7378 - DNA, 26 bp, Artificial Sequence
  Synthetic Construct
ccaagtccttacaacattgcctctca

SEQ ID NO: 7379 - DNA, 20 bp, Artificial Sequence
  Synthetic Construct
gtcacactcaaccccttgca

SEQ ID NO: 7380 - DNA, 25 bp, Artificial Sequence
  Synthetic Construct
ccatatcatccatggtgcagaagac

SEQ ID NO: 7381 - DNA, 23 bp, Artificial Sequence
  Synthetic Construct
ttcaaacgcacagcttgggactt

SEQ ID NO: 7382 - DNA, 21 bp, Artificial Sequence
  Synthetic Construct
tccctgagagctggtgatgag

SEQ ID NO: 7383 - DNA, 21 bp, Artificial Sequence
  Synthetic Construct
ttcccagtctgagctcttgca

SEQ ID NO: 7384 - DNA, 22 bp, Artificial Sequence
  Synthetic Construct
ggccttttcccactgtgattgt

SEQ ID NO: 7385 - DNA, 25 bp, Artificial Sequence
  Synthetic Construct
gttggtgactgattcgattgaggta

SEQ ID NO: 7386 - DNA, 21 bp, Artificial Sequence
  Synthetic Construct
tctcgccagcattgtcctctt

SEQ ID NO: 7387 - DNA, 27 bp, Artificial Sequence
  Synthetic Construct
ggagataatgtgtttacaggagtgtct

SEQ ID NO: 7388 - DNA, 27 bp, Artificial Sequence
  Synthetic Construct
gcacacaaacttctgctcatttttagc

SEQ ID NO: 7389 - DNA, 23 bp, Artificial Sequence
  Synthetic Construct
ctgacaggcacatctaagaagct

SEQ ID NO: 7390 - DNA, 19 bp, Artificial Sequence
  Synthetic Construct
gctccgagggaaaggcatt

SEQ ID NO: 7391 - DNA, 20 bp, Artificial Sequence
  Synthetic Construct
agcagatgggcctgttccaa

SEQ ID NO: 7392 - DNA, 22 bp, Artificial Sequence
  Synthetic Construct
ctagacagtgtggctggaacat

SEQ ID NO: 7393 - DNA, 22 bp, Artificial Sequence
  Synthetic Construct
cctgtgagctgggccatttttt

SEQ ID NO: 7394 - DNA, 22 bp, Artificial Sequence
  Synthetic Construct
ggtggcatgctgaaatcagaag

SEQ ID NO: 7395 - DNA, 27 bp, Artificial Sequence
  Synthetic Construct
cccaaaaaagatggaacagcctttgtc

SEQ ID NO: 7396 - DNA, 21 bp, Artificial Sequence
  Synthetic Construct
tcttgaacagtgtgccatgct

SEQ ID NO: 7397 - DNA, 22 bp, Artificial Sequence
  Synthetic Construct
tgaacatcttggtggggagaca

SEQ ID NO: 7398 - DNA, 25 bp, Artificial Sequence
  Synthetic Construct
gttcaggaaacacttgctagaggaa

SEQ ID NO: 7399 - DNA, 23 bp, Artificial Sequence
  Synthetic Construct
cagaaagttcatgcactgccttt

SEQ ID NO: 7400 - DNA, 20 bp, Artificial Sequence
  Synthetic Construct
agaaggctgagtggggagtt

SEQ ID NO: 7401 - DNA, 22 bp, Artificial Sequence
  Synthetic Construct
gccaacagcacttgtcatacca

SEQ ID NO: 7402 - DNA, 24 bp, Artificial Sequence
  Synthetic Construct
ggccgggtagaatatgatcagaca

SEQ ID NO: 7403 - DNA, 22 bp, Artificial Sequence
  Synthetic Construct
tgggcttgcaacagttggaact

SEQ ID NO: 7404 - DNA, 23 bp, Artificial Sequence
  Synthetic Construct
tgggaggaacttgctggttttgg

SEQ ID NO: 7405 - DNA, 21 bp, Artificial Sequence
  Synthetic Construct
tggctggaggttgtgatttgg

SEQ ID NO: 7406 - DNA, 21 bp, Artificial Sequence
  Synthetic Construct
tgtgggggctaatggtttcct

SEQ ID NO: 7407 - DNA, 29 bp, Artificial Sequence
  Synthetic Construct
ggaaggaatcactagtacttctagcctat

SEQ ID NO: 7408 - DNA, 22 bp, Artificial Sequence
  Synthetic Construct
agcatacaagcaaccaggtgaa

SEQ ID NO: 7409 - DNA, 27 bp, Artificial Sequence
  Synthetic Construct
tggatagaccgttctatgccatatcta

SEQ ID NO: 7410 - DNA, 23 bp, Artificial Sequence
  Synthetic Construct
ggataacaaggggccagatagtg

SEQ ID NO: 7411 - DNA, 18 bp, Artificial Sequence
  Synthetic Construct
gcggggggtctactcaga

SEQ ID NO: 7412 - DNA, 30 bp, Artificial Sequence
  Synthetic Construct
catgagaaataataagtcattgctgcttca

SEQ ID NO: 7413 - DNA, 24 bp, Artificial Sequence
  Synthetic Construct
ggtggaagaatgaggctgtacctt

SEQ ID NO: 7414 - DNA, 28 bp, Artificial Sequence
  Synthetic Construct
caaagactgtatcctccataaagcctaa

SEQ ID NO: 7415 - DNA, 24 bp, Artificial Sequence
  Synthetic Construct
atgtgaaggtagaagcatgtgtct

SEQ ID NO: 7416 - DNA, 19 bp, Artificial Sequence
  Synthetic Construct
tccctcgctcatcccactt

SEQ ID NO: 7417 - DNA, 24 bp, Artificial Sequence
  Synthetic Construct
agcttttgacaggacctcattcaa

SEQ ID NO: 7418 - DNA, 20 bp, Artificial Sequence
  Synthetic Construct
ccgatccaagttgccatcct

SEQ ID NO: 7419 - DNA, 22 bp, Artificial Sequence
  Synthetic Construct
tgctgcaggggttttggtgata

SEQ ID NO: 7420 - DNA, 26 bp, Artificial Sequence
  Synthetic Construct
tgagcagtgacattgtagttaaagct

SEQ ID NO: 7421 - DNA, 24 bp, Artificial Sequence
  Synthetic Construct
agggactgaggaacagcagtaatg

SEQ ID NO: 7422 - DNA, 22 bp, Artificial Sequence
  Synthetic Construct
ggcagcttccaggagtaaagag

SEQ ID NO: 7423 - DNA, 24 bp, Artificial Sequence
  Synthetic Construct
tgatggtcacacagctctcatagg

SEQ ID NO: 7424 - DNA, 20 bp, Artificial Sequence
  Synthetic Construct
tgactgcagggtgtgactgt

SEQ ID NO: 7425 - DNA, 21 bp, Artificial Sequence
  Synthetic Construct
ccacatgctaggctgggtaga

SEQ ID NO: 7426 - DNA, 24 bp, Artificial Sequence
  Synthetic Construct
ccagatggagtggggtaaaatcac

SEQ ID NO: 7427 - DNA, 20 bp, Artificial Sequence
  Synthetic Construct
cagttggcaagctggagact

SEQ ID NO: 7428 - DNA, 22 bp, Artificial Sequence
  Synthetic Construct
ttgtccctgagtcagtggctta

SEQ ID NO: 7429 - DNA, 25 bp, Artificial Sequence
  Synthetic Construct
cctcaagccctcttagtaggcataa

SEQ ID NO: 7430 - DNA, 22 bp, Artificial Sequence
  Synthetic Construct
ctggtccagtcctttcttgctt

SEQ ID NO: 7431 - DNA, 25 bp, Artificial Sequence
  Synthetic Construct
ccctgtcctttactcctaagagtct

SEQ ID NO: 7432 - DNA, 22 bp, Artificial Sequence
  Synthetic Construct
tccacagttcagctcagtcact

SEQ ID NO: 7433 - DNA, 26 bp, Artificial Sequence
  Synthetic Construct
cactgctccattttggcttatgtttt

SEQ ID NO: 7434 - DNA, 25 bp, Artificial Sequence
  Synthetic Construct
cctgctgaacaccttggttatagtg

SEQ ID NO: 7435 - DNA, 22 bp, Artificial Sequence
  Synthetic Construct
tgggttgtggggattggagaga

SEQ ID NO: 7436 - DNA, 20 bp, Artificial Sequence
  Synthetic Construct
cggtgcagaggatggtgtga

SEQ ID NO: 7437 - DNA, 22 bp, Artificial Sequence
  Synthetic Construct
ttctgtcacccccacacacttg

SEQ ID NO: 7438 - DNA, 22 bp, Artificial Sequence
  Synthetic Construct
cgatggaggcagattgtagcaa

SEQ ID NO: 7439 - DNA, 24 bp, Artificial Sequence
  Synthetic Construct
ctgttgcatgttgcttgaggctat

SEQ ID NO: 7440 - DNA, 25 bp, Artificial Sequence
  Synthetic Construct
caaaccttgcaggtctgaccttcat

SEQ ID NO: 7441 - DNA, 24 bp, Artificial Sequence
  Synthetic Construct
tcaacacctgagaaagactgttca

SEQ ID NO: 7442 - DNA, 26 bp, Artificial Sequence
  Synthetic Construct
gactctccagttagatggaccaagag

SEQ ID NO: 7443 - DNA, 27 bp, Artificial Sequence
  Synthetic Construct
ggttaaggagacagaatgttaccagtt

SEQ ID NO: 7444 - DNA, 19 bp, Artificial Sequence
  Synthetic Construct
tggcatggcagtggcagaa

SEQ ID NO: 7445 - DNA, 25 bp, Artificial Sequence
  Synthetic Construct
gttcccagagagtggtttatactgt

SEQ ID NO: 7446 - DNA, 24 bp, Artificial Sequence
  Synthetic Construct
cctctcagaatgcaaatggtagga

SEQ ID NO: 7447 - DNA, 22 bp, Artificial Sequence
  Synthetic Construct
tgcaacgaactttctcctccat

SEQ ID NO: 7448 - DNA, 21 bp, Artificial Sequence
  Synthetic Construct
aagtcacaggggtggtttcca

SEQ ID NO: 7449 - DNA, 26 bp, Artificial Sequence
  Synthetic Construct
gcaaagtccttacgaagtgagatgga

SEQ ID NO: 7450 - DNA, 25 bp, Artificial Sequence
  Synthetic Construct
ggctgtgcatcttagggtcatgata

SEQ ID NO: 7451 - DNA, 22 bp, Artificial Sequence
  Synthetic Construct
cttaagttggacgcagctgtct

SEQ ID NO: 7452 - DNA, 22 bp, Artificial Sequence
  Synthetic Construct
accaacatgcaaacaggacaca

SEQ ID NO: 7453 - DNA, 21 bp, Artificial Sequence
  Synthetic Construct
tcacgcagcctatgagtaggt

SEQ ID NO: 7454 - DNA, 21 bp, Artificial Sequence
  Synthetic Construct
ggctctatcccttgccccaat

SEQ ID NO: 7455 - DNA, 20 bp, Artificial Sequence
  Synthetic Construct
aacgcacagagcctgacttg

SEQ ID NO: 7456 - DNA, 22 bp, Artificial Sequence
  Synthetic Construct
tgtgtcacagtctgccaaccta

SEQ ID NO: 7457 - DNA, 23 bp, Artificial Sequence
  Synthetic Construct
ggccatcatccaattagggtttg

SEQ ID NO: 7458 - DNA, 26 bp, Artificial Sequence
  Synthetic Construct
cagtgttatcttaatgggagcaccta

SEQ ID NO: 7459 - DNA, 27 bp, Artificial Sequence
  Synthetic Construct
cccagctgtatctcaacaggtaagaag

SEQ ID NO: 7460 - DNA, 21 bp, Artificial Sequence
  Synthetic Construct
aggacccagcactctgaggaa

SEQ ID NO: 7461 - DNA, 27 bp, Artificial Sequence
  Synthetic Construct
ggactgcaaaagactgaatgataaggt

SEQ ID NO: 7462 - DNA, 24 bp, Artificial Sequence
  Synthetic Construct
agtggcttataggtccctaatgca

SEQ ID NO: 7463 - DNA, 22 bp, Artificial Sequence
  Synthetic Construct
tccgttttcagggctgggataa

SEQ ID NO: 7464 - DNA, 23 bp, Artificial Sequence
  Synthetic Construct
cctgggtaagctgtcagtagcat

SEQ ID NO: 7465 - DNA, 24 bp, Artificial Sequence
  Synthetic Construct
gttcagagctttgcctagatctca

SEQ ID NO: 7466 - DNA, 21 bp, Artificial Sequence
  Synthetic Construct
gcagggcagaagctacacaga

SEQ ID NO: 7467 - DNA, 29 bp, Artificial Sequence
  Synthetic Construct
acaaactacatgtaaaggcaggatagtag

SEQ ID NO: 7468 - DNA, 24 bp, Artificial Sequence
  Synthetic Construct
caaattgcctggcttcacattctg

SEQ ID NO: 7469 - DNA, 23 bp, Artificial Sequence
  Synthetic Construct
tctcacctcactgtcatctctgt

SEQ ID NO: 7470 - DNA, 21 bp, Artificial Sequence
  Synthetic Construct
tcaggcctcactgagacatca

SEQ ID NO: 7471 - DNA, 20 bp, Artificial Sequence
  Synthetic Construct
ttcagcatgctcgccactac

SEQ ID NO: 7472 - DNA, 22 bp, Artificial Sequence
  Synthetic Construct
agcactggtctggaagtgagat

SEQ ID NO: 7473 - DNA, 19 bp, Artificial Sequence
  Synthetic Construct
ccacagcccacgctactgt

SEQ ID NO: 7474 - DNA, 20 bp, Artificial Sequence
  Synthetic Construct
gctctcctccctcccagtct

SEQ ID NO: 7475 - DNA, 21 bp, Artificial Sequence
  Synthetic Construct
tccctccacccatcttatgca

SEQ ID NO: 7476 - DNA, 23 bp, Artificial Sequence
  Synthetic Construct
tgctttggcatagtctccatctc

SEQ ID NO: 7477 - DNA, 23 bp, Artificial Sequence
  Synthetic Construct
tggagactggtcatgtacacaca

SEQ ID NO: 7478 - DNA, 25 bp, Artificial Sequence
  Synthetic Construct
ggtaatggcaaaagttcctcatgag

SEQ ID NO: 7479 - DNA, 22 bp, Artificial Sequence
  Synthetic Construct
accaggaccacagttggaatcc

SEQ ID NO: 7480 - DNA, 23 bp, Artificial Sequence
  Synthetic Construct
tcctgtgattgctttccctttga

SEQ ID NO: 7481 - DNA, 22 bp, Artificial Sequence
  Synthetic Construct
agcagcaagtacagccatagag

SEQ ID NO: 7482 - DNA, 25 bp, Artificial Sequence
  Synthetic Construct
aaaccacaattatcccccaaaacac

SEQ ID NO: 7483 - DNA, 21 bp, Artificial Sequence
  Synthetic Construct
agctgtctgtgcactgatgtg

SEQ ID NO: 7484 - DNA, 24 bp, Artificial Sequence
  Synthetic Construct
gccctcactcttcagggacaatag

SEQ ID NO: 7485 - DNA, 19 bp, Artificial Sequence
  Synthetic Construct
ccgggtcaagcctgtgaca

SEQ ID NO: 7486 - DNA, 23 bp, Artificial Sequence
  Synthetic Construct
gtctctgggaagttgcatgtaca

SEQ ID NO: 7487 - DNA, 21 bp, Artificial Sequence
  Synthetic Construct
atcctgggacaccggtagcat

SEQ ID NO: 7488 - DNA, 20 bp, Artificial Sequence
  Synthetic Construct
aagcagggctgtgagttgtg

SEQ ID NO: 7489 - DNA, 23 bp, Artificial Sequence
  Synthetic Construct
accgagggtgtctttatcaaggt

SEQ ID NO: 7490 - DNA, 21 bp, Artificial Sequence
  Synthetic Construct
agaaggccacgtgtcacaaga

SEQ ID NO: 7491 - DNA, 22 bp, Artificial Sequence
  Synthetic Construct
ggcgagagagacaaaggattca

SEQ ID NO: 7492 - DNA, 24 bp, Artificial Sequence
  Synthetic Construct
gtgtgtgtgtttatccaggttcac

SEQ ID NO: 7493 - DNA, 19 bp, Artificial Sequence
  Synthetic Construct
gccaggctgcacagatcag

SEQ ID NO: 7494 - DNA, 21 bp, Artificial Sequence
  Synthetic Construct
tgctgagacggtggatttgtg

SEQ ID NO: 7495 - DNA, 22 bp, Artificial Sequence
  Synthetic Construct
agacagatgggtgcatcaagga

SEQ ID NO: 7496 - DNA, 22 bp, Artificial Sequence
  Synthetic Construct
tgccagtgcatttgaaggatga

SEQ ID NO: 7497 - DNA, 22 bp, Artificial Sequence
  Synthetic Construct
actgctgcgtcctaaagaagac

SEQ ID NO: 7498 - DNA, 26 bp, Artificial Sequence
  Synthetic Construct
agctggcaccaaatttatcacataag

SEQ ID NO: 7499 - DNA, 26 bp, Artificial Sequence
  Synthetic Construct
ctactgtttaacttctggggatcact

SEQ ID NO: 7500 - DNA, 24 bp, Artificial Sequence
  Synthetic Construct
gggtggaatggagatcagaaactg

SEQ ID NO: 7501 - DNA, 22 bp, Artificial Sequence
  Synthetic Construct
actttagggccagctgttttct

SEQ ID NO: 7502 - DNA, 28 bp, Artificial Sequence
  Synthetic Construct
acaaagctatactaaacgatctgtctca

SEQ ID NO: 7503 - DNA, 23 bp, Artificial Sequence
  Synthetic Construct
aagttgagaccagtgtcattgct

SEQ ID NO: 7504 - DNA, 20 bp, Artificial Sequence
  Synthetic Construct
acgctccacatgtggcaaat

SEQ ID NO: 7505 - DNA, 19 bp, Artificial Sequence
  Synthetic Construct
ccacccccacctcaagcta

SEQ ID NO: 7506 - DNA, 26 bp, Artificial Sequence
  Synthetic Construct
gggtactctggactttttgcatttgg

SEQ ID NO: 7507 - DNA, 24 bp, Artificial Sequence
  Synthetic Construct
gcctaggaagtgaagaaccaaagc

SEQ ID NO: 7508 - DNA, 21 bp, Artificial Sequence
  Synthetic Construct
agcacccaggcttcaaacact

SEQ ID NO: 7509 - DNA, 25 bp, Artificial Sequence
  Synthetic Construct
cctcactcaggaagaatgtgtcctt

SEQ ID NO: 7510 - DNA, 24 bp, Artificial Sequence
  Synthetic Construct
gagccatcttcctgccttttaaga

SEQ ID NO: 7511 - DNA, 25 bp, Artificial Sequence
  Synthetic Construct
gctactcactcaagacctctgtcaa

SEQ ID NO: 7512 - DNA, 24 bp, Artificial Sequence
  Synthetic Construct
ggtgcttggaaatgggctaaattg

SEQ ID NO: 7513 - DNA, 21 bp, Artificial Sequence
  Synthetic Construct
agtttccctctgtcgcagtct

SEQ ID NO: 7514 - DNA, 22 bp, Artificial Sequence
  Synthetic Construct
gacaattgctcagctcctctgt

SEQ ID NO: 7515 - DNA, 22 bp, Artificial Sequence
  Synthetic Construct
cctgtacagcatctgtcgctat

SEQ ID NO: 7516 - DNA, 24 bp, Artificial Sequence
  Synthetic Construct
ggtggttgaggtcaggtcaatgaa

SEQ ID NO: 7517 - DNA, 24 bp, Artificial Sequence
  Synthetic Construct
gtggtggaatgcctctagattgtg

SEQ ID NO: 7518 - DNA, 23 bp, Artificial Sequence
  Synthetic Construct
tgcggtccaggtatcatctaggt

SEQ ID NO: 7519 - DNA, 23 bp, Artificial Sequence
  Synthetic Construct
ggccaagttctgggataacaaca

SEQ ID NO: 7520 - DNA, 22 bp, Artificial Sequence
  Synthetic Construct
gcagaaatgggagcagttcaca

SEQ ID NO: 7521 - DNA, 24 bp, Artificial Sequence
  Synthetic Construct
ggacagcaggcatttcctagtcaa

SEQ ID NO: 7522 - DNA, 22 bp, Artificial Sequence
  Synthetic Construct
agcaaggaaaggggtcaccaaa

SEQ ID NO: 7523 - DNA, 24 bp, Artificial Sequence
  Synthetic Construct
ggaaccaagcttgtttgcatttgc

SEQ ID NO: 7524 - DNA, 24 bp, Artificial Sequence
  Synthetic Construct
ggaggaataccaatcagacgacaa

SEQ ID NO: 7525 - DNA, 22 bp, Artificial Sequence
  Synthetic Construct
gggttgcttccaaggtcacttt

SEQ ID NO: 7526 - DNA, 22 bp, Artificial Sequence
  Synthetic Construct
ccgtggttctacaagcaaccaa

SEQ ID NO: 7527 - DNA, 22 bp, Artificial Sequence
  Synthetic Construct
tgccacttggagactgtgatca

SEQ ID NO: 7528 - DNA, 23 bp, Artificial Sequence
  Synthetic Construct
tggtgggtggcaaggagtgatat

SEQ ID NO: 7529 - DNA, 24 bp, Artificial Sequence
  Synthetic Construct
ctcaaactcctggcttcatatggt

SEQ ID NO: 7530 - DNA, 22 bp, Artificial Sequence
  Synthetic Construct
cagcagcaacaaggagatctga

SEQ ID NO: 7531 - DNA, 19 bp, Artificial Sequence
  Synthetic Construct
tgcactcctgcctgttctg

SEQ ID NO: 7532 - DNA, 25 bp, Artificial Sequence
  Synthetic Construct
aactggattttttcctagggctaca

SEQ ID NO: 7533 - DNA, 23 bp, Artificial Sequence
  Synthetic Construct
gccactctgccaatcttatttgc

SEQ ID NO: 7534 - DNA, 26 bp, Artificial Sequence
  Synthetic Construct
cctatgggctttacaattggagtaga

SEQ ID NO: 7535 - DNA, 25 bp, Artificial Sequence
  Synthetic Construct
gaaaaggcaacagattacgtcaaca

SEQ ID NO: 7536 - DNA, 25 bp, Artificial Sequence
  Synthetic Construct
ggactaggcaacagaggatatgaac

SEQ ID NO: 7537 - DNA, 28 bp, Artificial Sequence
  Synthetic Construct
agaggtgtagagttatttgcactgtatc

SEQ ID NO: 7538 - DNA, 23 bp, Artificial Sequence
  Synthetic Construct
acctctggggtcttggtatacat

SEQ ID NO: 7539 - DNA, 24 bp, Artificial Sequence
  Synthetic Construct
gatggagagagatggtccaaagac

SEQ ID NO: 7540 - DNA, 21 bp, Artificial Sequence
  Synthetic Construct
gtaagcgtgctggaggatgaa

SEQ ID NO: 7541 - DNA, 26 bp, Artificial Sequence
  Synthetic Construct
cccttcccttgaatgtgttgaaagtg

SEQ ID NO: 7542 - DNA, 24 bp, Artificial Sequence
  Synthetic Construct
tcaaccccatctgaggacattgag

SEQ ID NO: 7543 - DNA, 24 bp, Artificial Sequence
  Synthetic Construct
gcagagaagagaacagctgctttc

SEQ ID NO: 7544 - DNA, 22 bp, Artificial Sequence
  Synthetic Construct
ctgtaggacaagcatggaagca

SEQ ID NO: 7545 - DNA, 21 bp, Artificial Sequence
  Synthetic Construct
tcagggtttcagctgctggaa

SEQ ID NO: 7546 - DNA, 26 bp, Artificial Sequence
  Synthetic Construct
ccaagattgtgatggaaattcccaaa

SEQ ID NO: 7547 - DNA, 25 bp, Artificial Sequence
  Synthetic Construct
ctggataaaagtggggagcttaagg

SEQ ID NO: 7548 - DNA, 25 bp, Artificial Sequence
  Synthetic Construct
gctctgtctccaatgtgtttttgtg

SEQ ID NO: 7549 - DNA, 23 bp, Artificial Sequence
  Synthetic Construct
agcacaggagctgcagagtgaaa

SEQ ID NO: 7550 - DNA, 24 bp, Artificial Sequence
  Synthetic Construct
tgagcccttgaattacaggagaga

SEQ ID NO: 7551 - DNA, 21 bp, Artificial Sequence
  Synthetic Construct
tcctcccttgacccatgttct

SEQ ID NO: 7552 - DNA, 27 bp, Artificial Sequence
  Synthetic Construct
ggcctgaaggtaatgattcttatcaca

SEQ ID NO: 7553 - DNA, 21 bp, Artificial Sequence
  Synthetic Construct
acacagcaaaggcaggctctt

SEQ ID NO: 7554 - DNA, 23 bp, Artificial Sequence
  Synthetic Construct
cagaacctggagctgtgaattca

SEQ ID NO: 7555 - DNA, 20 bp, Artificial Sequence
  Synthetic Construct
atcccatccggagccaaagg

SEQ ID NO: 7556 - DNA, 24 bp, Artificial Sequence
  Synthetic Construct
tgtccaggttgcatactacacaac

SEQ ID NO: 7557 - DNA, 27 bp, Artificial Sequence
  Synthetic Construct
gggtaacaaatgggtcaggtatattgg

SEQ ID NO: 7558 - DNA, 27 bp, Artificial Sequence
  Synthetic Construct
cctgtaatggagttgatggggatttaa

SEQ ID NO: 7559 - DNA, 20 bp, Artificial Sequence
  Synthetic Construct
ggtgggtgtgggtgtcatct

SEQ ID NO: 7560 - DNA, 26 bp, Artificial Sequence
  Synthetic Construct
gatgtgaatgatgtgttacggtaacc

SEQ ID NO: 7561 - DNA, 21 bp, Artificial Sequence
  Synthetic Construct
cgggtgtctgtcgagtaacag

SEQ ID NO: 7562 - DNA, 25 bp, Artificial Sequence
  Synthetic Construct
acaagcttgggatagtctgttgatt

SEQ ID NO: 7563 - DNA, 25 bp, Artificial Sequence
  Synthetic Construct
cagagaagtggcaaggagaagtttg

SEQ ID NO: 7564 - DNA, 24 bp, Artificial Sequence
  Synthetic Construct
aaactgggtctgaacttggaatct

SEQ ID NO: 7565 - DNA, 21 bp, Artificial Sequence
  Synthetic Construct
acaagccagtgtgcccattaa

SEQ ID NO: 7566 - DNA, 23 bp, Artificial Sequence
  Synthetic Construct
ttgaggtcaggaatcccaagttc

SEQ ID NO: 7567 - DNA, 22 bp, Artificial Sequence
  Synthetic Construct
tgaactgtgccttccactgaca

SEQ ID NO: 7568 - DNA, 25 bp, Artificial Sequence
  Synthetic Construct
cagtggtttcttctttgcagtagct

SEQ ID NO: 7569 - DNA, 23 bp, Artificial Sequence
  Synthetic Construct
gccaccaaagacttatggagtgt

SEQ ID NO: 7570 - DNA, 24 bp, Artificial Sequence
  Synthetic Construct
aggccagattggatctccatgaga

SEQ ID NO: 7571 - DNA, 20 bp, Artificial Sequence
  Synthetic Construct
tctcgtgcactggaagcaaa

SEQ ID NO: 7572 - DNA, 22 bp, Artificial Sequence
  Synthetic Construct
agcagtagcatctcctctctgt

SEQ ID NO: 7573 - DNA, 22 bp, Artificial Sequence
  Synthetic Construct
gccgactcattctccctatgca

SEQ ID NO: 7574 - DNA, 22 bp, Artificial Sequence
  Synthetic Construct
agaaagcaagctgcatggagat

SEQ ID NO: 7575 - DNA, 27 bp, Artificial Sequence
  Synthetic Construct
gcctacttctcacatcacagctctcta

SEQ ID NO: 7576 - DNA, 28 bp, Artificial Sequence
  Synthetic Construct
actagaatgtggaaaccctaaattcaga

SEQ ID NO: 7577 - DNA, 23 bp, Artificial Sequence
  Synthetic Construct
gcttgcaggaatctaaccctgta

SEQ ID NO: 7578 - DNA, 24 bp, Artificial Sequence
  Synthetic Construct
atctctgggagttgagttgttgag

SEQ ID NO: 7579 - DNA, 21 bp, Artificial Sequence
  Synthetic Construct
ccatgcttcagtgtgcaagag

SEQ ID NO: 7580 - DNA, 20 bp, Artificial Sequence
  Synthetic Construct
agggtgagaacggagtgcat

SEQ ID NO: 7581 - DNA, 22 bp, Artificial Sequence
  Synthetic Construct
gcacctcaccttccccatcatt

SEQ ID NO: 7582 - DNA, 22 bp, Artificial Sequence
  Synthetic Construct
ggctgtggtattgaacctccaa

SEQ ID NO: 7583 - DNA, 24 bp, Artificial Sequence
  Synthetic Construct
ggtgaacaggtgatgtcgacttga

SEQ ID NO: 7584 - DNA, 22 bp, Artificial Sequence
  Synthetic Construct
tgtcctctgtctcagccatgtg

SEQ ID NO: 7585 - DNA, 19 bp, Artificial Sequence
  Synthetic Construct
tgctgttcaggcccactct

SEQ ID NO: 7586 - DNA, 24 bp, Artificial Sequence
  Synthetic Construct
gctcagcagggggattattctaca

SEQ ID NO: 7587 - DNA, 21 bp, Artificial Sequence
  Synthetic Construct
tgaagcctgggtgtagctttg

SEQ ID NO: 7588 - DNA, 20 bp, Artificial Sequence
  Synthetic Construct
ccagcacagggttggatacc

SEQ ID NO: 7589 - DNA, 22 bp, Artificial Sequence
  Synthetic Construct
gccttggctcacagagtcatct

SEQ ID NO: 7590 - DNA, 20 bp, Artificial Sequence
  Synthetic Construct
aaccggtgtgaggcaatacc

SEQ ID NO: 7591 - DNA, 22 bp, Artificial Sequence
  Synthetic Construct
cgaacgctggttctttctttgc

SEQ ID NO: 7592 - DNA, 22 bp, Artificial Sequence
  Synthetic Construct
ggatttgggctttcggctatct

SEQ ID NO: 7593 - DNA, 20 bp, Artificial Sequence
  Synthetic Construct
gtggcttgggctagattgca

SEQ ID NO: 7594 - DNA, 25 bp, Artificial Sequence
  Synthetic Construct
acaacagacaagcaatgttcattga

SEQ ID NO: 7595 - DNA, 21 bp, Artificial Sequence
  Synthetic Construct
tggggtcaggggaatgtggat

SEQ ID NO: 7596 - DNA, 22 bp, Artificial Sequence
  Synthetic Construct
ggacacacagcactctaaagct

SEQ ID NO: 7597 - DNA, 23 bp, Artificial Sequence
  Synthetic Construct
ccagtgagtggtatctgttggaa

SEQ ID NO: 7598 - DNA, 22 bp, Artificial Sequence
  Synthetic Construct
cgctttcgaagtctgactttcc

SEQ ID NO: 7599 - DNA, 21 bp, Artificial Sequence
  Synthetic Construct
gatgccttctcctgctagcaa

SEQ ID NO: 7600 - DNA, 21 bp, Artificial Sequence
  Synthetic Construct
tccactgccctacctttccat

SEQ ID NO: 7601 - DNA, 22 bp, Artificial Sequence
  Synthetic Construct
gccagtttgcaacctctatgct

SEQ ID NO: 7602 - DNA, 19 bp, Artificial Sequence
  Synthetic Construct
gcgtgggcctggatgttca

SEQ ID NO: 7603 - DNA, 26 bp, Artificial Sequence
  Synthetic Construct
gctgtaaacagaggcatttggtacct

SEQ ID NO: 7604 - DNA, 22 bp, Artificial Sequence
  Synthetic Construct
gtttggtgtagggagccacaat

SEQ ID NO: 7605 - DNA, 25 bp, Artificial Sequence
  Synthetic Construct
gcaaccaacctgtattctcaaaagg

SEQ ID NO: 7606 - DNA, 24 bp, Artificial Sequence
  Synthetic Construct
ggctggaagctaattttggtttgg

SEQ ID NO: 7607 - DNA, 24 bp, Artificial Sequence
  Synthetic Construct
acacaccttggacagtctataacc

SEQ ID NO: 7608 - DNA, 22 bp, Artificial Sequence
  Synthetic Construct
tttagccaggcatgagctacag

SEQ ID NO: 7609 - DNA, 22 bp, Artificial Sequence
  Synthetic Construct
agattccacaaagggcccatct

SEQ ID NO: 7610 - DNA, 24 bp, Artificial Sequence
  Synthetic Construct
gtctaacctatggccatgggattt

SEQ ID NO: 7611 - DNA, 26 bp, Artificial Sequence
  Synthetic Construct
cgttgaggaaagtttcaagggaggat

SEQ ID NO: 7612 - DNA, 20 bp, Artificial Sequence
  Synthetic Construct
aaatggctgcaggtgtcaca

SEQ ID NO: 7613 - DNA, 21 bp, Artificial Sequence
  Synthetic Construct
cccccatcctacacagagcaa

SEQ ID NO: 7614 - DNA, 25 bp, Artificial Sequence
  Synthetic Construct
gacaaagtcttcatggtggttttca

SEQ ID NO: 7615 - DNA, 28 bp, Artificial Sequence
  Synthetic Construct
ggaaatgctagtacctactgctctatcc

SEQ ID NO: 7616 - DNA, 20 bp, Artificial Sequence
  Synthetic Construct
ggggaggctttctgctccta

SEQ ID NO: 7617 - DNA, 24 bp, Artificial Sequence
  Synthetic Construct
ggatgggttcagttgcattttgtc

SEQ ID NO: 7618 - DNA, 23 bp, Artificial Sequence
  Synthetic Construct
gaagccaggaaatgacgtaggat

SEQ ID NO: 7619 - DNA, 25 bp, Artificial Sequence
  Synthetic Construct
ctgggaatttgtggttaacattggt

SEQ ID NO: 7620 - DNA, 22 bp, Artificial Sequence
  Synthetic Construct
ccgattcacagtgctgctttca

SEQ ID NO: 7621 - DNA, 25 bp, Artificial Sequence
  Synthetic Construct
ccccagctatactcacaacagtgat

SEQ ID NO: 7622 - DNA, 22 bp, Artificial Sequence
  Synthetic Construct
tgggcagttcagcttgttgtgt

SEQ ID NO: 7623 - DNA, 25 bp, Artificial Sequence
  Synthetic Construct
agagctgataatacaccctgactgt

SEQ ID NO: 7624 - DNA, 24 bp, Artificial Sequence
  Synthetic Construct
cagcagttggggttattccagaag

SEQ ID NO: 7625 - DNA, 24 bp, Artificial Sequence
  Synthetic Construct
cattctgaactagccacggtactg

SEQ ID NO: 7626 - DNA, 22 bp, Artificial Sequence
  Synthetic Construct
ccctaatgatgggcacaaggtt

SEQ ID NO: 7627 - DNA, 21 bp, Artificial Sequence
  Synthetic Construct
cccagctcctccacggtctgt

SEQ ID NO: 7628 - DNA, 22 bp, Artificial Sequence
  Synthetic Construct
gcttggaaatgtggcactgagt

SEQ ID NO: 7629 - DNA, 22 bp, Artificial Sequence
  Synthetic Construct
tggagtggggactgagttcatt

SEQ ID NO: 7630 - DNA, 21 bp, Artificial Sequence
  Synthetic Construct
agctgtaagacctggggcttt

SEQ ID NO: 7631 - DNA, 25 bp, Artificial Sequence
  Synthetic Construct
gagatgtctctggtgcaaatacaga

SEQ ID NO: 7632 - DNA, 22 bp, Artificial Sequence
  Synthetic Construct
agccaaaccctgctagcttacc

SEQ ID NO: 7633 - DNA, 22 bp, Artificial Sequence
  Synthetic Construct
acccagtgaagctgatgcgtaa

SEQ ID NO: 7634 - DNA, 25 bp, Artificial Sequence
  Synthetic Construct
gctcaaatcagttctgtctctggtt

SEQ ID NO: 7635 - DNA, 25 bp, Artificial Sequence
  Synthetic Construct
gcactcactctggttaacagtggtt

SEQ ID NO: 7636 - DNA, 21 bp, Artificial Sequence
  Synthetic Construct
agggcagactgggttgggtta

SEQ ID NO: 7637 - DNA, 24 bp, Artificial Sequence
  Synthetic Construct
agggagaagacactctctcacctt

SEQ ID NO: 7638 - DNA, 22 bp, Artificial Sequence
  Synthetic Construct
tggcaggataaaagcccctaag

SEQ ID NO: 7639 - DNA, 26 bp, Artificial Sequence
  Synthetic Construct
gtctgcatgattgagatttgattgca

SEQ ID NO: 7640 - DNA, 22 bp, Artificial Sequence
  Synthetic Construct
aggaagcctccagcaattacag

SEQ ID NO: 7641 - DNA, 23 bp, Artificial Sequence
  Synthetic Construct
gtgccctattgtgggaaattagc

SEQ ID NO: 7642 - DNA, 24 bp, Artificial Sequence
  Synthetic Construct
aggtacaagcactccttcaagtag

SEQ ID NO: 7643 - DNA, 26 bp, Artificial Sequence
  Synthetic Construct
gcagataaaatcttggtgttcgtaca

SEQ ID NO: 7644 - DNA, 23 bp, Artificial Sequence
  Synthetic Construct
gaaaagtgggtcaatgggagtca

SEQ ID NO: 7645 - DNA, 18 bp, Artificial Sequence
  Synthetic Construct
tggcacctccggatctca

SEQ ID NO: 7646 - DNA, 22 bp, Artificial Sequence
  Synthetic Construct
ctgtggtgagctcaaggatgtt

SEQ ID NO: 7647 - DNA, 26 bp, Artificial Sequence
  Synthetic Construct
ccatagaacaaatctctgggttgatg

SEQ ID NO: 7648 - DNA, 24 bp, Artificial Sequence
  Synthetic Construct
cctctccacatccagtcatccaat

SEQ ID NO: 7649 - DNA, 21 bp, Artificial Sequence
  Synthetic Construct
gacctggagggctgagtgata

SEQ ID NO: 7650 - DNA, 29 bp, Artificial Sequence
  Synthetic Construct
ctcaaagtaattgttgggattgaatgaga

SEQ ID NO: 7651 - DNA, 24 bp, Artificial Sequence
  Synthetic Construct
ctgaaggcaggttgataagagcat

SEQ ID NO: 7652 - DNA, 27 bp, Artificial Sequence
  Synthetic Construct
cctccagaacttttgttacagtaagga

SEQ ID NO: 7653 - DNA, 22 bp, Artificial Sequence
  Synthetic Construct
agtacggaacaggaggaggaaa

SEQ ID NO: 7654 - DNA, 26 bp, Artificial Sequence
  Synthetic Construct
cctttgtactgcagtctgcttctaac

SEQ ID NO: 7655 - DNA, 21 bp, Artificial Sequence
  Synthetic Construct
aggggtcaagcagcagtttga

SEQ ID NO: 7656 - DNA, 26 bp, Artificial Sequence
  Synthetic Construct
ctctgtgaatattctacccccatcaa

SEQ ID NO: 7657 - DNA, 22 bp, Artificial Sequence
  Synthetic Construct
gctaggcgcataatccttctct

SEQ ID NO: 7658 - DNA, 27 bp, Artificial Sequence
  Synthetic Construct
ccattgagaactttacttcccacatca

SEQ ID NO: 7659 - DNA, 21 bp, Artificial Sequence
  Synthetic Construct
actcacgccgctatccctatt

SEQ ID NO: 7660 - DNA, 20 bp, Artificial Sequence
  Synthetic Construct
cagacactgccacccatctg

SEQ ID NO: 7661 - DNA, 18 bp, Artificial Sequence
  Synthetic Construct
tgctggtgcgaggagaga

SEQ ID NO: 7662 - DNA, 26 bp, Artificial Sequence
  Synthetic Construct
cagccaaaccatatcattcactatgc

SEQ ID NO: 7663 - DNA, 18 bp, Artificial Sequence
  Synthetic Construct
ctggctgccagggagtgt

SEQ ID NO: 7664 - DNA, 22 bp, Artificial Sequence
  Synthetic Construct
gcataagccaggctgtagtaca

SEQ ID NO: 7665 - DNA, 23 bp, Artificial Sequence
  Synthetic Construct
ggaaagaaaagggtgctctggat

SEQ ID NO: 7666 - DNA, 23 bp, Artificial Sequence
  Synthetic Construct
gcagaacccctacaaagaaggta

SEQ ID NO: 7667 - DNA, 25 bp, Artificial Sequence
  Synthetic Construct
ggtggtgttaagaagccaagaagat

SEQ ID NO: 7668 - DNA, 28 bp, Artificial Sequence
  Synthetic Construct
gggtcaggaaaatattgtctggagtgtt

SEQ ID NO: 7669 - DNA, 22 bp, Artificial Sequence
  Synthetic Construct
gcttttgcacttggctccttgt

SEQ ID NO: 7670 - DNA, 24 bp, Artificial Sequence
  Synthetic Construct
tgcctcccaagtaggatagaactc

SEQ ID NO: 7671 - DNA, 25 bp, Artificial Sequence
  Synthetic Construct
ccttctcattgctgagtgtttaacc

SEQ ID NO: 7672 - DNA, 21 bp, Artificial Sequence
  Synthetic Construct
cctctcccctttgagcagaca

SEQ ID NO: 7673 - DNA, 25 bp, Artificial Sequence
  Synthetic Construct
gaggcacaagataaagaggtttagc

SEQ ID NO: 7674 - DNA, 24 bp, Artificial Sequence
  Synthetic Construct
gaataggaatgtgtggagcagaca

SEQ ID NO: 7675 - DNA, 21 bp, Artificial Sequence
  Synthetic Construct
catgtgttgcaagccacatgt

SEQ ID NO: 7676 - DNA, 21 bp, Artificial Sequence
  Synthetic Construct
agccctcccacctggtaacta

SEQ ID NO: 7677 - DNA, 18 bp, Artificial Sequence
  Synthetic Construct
ccctgctgcccacatcag

SEQ ID NO: 7678 - DNA, 20 bp, Artificial Sequence
  Synthetic Construct
tcattgctggcatgcatcca

SEQ ID NO: 7679 - DNA, 24 bp, Artificial Sequence
  Synthetic Construct
cctttgcagtcaccaatgttttgt

SEQ ID NO: 7680 - DNA, 28 bp, Artificial Sequence
  Synthetic Construct
cgagctataagtgatggagctagtatct

SEQ ID NO: 7681 - DNA, 22 bp, Artificial Sequence
  Synthetic Construct
gaactggagctccacacttagg

SEQ ID NO: 7682 - DNA, 26 bp, Artificial Sequence
  Synthetic Construct
ccagttctgaaggaggcatttatcag

SEQ ID NO: 7683 - DNA, 23 bp, Artificial Sequence
  Synthetic Construct
gtgtacccactgtcactcatacc

SEQ ID NO: 7684 - DNA, 23 bp, Artificial Sequence
  Synthetic Construct
gcagattttgacaagggttggaa

SEQ ID NO: 7685 - DNA, 24 bp, Artificial Sequence
  Synthetic Construct
ccacagagctaggaaactcgtgaa

SEQ ID NO: 7686 - DNA, 23 bp, Artificial Sequence
  Synthetic Construct
ttcctcggcccttcttcctgaga

SEQ ID NO: 7687 - DNA, 24 bp, Artificial Sequence
  Synthetic Construct
aggggtgaaacaaatcatgcttct

SEQ ID NO: 7688 - DNA, 24 bp, Artificial Sequence
  Synthetic Construct
aggaaccctgtccttgctttaacc

SEQ ID NO: 7689 - DNA, 25 bp, Artificial Sequence
  Synthetic Construct
ggaaagtctgaacacacacttccat

SEQ ID NO: 7690 - DNA, 22 bp, Artificial Sequence
  Synthetic Construct
aagccaaatacgcacccctaac

SEQ ID NO: 7691 - DNA, 25 bp, Artificial Sequence
  Synthetic Construct
ggcctttcacaaactactccttcct

SEQ ID NO: 7692 - DNA, 23 bp, Artificial Sequence
  Synthetic Construct
gtgtttgtgtgcagacactgtac

SEQ ID NO: 7693 - DNA, 23 bp, Artificial Sequence
  Synthetic Construct
gtgcttgcttgagttctcagcta

SEQ ID NO: 7694 - DNA, 26 bp, Artificial Sequence
  Synthetic Construct
gcaacagcatctttgatagggaacac

SEQ ID NO: 7695 - DNA, 22 bp, Artificial Sequence
  Synthetic Construct
ggctggaaggaaaggcaaacat

SEQ ID NO: 7696 - DNA, 22 bp, Artificial Sequence
  Synthetic Construct
agatccctgctgccctacatta

SEQ ID NO: 7697 - DNA, 23 bp, Artificial Sequence
  Synthetic Construct
cctgagccacccaggactttttg

SEQ ID NO: 7698 - DNA, 26 bp, Artificial Sequence
  Synthetic Construct
ttgccaccaatatcaggagtgtatag

SEQ ID NO: 7699 - DNA, 28 bp, Artificial Sequence
  Synthetic Construct
tgtgagactctttggtacttaagtttgt

SEQ ID NO: 7700 - DNA, 20 bp, Artificial Sequence
  Synthetic Construct
tgcctcacagccaagcttct

SEQ ID NO: 7701 - DNA, 25 bp, Artificial Sequence
  Synthetic Construct
tgaagtaattgacggtctcagttct

SEQ ID NO: 7702 - DNA, 26 bp, Artificial Sequence
  Synthetic Construct
cgtggttatcttgtcaatgggaactc

SEQ ID NO: 7703 - DNA, 29 bp, Artificial Sequence
  Synthetic Construct
ggtcaagatggagcagtattttgatcatc

SEQ ID NO: 7704 - DNA, 22 bp, Artificial Sequence
  Synthetic Construct
aacacctgccagtgtcaatgag

SEQ ID NO: 7705 - DNA, 22 bp, Artificial Sequence
  Synthetic Construct
tgcctggaggtgaggtgtgttt

SEQ ID NO: 7706 - DNA, 23 bp, Artificial Sequence
  Synthetic Construct
agattgaggtggcatttcctgaa

SEQ ID NO: 7707 - DNA, 21 bp, Artificial Sequence
  Synthetic Construct
acacgggggttacagagatga

SEQ ID NO: 7708 - DNA, 25 bp, Artificial Sequence
  Synthetic Construct
tgaaaagtagaagagtctgctgtgt

SEQ ID NO: 7709 - DNA, 25 bp, Artificial Sequence
  Synthetic Construct
ggtttcacagggaggactggagtta

SEQ ID NO: 7710 - DNA, 25 bp, Artificial Sequence
  Synthetic Construct
aggccattgggttaaatatccatca

SEQ ID NO: 7711 - DNA, 22 bp, Artificial Sequence
  Synthetic Construct
gcaaactccacttcagcaggat

SEQ ID NO: 7712 - DNA, 18 bp, Artificial Sequence
  Synthetic Construct
gctttctgccggcaagca

SEQ ID NO: 7713 - DNA, 25 bp, Artificial Sequence
  Synthetic Construct
actaaggcaatggatttcaaatgca

SEQ ID NO: 7714 - DNA, 27 bp, Artificial Sequence
  Synthetic Construct
ccaccaatttcagtagggttttatgca

SEQ ID NO: 7715 - DNA, 26 bp, Artificial Sequence
  Synthetic Construct
ctcagacacacatcatagctctacag

SEQ ID NO: 7716 - DNA, 23 bp, Artificial Sequence
  Synthetic Construct
agatctagaaccaaggccactga

SEQ ID NO: 7717 - DNA, 20 bp, Artificial Sequence
  Synthetic Construct
ccatcagagccacccacact

SEQ ID NO: 7718 - DNA, 24 bp, Artificial Sequence
  Synthetic Construct
ctaaggtggggattcacatcaaca

SEQ ID NO: 7719 - DNA, 22 bp, Artificial Sequence
  Synthetic Construct
ccttgaactgttggctgtagca

SEQ ID NO: 7720 - DNA, 20 bp, Artificial Sequence
  Synthetic Construct
accgttgagctgttgcaact

SEQ ID NO: 7721 - DNA, 24 bp, Artificial Sequence
  Synthetic Construct
ctggtggctcaaaccgttagtgaa

SEQ ID NO: 7722 - DNA, 23 bp, Artificial Sequence
  Synthetic Construct
gacattactggaagctgggttga

SEQ ID NO: 7723 - DNA, 22 bp, Artificial Sequence
  Synthetic Construct
cttgggtgtgtttctcctgtct

SEQ ID NO: 7724 - DNA, 24 bp, Artificial Sequence
  Synthetic Construct
gtaacccttccagtgattgagtca

SEQ ID NO: 7725 - DNA, 21 bp, Artificial Sequence
  Synthetic Construct
cagcccagtgtctcagaacag

SEQ ID NO: 7726 - DNA, 24 bp, Artificial Sequence
  Synthetic Construct
actcagctgaactattgccttctc

SEQ ID NO: 7727 - DNA, 22 bp, Artificial Sequence
  Synthetic Construct
gcgtttgttcaggctcaaagtc

SEQ ID NO: 7728 - DNA, 22 bp, Artificial Sequence
  Synthetic Construct
caggcggtggaattttctgcta

SEQ ID NO: 7729 - DNA, 20 bp, Artificial Sequence
  Synthetic Construct
acaggagccaaaccggtact

SEQ ID NO: 7730 - DNA, 24 bp, Artificial Sequence
  Synthetic Construct
caaccacagaagcagcagaagttg

SEQ ID NO: 7731 - DNA, 24 bp, Artificial Sequence
  Synthetic Construct
cagaggctctgtagagttcagact

SEQ ID NO: 7732 - DNA, 24 bp, Artificial Sequence
  Synthetic Construct
gggtttccctctagctgtttactg

SEQ ID NO: 7733 - DNA, 25 bp, Artificial Sequence
  Synthetic Construct
ctctagataggtgcctgtagcctaa

SEQ ID NO: 7734 - DNA, 22 bp, Artificial Sequence
  Synthetic Construct
gcctaacttgcttgctcctgtt

SEQ ID NO: 7735 - DNA, 24 bp, Artificial Sequence
  Synthetic Construct
agaagccctgcttatactgtcatc

SEQ ID NO: 7736 - DNA, 20 bp, Artificial Sequence
  Synthetic Construct
caccctctggcactctcaga

SEQ ID NO: 7737 - DNA, 22 bp, Artificial Sequence
  Synthetic Construct
ccagatagctgcttcacatggt

SEQ ID NO: 7738 - DNA, 21 bp, Artificial Sequence
  Synthetic Construct
tggcttacctgcaacctgtca

SEQ ID NO: 7739 - DNA, 19 bp, Artificial Sequence
  Synthetic Construct
tgcgaggggcagagacttt

SEQ ID NO: 7740 - DNA, 28 bp, Artificial Sequence
  Synthetic Construct
cctgtcttcaagtttactgaacgttcct

SEQ ID NO: 7741 - DNA, 22 bp, Artificial Sequence
  Synthetic Construct
gagtggcctttgaagtcttgca

SEQ ID NO: 7742 - DNA, 27 bp, Artificial Sequence
  Synthetic Construct
aagaattgctagaaatgtgggaacatc

SEQ ID NO: 7743 - DNA, 24 bp, Artificial Sequence
  Synthetic Construct
ccgctgaacaggttcttgagttga

SEQ ID NO: 7744 - DNA, 22 bp, Artificial Sequence
  Synthetic Construct
gcagcaacaactcattcaggtt

SEQ ID NO: 7745 - DNA, 21 bp, Artificial Sequence
  Synthetic Construct
aagtgcctttcagccattcca

SEQ ID NO: 7746 - DNA, 26 bp, Artificial Sequence
  Synthetic Construct
agtctagatacagcctcagaatcctt

SEQ ID NO: 7747 - DNA, 21 bp, Artificial Sequence
  Synthetic Construct
gcccttgagatctgcccaagt

SEQ ID NO: 7748 - DNA, 26 bp, Artificial Sequence
  Synthetic Construct
ggtagccaaagctccatattcttagc

SEQ ID NO: 7749 - DNA, 22 bp, Artificial Sequence
  Synthetic Construct
cccatgacttccacccaaaacc

SEQ ID NO: 7750 - DNA, 22 bp, Artificial Sequence
  Synthetic Construct
ggcctgtctgcaatctctttgt

SEQ ID NO: 7751 - DNA, 20 bp, Artificial Sequence
  Synthetic Construct
atccggccgtgattccattt

SEQ ID NO: 7752 - DNA, 22 bp, Artificial Sequence
  Synthetic Construct
gcaataccagaccctgtggaat

SEQ ID NO: 7753 - DNA, 25 bp, Artificial Sequence
  Synthetic Construct
caagaacagccaacaggaaatgatg

SEQ ID NO: 7754 - DNA, 22 bp, Artificial Sequence
  Synthetic Construct
ctgcacgcatgatcagttatgg

SEQ ID NO: 7755 - DNA, 22 bp, Artificial Sequence
  Synthetic Construct
tgtgcacacacacttccctctt

SEQ ID NO: 7756 - DNA, 22 bp, Artificial Sequence
  Synthetic Construct
tccatcccctggtgtatgaaca

SEQ ID NO: 7757 - DNA, 23 bp, Artificial Sequence
  Synthetic Construct
gtgtccctgtgtcttcagcaata

SEQ ID NO: 7758 - DNA, 28 bp, Artificial Sequence
  Synthetic Construct
agcattgacacagtttatcatacaacag

SEQ ID NO: 7759 - DNA, 20 bp, Artificial Sequence
  Synthetic Construct
tgcagctgcagaaacgatca

SEQ ID NO: 7760 - DNA, 26 bp, Artificial Sequence
  Synthetic Construct
gcctcctgtctctcatatccatgaac

SEQ ID NO: 7761 - DNA, 20 bp, Artificial Sequence
  Synthetic Construct
ggctcctcctgctccaactt

SEQ ID NO: 7762 - DNA, 21 bp, Artificial Sequence
  Synthetic Construct
tggccgctgaactcttccttt

SEQ ID NO: 7763 - DNA, 26 bp, Artificial Sequence
  Synthetic Construct
gcattcaattaaccagaggggagaca

SEQ ID NO: 7764 - DNA, 26 bp, Artificial Sequence
  Synthetic Construct
gcatgtgacctagggagataccagat

SEQ ID NO: 7765 - DNA, 25 bp, Artificial Sequence
  Synthetic Construct
gagtcctgctctctggaatgattct

SEQ ID NO: 7766 - DNA, 22 bp, Artificial Sequence
  Synthetic Construct
cagagccacacctgaactgttt

SEQ ID NO: 7767 - DNA, 26 bp, Artificial Sequence
  Synthetic Construct
ggttgtatgtgtagttgtgtgtgctt

SEQ ID NO: 7768 - DNA, 26 bp, Artificial Sequence
  Synthetic Construct
gtaaggctttctgggataggagatag

SEQ ID NO: 7769 - DNA, 26 bp, Artificial Sequence
  Synthetic Construct
ggcccagactagaaagggattatcca

SEQ ID NO: 7770 - DNA, 25 bp, Artificial Sequence
  Synthetic Construct
caagagatgctgctgttgatgttag

SEQ ID NO: 7771 - DNA, 27 bp, Artificial Sequence
  Synthetic Construct
gcagaatgctaagggaggttgttaagg

SEQ ID NO: 7772 - DNA, 25 bp, Artificial Sequence
  Synthetic Construct
ggtgagcctaaagtccatgcatgat

SEQ ID NO: 7773 - DNA, 26 bp, Artificial Sequence
  Synthetic Construct
cagccaagtatgcgtttaaacttctc

SEQ ID NO: 7774 - DNA, 22 bp, Artificial Sequence
  Synthetic Construct
agcaaggagcaatgaacagcta

SEQ ID NO: 7775 - DNA, 27 bp, Artificial Sequence
  Synthetic Construct
aggcatacattttaactaggacaccaa

SEQ ID NO: 7776 - DNA, 22 bp, Artificial Sequence
  Synthetic Construct
gcattggtgtgaaagcctgctt

SEQ ID NO: 7777 - DNA, 20 bp, Artificial Sequence
  Synthetic Construct
aggccatccaccactgaaca

SEQ ID NO: 7778 - DNA, 25 bp, Artificial Sequence
  Synthetic Construct
tctccatggtactaacccattctct

SEQ ID NO: 7779 - DNA, 20 bp, Artificial Sequence
  Synthetic Construct
actcctccgttggtgtgttc

SEQ ID NO: 7780 - DNA, 21 bp, Artificial Sequence
  Synthetic Construct
cctgctgggattctgctctca

SEQ ID NO: 7781 - DNA, 18 bp, Artificial Sequence
  Synthetic Construct
ctcacccctggccctctt

SEQ ID NO: 7782 - DNA, 27 bp, Artificial Sequence
  Synthetic Construct
gcataatgtaacaggtaggggtacttc

SEQ ID NO: 7783 - DNA, 20 bp, Artificial Sequence
  Synthetic Construct
tgcggtcccatttctgaaca

SEQ ID NO: 7784 - DNA, 24 bp, Artificial Sequence
  Synthetic Construct
cccagatggatgagtctgaagctt

SEQ ID NO: 7785 - DNA, 26 bp, Artificial Sequence
  Synthetic Construct
ggaactccatcaattaaacagttgca

SEQ ID NO: 7786 - DNA, 22 bp, Artificial Sequence
  Synthetic Construct
tgcagactgaccctgtgacttt

SEQ ID NO: 7787 - DNA, 25 bp, Artificial Sequence
  Synthetic Construct
gtcattcaaggccatagaggtacag

SEQ ID NO: 7788 - DNA, 24 bp, Artificial Sequence
  Synthetic Construct
gggagaggatggggattaaagcat

SEQ ID NO: 7789 - DNA, 23 bp, Artificial Sequence
  Synthetic Construct
catgggctaagaggacacattct

SEQ ID NO: 7790 - DNA, 22 bp, Artificial Sequence
  Synthetic Construct
gcctcaggaacttgagtccttt

SEQ ID NO: 7791 - DNA, 26 bp, Artificial Sequence
  Synthetic Construct
ccagtaagaacatgctagaacactca

SEQ ID NO: 7792 - DNA, 20 bp, Artificial Sequence
  Synthetic Construct
tcctgccctgtgagccttct

SEQ ID NO: 7793 - DNA, 23 bp, Artificial Sequence
  Synthetic Construct
tctaaagagccctcctcccatct

SEQ ID NO: 7794 - DNA, 24 bp, Artificial Sequence
  Synthetic Construct
agcaaagaccatgttcctcatgtt

SEQ ID NO: 7795 - DNA, 24 bp, Artificial Sequence
  Synthetic Construct
accctcatctcaggcctttatctg

SEQ ID NO: 7796 - DNA, 25 bp, Artificial Sequence
  Synthetic Construct
gttagtcttctctctgccaggaaac

SEQ ID NO: 7797 - DNA, 22 bp, Artificial Sequence
  Synthetic Construct
ccagcgtttgttcacagtgtgt

SEQ ID NO: 7798 - DNA, 26 bp, Artificial Sequence
  Synthetic Construct
agtggcaactatctttcatcttagct

SEQ ID NO: 7799 - DNA, 24 bp, Artificial Sequence
  Synthetic Construct
gcagtggaatgagtgaaggtacag

SEQ ID NO: 7800 - DNA, 23 bp, Artificial Sequence
  Synthetic Construct
caaggctcaagttcagagaggtt

SEQ ID NO: 7801 - DNA, 25 bp, Artificial Sequence
  Synthetic Construct
gctacatcctgcatttccacatagc

SEQ ID NO: 7802 - DNA, 24 bp, Artificial Sequence
  Synthetic Construct
cctttgggaacatggtttggaaag

SEQ ID NO: 7803 - DNA, 22 bp, Artificial Sequence
  Synthetic Construct
aaggcgcacattagtcccataa

SEQ ID NO: 7804 - DNA, 24 bp, Artificial Sequence
  Synthetic Construct
ccaaccccacagactgtcaacatt

SEQ ID NO: 7805 - DNA, 24 bp, Artificial Sequence
  Synthetic Construct
cccggttattctgtggcctattgt

SEQ ID NO: 7806 - DNA, 22 bp, Artificial Sequence
  Synthetic Construct
tcaggggaagcagcatcattag

SEQ ID NO: 7807 - DNA, 21 bp, Artificial Sequence
  Synthetic Construct
tctggttccacaggagggtaa

SEQ ID NO: 7808 - DNA, 26 bp, Artificial Sequence
  Synthetic Construct
gtactatctgggctcaatgatactgt

SEQ ID NO: 7809 - DNA, 23 bp, Artificial Sequence
  Synthetic Construct
gcagaagtggggatgtgagaatt

SEQ ID NO: 7810 - DNA, 22 bp, Artificial Sequence
  Synthetic Construct
cagagtgccatgcattgtggta

SEQ ID NO: 7811 - DNA, 22 bp, Artificial Sequence
  Synthetic Construct
gctacctgggctgtggtatctt

SEQ ID NO: 7812 - DNA, 29 bp, Artificial Sequence
  Synthetic Construct
atgtctagagctctacataatagcttctg

SEQ ID NO: 7813 - DNA, 22 bp, Artificial Sequence
  Synthetic Construct
caccttgcatccacttgagact

SEQ ID NO: 7814 - DNA, 21 bp, Artificial Sequence
  Synthetic Construct
ccaacttcccctctccagtct

SEQ ID NO: 7815 - DNA, 26 bp, Artificial Sequence
  Synthetic Construct
cattaacccatcattcagcttcaaca

SEQ ID NO: 7816 - DNA, 22 bp, Artificial Sequence
  Synthetic Construct
agtttgcccctagagctgaaac

SEQ ID NO: 7817 - DNA, 22 bp, Artificial Sequence
  Synthetic Construct
acgtaggagctccacaacctaa

SEQ ID NO: 7818 - DNA, 23 bp, Artificial Sequence
  Synthetic Construct
acttggcataaaaccccacgtaa

SEQ ID NO: 7819 - DNA, 22 bp, Artificial Sequence
  Synthetic Construct
gaagccccagtcctacttgaaa

SEQ ID NO: 7820 - DNA, 23 bp, Artificial Sequence
  Synthetic Construct
ctacacttgtggagctgtctgaa

SEQ ID NO: 7821 - DNA, 19 bp, Artificial Sequence
  Synthetic Construct
tggctccactccggcacaa

SEQ ID NO: 7822 - DNA, 22 bp, Artificial Sequence
  Synthetic Construct
cctcctgacctgttcacagtga

SEQ ID NO: 7823 - DNA, 22 bp, Artificial Sequence
  Synthetic Construct
gtgcccaaactattcccactgt

SEQ ID NO: 7824 - DNA, 25 bp, Artificial Sequence
  Synthetic Construct
ttggtaacctgacttcaacacctaa

SEQ ID NO: 7825 - DNA, 22 bp, Artificial Sequence
  Synthetic Construct
gcatgggccaagacatacacaa

SEQ ID NO: 7826 - DNA, 22 bp, Artificial Sequence
  Synthetic Construct
tttgggcaaggcggtttcctta

SEQ ID NO: 7827 - DNA, 25 bp, Artificial Sequence
  Synthetic Construct
ggtctgtactcaagtacacatgctt

SEQ ID NO: 7828 - DNA, 20 bp, Artificial Sequence
  Synthetic Construct
tgccagccagtcacagaagt

SEQ ID NO: 7829 - DNA, 28 bp, Artificial Sequence
  Synthetic Construct
aatgtcactcttacccattgcattaatc

SEQ ID NO: 7830 - DNA, 22 bp, Artificial Sequence
  Synthetic Construct
ggtaggcaaagcttgggtatct

SEQ ID NO: 7831 - DNA, 23 bp, Artificial Sequence
  Synthetic Construct
tcctgtgcttgggatctgagtca

SEQ ID NO: 7832 - DNA, 23 bp, Artificial Sequence
  Synthetic Construct
gcagcttcagtattggggatttc

SEQ ID NO: 7833 - DNA, 26 bp, Artificial Sequence
  Synthetic Construct
gggtacaattagccatgacccatctg

SEQ ID NO: 7834 - DNA, 29 bp, Artificial Sequence
  Synthetic Construct
gactagaaaaatgtaatcagtccccaagt

SEQ ID NO: 7835 - DNA, 22 bp, Artificial Sequence
  Synthetic Construct
acactgaccagaaccacaagtt

SEQ ID NO: 7836 - DNA, 22 bp, Artificial Sequence
  Synthetic Construct
ccaaatttctggcctccacttg

SEQ ID NO: 7837 - DNA, 22 bp, Artificial Sequence
  Synthetic Construct
tcagcaatgcagtgtgttcaga

SEQ ID NO: 7838 - DNA, 22 bp, Artificial Sequence
  Synthetic Construct
gaatggccacactcaagcttct

SEQ ID NO: 7839 - DNA, 21 bp, Artificial Sequence
  Synthetic Construct
aggccgtccaggtagagtaga

SEQ ID NO: 7840 - DNA, 20 bp, Artificial Sequence
  Synthetic Construct
tggccaccctgagatgtcat

SEQ ID NO: 7841 - DNA, 22 bp, Artificial Sequence
  Synthetic Construct
tgcctgtcagtcacatgcttct

SEQ ID NO: 7842 - DNA, 24 bp, Artificial Sequence
  Synthetic Construct
gacaaatgtctgcttcaacaagct

SEQ ID NO: 7843 - DNA, 26 bp, Artificial Sequence
  Synthetic Construct
agtggggtatcagtatcttcctcatt

SEQ ID NO: 7844 - DNA, 22 bp, Artificial Sequence
  Synthetic Construct
ttcccccactgatccattgctt

SEQ ID NO: 7845 - DNA, 20 bp, Artificial Sequence
  Synthetic Construct
tcctctcccggtctctacct

SEQ ID NO: 7846 - DNA, 22 bp, Artificial Sequence
  Synthetic Construct
tccaggagtggagatgtcacat

SEQ ID NO: 7847 - DNA, 24 bp, Artificial Sequence
  Synthetic Construct
gactggtgtgtgtctctgaaagtc

SEQ ID NO: 7848 - DNA, 22 bp, Artificial Sequence
  Synthetic Construct
tgaggacagagggcatattcct

SEQ ID NO: 7849 - DNA, 18 bp, Artificial Sequence
  Synthetic Construct
ggaccggcagcagaacca

SEQ ID NO: 7850 - DNA, 22 bp, Artificial Sequence
  Synthetic Construct
cagcaccactttgcactacttc

SEQ ID NO: 7851 - DNA, 22 bp, Artificial Sequence
  Synthetic Construct
ctgacctcagacatgcaggatt

SEQ ID NO: 7852 - DNA, 21 bp, Artificial Sequence
  Synthetic Construct
tgcctccccacaatccgttct

SEQ ID NO: 7853 - DNA, 23 bp, Artificial Sequence
  Synthetic Construct
ctgtgcattacctccatccttgt

SEQ ID NO: 7854 - DNA, 24 bp, Artificial Sequence
  Synthetic Construct
acatcacacagagtcctttgctaa

SEQ ID NO: 7855 - DNA, 25 bp, Artificial Sequence
  Synthetic Construct
agtatggcatgggagactaatttgg

SEQ ID NO: 7856 - DNA, 22 bp, Artificial Sequence
  Synthetic Construct
tggacgtgatgggtagaatcca

SEQ ID NO: 7857 - DNA, 23 bp, Artificial Sequence
  Synthetic Construct
ggtgctttagaaggcccttaaca

SEQ ID NO: 7858 - DNA, 28 bp, Artificial Sequence
  Synthetic Construct
acctttgtaacctaagatagggtagact

SEQ ID NO: 7859 - DNA, 22 bp, Artificial Sequence
  Synthetic Construct
accgtctccttctccaagttct

SEQ ID NO: 7860 - DNA, 20 bp, Artificial Sequence
  Synthetic Construct
cagccaggtcagcaggttca

SEQ ID NO: 7861 - DNA, 19 bp, Artificial Sequence
  Synthetic Construct
aggaagccgcagagccata

SEQ ID NO: 7862 - DNA, 23 bp, Artificial Sequence
  Synthetic Construct
ggctgagacttgaactcttctgt

SEQ ID NO: 7863 - DNA, 19 bp, Artificial Sequence
  Synthetic Construct
tgggtccgtgccacagtga

SEQ ID NO: 7864 - DNA, 26 bp, Artificial Sequence
  Synthetic Construct
ggatttagggacccagcttcttactg

SEQ ID NO: 7865 - DNA, 24 bp, Artificial Sequence
  Synthetic Construct
agacagtttgccagtcattatcca

SEQ ID NO: 7866 - DNA, 26 bp, Artificial Sequence
  Synthetic Construct
cctctagaaggaggggatagtcagat

SEQ ID NO: 7867 - DNA, 24 bp, Artificial Sequence
  Synthetic Construct
gacctggtattggtgaccctaaga

SEQ ID NO: 7868 - DNA, 25 bp, Artificial Sequence
  Synthetic Construct
gctcggaggtgactatcttctacag

SEQ ID NO: 7869 - DNA, 22 bp, Artificial Sequence
  Synthetic Construct
ccaaccactccctcatgctaca

SEQ ID NO: 7870 - DNA, 27 bp, Artificial Sequence
  Synthetic Construct
ccactgctatttctttgttgtgacaca

SEQ ID NO: 7871 - DNA, 26 bp, Artificial Sequence
  Synthetic Construct
gctgactatatgcttctgctgaactg

SEQ ID NO: 7872 - DNA, 24 bp, Artificial Sequence
  Synthetic Construct
gccacaaagtagttgccagatcac

SEQ ID NO: 7873 - DNA, 21 bp, Artificial Sequence
  Synthetic Construct
tgggagcatggatggtgatca

SEQ ID NO: 7874 - DNA, 26 bp, Artificial Sequence
  Synthetic Construct
ctgcacatccttaattcttcctgtct

SEQ ID NO: 7875 - DNA, 21 bp, Artificial Sequence
  Synthetic Construct
tgctgtgctaggtggctttag

SEQ ID NO: 7876 - DNA, 21 bp, Artificial Sequence
  Synthetic Construct
aaaccctggcacacagaatca

SEQ ID NO: 7877 - DNA, 20 bp, Artificial Sequence
  Synthetic Construct
tggagaccctggggcttgtg

SEQ ID NO: 7878 - DNA, 22 bp, Artificial Sequence
  Synthetic Construct
acaccttagcagcactgaacac

SEQ ID NO: 7879 - DNA, 21 bp, Artificial Sequence
  Synthetic Construct
gaacacccgagccattctgaa

SEQ ID NO: 7880 - DNA, 26 bp, Artificial Sequence
  Synthetic Construct
ccagtgtaactatttgagctggacta

SEQ ID NO: 7881 - DNA, 24 bp, Artificial Sequence
  Synthetic Construct
tcttgcttgaggctgatctctatg

SEQ ID NO: 7882 - DNA, 22 bp, Artificial Sequence
  Synthetic Construct
aacagggtctggaagggctttt

SEQ ID NO: 7883 - DNA, 25 bp, Artificial Sequence
  Synthetic Construct
ggtgtgtatgaagccaagtctagga

SEQ ID NO: 7884 - DNA, 21 bp, Artificial Sequence
  Synthetic Construct
tgatgcagctctctcctgtca

SEQ ID NO: 7885 - DNA, 28 bp, Artificial Sequence
  Synthetic Construct
gagataggtcatctcttgaagacagagt

SEQ ID NO: 7886 - DNA, 24 bp, Artificial Sequence
  Synthetic Construct
gcaacggaggcagttctagatctt

SEQ ID NO: 7887 - DNA, 23 bp, Artificial Sequence
  Synthetic Construct
gctctggaaggtacaagccataa

SEQ ID NO: 7888 - DNA, 21 bp, Artificial Sequence
  Synthetic Construct
ctaggccccacccacaaaacc

SEQ ID NO: 7889 - DNA, 21 bp, Artificial Sequence
  Synthetic Construct
cacaccatccaacctgagcaa

SEQ ID NO: 7890 - DNA, 25 bp, Artificial Sequence
  Synthetic Construct
gtttgaccaaatacctgtggaccta

SEQ ID NO: 7891 - DNA, 22 bp, Artificial Sequence
  Synthetic Construct
ctcctgctccttcacacacaaa

SEQ ID NO: 7892 - DNA, 24 bp, Artificial Sequence
  Synthetic Construct
tccactctaaagctttcccattcc

SEQ ID NO: 7893 - DNA, 25 bp, Artificial Sequence
  Synthetic Construct
agcattccaatgtcacttgattgtg

SEQ ID NO: 7894 - DNA, 21 bp, Artificial Sequence
  Synthetic Construct
aatgtgtggcagggacagcaa

SEQ ID NO: 7895 - DNA, 25 bp, Artificial Sequence
  Synthetic Construct
cctttaggggacaacttttcatgga

SEQ ID NO: 7896 - DNA, 19 bp, Artificial Sequence
  Synthetic Construct
cagggtgaaccagcaagct

SEQ ID NO: 7897 - DNA, 22 bp, Artificial Sequence
  Synthetic Construct
agggcagggaccttatttacct

SEQ ID NO: 7898 - DNA, 23 bp, Artificial Sequence
  Synthetic Construct
tggaccatctgaaggcctactga

SEQ ID NO: 7899 - DNA, 25 bp, Artificial Sequence
  Synthetic Construct
cccactgaacctgcagacattattt

SEQ ID NO: 7900 - DNA, 24 bp, Artificial Sequence
  Synthetic Construct
caagaggagaaagtgtggatttgc

SEQ ID NO: 7901 - DNA, 23 bp, Artificial Sequence
  Synthetic Construct
catgcaggagcttagagactgat

SEQ ID NO: 7902 - DNA, 21 bp, Artificial Sequence
  Synthetic Construct
ttggacccgaatgcagatctg

SEQ ID NO: 7903 - DNA, 24 bp, Artificial Sequence
  Synthetic Construct
tggagcccagagaggttttatgtc

SEQ ID NO: 7904 - DNA, 22 bp, Artificial Sequence
  Synthetic Construct
tcctcagcttgtggacacaaac

SEQ ID NO: 7905 - DNA, 21 bp, Artificial Sequence
  Synthetic Construct
caaaaaggcagcacacacgat

SEQ ID NO: 7906 - DNA, 22 bp, Artificial Sequence
  Synthetic Construct
gggtaggaggaggacacagtac

SEQ ID NO: 7907 - DNA, 24 bp, Artificial Sequence
  Synthetic Construct
gcactaccaaaacctctcctccaa

SEQ ID NO: 7908 - DNA, 25 bp, Artificial Sequence
  Synthetic Construct
ggcttagagcaataggagtttgttc

SEQ ID NO: 7909 - DNA, 27 bp, Artificial Sequence
  Synthetic Construct
gtggtaactgtttagtccacacttagg

SEQ ID NO: 7910 - DNA, 21 bp, Artificial Sequence
  Synthetic Construct
caaagctgtggtgacccagat

SEQ ID NO: 7911 - DNA, 24 bp, Artificial Sequence
  Synthetic Construct
ggaatagaaggcagggaacacttc

SEQ ID NO: 7912 - DNA, 22 bp, Artificial Sequence
  Synthetic Construct
ctgtcaacagggctttcaagct

SEQ ID NO: 7913 - DNA, 24 bp, Artificial Sequence
  Synthetic Construct
gccatcattcagaggagctttcga

SEQ ID NO: 7914 - DNA, 24 bp, Artificial Sequence
  Synthetic Construct
gtcaacagcctgcctctttttatg

SEQ ID NO: 7915 - DNA, 22 bp, Artificial Sequence
  Synthetic Construct
gtgcatctccaatccaggtgat

SEQ ID NO: 7916 - DNA, 24 bp, Artificial Sequence
  Synthetic Construct
gacctggagatttcttctcacctt

SEQ ID NO: 7917 - DNA, 22 bp, Artificial Sequence
  Synthetic Construct
acctgacttcccatgcttaagc

SEQ ID NO: 7918 - DNA, 27 bp, Artificial Sequence
  Synthetic Construct
ccaaagtttgaaaaggatagagcttga

SEQ ID NO: 7919 - DNA, 22 bp, Artificial Sequence
  Synthetic Construct
tctccagccagtctacctctca

SEQ ID NO: 7920 - DNA, 24 bp, Artificial Sequence
  Synthetic Construct
gataggggcagagtcttcctaaac

SEQ ID NO: 7921 - DNA, 18 bp, Artificial Sequence
  Synthetic Construct
tggctgacccgggtagct

SEQ ID NO: 7922 - DNA, 24 bp, Artificial Sequence
  Synthetic Construct
ggtgtgacttacagccagatgatc

SEQ ID NO: 7923 - DNA, 27 bp, Artificial Sequence
  Synthetic Construct
ctgcacattgtggcctaccctctctta

SEQ ID NO: 7924 - DNA, 22 bp, Artificial Sequence
  Synthetic Construct
tgggattgtgctcctgctaagt

SEQ ID NO: 7925 - DNA, 25 bp, Artificial Sequence
  Synthetic Construct
aaacagacttcatttccccaatcac

SEQ ID NO: 7926 - DNA, 27 bp, Artificial Sequence
  Synthetic Construct
gcttaaaaagaaggtttgcatcccata

SEQ ID NO: 7927 - DNA, 26 bp, Artificial Sequence
  Synthetic Construct
gtgaccataaagatgcgtctctttcc

SEQ ID NO: 7928 - DNA, 24 bp, Artificial Sequence
  Synthetic Construct
cccatcccacctttctacagcatt

SEQ ID NO: 7929 - DNA, 20 bp, Artificial Sequence
  Synthetic Construct
ttctggcccctctccctaca

SEQ ID NO: 7930 - DNA, 23 bp, Artificial Sequence
  Synthetic Construct
atgggaagaaagccatagagcaa

SEQ ID NO: 7931 - DNA, 20 bp, Artificial Sequence
  Synthetic Construct
tgcttgactcacgccttcca

SEQ ID NO: 7932 - DNA, 21 bp, Artificial Sequence
  Synthetic Construct
aagactggggacgggatactt

SEQ ID NO: 7933 - DNA, 24 bp, Artificial Sequence
  Synthetic Construct
ccaggaactctagggaagacagaa

SEQ ID NO: 7934 - DNA, 23 bp, Artificial Sequence
  Synthetic Construct
cacccagataacacactctggaa

SEQ ID NO: 7935 - DNA, 22 bp, Artificial Sequence
  Synthetic Construct
cagcaaggcttcttctggtcaa

SEQ ID NO: 7936 - DNA, 21 bp, Artificial Sequence
  Synthetic Construct
tgccagcgaaccctagaagga

SEQ ID NO: 7937 - DNA, 26 bp, Artificial Sequence
  Synthetic Construct
accagcccaatattatccccaatatg

SEQ ID NO: 7938 - DNA, 23 bp, Artificial Sequence
  Synthetic Construct
agcccagattcctgagggcttta

SEQ ID NO: 7939 - DNA, 22 bp, Artificial Sequence
  Synthetic Construct
tgctccacttcagtgactaggt

SEQ ID NO: 7940 - DNA, 19 bp, Artificial Sequence
  Synthetic Construct
agagctgtgctgccttctg

SEQ ID NO: 7941 - DNA, 27 bp, Artificial Sequence
  Synthetic Construct
gctccttctattttgagggtcaaggtt

SEQ ID NO: 7942 - DNA, 23 bp, Artificial Sequence
  Synthetic Construct
cctcttgggaaacagctctttgg

SEQ ID NO: 7943 - DNA, 24 bp, Artificial Sequence
  Synthetic Construct
cgtctctctccctgatacattcct

SEQ ID NO: 7944 - DNA, 20 bp, Artificial Sequence
  Synthetic Construct
acggctctttccacccatca

SEQ ID NO: 7945 - DNA, 22 bp, Artificial Sequence
  Synthetic Construct
aggcccatgtctgagctggtaa

SEQ ID NO: 7946 - DNA, 22 bp, Artificial Sequence
  Synthetic Construct
tcactgtgcccagcctttgtaa

SEQ ID NO: 7947 - DNA, 24 bp, Artificial Sequence
  Synthetic Construct
actacaggattcggagagggaaac

SEQ ID NO: 7948 - DNA, 22 bp, Artificial Sequence
  Synthetic Construct
ggaacgcttgtctttggattgg

SEQ ID NO: 7949 - DNA, 25 bp, Artificial Sequence
  Synthetic Construct
gaaaggatgttcataggggagtgat

SEQ ID NO: 7950 - DNA, 21 bp, Artificial Sequence
  Synthetic Construct
aggctggaggaggacacattt

SEQ ID NO: 7951 - DNA, 23 bp, Artificial Sequence
  Synthetic Construct
tgtcttcatgtgtatggctgtgt

SEQ ID NO: 7952 - DNA, 22 bp, Artificial Sequence
  Synthetic Construct
gggtcaacagatgcatgtgaag

SEQ ID NO: 7953 - DNA, 23 bp, Artificial Sequence
  Synthetic Construct
caccacacctggcctattttcct

SEQ ID NO: 7954 - DNA, 20 bp, Artificial Sequence
  Synthetic Construct
accaggtggctgggtgacat

SEQ ID NO: 7955 - DNA, 26 bp, Artificial Sequence
  Synthetic Construct
cctacagtgatcatgatgaactgcta

SEQ ID NO: 7956 - DNA, 30 bp, Artificial Sequence
  Synthetic Construct
ctgttcttattttaggtgcatagggttatg

SEQ ID NO: 7957 - DNA, 19 bp, Artificial Sequence
  Synthetic Construct
acttccccaaccccactct

SEQ ID NO: 7958 - DNA, 22 bp, Artificial Sequence
  Synthetic Construct
cagctccaggaattgctgtact

SEQ ID NO: 7959 - DNA, 24 bp, Artificial Sequence
  Synthetic Construct
acctgggtcttcattctggagaga

SEQ ID NO: 7960 - DNA, 23 bp, Artificial Sequence
  Synthetic Construct
actctttcctgcttcaactgcaa

SEQ ID NO: 7961 - DNA, 26 bp, Artificial Sequence
  Synthetic Construct
ccctaaaacacaaccttgatcatgct

SEQ ID NO: 7962 - DNA, 24 bp, Artificial Sequence
  Synthetic Construct
ccttccctcaaatcactgctgctt

SEQ ID NO: 7963 - DNA, 22 bp, Artificial Sequence
  Synthetic Construct
aggaggaacccaggcaaatagg

SEQ ID NO: 7964 - DNA, 23 bp, Artificial Sequence
  Synthetic Construct
agtcagtggcctgagttctagtc

SEQ ID NO: 7965 - DNA, 24 bp, Artificial Sequence
  Synthetic Construct
cctggaagacagaaagctcattcc

SEQ ID NO: 7966 - DNA, 20 bp, Artificial Sequence
  Synthetic Construct
tcccccatgccttccaaatc

SEQ ID NO: 7967 - DNA, 26 bp, Artificial Sequence
  Synthetic Construct
ctcttgttgattggactctgctagtg

SEQ ID NO: 7968 - DNA, 23 bp, Artificial Sequence
  Synthetic Construct
tggagggacctggaattccatgt

SEQ ID NO: 7969 - DNA, 25 bp, Artificial Sequence
  Synthetic Construct
gggatccatagttacccttctccta

SEQ ID NO: 7970 - DNA, 23 bp, Artificial Sequence
  Synthetic Construct
ccctacctcttagcccagaaact

SEQ ID NO: 7971 - DNA, 25 bp, Artificial Sequence
  Synthetic Construct
ctgcagtgtcactttacttctctgt

SEQ ID NO: 7972 - DNA, 22 bp, Artificial Sequence
  Synthetic Construct
tcactctgtccactcctcagtt

SEQ ID NO: 7973 - DNA, 24 bp, Artificial Sequence
  Synthetic Construct
ccaaccatggcttgagatcttcac

SEQ ID NO: 7974 - DNA, 20 bp, Artificial Sequence
  Synthetic Construct
atttcacggcagaggtgtgt

SEQ ID NO: 7975 - DNA, 24 bp, Artificial Sequence
  Synthetic Construct
ggctggtactgtgggtgattacaa

SEQ ID NO: 7976 - DNA, 23 bp, Artificial Sequence
  Synthetic Construct
gagagaggcctgggtcagatcct

SEQ ID NO: 7977 - DNA, 24 bp, Artificial Sequence
  Synthetic Construct
gctctttcacatgtgggagtagct

SEQ ID NO: 7978 - DNA, 22 bp, Artificial Sequence
  Synthetic Construct
ccaggtcatgcacaaagaccta

SEQ ID NO: 7979 - DNA, 25 bp, Artificial Sequence
  Synthetic Construct
cgaagcccatgtttagtcacttagt

SEQ ID NO: 7980 - DNA, 25 bp, Artificial Sequence
  Synthetic Construct
gagtggttctagggaagtcacactt

SEQ ID NO: 7981 - DNA, 26 bp, Artificial Sequence
  Synthetic Construct
caatcatgttttggagactggaggat

SEQ ID NO: 7982 - DNA, 22 bp, Artificial Sequence
  Synthetic Construct
cagccttccacaacatgaacca

SEQ ID NO: 7983 - DNA, 21 bp, Artificial Sequence
  Synthetic Construct
ccacttgcagaagaggtgcat

SEQ ID NO: 7984 - DNA, 22 bp, Artificial Sequence
  Synthetic Construct
gttcccacacagttaccaagct

SEQ ID NO: 7985 - DNA, 22 bp, Artificial Sequence
  Synthetic Construct
tgcactaagggaaagggaacac

SEQ ID NO: 7986 - DNA, 25 bp, Artificial Sequence
  Synthetic Construct
ccaatttgggattccaatgctactt

SEQ ID NO: 7987 - DNA, 22 bp, Artificial Sequence
  Synthetic Construct
cagttacgctcactggatggat

SEQ ID NO: 7988 - DNA, 26 bp, Artificial Sequence
  Synthetic Construct
gcatgaggactactctgggtctattg

SEQ ID NO: 7989 - DNA, 22 bp, Artificial Sequence
  Synthetic Construct
cctgatgggaacaggcattctt

SEQ ID NO: 7990 - DNA, 23 bp, Artificial Sequence
  Synthetic Construct
gaagcagcctgaggttaatctct

SEQ ID NO: 7991 - DNA, 24 bp, Artificial Sequence
  Synthetic Construct
ccttacttgtgggagtgacatggt

SEQ ID NO: 7992 - DNA, 21 bp, Artificial Sequence
  Synthetic Construct
aggtaaccgaggctgggagtt

SEQ ID NO: 7993 - DNA, 22 bp, Artificial Sequence
  Synthetic Construct
ttgagcaggaccatctcctttg

SEQ ID NO: 7994 - DNA, 23 bp, Artificial Sequence
  Synthetic Construct
tcaataaatggcagccaccatca

SEQ ID NO: 7995 - DNA, 20 bp, Artificial Sequence
  Synthetic Construct
tgcctgcatctcctcccttt

SEQ ID NO: 7996 - DNA, 24 bp, Artificial Sequence
  Synthetic Construct
ggaggtcagacacaggacaaacaa

SEQ ID NO: 7997 - DNA, 18 bp, Artificial Sequence
  Synthetic Construct
tcgccacccagctcaaca

SEQ ID NO: 7998 - DNA, 24 bp, Artificial Sequence
  Synthetic Construct
gctgccgtgttaaaaaaccatggt

SEQ ID NO: 7999 - DNA, 24 bp, Artificial Sequence
  Synthetic Construct
cagctgagctcatctcttcctctt

SEQ ID NO: 8000 - DNA, 22 bp, Artificial Sequence
  Synthetic Construct
ggcctagaagagctctgagaca

SEQ ID NO: 8001 - DNA, 20 bp, Artificial Sequence
  Synthetic Construct
acggtagttccccccttacc

SEQ ID NO: 8002 - DNA, 23 bp, Artificial Sequence
  Synthetic Construct
caaatatgcagtcagcccttgtc

SEQ ID NO: 8003 - DNA, 22 bp, Artificial Sequence
  Synthetic Construct
ccacagcattcccagtctacct

SEQ ID NO: 8004 - DNA, 25 bp, Artificial Sequence
  Synthetic Construct
agctcctggattaaaaggcacatag

SEQ ID NO: 8005 - DNA, 23 bp, Artificial Sequence
  Synthetic Construct
agactgctgctgagtttttgagt

SEQ ID NO: 8006 - DNA, 23 bp, Artificial Sequence
  Synthetic Construct
gaagccgggtatggaaatagtga

SEQ ID NO: 8007 - DNA, 24 bp, Artificial Sequence
  Synthetic Construct
gggtcagtcaacaccaggagttaa

SEQ ID NO: 8008 - DNA, 23 bp, Artificial Sequence
  Synthetic Construct
tcagtttcccccctacacaatgg

SEQ ID NO: 8009 - DNA, 27 bp, Artificial Sequence
  Synthetic Construct
tgtatagataggggtcttgccattttg

SEQ ID NO: 8010 - DNA, 21 bp, Artificial Sequence
  Synthetic Construct
ggtggaacggatttgggcata

SEQ ID NO: 8011 - DNA, 21 bp, Artificial Sequence
  Synthetic Construct
caggatggcttggttcactga

SEQ ID NO: 8012 - DNA, 22 bp, Artificial Sequence
  Synthetic Construct
catccagctgtgtctgctttgt

SEQ ID NO: 8013 - DNA, 26 bp, Artificial Sequence
  Synthetic Construct
cttaccttaagattcatgccccatca

SEQ ID NO: 8014 - DNA, 20 bp, Artificial Sequence
  Synthetic Construct
agtcctgcctttcccacatg

SEQ ID NO: 8015 - DNA, 25 bp, Artificial Sequence
  Synthetic Construct
gggagagaggtgtgaaggaccacat

SEQ ID NO: 8016 - DNA, 22 bp, Artificial Sequence
  Synthetic Construct
tccagggtcacggtgttctttt

SEQ ID NO: 8017 - DNA, 23 bp, Artificial Sequence
  Synthetic Construct
ccttctgtggctgctctcctttt

SEQ ID NO: 8018 - DNA, 23 bp, Artificial Sequence
  Synthetic Construct
ccaatgccattagctccagaaca

SEQ ID NO: 8019 - DNA, 25 bp, Artificial Sequence
  Synthetic Construct
gtgttaagttaagccgtgtcagcaa

SEQ ID NO: 8020 - DNA, 24 bp, Artificial Sequence
  Synthetic Construct
ggtgatcccctgcaaagttgaaac

SEQ ID NO: 8021 - DNA, 25 bp, Artificial Sequence
  Synthetic Construct
ggcttgaccttttacagatcacctt

SEQ ID NO: 8022 - DNA, 26 bp, Artificial Sequence
  Synthetic Construct
gttcaagagtcacggcaaacatacag

SEQ ID NO: 8023 - DNA, 26 bp, Artificial Sequence
  Synthetic Construct
ctgcaatagtttggtggagacataac

SEQ ID NO: 8024 - DNA, 20 bp, Artificial Sequence
  Synthetic Construct
atgcccctgtgcctttgagt

SEQ ID NO: 8025 - DNA, 21 bp, Artificial Sequence
  Synthetic Construct
agtcgcacccttccatctcat

SEQ ID NO: 8026 - DNA, 23 bp, Artificial Sequence
  Synthetic Construct
cacctaattcctccccagatcct

SEQ ID NO: 8027 - DNA, 24 bp, Artificial Sequence
  Synthetic Construct
ggaagacaaaggaggcaagacatc

SEQ ID NO: 8028 - DNA, 24 bp, Artificial Sequence
  Synthetic Construct
gggttgccagtctgattgtggtaa

SEQ ID NO: 8029 - DNA, 23 bp, Artificial Sequence
  Synthetic Construct
gccatgggctgtgatctcactta

SEQ ID NO: 8030 - DNA, 23 bp, Artificial Sequence
  Synthetic Construct
gacaatcctcacaatggctctgt

SEQ ID NO: 8031 - DNA, 22 bp, Artificial Sequence
  Synthetic Construct
agaccctgaccaccctgtttaa

SEQ ID NO: 8032 - DNA, 19 bp, Artificial Sequence
  Synthetic Construct
tgctgctggggctgacaga

SEQ ID NO: 8033 - DNA, 25 bp, Artificial Sequence
  Synthetic Construct
agtgatacccctgtgtagaatcgat

SEQ ID NO: 8034 - DNA, 21 bp, Artificial Sequence
  Synthetic Construct
tgggtctagcctccctactgt

SEQ ID NO: 8035 - DNA, 21 bp, Artificial Sequence
  Synthetic Construct
tcccaccttcccaggatgtca

SEQ ID NO: 8036 - DNA, 21 bp, Artificial Sequence
  Synthetic Construct
agccatggagagacaggaact

SEQ ID NO: 8037 - DNA, 26 bp, Artificial Sequence
  Synthetic Construct
catggttgctgtgataattggatcag

SEQ ID NO: 8038 - DNA, 22 bp, Artificial Sequence
  Synthetic Construct
catccagggacaacaagactgt

SEQ ID NO: 8039 - DNA, 24 bp, Artificial Sequence
  Synthetic Construct
gagccgcccaggtataaaataacc

SEQ ID NO: 8040 - DNA, 19 bp, Artificial Sequence
  Synthetic Construct
tggtgccaatgcagttgct

SEQ ID NO: 8041 - DNA, 22 bp, Artificial Sequence
  Synthetic Construct
aaggagcttggaagtcgccatt

SEQ ID NO: 8042 - DNA, 19 bp, Artificial Sequence
  Synthetic Construct
atgtgcccccttccttcca

SEQ ID NO: 8043 - DNA, 19 bp, Artificial Sequence
  Synthetic Construct
gccctcccctcagcttctg

SEQ ID NO: 8044 - DNA, 26 bp, Artificial Sequence
  Synthetic Construct
ccaaaactcaggaaagaaaggtacga

SEQ ID NO: 8045 - DNA, 22 bp, Artificial Sequence
  Synthetic Construct
aggtaaaccccatctggctttc

SEQ ID NO: 8046 - DNA, 27 bp, Artificial Sequence
  Synthetic Construct
caacacacatatccaggtgtttttctc

SEQ ID NO: 8047 - DNA, 21 bp, Artificial Sequence
  Synthetic Construct
atcaaccagcagggctcatca

SEQ ID NO: 8048 - DNA, 30 bp, Artificial Sequence
  Synthetic Construct
gcataaagagtaggtggtttagaagggtta

SEQ ID NO: 8049 - DNA, 19 bp, Artificial Sequence
  Synthetic Construct
tgcgtaaagcccccacaac

SEQ ID NO: 8050 - DNA, 21 bp, Artificial Sequence
  Synthetic Construct
tgtgtgtttcgggtgggagta

SEQ ID NO: 8051 - DNA, 22 bp, Artificial Sequence
  Synthetic Construct
aactcgccagtcccttcctaat

SEQ ID NO: 8052 - DNA, 21 bp, Artificial Sequence
  Synthetic Construct
ccatgacccagagctcagaga

SEQ ID NO: 8053 - DNA, 21 bp, Artificial Sequence
  Synthetic Construct
ccagccttgccaatcatacca

SEQ ID NO: 8054 - DNA, 24 bp, Artificial Sequence
  Synthetic Construct
gcctgtgataactctggcttgatg

SEQ ID NO: 8055 - DNA, 21 bp, Artificial Sequence
  Synthetic Construct
tgcacaagcctcagtgtttgg

SEQ ID NO: 8056 - DNA, 25 bp, Artificial Sequence
  Synthetic Construct
tctggtgtttaaaagacaccctctt

SEQ ID NO: 8057 - DNA, 19 bp, Artificial Sequence
  Synthetic Construct
gcacaggactggtgcttct

SEQ ID NO: 8058 - DNA, 22 bp, Artificial Sequence
  Synthetic Construct
cctcatggggtggttgggaata

SEQ ID NO: 8059 - DNA, 20 bp, Artificial Sequence
  Synthetic Construct
ggctctcagtcctccaaagc

SEQ ID NO: 8060 - DNA, 22 bp, Artificial Sequence
  Synthetic Construct
gaggggcctgataaagtttggt

SEQ ID NO: 8061 - DNA, 18 bp, Artificial Sequence
  Synthetic Construct
acaggccaggtggacagt

SEQ ID NO: 8062 - DNA, 24 bp, Artificial Sequence
  Synthetic Construct
agcaggtacaccgttaatgagaag

SEQ ID NO: 8063 - DNA, 27 bp, Artificial Sequence
  Synthetic Construct
ccttacctctactctgaactggacttg

SEQ ID NO: 8064 - DNA, 23 bp, Artificial Sequence
  Synthetic Construct
aggcactctgagttacagtttgg

SEQ ID NO: 8065 - DNA, 22 bp, Artificial Sequence
  Synthetic Construct
gaagccagcatggtctcatgtt

SEQ ID NO: 8066 - DNA, 25 bp, Artificial Sequence
  Synthetic Construct
gactgtcttcaaatcagctgcattc

SEQ ID NO: 8067 - DNA, 22 bp, Artificial Sequence
  Synthetic Construct
aagacagcaggagggagacatt

SEQ ID NO: 8068 - DNA, 24 bp, Artificial Sequence
  Synthetic Construct
ctgtactttgcccatctctttcct

SEQ ID NO: 8069 - DNA, 24 bp, Artificial Sequence
  Synthetic Construct
gctcaagccccctcaataatggat

SEQ ID NO: 8070 - DNA, 20 bp, Artificial Sequence
  Synthetic Construct
acagacactgagcccagtca

SEQ ID NO: 8071 - DNA, 26 bp, Artificial Sequence
  Synthetic Construct
tcacatagagcagtgttacttcttca

SEQ ID NO: 8072 - DNA, 26 bp, Artificial Sequence
  Synthetic Construct
ggacatttgttaccaaaggctaagca

SEQ ID NO: 8073 - DNA, 24 bp, Artificial Sequence
  Synthetic Construct
gagtaccctaacacaccccatagt

SEQ ID NO: 8074 - DNA, 22 bp, Artificial Sequence
  Synthetic Construct
ttcccttgcagtgagcttttcc

SEQ ID NO: 8075 - DNA, 25 bp, Artificial Sequence
  Synthetic Construct
gagacactcattttgcagagaacaa

SEQ ID NO: 8076 - DNA, 22 bp, Artificial Sequence
  Synthetic Construct
tggtggcctgacttccttctga

SEQ ID NO: 8077 - DNA, 22 bp, Artificial Sequence
  Synthetic Construct
gcactgaggattccagattcca

SEQ ID NO: 8078 - DNA, 23 bp, Artificial Sequence
  Synthetic Construct
tcctcctgtctatctgcctttct

SEQ ID NO: 8079 - DNA, 24 bp, Artificial Sequence
  Synthetic Construct
cctctgcttgtcagcccttatctt

SEQ ID NO: 8080 - DNA, 22 bp, Artificial Sequence
  Synthetic Construct
tgggaaaagagaaccagttgca

SEQ ID NO: 8081 - DNA, 22 bp, Artificial Sequence
  Synthetic Construct
gttcacatggagcatcgtgcat

SEQ ID NO: 8082 - DNA, 24 bp, Artificial Sequence
  Synthetic Construct
gcaccaaaagggagagcaagtttc

SEQ ID NO: 8083 - DNA, 24 bp, Artificial Sequence
  Synthetic Construct
agcaggacctgactctgacctata

SEQ ID NO: 8084 - DNA, 22 bp, Artificial Sequence
  Synthetic Construct
aacctcagacccaggctctaca

SEQ ID NO: 8085 - DNA, 24 bp, Artificial Sequence
  Synthetic Construct
ggcttccttgctgtaccttcatct

SEQ ID NO: 8086 - DNA, 23 bp, Artificial Sequence
  Synthetic Construct
aggctgggaatgggattctttcc

SEQ ID NO: 8087 - DNA, 24 bp, Artificial Sequence
  Synthetic Construct
gccttagtgagtggaagtcatgtt

SEQ ID NO: 8088 - DNA, 22 bp, Artificial Sequence
  Synthetic Construct
ccaggacacagtgctactccaa

SEQ ID NO: 8089 - DNA, 22 bp, Artificial Sequence
  Synthetic Construct
tctgacaatggtgccgatatgg

SEQ ID NO: 8090 - DNA, 20 bp, Artificial Sequence
  Synthetic Construct
accagaagcaagggcagaca

SEQ ID NO: 8091 - DNA, 24 bp, Artificial Sequence
  Synthetic Construct
tgccaggatttgatgacttgttga

SEQ ID NO: 8092 - DNA, 22 bp, Artificial Sequence
  Synthetic Construct
tggaggccacccttatgtctca

SEQ ID NO: 8093 - DNA, 28 bp, Artificial Sequence
  Synthetic Construct
agtgccagtatattattcaaacgtctct

SEQ ID NO: 8094 - DNA, 22 bp, Artificial Sequence
  Synthetic Construct
gaaatctggctaggagcaaggt

SEQ ID NO: 8095 - DNA, 22 bp, Artificial Sequence
  Synthetic Construct
ggccatttctacaggggattcc

SEQ ID NO: 8096 - DNA, 21 bp, Artificial Sequence
  Synthetic Construct
cgctgaccctcccatagtgtt

SEQ ID NO: 8097 - DNA, 24 bp, Artificial Sequence
  Synthetic Construct
cctgcataaagccctgatggtgaa

SEQ ID NO: 8098 - DNA, 19 bp, Artificial Sequence
  Synthetic Construct
aggagggcaggtggaagca

SEQ ID NO: 8099 - DNA, 18 bp, Artificial Sequence
  Synthetic Construct
gccccctcactggcttct

SEQ ID NO: 8100 - DNA, 24 bp, Artificial Sequence
  Synthetic Construct
ggaaaacctcagagacgagggttt

SEQ ID NO: 8101 - DNA, 24 bp, Artificial Sequence
  Synthetic Construct
tgggagtgctgtcattgagctatg

SEQ ID NO: 8102 - DNA, 26 bp, Artificial Sequence
  Synthetic Construct
tgcacctatgatttttactgcacttg

SEQ ID NO: 8103 - DNA, 22 bp, Artificial Sequence
  Synthetic Construct
tccagctgtcactgtggtatga

SEQ ID NO: 8104 - DNA, 22 bp, Artificial Sequence
  Synthetic Construct
tgttgcggcttaggacatgcta

SEQ ID NO: 8105 - DNA, 24 bp, Artificial Sequence
  Synthetic Construct
gggtgtctagatgggtgagtaagt

SEQ ID NO: 8106 - DNA, 29 bp, Artificial Sequence
  Synthetic Construct
gcaaggtattcactatgattcccttacag

SEQ ID NO: 8107 - DNA, 23 bp, Artificial Sequence
  Synthetic Construct
cagcccataaggtttctcttggt

SEQ ID NO: 8108 - DNA, 27 bp, Artificial Sequence
  Synthetic Construct
gttgggagtttaagatagctgaatcac

SEQ ID NO: 8109 - DNA, 26 bp, Artificial Sequence
  Synthetic Construct
gtataggcctagagactaaggtgtca

SEQ ID NO: 8110 - DNA, 26 bp, Artificial Sequence
  Synthetic Construct
ggtaaatcagagtggactcagcatct

SEQ ID NO: 8111 - DNA, 24 bp, Artificial Sequence
  Synthetic Construct
ccagtgccatgctctaaacaagga

SEQ ID NO: 8112 - DNA, 25 bp, Artificial Sequence
  Synthetic Construct
gactctactgcaaaaggatctggat

SEQ ID NO: 8113 - DNA, 26 bp, Artificial Sequence
  Synthetic Construct
gatgaaaagagatgaagggacatgac

SEQ ID NO: 8114 - DNA, 19 bp, Artificial Sequence
  Synthetic Construct
gctgaccccttggcaccat

SEQ ID NO: 8115 - DNA, 21 bp, Artificial Sequence
  Synthetic Construct
tctcaatggtggctgcaatca

SEQ ID NO: 8116 - DNA, 22 bp, Artificial Sequence
  Synthetic Construct
ttggagcccagtgagcttcatc

SEQ ID NO: 8117 - DNA, 20 bp, Artificial Sequence
  Synthetic Construct
tccttgcaagttgcctggaa

SEQ ID NO: 8118 - DNA, 19 bp, Artificial Sequence
  Synthetic Construct
ttcccccacctccatgaca

SEQ ID NO: 8119 - DNA, 21 bp, Artificial Sequence
  Synthetic Construct
gtgatcaagggggaggaacct

SEQ ID NO: 8120 - DNA, 25 bp, Artificial Sequence
  Synthetic Construct
gctaaaatctcaggccattgctatc

SEQ ID NO: 8121 - DNA, 22 bp, Artificial Sequence
  Synthetic Construct
gtccagggaatcagcaaagaca

SEQ ID NO: 8122 - DNA, 24 bp, Artificial Sequence
  Synthetic Construct
cccccttcagaaaagcagctttca

SEQ ID NO: 8123 - DNA, 21 bp, Artificial Sequence
  Synthetic Construct
tcccgtaacagcagcctaatc

SEQ ID NO: 8124 - DNA, 22 bp, Artificial Sequence
  Synthetic Construct
ccttgatgtcctgctcaattgc

SEQ ID NO: 8125 - DNA, 22 bp, Artificial Sequence
  Synthetic Construct
ggaggttgcacacagttggtat

SEQ ID NO: 8126 - DNA, 21 bp, Artificial Sequence
  Synthetic Construct
tgggacaggcagaagaagtgt

SEQ ID NO: 8127 - DNA, 19 bp, Artificial Sequence
  Synthetic Construct
aaacacccagcccccaaca

SEQ ID NO: 8128 - DNA, 25 bp, Artificial Sequence
  Synthetic Construct
ccagttctgagcacagagttatgtg

SEQ ID NO: 8129 - DNA, 20 bp, Artificial Sequence
  Synthetic Construct
ccaagcctgcagcaaggtta

SEQ ID NO: 8130 - DNA, 23 bp, Artificial Sequence
  Synthetic Construct
gagttgcaggaggtagctgtatg

SEQ ID NO: 8131 - DNA, 22 bp, Artificial Sequence
  Synthetic Construct
ggctgaacctgaggttttcact

SEQ ID NO: 8132 - DNA, 23 bp, Artificial Sequence
  Synthetic Construct
ccaaaagagatcccatccttcca

SEQ ID NO: 8133 - DNA, 22 bp, Artificial Sequence
  Synthetic Construct
aacccttcctcttcccagatga

SEQ ID NO: 8134 - DNA, 22 bp, Artificial Sequence
  Synthetic Construct
tggggacatttgcatctcacat

SEQ ID NO: 8135 - DNA, 23 bp, Artificial Sequence
  Synthetic Construct
ggttccagaactgttggaatcct

SEQ ID NO: 8136 - DNA, 24 bp, Artificial Sequence
  Synthetic Construct
ggttccctaacgacatcctttcac

SEQ ID NO: 8137 - DNA, 26 bp, Artificial Sequence
  Synthetic Construct
ctcctgatggttaaatcgtggaagac

SEQ ID NO: 8138 - DNA, 18 bp, Artificial Sequence
  Synthetic Construct
cgaatccccggccagtct

SEQ ID NO: 8139 - DNA, 24 bp, Artificial Sequence
  Synthetic Construct
ggcaggaaatgtttctgcctaagc

SEQ ID NO: 8140 - DNA, 22 bp, Artificial Sequence
  Synthetic Construct
tggcagaactcaaggggcaaaa

SEQ ID NO: 8141 - DNA, 24 bp, Artificial Sequence
  Synthetic Construct
tgccaactctgtaatcttgggaaa

SEQ ID NO: 8142 - DNA, 27 bp, Artificial Sequence
  Synthetic Construct
cagaggatgcctaagagttttctaggt

SEQ ID NO: 8143 - DNA, 21 bp, Artificial Sequence
  Synthetic Construct
acccctggtgtatcgtatgct

SEQ ID NO: 8144 - DNA, 18 bp, Artificial Sequence
  Synthetic Construct
gtggcccacacgaaggtt

SEQ ID NO: 8145 - DNA, 21 bp, Artificial Sequence
  Synthetic Construct
ctgtgtgcacctcaccctatc

SEQ ID NO: 8146 - DNA, 25 bp, Artificial Sequence
  Synthetic Construct
gactttgggccctttttgattttca

SEQ ID NO: 8147 - DNA, 24 bp, Artificial Sequence
  Synthetic Construct
ggacaccaaaaatctcagcaagtt

SEQ ID NO: 8148 - DNA, 22 bp, Artificial Sequence
  Synthetic Construct
aggaatgtgtaggtggctgaga

SEQ ID NO: 8149 - DNA, 27 bp, Artificial Sequence
  Synthetic Construct
gggagtaagggttgattttactttcgt

SEQ ID NO: 8150 - DNA, 25 bp, Artificial Sequence
  Synthetic Construct
ggacataacctagtcgtatggcaaa

SEQ ID NO: 8151 - DNA, 23 bp, Artificial Sequence
  Synthetic Construct
cccaaaagccatatgctctgttg

SEQ ID NO: 8152 - DNA, 22 bp, Artificial Sequence
  Synthetic Construct
gccctgattaccctaagccaat

SEQ ID NO: 8153 - DNA, 29 bp, Artificial Sequence
  Synthetic Construct
ccaataggcaaagaaattactctgttgga

SEQ ID NO: 8154 - DNA, 20 bp, Artificial Sequence
  Synthetic Construct
tcccaggatcaccagagcat

SEQ ID NO: 8155 - DNA, 19 bp, Artificial Sequence
  Synthetic Construct
tgcttggggcatgcgttca

SEQ ID NO: 8156 - DNA, 22 bp, Artificial Sequence
  Synthetic Construct
tgctcccgaccttgtcagagta

SEQ ID NO: 8157 - DNA, 24 bp, Artificial Sequence
  Synthetic Construct
ggagctacaatcacctgagctgaa

SEQ ID NO: 8158 - DNA, 22 bp, Artificial Sequence
  Synthetic Construct
gacaattggcagacaccaacag

SEQ ID NO: 8159 - DNA, 20 bp, Artificial Sequence
  Synthetic Construct
aggtgagctgggtcagacaa

SEQ ID NO: 8160 - DNA, 24 bp, Artificial Sequence
  Synthetic Construct
ccactgctcttgaaaaggcctgaa

SEQ ID NO: 8161 - DNA, 22 bp, Artificial Sequence
  Synthetic Construct
ggaatgaagagggcttctcaca

SEQ ID NO: 8162 - DNA, 25 bp, Artificial Sequence
  Synthetic Construct
gagtctgcactgctaatctctacca

SEQ ID NO: 8163 - DNA, 21 bp, Artificial Sequence
  Synthetic Construct
ggggggaatagcacagaaggt

SEQ ID NO: 8164 - DNA, 24 bp, Artificial Sequence
  Synthetic Construct
gaaagatgggcagagttcttttgg

SEQ ID NO: 8165 - DNA, 22 bp, Artificial Sequence
  Synthetic Construct
ggacgcacagcctttttatgag

SEQ ID NO: 8166 - DNA, 20 bp, Artificial Sequence
  Synthetic Construct
gcagtgaaatgggcatgcat

SEQ ID NO: 8167 - DNA, 21 bp, Artificial Sequence
  Synthetic Construct
ggtttgggtgggctagaaagc

SEQ ID NO: 8168 - DNA, 23 bp, Artificial Sequence
  Synthetic Construct
tgcatctgctgatccttcagttc

SEQ ID NO: 8169 - DNA, 21 bp, Artificial Sequence
  Synthetic Construct
agctgttggaagggtcaagct

SEQ ID NO: 8170 - DNA, 26 bp, Artificial Sequence
  Synthetic Construct
caggtagatgaataaggccagaatgg

SEQ ID NO: 8171 - DNA, 19 bp, Artificial Sequence
  Synthetic Construct
atggctgcagaggccttga

SEQ ID NO: 8172 - DNA, 22 bp, Artificial Sequence
  Synthetic Construct
atttccctcccccaacatgtct

SEQ ID NO: 8173 - DNA, 22 bp, Artificial Sequence
  Synthetic Construct
agccaccccctcgactattcaa

SEQ ID NO: 8174 - DNA, 21 bp, Artificial Sequence
  Synthetic Construct
ggtggtgagtgcaaagaggat

SEQ ID NO: 8175 - DNA, 24 bp, Artificial Sequence
  Synthetic Construct
gccttgtaccctgaaaacctccat

SEQ ID NO: 8176 - DNA, 28 bp, Artificial Sequence
  Synthetic Construct
cactcttcatgggatcattactgtaact

SEQ ID NO: 8177 - DNA, 19 bp, Artificial Sequence
  Synthetic Construct
cttggccacagcactggaa

SEQ ID NO: 8178 - DNA, 21 bp, Artificial Sequence
  Synthetic Construct
ccacagggggttgggactaaa

SEQ ID NO: 8179 - DNA, 28 bp, Artificial Sequence
  Synthetic Construct
gcctaataagaaagcttagggtacaagt

SEQ ID NO: 8180 - DNA, 22 bp, Artificial Sequence
  Synthetic Construct
gcttgcaagggtgagtaactga

SEQ ID NO: 8181 - DNA, 28 bp, Artificial Sequence
  Synthetic Construct
gtgatgcatgactatacttctacacaca

SEQ ID NO: 8182 - DNA, 25 bp, Artificial Sequence
  Synthetic Construct
gctgttatggtatcggtgtctacaa

SEQ ID NO: 8183 - DNA, 20 bp, Artificial Sequence
  Synthetic Construct
tgctcgtggttctgcagatt

SEQ ID NO: 8184 - DNA, 27 bp, Artificial Sequence
  Synthetic Construct
gaagaggagtcaggtagatgttctaag

SEQ ID NO: 8185 - DNA, 21 bp, Artificial Sequence
  Synthetic Construct
gctgagggagccaagcttaca

SEQ ID NO: 8186 - DNA, 23 bp, Artificial Sequence
  Synthetic Construct
cacgagacttgttgatcctgtga

SEQ ID NO: 8187 - DNA, 26 bp, Artificial Sequence
  Synthetic Construct
gggaagatgaccttagttcacacaga

SEQ ID NO: 8188 - DNA, 19 bp, Artificial Sequence
  Synthetic Construct
acccctgcctcctgctctt

SEQ ID NO: 8189 - DNA, 25 bp, Artificial Sequence
  Synthetic Construct
ctgctcacaactagagatggacatc

SEQ ID NO: 8190 - DNA, 22 bp, Artificial Sequence
  Synthetic Construct
gcctgtagcatggtggtatggt

SEQ ID NO: 8191 - DNA, 27 bp, Artificial Sequence
  Synthetic Construct
agtgtttccaaatacatagaccaccat

SEQ ID NO: 8192 - DNA, 28 bp, Artificial Sequence
  Synthetic Construct
acaaaaatcttcacatatcatgccactt

SEQ ID NO: 8193 - DNA, 22 bp, Artificial Sequence
  Synthetic Construct
cacaaggaagtgaggtgatcca

SEQ ID NO: 8194 - DNA, 24 bp, Artificial Sequence
  Synthetic Construct
gctctgtggtcaaggggatgtaat

SEQ ID NO: 8195 - DNA, 20 bp, Artificial Sequence
  Synthetic Construct
tcacctccctgtcccatgtt

SEQ ID NO: 8196 - DNA, 24 bp, Artificial Sequence
  Synthetic Construct
aggtcagggactactagacatgct

SEQ ID NO: 8197 - DNA, 24 bp, Artificial Sequence
  Synthetic Construct
tggctgtaaatcgctttgagtttg

SEQ ID NO: 8198 - DNA, 21 bp, Artificial Sequence
  Synthetic Construct
gaagtgggctttgggcaaaat

SEQ ID NO: 8199 - DNA, 25 bp, Artificial Sequence
  Synthetic Construct
tggaacagaaaagatgggataacga

SEQ ID NO: 8200 - DNA, 21 bp, Artificial Sequence
  Synthetic Construct
cacttccccacccagaggtaa

SEQ ID NO: 8201 - DNA, 24 bp, Artificial Sequence
  Synthetic Construct
gggagccttggaaggagtctttat

SEQ ID NO: 8202 - DNA, 22 bp, Artificial Sequence
  Synthetic Construct
gaagggagaatggctgttggat

SEQ ID NO: 8203 - DNA, 24 bp, Artificial Sequence
  Synthetic Construct
gtggaatcatgtccctgactgatg

SEQ ID NO: 8204 - DNA, 24 bp, Artificial Sequence
  Synthetic Construct
tctctggtatctttcccactctgt

SEQ ID NO: 8205 - DNA, 26 bp, Artificial Sequence
  Synthetic Construct
actttgaatcttaccaccagcttaga

SEQ ID NO: 8206 - DNA, 19 bp, Artificial Sequence
  Synthetic Construct
cggttccacccaggtttgg

SEQ ID NO: 8207 - DNA, 22 bp, Artificial Sequence
  Synthetic Construct
agttccaggggatgtcaatgct

SEQ ID NO: 8208 - DNA, 22 bp, Artificial Sequence
  Synthetic Construct
aatgcctcaagccagtgttact

SEQ ID NO: 8209 - DNA, 24 bp, Artificial Sequence
  Synthetic Construct
gaaaagtctgttgcctaggacaca

SEQ ID NO: 8210 - DNA, 26 bp, Artificial Sequence
  Synthetic Construct
ggggcaggcatataatacacaatcaa

SEQ ID NO: 8211 - DNA, 26 bp, Artificial Sequence
  Synthetic Construct
caaactgaaggtattgtttggtcctt

SEQ ID NO: 8212 - DNA, 23 bp, Artificial Sequence
  Synthetic Construct
gctgttaaaaaccactgcacaca

SEQ ID NO: 8213 - DNA, 24 bp, Artificial Sequence
  Synthetic Construct
ctcatcacgtggcttagtgttctg

SEQ ID NO: 8214 - DNA, 25 bp, Artificial Sequence
  Synthetic Construct
ctattcatcaggctctgtgtacact

SEQ ID NO: 8215 - DNA, 26 bp, Artificial Sequence
  Synthetic Construct
catcattagatgtgcctgtgtactct

SEQ ID NO: 8216 - DNA, 24 bp, Artificial Sequence
  Synthetic Construct
ctcctccatgtaagctcctatgct

SEQ ID NO: 8217 - DNA, 18 bp, Artificial Sequence
  Synthetic Construct
ccccgggcaagacaagct

SEQ ID NO: 8218 - DNA, 26 bp, Artificial Sequence
  Synthetic Construct
ccccaccatctacactttctgaacag

SEQ ID NO: 8219 - DNA, 26 bp, Artificial Sequence
  Synthetic Construct
gaagtgcctattcctaaaccaatcac

SEQ ID NO: 8220 - DNA, 26 bp, Artificial Sequence
  Synthetic Construct
cccatggatagtagggaatggtgtag

SEQ ID NO: 8221 - DNA, 22 bp, Artificial Sequence
  Synthetic Construct
gcctttgttgcccatcacttac

SEQ ID NO: 8222 - DNA, 24 bp, Artificial Sequence
  Synthetic Construct
aagaagtggactgacatcggaatt

SEQ ID NO: 8223 - DNA, 25 bp, Artificial Sequence
  Synthetic Construct
gtagccttgggaacattgtttaacc

SEQ ID NO: 8224 - DNA, 21 bp, Artificial Sequence
  Synthetic Construct
ttatcctccctccccaaagca

SEQ ID NO: 8225 - DNA, 24 bp, Artificial Sequence
  Synthetic Construct
cccagtggaagttgagtgtaagtc

SEQ ID NO: 8226 - DNA, 23 bp, Artificial Sequence
  Synthetic Construct
ttgtagagggcctttctctcact

SEQ ID NO: 8227 - DNA, 25 bp, Artificial Sequence
  Synthetic Construct
tgggagcaaaatgttttactttgca

SEQ ID NO: 8228 - DNA, 21 bp, Artificial Sequence
  Synthetic Construct
agcctgcatctgactcctgta

SEQ ID NO: 8229 - DNA, 23 bp, Artificial Sequence
  Synthetic Construct
gaatcaggaagtccagcacaagt

SEQ ID NO: 8230 - DNA, 24 bp, Artificial Sequence
  Synthetic Construct
ggtttctgccaatgacatctcaca

SEQ ID NO: 8231 - DNA, 21 bp, Artificial Sequence
  Synthetic Construct
cccgcatcgttttaggggtaa

SEQ ID NO: 8232 - DNA, 24 bp, Artificial Sequence
  Synthetic Construct
ctctccaatgcccctttcttcttc

SEQ ID NO: 8233 - DNA, 20 bp, Artificial Sequence
  Synthetic Construct
gggtgtgctccagaatgcat

SEQ ID NO: 8234 - DNA, 22 bp, Artificial Sequence
  Synthetic Construct
acagctgcctgaatttggaaac

SEQ ID NO: 8235 - DNA, 22 bp, Artificial Sequence
  Synthetic Construct
agatcacattgggtcccacaca

SEQ ID NO: 8236 - DNA, 24 bp, Artificial Sequence
  Synthetic Construct
ctcacaagtggaattggagctctt

SEQ ID NO: 8237 - DNA, 25 bp, Artificial Sequence
  Synthetic Construct
ccactttagctaccttggagaacat

SEQ ID NO: 8238 - DNA, 22 bp, Artificial Sequence
  Synthetic Construct
cagtttgtggagccttgctttt

SEQ ID NO: 8239 - DNA, 22 bp, Artificial Sequence
  Synthetic Construct
agggtgccaaacaggtttatgg

SEQ ID NO: 8240 - DNA, 18 bp, Artificial Sequence
  Synthetic Construct
tgccacgctgccacatct

SEQ ID NO: 8241 - DNA, 21 bp, Artificial Sequence
  Synthetic Construct
accttcaggcccacctactgt

SEQ ID NO: 8242 - DNA, 27 bp, Artificial Sequence
  Synthetic Construct
gaaacctgtagagtcttacatgccatt

SEQ ID NO: 8243 - DNA, 20 bp, Artificial Sequence
  Synthetic Construct
cctaggctggcccaagatga

SEQ ID NO: 8244 - DNA, 19 bp, Artificial Sequence
  Synthetic Construct
ctcaccatgcgcagttcct

SEQ ID NO: 8245 - DNA, 24 bp, Artificial Sequence
  Synthetic Construct
cacaggtcagacaaggctaaaacc

SEQ ID NO: 8246 - DNA, 22 bp, Artificial Sequence
  Synthetic Construct
aggactagcccttggtttggat

SEQ ID NO: 8247 - DNA, 22 bp, Artificial Sequence
  Synthetic Construct
aggcagaccactaactggagaa

SEQ ID NO: 8248 - DNA, 20 bp, Artificial Sequence
  Synthetic Construct
accactggtcccagcaacta

SEQ ID NO: 8249 - DNA, 20 bp, Artificial Sequence
  Synthetic Construct
agctgctacccacctaaggt

SEQ ID NO: 8250 - DNA, 26 bp, Artificial Sequence
  Synthetic Construct
gcttatctgggattgctaccaactag

SEQ ID NO: 8251 - DNA, 22 bp, Artificial Sequence
  Synthetic Construct
tgccttggatggtgtggcaaca

SEQ ID NO: 8252 - DNA, 26 bp, Artificial Sequence
  Synthetic Construct
ccaggtaggtaaaacctcttggattc

SEQ ID NO: 8253 - DNA, 26 bp, Artificial Sequence
  Synthetic Construct
ctccaacaagccacgtatatgttagg

SEQ ID NO: 8254 - DNA, 19 bp, Artificial Sequence
  Synthetic Construct
gggacagatgcggcaacaa

SEQ ID NO: 8255 - DNA, 25 bp, Artificial Sequence
  Synthetic Construct
ggcagcttgagcaatcttctaaagg

SEQ ID NO: 8256 - DNA, 25 bp, Artificial Sequence
  Synthetic Construct
gtgacattttcctgtgtccttgagt

SEQ ID NO: 8257 - DNA, 26 bp, Artificial Sequence
  Synthetic Construct
gcaggaaggatgagggttagatacca

SEQ ID NO: 8258 - DNA, 22 bp, Artificial Sequence
  Synthetic Construct
ggagtccacagaggcagcttat

SEQ ID NO: 8259 - DNA, 19 bp, Artificial Sequence
  Synthetic Construct
ccgtcttgggtggttcaca

SEQ ID NO: 8260 - DNA, 23 bp, Artificial Sequence
  Synthetic Construct
ctctgcttctcacactgtgcaaa

SEQ ID NO: 8261 - DNA, 23 bp, Artificial Sequence
  Synthetic Construct
gcttaaagctgcagtggagaaca

SEQ ID NO: 8262 - DNA, 22 bp, Artificial Sequence
  Synthetic Construct
ggcactagtgatcctcctacct

SEQ ID NO: 8263 - DNA, 24 bp, Artificial Sequence
  Synthetic Construct
ctatgtctcctccctgcataggta

SEQ ID NO: 8264 - DNA, 23 bp, Artificial Sequence
  Synthetic Construct
agtttcctgcagaaagacaagca

SEQ ID NO: 8265 - DNA, 18 bp, Artificial Sequence
  Synthetic Construct
aggaggcttgccctgtgt

SEQ ID NO: 8266 - DNA, 27 bp, Artificial Sequence
  Synthetic Construct
gcacacttgtcctagtaacaggtgaat

SEQ ID NO: 8267 - DNA, 20 bp, Artificial Sequence
  Synthetic Construct
tgggagtggagcaggaatcc

SEQ ID NO: 8268 - DNA, 22 bp, Artificial Sequence
  Synthetic Construct
tggggaaactgaccaacacaag

SEQ ID NO: 8269 - DNA, 22 bp, Artificial Sequence
  Synthetic Construct
ccctgatcactgcattctggat

SEQ ID NO: 8270 - DNA, 23 bp, Artificial Sequence
  Synthetic Construct
gtggggagtcaccaatgatactt

SEQ ID NO: 8271 - DNA, 22 bp, Artificial Sequence
  Synthetic Construct
ctggaggtccttcaaggtcttg

SEQ ID NO: 8272 - DNA, 24 bp, Artificial Sequence
  Synthetic Construct
aggggaagtgacacagagttacag

SEQ ID NO: 8273 - DNA, 22 bp, Artificial Sequence
  Synthetic Construct
gttcccacatccttgtgcatct

SEQ ID NO: 8274 - DNA, 24 bp, Artificial Sequence
  Synthetic Construct
cacagctgatgcaaactagctctt

SEQ ID NO: 8275 - DNA, 24 bp, Artificial Sequence
  Synthetic Construct
cgcactcagcctttgttgtagaag

SEQ ID NO: 8276 - DNA, 24 bp, Artificial Sequence
  Synthetic Construct
ctcaggtatggaggatgcaggaat

SEQ ID NO: 8277 - DNA, 26 bp, Artificial Sequence
  Synthetic Construct
cgcatagtccacaactgggatacttc

SEQ ID NO: 8278 - DNA, 23 bp, Artificial Sequence
  Synthetic Construct
caccaccaaacaaaccccaaatc

SEQ ID NO: 8279 - DNA, 20 bp, Artificial Sequence
  Synthetic Construct
tgtcccctccctacctcaca

SEQ ID NO: 8280 - DNA, 24 bp, Artificial Sequence
  Synthetic Construct
gaacagagagaatgaggggagaga

SEQ ID NO: 8281 - DNA, 22 bp, Artificial Sequence
  Synthetic Construct
tggaggtttgtgtcacccttct

SEQ ID NO: 8282 - DNA, 22 bp, Artificial Sequence
  Synthetic Construct
agtcagaacctgccacttcact

SEQ ID NO: 8283 - DNA, 24 bp, Artificial Sequence
  Synthetic Construct
gcagataggatggtctggaatgtc

SEQ ID NO: 8284 - DNA, 28 bp, Artificial Sequence
  Synthetic Construct
ggaaagcccctagtcacttagtcatatg

SEQ ID NO: 8285 - DNA, 19 bp, Artificial Sequence
  Synthetic Construct
aaggggctggtggcttcca

SEQ ID NO: 8286 - DNA, 25 bp, Artificial Sequence
  Synthetic Construct
tgctggacttgcatttcaaattagg

SEQ ID NO: 8287 - DNA, 22 bp, Artificial Sequence
  Synthetic Construct
tcaaactgtgggttgcaatcca

SEQ ID NO: 8288 - DNA, 25 bp, Artificial Sequence
  Synthetic Construct
gctcatccttcaggcttaaggacaa

SEQ ID NO: 8289 - DNA, 22 bp, Artificial Sequence
  Synthetic Construct
agagagcaagccagtgagtaga

SEQ ID NO: 8290 - DNA, 22 bp, Artificial Sequence
  Synthetic Construct
acaccactgctcccaagttgta

SEQ ID NO: 8291 - DNA, 26 bp, Artificial Sequence
  Synthetic Construct
agctgcttactacataccatcatcag

SEQ ID NO: 8292 - DNA, 24 bp, Artificial Sequence
  Synthetic Construct
gcagtttgtttcctgggctaatcc

SEQ ID NO: 8293 - DNA, 24 bp, Artificial Sequence
  Synthetic Construct
acaccaacatagctttcagttcct

SEQ ID NO: 8294 - DNA, 23 bp, Artificial Sequence
  Synthetic Construct
cacagcaagaataaagccaagct

SEQ ID NO: 8295 - DNA, 25 bp, Artificial Sequence
  Synthetic Construct
gagtttggtagcacagcaaaaactg

SEQ ID NO: 8296 - DNA, 24 bp, Artificial Sequence
  Synthetic Construct
ctgtgtgtagcctttgctctcaag

SEQ ID NO: 8297 - DNA, 22 bp, Artificial Sequence
  Synthetic Construct
gcttgggaaagggaggtcaatt

SEQ ID NO: 8298 - DNA, 23 bp, Artificial Sequence
  Synthetic Construct
acacataggcctagggaaagaca

SEQ ID NO: 8299 - DNA, 24 bp, Artificial Sequence
  Synthetic Construct
ggacctgcttgcagagtttatgat

SEQ ID NO: 8300 - DNA, 24 bp, Artificial Sequence
  Synthetic Construct
ggctgcaactaaatttcccaaacc

SEQ ID NO: 8301 - DNA, 22 bp, Artificial Sequence
  Synthetic Construct
agcatttggcagccagtgaaag

SEQ ID NO: 8302 - DNA, 21 bp, Artificial Sequence
  Synthetic Construct
tcgcctcctggtgagcttgta

SEQ ID NO: 8303 - DNA, 26 bp, Artificial Sequence
  Synthetic Construct
ggacagattcagaaggagggagaata

SEQ ID NO: 8304 - DNA, 22 bp, Artificial Sequence
  Synthetic Construct
ggagccccaaagtgcaacaatt

SEQ ID NO: 8305 - DNA, 22 bp, Artificial Sequence
  Synthetic Construct
gcaccctggctgttttgcaaat

SEQ ID NO: 8306 - DNA, 26 bp, Artificial Sequence
  Synthetic Construct
gctgagttcaagtctaaggaggattg

SEQ ID NO: 8307 - DNA, 25 bp, Artificial Sequence
  Synthetic Construct
ggctgttgacagtctatttttggaa

SEQ ID NO: 8308 - DNA, 23 bp, Artificial Sequence
  Synthetic Construct
gcgtgaaacctaaacaagctcaa

SEQ ID NO: 8309 - DNA, 23 bp, Artificial Sequence
  Synthetic Construct
agttccaggagatgcctttagtg

SEQ ID NO: 8310 - DNA, 22 bp, Artificial Sequence
  Synthetic Construct
tggaagcgtggattttgctaga

SEQ ID NO: 8311 - DNA, 26 bp, Artificial Sequence
  Synthetic Construct
ctggtggttcttccatgttcattatc

SEQ ID NO: 8312 - DNA, 22 bp, Artificial Sequence
  Synthetic Construct
gaggaaccagggagtaccttca

SEQ ID NO: 8313 - DNA, 24 bp, Artificial Sequence
  Synthetic Construct
ggaacactacaacaacccaatcct

SEQ ID NO: 8314 - DNA, 22 bp, Artificial Sequence
  Synthetic Construct
gagagccaggaacttccaagca

SEQ ID NO: 8315 - DNA, 24 bp, Artificial Sequence
  Synthetic Construct
aggatcacatcagtagtgtgcttt

SEQ ID NO: 8316 - DNA, 24 bp, Artificial Sequence
  Synthetic Construct
gcaaaggactgtaggtggatagga

SEQ ID NO: 8317 - DNA, 20 bp, Artificial Sequence
  Synthetic Construct
tgtgcataactggggtgcat

SEQ ID NO: 8318 - DNA, 25 bp, Artificial Sequence
  Synthetic Construct
caatacagtagtgccgagacagatc

SEQ ID NO: 8319 - DNA, 24 bp, Artificial Sequence
  Synthetic Construct
gactaggctggaaactgagttacc

SEQ ID NO: 8320 - DNA, 22 bp, Artificial Sequence
  Synthetic Construct
ggtgccatgttattgcatgcaa

SEQ ID NO: 8321 - DNA, 22 bp, Artificial Sequence
  Synthetic Construct
aggggagtgggatgacctgatt

SEQ ID NO: 8322 - DNA, 21 bp, Artificial Sequence
  Synthetic Construct
cggcaagtctcctgacctctt

SEQ ID NO: 8323 - DNA, 22 bp, Artificial Sequence
  Synthetic Construct
tgctggatggggtctgaaaaat

SEQ ID NO: 8324 - DNA, 25 bp, Artificial Sequence
  Synthetic Construct
gcatgtctcaccttctaaaatgctt

SEQ ID NO: 8325 - DNA, 22 bp, Artificial Sequence
  Synthetic Construct
tcaagatgcggcctatttccat

SEQ ID NO: 8326 - DNA, 20 bp, Artificial Sequence
  Synthetic Construct
ggtccctggggcttcggata

SEQ ID NO: 8327 - DNA, 26 bp, Artificial Sequence
  Synthetic Construct
cctatagacctctgcaggacaatatg

SEQ ID NO: 8328 - DNA, 22 bp, Artificial Sequence
  Synthetic Construct
tcctgggatgtctacagcaaca

SEQ ID NO: 8329 - DNA, 22 bp, Artificial Sequence
  Synthetic Construct
cctccaccgggttactgtttct

SEQ ID NO: 8330 - DNA, 26 bp, Artificial Sequence
  Synthetic Construct
agatgacaactaatgactcggtgtaa

SEQ ID NO: 8331 - DNA, 22 bp, Artificial Sequence
  Synthetic Construct
agagcaagggtcaacacactac

SEQ ID NO: 8332 - DNA, 26 bp, Artificial Sequence
  Synthetic Construct
cgaatgaacagcactctaccccttag

SEQ ID NO: 8333 - DNA, 21 bp, Artificial Sequence
  Synthetic Construct
tgagccagtggttcagtttgg

SEQ ID NO: 8334 - DNA, 20 bp, Artificial Sequence
  Synthetic Construct
ggagacgctgtacccacaaa

SEQ ID NO: 8335 - DNA, 25 bp, Artificial Sequence
  Synthetic Construct
gtgtaagggggcacgaagaaataac

SEQ ID NO: 8336 - DNA, 20 bp, Artificial Sequence
  Synthetic Construct
tcatgcaagggcctgtgttt

SEQ ID NO: 8337 - DNA, 22 bp, Artificial Sequence
  Synthetic Construct
ccttcatccatgcctctggttt

SEQ ID NO: 8338 - DNA, 22 bp, Artificial Sequence
  Synthetic Construct
aggaggccagattgcagtacag

SEQ ID NO: 8339 - DNA, 25 bp, Artificial Sequence
  Synthetic Construct
tcaatttatatcgcctggactacgt

SEQ ID NO: 8340 - DNA, 24 bp, Artificial Sequence
  Synthetic Construct
ggattctccaggcagaagtagtgt

SEQ ID NO: 8341 - DNA, 25 bp, Artificial Sequence
  Synthetic Construct
ggtgagaattaacttggcctaatgc

SEQ ID NO: 8342 - DNA, 22 bp, Artificial Sequence
  Synthetic Construct
ggaaagattccctggtctgcat

SEQ ID NO: 8343 - DNA, 23 bp, Artificial Sequence
  Synthetic Construct
ggaaactctcaaggcatcaaggt

SEQ ID NO: 8344 - DNA, 22 bp, Artificial Sequence
  Synthetic Construct
ccccaaatcctgccaatcctat

SEQ ID NO: 8345 - DNA, 24 bp, Artificial Sequence
  Synthetic Construct
gaggagagacagcagtgtttgtaa

SEQ ID NO: 8346 - DNA, 22 bp, Artificial Sequence
  Synthetic Construct
tgatgaggcaccaaggttacac

SEQ ID NO: 8347 - DNA, 25 bp, Artificial Sequence
  Synthetic Construct
ggcagataatctcaccccattttgg

SEQ ID NO: 8348 - DNA, 22 bp, Artificial Sequence
  Synthetic Construct
tggcgtgctgtcattctacatg

SEQ ID NO: 8349 - DNA, 21 bp, Artificial Sequence
  Synthetic Construct
tctcagagcctccctttgcat

SEQ ID NO: 8350 - DNA, 26 bp, Artificial Sequence
  Synthetic Construct
tggagacagggaaatatgaggagtag

SEQ ID NO: 8351 - DNA, 19 bp, Artificial Sequence
  Synthetic Construct
tccccgaacatgggcagat

SEQ ID NO: 8352 - DNA, 21 bp, Artificial Sequence
  Synthetic Construct
tcccaacctccagccctttaa

SEQ ID NO: 8353 - DNA, 24 bp, Artificial Sequence
  Synthetic Construct
gcactaagaacacagggggaaagt

SEQ ID NO: 8354 - DNA, 24 bp, Artificial Sequence
  Synthetic Construct
ctcaaagcctggaattggaatggt

SEQ ID NO: 8355 - DNA, 23 bp, Artificial Sequence
  Synthetic Construct
ccagctgtaatttgtggccaaaa

SEQ ID NO: 8356 - DNA, 27 bp, Artificial Sequence
  Synthetic Construct
ggcctcaagaactttctactcattcct

SEQ ID NO: 8357 - DNA, 20 bp, Artificial Sequence
  Synthetic Construct
ggtgactgggggtacacagt

SEQ ID NO: 8358 - DNA, 23 bp, Artificial Sequence
  Synthetic Construct
aggccccatcttactcactttcc

SEQ ID NO: 8359 - DNA, 22 bp, Artificial Sequence
  Synthetic Construct
gcttgggtttggctgacatcta

SEQ ID NO: 8360 - DNA, 21 bp, Artificial Sequence
  Synthetic Construct
ccactccaagggtgggtccta

SEQ ID NO: 8361 - DNA, 23 bp, Artificial Sequence
  Synthetic Construct
tgggtcccaatgccaagtaaagg

SEQ ID NO: 8362 - DNA, 23 bp, Artificial Sequence
  Synthetic Construct
tgaaaagctctggagtcacactt

SEQ ID NO: 8363 - DNA, 21 bp, Artificial Sequence
  Synthetic Construct
catttccgctcacaagccatt

SEQ ID NO: 8364 - DNA, 26 bp, Artificial Sequence
  Synthetic Construct
cccatacaaggatccaagtacctgtt

SEQ ID NO: 8365 - DNA, 24 bp, Artificial Sequence
  Synthetic Construct
caaagccatatgacaaaggaagca

SEQ ID NO: 8366 - DNA, 20 bp, Artificial Sequence
  Synthetic Construct
agaagcgagggtgcaaatgc

SEQ ID NO: 8367 - DNA, 22 bp, Artificial Sequence
  Synthetic Construct
agcaggaatcaggcaggaaaaa

SEQ ID NO: 8368 - DNA, 19 bp, Artificial Sequence
  Synthetic Construct
agccacctgccactatcct

SEQ ID NO: 8369 - DNA, 21 bp, Artificial Sequence
  Synthetic Construct
actgcactctggcatcaccat

SEQ ID NO: 8370 - DNA, 24 bp, Artificial Sequence
  Synthetic Construct
acaacatacattgctgggccttaa

SEQ ID NO: 8371 - DNA, 24 bp, Artificial Sequence
  Synthetic Construct
ggctaaccctgctgagaacctttt

SEQ ID NO: 8372 - DNA, 20 bp, Artificial Sequence
  Synthetic Construct
gctggcttcgggtagagaca

SEQ ID NO: 8373 - DNA, 22 bp, Artificial Sequence
  Synthetic Construct
gagaatagctcctgcagttgct

SEQ ID NO: 8374 - DNA, 25 bp, Artificial Sequence
  Synthetic Construct
actagcaaaccaaagctaacgacat

SEQ ID NO: 8375 - DNA, 25 bp, Artificial Sequence
  Synthetic Construct
gagcatgtatgattcacgcttcttg

SEQ ID NO: 8376 - DNA, 25 bp, Artificial Sequence
  Synthetic Construct
caggaaaggcagatgcttctaagtg

SEQ ID NO: 8377 - DNA, 27 bp, Artificial Sequence
  Synthetic Construct
gcagagatttcagctcatgtgtttcag

SEQ ID NO: 8378 - DNA, 22 bp, Artificial Sequence
  Synthetic Construct
tgggaaatgggcagtgcctaga

SEQ ID NO: 8379 - DNA, 22 bp, Artificial Sequence
  Synthetic Construct
caggagcctcagagacaaagac

SEQ ID NO: 8380 - DNA, 21 bp, Artificial Sequence
  Synthetic Construct
agaaggccaggtgcattgtga

SEQ ID NO: 8381 - DNA, 19 bp, Artificial Sequence
  Synthetic Construct
aggcagaggctcgcagtga

SEQ ID NO: 8382 - DNA, 22 bp, Artificial Sequence
  Synthetic Construct
aggaggaacaactgaggccaaa

SEQ ID NO: 8383 - DNA, 26 bp, Artificial Sequence
  Synthetic Construct
gctgactttcaaagcatgaacccttt

SEQ ID NO: 8384 - DNA, 20 bp, Artificial Sequence
  Synthetic Construct
accctcctgtggtggtagac

SEQ ID NO: 8385 - DNA, 29 bp, Artificial Sequence
  Synthetic Construct
gtggtgatatttcctaattccagggaatg

SEQ ID NO: 8386 - DNA, 25 bp, Artificial Sequence
  Synthetic Construct
ggcagaacaaatagttgagcaatgg

SEQ ID NO: 8387 - DNA, 24 bp, Artificial Sequence
  Synthetic Construct
gacaaaggccagcttctcatacag

SEQ ID NO: 8388 - DNA, 23 bp, Artificial Sequence
  Synthetic Construct
tggcaccaacctaataggaagtg

SEQ ID NO: 8389 - DNA, 25 bp, Artificial Sequence
  Synthetic Construct
gatgtttggcttttcttgcttctga

SEQ ID NO: 8390 - DNA, 22 bp, Artificial Sequence
  Synthetic Construct
aggagtgactgctacagctcaa

SEQ ID NO: 8391 - DNA, 25 bp, Artificial Sequence
  Synthetic Construct
gaatgacatttctgagctcctggaa

SEQ ID NO: 8392 - DNA, 22 bp, Artificial Sequence
  Synthetic Construct
cattgcaggagtggctacttca

SEQ ID NO: 8393 - DNA, 21 bp, Artificial Sequence
  Synthetic Construct
agctttggacccagctgtgaa

SEQ ID NO: 8394 - DNA, 24 bp, Artificial Sequence
  Synthetic Construct
ctgtttacagctcaaaccctctca

SEQ ID NO: 8395 - DNA, 24 bp, Artificial Sequence
  Synthetic Construct
tgcccctactaaatgtggtttctg

SEQ ID NO: 8396 - DNA, 27 bp, Artificial Sequence
  Synthetic Construct
ggaaatagctagaggatgagacaagct

SEQ ID NO: 8397 - DNA, 25 bp, Artificial Sequence
  Synthetic Construct
cgtctctaaatttgcctgctgtttg

SEQ ID NO: 8398 - DNA, 21 bp, Artificial Sequence
  Synthetic Construct
acccagagagactgcaaaggt

SEQ ID NO: 8399 - DNA, 28 bp, Artificial Sequence
  Synthetic Construct
gggactactaccagtgttaagtgagatg

SEQ ID NO: 8400 - DNA, 22 bp, Artificial Sequence
  Synthetic Construct
ccctcccctacctctctacaga

SEQ ID NO: 8401 - DNA, 20 bp, Artificial Sequence
  Synthetic Construct
gctgatgcccagatgtctgt

SEQ ID NO: 8402 - DNA, 18 bp, Artificial Sequence
  Synthetic Construct
tgcccagacacgcagcat

SEQ ID NO: 8403 - DNA, 23 bp, Artificial Sequence
  Synthetic Construct
gatctcactgttgctgtcggtat

SEQ ID NO: 8404 - DNA, 22 bp, Artificial Sequence
  Synthetic Construct
gccaccagaccattgctcattt

SEQ ID NO: 8405 - DNA, 26 bp, Artificial Sequence
  Synthetic Construct
catgtcaccttgcctatgagttagag

SEQ ID NO: 8406 - DNA, 24 bp, Artificial Sequence
  Synthetic Construct
ggacttctggctaacactccatgt

SEQ ID NO: 8407 - DNA, 18 bp, Artificial Sequence
  Synthetic Construct
tgcacgcctcctgactca

SEQ ID NO: 8408 - DNA, 22 bp, Artificial Sequence
  Synthetic Construct
gcttccaccaagccaaacaaca

SEQ ID NO: 8409 - DNA, 25 bp, Artificial Sequence
  Synthetic Construct
gagtgtatgccaggtgttaacaaca

SEQ ID NO: 8410 - DNA, 25 bp, Artificial Sequence
  Synthetic Construct
ggacagcagggatctatcttttcag

SEQ ID NO: 8411 - DNA, 20 bp, Artificial Sequence
  Synthetic Construct
atgactggtggctgctgagt

SEQ ID NO: 8412 - DNA, 26 bp, Artificial Sequence
  Synthetic Construct
cacacacactcacagaatgattagca

SEQ ID NO: 8413 - DNA, 22 bp, Artificial Sequence
  Synthetic Construct
tcacaggccttgaacttttcca

SEQ ID NO: 8414 - DNA, 20 bp, Artificial Sequence
  Synthetic Construct
tgtcacagcgtgaggtcact

SEQ ID NO: 8415 - DNA, 25 bp, Artificial Sequence
  Synthetic Construct
gcatatagcctatgccaaagaacag

SEQ ID NO: 8416 - DNA, 24 bp, Artificial Sequence
  Synthetic Construct
gatcaagatgtcacagctgatcct

SEQ ID NO: 8417 - DNA, 20 bp, Artificial Sequence
  Synthetic Construct
tgctcaccacgtaggcctat

SEQ ID NO: 8418 - DNA, 23 bp, Artificial Sequence
  Synthetic Construct
ctgagggagggtagggttacctt

SEQ ID NO: 8419 - DNA, 24 bp, Artificial Sequence
  Synthetic Construct
gagaaggaattggaaccaggacat

SEQ ID NO: 8420 - DNA, 21 bp, Artificial Sequence
  Synthetic Construct
tgcccctgcacagtattggat

SEQ ID NO: 8421 - DNA, 21 bp, Artificial Sequence
  Synthetic Construct
agactggaagcctgaggtcat

SEQ ID NO: 8422 - DNA, 26 bp, Artificial Sequence
  Synthetic Construct
cgcactgagtgttaattttccaagca

SEQ ID NO: 8423 - DNA, 27 bp, Artificial Sequence
  Synthetic Construct
cctctagcctggatgttctctcttttc

SEQ ID NO: 8424 - DNA, 19 bp, Artificial Sequence
  Synthetic Construct
gcagactgcagggtttcca

SEQ ID NO: 8425 - DNA, 23 bp, Artificial Sequence
  Synthetic Construct
ggacagggtcatctcagtgtgaa

SEQ ID NO: 8426 - DNA, 23 bp, Artificial Sequence
  Synthetic Construct
tgcccatgtcttctactcactgt

SEQ ID NO: 8427 - DNA, 25 bp, Artificial Sequence
  Synthetic Construct
ccatggaaggataccacaacaagac

SEQ ID NO: 8428 - DNA, 22 bp, Artificial Sequence
  Synthetic Construct
gggatcttcaagcacagtctga

SEQ ID NO: 8429 - DNA, 22 bp, Artificial Sequence
  Synthetic Construct
acatagtcctccttgggggaaa

SEQ ID NO: 8430 - DNA, 25 bp, Artificial Sequence
  Synthetic Construct
aaccccttgaaggagttgtctattc

SEQ ID NO: 8431 - DNA, 19 bp, Artificial Sequence
  Synthetic Construct
gcaaggggagctcaaaggt

SEQ ID NO: 8432 - DNA, 23 bp, Artificial Sequence
  Synthetic Construct
agagctcagtctgtctctcatct

SEQ ID NO: 8433 - DNA, 22 bp, Artificial Sequence
  Synthetic Construct
acgcttgtaggcccaactacac

SEQ ID NO: 8434 - DNA, 24 bp, Artificial Sequence
  Synthetic Construct
tcagtgtccactctgagagctaag

SEQ ID NO: 8435 - DNA, 23 bp, Artificial Sequence
  Synthetic Construct
tctgagtgtttggaatggacgtt

SEQ ID NO: 8436 - DNA, 28 bp, Artificial Sequence
  Synthetic Construct
ccaatccctgaagtctgtattacaagac

SEQ ID NO: 8437 - DNA, 24 bp, Artificial Sequence
  Synthetic Construct
gggactgggagacacatctattga

SEQ ID NO: 8438 - DNA, 20 bp, Artificial Sequence
  Synthetic Construct
ccctcctccctcaccactag

SEQ ID NO: 8439 - DNA, 22 bp, Artificial Sequence
  Synthetic Construct
agcgtagtgggtgggaaatctg

SEQ ID NO: 8440 - DNA, 21 bp, Artificial Sequence
  Synthetic Construct
gcctgtcatcctcctcgatgt

SEQ ID NO: 8441 - DNA, 24 bp, Artificial Sequence
  Synthetic Construct
gcacagtgattcagagagcagctt

SEQ ID NO: 8442 - DNA, 24 bp, Artificial Sequence
  Synthetic Construct
agctcagtccccaggttattagga

SEQ ID NO: 8443 - DNA, 24 bp, Artificial Sequence
  Synthetic Construct
tgcttgaaccccatcctttatgtc

SEQ ID NO: 8444 - DNA, 24 bp, Artificial Sequence
  Synthetic Construct
cctgaagagagtctacagccaatg

SEQ ID NO: 8445 - DNA, 21 bp, Artificial Sequence
  Synthetic Construct
agctaaccatggcctctgagt

SEQ ID NO: 8446 - DNA, 26 bp, Artificial Sequence
  Synthetic Construct
tgtattactgcatgcctagtccctaa

SEQ ID NO: 8447 - DNA, 19 bp, Artificial Sequence
  Synthetic Construct
tgcccaggggtggctctgt

SEQ ID NO: 8448 - DNA, 21 bp, Artificial Sequence
  Synthetic Construct
tgtgcctgatgtggtgaactt

SEQ ID NO: 8449 - DNA, 23 bp, Artificial Sequence
  Synthetic Construct
tcggaggggttcagtaacactca

SEQ ID NO: 8450 - DNA, 22 bp, Artificial Sequence
  Synthetic Construct
ccaacttcagctgctccactta

SEQ ID NO: 8451 - DNA, 21 bp, Artificial Sequence
  Synthetic Construct
tctcctgcagcccactatgtg

SEQ ID NO: 8452 - DNA, 20 bp, Artificial Sequence
  Synthetic Construct
atcccctgatgcccccactt

SEQ ID NO: 8453 - DNA, 24 bp, Artificial Sequence
  Synthetic Construct
tggaagcctcaagtcctcttcctt

SEQ ID NO: 8454 - DNA, 20 bp, Artificial Sequence
  Synthetic Construct
gcagatgacagccccttgtt

SEQ ID NO: 8455 - DNA, 25 bp, Artificial Sequence
  Synthetic Construct
tcagaccttcagaaacccatcattt

SEQ ID NO: 8456 - DNA, 24 bp, Artificial Sequence
  Synthetic Construct
cccatcctgaacctctagcaacta

SEQ ID NO: 8457 - DNA, 24 bp, Artificial Sequence
  Synthetic Construct
agagagactgaggatatggctgat

SEQ ID NO: 8458 - DNA, 21 bp, Artificial Sequence
  Synthetic Construct
accctgatggtttgcaccttt

SEQ ID NO: 8459 - DNA, 24 bp, Artificial Sequence
  Synthetic Construct
cagatcccacccacataggttaga

SEQ ID NO: 8460 - DNA, 26 bp, Artificial Sequence
  Synthetic Construct
gctcttgccaatgtttctagtgatga

SEQ ID NO: 8461 - DNA, 22 bp, Artificial Sequence
  Synthetic Construct
acagggacttccaagggagaca

SEQ ID NO: 8462 - DNA, 21 bp, Artificial Sequence
  Synthetic Construct
aggctttgtgctcctgtgatt

SEQ ID NO: 8463 - DNA, 24 bp, Artificial Sequence
  Synthetic Construct
acctacagggcattaggtgttacc

SEQ ID NO: 8464 - DNA, 26 bp, Artificial Sequence
  Synthetic Construct
acaagctcataaactcattgcacatt

SEQ ID NO: 8465 - DNA, 24 bp, Artificial Sequence
  Synthetic Construct
gccctgaattctgtgtctgcagat

SEQ ID NO: 8466 - DNA, 22 bp, Artificial Sequence
  Synthetic Construct
gcatatgtgctgtcgacaaagg

SEQ ID NO: 8467 - DNA, 24 bp, Artificial Sequence
  Synthetic Construct
caccacaccagacactgaagatag

SEQ ID NO: 8468 - DNA, 22 bp, Artificial Sequence
  Synthetic Construct
tgcaggtggtctgaggatcaca

SEQ ID NO: 8469 - DNA, 22 bp, Artificial Sequence
  Synthetic Construct
tgcagccttagaggagggagta

SEQ ID NO: 8470 - DNA, 25 bp, Artificial Sequence
  Synthetic Construct
cagtggcttttcatggtgaaatagc

SEQ ID NO: 8471 - DNA, 22 bp, Artificial Sequence
  Synthetic Construct
agctgagtgtcacctgtttctg

SEQ ID NO: 8472 - DNA, 21 bp, Artificial Sequence
  Synthetic Construct
tcctatcagcacccgccagaa

SEQ ID NO: 8473 - DNA, 22 bp, Artificial Sequence
  Synthetic Construct
caccttgcacttctggaagtct

SEQ ID NO: 8474 - DNA, 24 bp, Artificial Sequence
  Synthetic Construct
ctgcccgttgaatacatttaagca

SEQ ID NO: 8475 - DNA, 25 bp, Artificial Sequence
  Synthetic Construct
gagtactgggcacaaacaggtataa

SEQ ID NO: 8476 - DNA, 19 bp, Artificial Sequence
  Synthetic Construct
tgccttggtgacgccactt

SEQ ID NO: 8477 - DNA, 20 bp, Artificial Sequence
  Synthetic Construct
tcgggtctcagcagcccaat

SEQ ID NO: 8478 - DNA, 24 bp, Artificial Sequence
  Synthetic Construct
aaatactgttcacaagcccatgtg

SEQ ID NO: 8479 - DNA, 24 bp, Artificial Sequence
  Synthetic Construct
acattctttcctaactgccacaca

SEQ ID NO: 8480 - DNA, 25 bp, Artificial Sequence
  Synthetic Construct
ctcagcaaaggtaaagtgtgtagca

SEQ ID NO: 8481 - DNA, 27 bp, Artificial Sequence
  Synthetic Construct
ccagcagcaatgagaatgtatctgtag

SEQ ID NO: 8482 - DNA, 25 bp, Artificial Sequence
  Synthetic Construct
ccgtgaacttcctcttctagcaaac

SEQ ID NO: 8483 - DNA, 22 bp, Artificial Sequence
  Synthetic Construct
gcattcctcaagcaaccctaga

SEQ ID NO: 8484 - DNA, 21 bp, Artificial Sequence
  Synthetic Construct
tgtgttccaagccctgtagtg

SEQ ID NO: 8485 - DNA, 22 bp, Artificial Sequence
  Synthetic Construct
atccttgcaggtcattccaaca

SEQ ID NO: 8486 - DNA, 25 bp, Artificial Sequence
  Synthetic Construct
ttgtgactgttcatggctgtatagt

SEQ ID NO: 8487 - DNA, 22 bp, Artificial Sequence
  Synthetic Construct
cctgcagtgcttcattcaaagg

SEQ ID NO: 8488 - DNA, 23 bp, Artificial Sequence
  Synthetic Construct
acacttccctccatgcctctcta

SEQ ID NO: 8489 - DNA, 26 bp, Artificial Sequence
  Synthetic Construct
cccaactgaagataaccgatgcatgt

SEQ ID NO: 8490 - DNA, 28 bp, Artificial Sequence
  Synthetic Construct
caaaagttcccagagtgtatttaatcca

SEQ ID NO: 8491 - DNA, 28 bp, Artificial Sequence
  Synthetic Construct
ggcttattccccaaatggttcaatcatg

SEQ ID NO: 8492 - DNA, 23 bp, Artificial Sequence
  Synthetic Construct
gaaagctctcagggttaccagtt

SEQ ID NO: 8493 - DNA, 24 bp, Artificial Sequence
  Synthetic Construct
gactgagtgaatgaagagcagcta

SEQ ID NO: 8494 - DNA, 23 bp, Artificial Sequence
  Synthetic Construct
tccccctacaggctatggattag

SEQ ID NO: 8495 - DNA, 23 bp, Artificial Sequence
  Synthetic Construct
agtttcatagttgccccctttgt

SEQ ID NO: 8496 - DNA, 20 bp, Artificial Sequence
  Synthetic Construct
gctggctgttggaggacaga

SEQ ID NO: 8497 - DNA, 21 bp, Artificial Sequence
  Synthetic Construct
actgggacctcctctgcagat

SEQ ID NO: 8498 - DNA, 22 bp, Artificial Sequence
  Synthetic Construct
tgctgtctcttctaggcaaagg

SEQ ID NO: 8499 - DNA, 24 bp, Artificial Sequence
  Synthetic Construct
ctctccttcaaggtgcttctgaga

SEQ ID NO: 8500 - DNA, 22 bp, Artificial Sequence
  Synthetic Construct
gagactgcagtgaaccatcagt

SEQ ID NO: 8501 - DNA, 24 bp, Artificial Sequence
  Synthetic Construct
tgcctggcaatgttagataaggat

SEQ ID NO: 8502 - DNA, 24 bp, Artificial Sequence
  Synthetic Construct
gctgctttccctcttgttacacaa

SEQ ID NO: 8503 - DNA, 21 bp, Artificial Sequence
  Synthetic Construct
tgctgaatctgtggtgagctt

SEQ ID NO: 8504 - DNA, 21 bp, Artificial Sequence
  Synthetic Construct
aagtggccactgaagtcgatt

SEQ ID NO: 8505 - DNA, 28 bp, Artificial Sequence
  Synthetic Construct
ggaatcaaagcacctttatttactgctt

SEQ ID NO: 8506 - DNA, 21 bp, Artificial Sequence
  Synthetic Construct
agcccagagatccaagcactt

SEQ ID NO: 8507 - DNA, 26 bp, Artificial Sequence
  Synthetic Construct
agacttggagtaatctttgccttctt

SEQ ID NO: 8508 - DNA, 25 bp, Artificial Sequence
  Synthetic Construct
cctcaattttcaccccactcttctt

SEQ ID NO: 8509 - DNA, 24 bp, Artificial Sequence
  Synthetic Construct
agggtgaaattcctccagattcag

SEQ ID NO: 8510 - DNA, 22 bp, Artificial Sequence
  Synthetic Construct
agctcatcagcacatgagttca

SEQ ID NO: 8511 - DNA, 23 bp, Artificial Sequence
  Synthetic Construct
cctgtcacatgcagctatcaatg

SEQ ID NO: 8512 - DNA, 19 bp, Artificial Sequence
  Synthetic Construct
ggtgatgccagggctcaat

SEQ ID NO: 8513 - DNA, 29 bp, Artificial Sequence
  Synthetic Construct
ccattcttcccatcctctctaataatagg

SEQ ID NO: 8514 - DNA, 19 bp, Artificial Sequence
  Synthetic Construct
gctggggctcttctgcttt

SEQ ID NO: 8515 - DNA, 22 bp, Artificial Sequence
  Synthetic Construct
gagctcacatgccagattccat

SEQ ID NO: 8516 - DNA, 22 bp, Artificial Sequence
  Synthetic Construct
cctgggtagcactgtcttcaat

SEQ ID NO: 8517 - DNA, 25 bp, Artificial Sequence
  Synthetic Construct
tgcacggctaagcagtaagggactt

SEQ ID NO: 8518 - DNA, 27 bp, Artificial Sequence
  Synthetic Construct
gtctctcggggtaatttttctctatcc

SEQ ID NO: 8519 - DNA, 20 bp, Artificial Sequence
  Synthetic Construct
tgcaaacaggatggctgaca

SEQ ID NO: 8520 - DNA, 21 bp, Artificial Sequence
  Synthetic Construct
agccatgtccctgactaacct

SEQ ID NO: 8521 - DNA, 23 bp, Artificial Sequence
  Synthetic Construct
ctgaagggtaaaggcatgggtta

SEQ ID NO: 8522 - DNA, 24 bp, Artificial Sequence
  Synthetic Construct
ccagcagtgatgaccaaagatgac

SEQ ID NO: 8523 - DNA, 24 bp, Artificial Sequence
  Synthetic Construct
caaggtaatttgcctgagctttgg

SEQ ID NO: 8524 - DNA, 25 bp, Artificial Sequence
  Synthetic Construct
gcacattgctagctgagagaaacag

SEQ ID NO: 8525 - DNA, 21 bp, Artificial Sequence
  Synthetic Construct
tgccaagatcgtcgcagtgat

SEQ ID NO: 8526 - DNA, 21 bp, Artificial Sequence
  Synthetic Construct
gggaaccccaaacccttcttg

SEQ ID NO: 8527 - DNA, 21 bp, Artificial Sequence
  Synthetic Construct
agccaggtgcagtatgggaaa

SEQ ID NO: 8528 - DNA, 21 bp, Artificial Sequence
  Synthetic Construct
ctcatgcttgcctctggacaa

SEQ ID NO: 8529 - DNA, 25 bp, Artificial Sequence
  Synthetic Construct
gacccaaaactgaaactgagatgca

SEQ ID NO: 8530 - DNA, 22 bp, Artificial Sequence
  Synthetic Construct
ggccagcatttcttggatcctt

SEQ ID NO: 8531 - DNA, 24 bp, Artificial Sequence
  Synthetic Construct
ccccaggatagacaacatttggat

SEQ ID NO: 8532 - DNA, 22 bp, Artificial Sequence
  Synthetic Construct
tccaattggccacaagcttcgt

SEQ ID NO: 8533 - DNA, 22 bp, Artificial Sequence
  Synthetic Construct
gctcccctgacatcccactttt

SEQ ID NO: 8534 - DNA, 25 bp, Artificial Sequence
  Synthetic Construct
agatgttggggttcataagggaaac

SEQ ID NO: 8535 - DNA, 27 bp, Artificial Sequence
  Synthetic Construct
gccattatctctccaggtgtttactgt

SEQ ID NO: 8536 - DNA, 20 bp, Artificial Sequence
  Synthetic Construct
ccaggttgactgcacacaca

SEQ ID NO: 8537 - DNA, 22 bp, Artificial Sequence
  Synthetic Construct
ctggaccttggttaagcactga

SEQ ID NO: 8538 - DNA, 22 bp, Artificial Sequence
  Synthetic Construct
ctgggttctagtcctggttgtg

SEQ ID NO: 8539 - DNA, 25 bp, Artificial Sequence
  Synthetic Construct
gcaaagaggctgctactcagattca

SEQ ID NO: 8540 - DNA, 21 bp, Artificial Sequence
  Synthetic Construct
agtcaaaaggcaggaggcaaa

SEQ ID NO: 8541 - DNA, 21 bp, Artificial Sequence
  Synthetic Construct
agaaaagggcccactggtctt

SEQ ID NO: 8542 - DNA, 24 bp, Artificial Sequence
  Synthetic Construct
ccaatccactccacataccattgt

SEQ ID NO: 8543 - DNA, 24 bp, Artificial Sequence
  Synthetic Construct
ctgtaaagtctctggtgtcaaggt

SEQ ID NO: 8544 - DNA, 20 bp, Artificial Sequence
  Synthetic Construct
tggtcctggcttctgtgact

SEQ ID NO: 8545 - DNA, 27 bp, Artificial Sequence
  Synthetic Construct
gcattccgaacactgaattgttaagtg

SEQ ID NO: 8546 - DNA, 23 bp, Artificial Sequence
  Synthetic Construct
gactcagcttggggaattctctt

SEQ ID NO: 8547 - DNA, 22 bp, Artificial Sequence
  Synthetic Construct
gaggggctactagaagcaaacc

SEQ ID NO: 8548 - DNA, 27 bp, Artificial Sequence
  Synthetic Construct
gaatgcccctgataagctttaatgatg

SEQ ID NO: 8549 - DNA, 24 bp, Artificial Sequence
  Synthetic Construct
cacaaagagcagcaaatcacatca

SEQ ID NO: 8550 - DNA, 22 bp, Artificial Sequence
  Synthetic Construct
cagcaaatggtcccacaggatt

SEQ ID NO: 8551 - DNA, 26 bp, Artificial Sequence
  Synthetic Construct
gcccaattgcaatatttccgaatgca

SEQ ID NO: 8552 - DNA, 21 bp, Artificial Sequence
  Synthetic Construct
aaaagggatgtggtgcgatct

SEQ ID NO: 8553 - DNA, 21 bp, Artificial Sequence
  Synthetic Construct
aggcaacaggtggtcaaatga

SEQ ID NO: 8554 - DNA, 23 bp, Artificial Sequence
  Synthetic Construct
cgcattacttcccatcctaccaa

SEQ ID NO: 8555 - DNA, 21 bp, Artificial Sequence
  Synthetic Construct
tggctgtcagtctgcatgtgt

SEQ ID NO: 8556 - DNA, 22 bp, Artificial Sequence
  Synthetic Construct
acaagatccagggttgctctgt

SEQ ID NO: 8557 - DNA, 21 bp, Artificial Sequence
  Synthetic Construct
ttggggttgtcacctgttgca

SEQ ID NO: 8558 - DNA, 23 bp, Artificial Sequence
  Synthetic Construct
aagagggtacaagggaggcttct

SEQ ID NO: 8559 - DNA, 26 bp, Artificial Sequence
  Synthetic Construct
agaggagaagtggagactattacagt

SEQ ID NO: 8560 - DNA, 24 bp, Artificial Sequence
  Synthetic Construct
gcacagtaggaaaagtctgttgtg

SEQ ID NO: 8561 - DNA, 25 bp, Artificial Sequence
  Synthetic Construct
aagactcacctctccttctatcctt

SEQ ID NO: 8562 - DNA, 25 bp, Artificial Sequence
  Synthetic Construct
tgaacctagttcctgctcctatgat

SEQ ID NO: 8563 - DNA, 22 bp, Artificial Sequence
  Synthetic Construct
acccctttcaagccaaggatgt

SEQ ID NO: 8564 - DNA, 22 bp, Artificial Sequence
  Synthetic Construct
gggaaacccaacctcctgacta

SEQ ID NO: 8565 - DNA, 24 bp, Artificial Sequence
  Synthetic Construct
cctaacctgctctcaagcttttgc

SEQ ID NO: 8566 - DNA, 21 bp, Artificial Sequence
  Synthetic Construct
aacctggccactccaaccata

SEQ ID NO: 8567 - DNA, 22 bp, Artificial Sequence
  Synthetic Construct
tggtgggtatatggagggtgtt

SEQ ID NO: 8568 - DNA, 19 bp, Artificial Sequence
  Synthetic Construct
tggaagaggggggcatctg

SEQ ID NO: 8569 - DNA, 22 bp, Artificial Sequence
  Synthetic Construct
tgttggttgtgtctcccatgca

SEQ ID NO: 8570 - DNA, 20 bp, Artificial Sequence
  Synthetic Construct
acctgcatcatggcctgaca

SEQ ID NO: 8571 - DNA, 19 bp, Artificial Sequence
  Synthetic Construct
aggagcatgtggcctcaga

SEQ ID NO: 8572 - DNA, 23 bp, Artificial Sequence
  Synthetic Construct
ccttagaggaacaaggcctgact

SEQ ID NO: 8573 - DNA, 23 bp, Artificial Sequence
  Synthetic Construct
caagacagtttcccatcctgaca

SEQ ID NO: 8574 - DNA, 19 bp, Artificial Sequence
  Synthetic Construct
gcgttgtgctgtccattgg

SEQ ID NO: 8575 - DNA, 21 bp, Artificial Sequence
  Synthetic Construct
tttgcaggccttggacatggt

SEQ ID NO: 8576 - DNA, 25 bp, Artificial Sequence
  Synthetic Construct
actggtccaatttagtcaccatgat

SEQ ID NO: 8577 - DNA, 26 bp, Artificial Sequence
  Synthetic Construct
gctcattcttgccctcctgtaagtac

SEQ ID NO: 8578 - DNA, 26 bp, Artificial Sequence
  Synthetic Construct
gctaagaggctcttaggtagcagtag

SEQ ID NO: 8579 - DNA, 21 bp, Artificial Sequence
  Synthetic Construct
gctgtggctgttttcctgcta

SEQ ID NO: 8580 - DNA, 24 bp, Artificial Sequence
  Synthetic Construct
ctcctccctctagttcttctgtgt

SEQ ID NO: 8581 - DNA, 24 bp, Artificial Sequence
  Synthetic Construct
ccttccctcctcctcaaaaactgt

SEQ ID NO: 8582 - DNA, 25 bp, Artificial Sequence
  Synthetic Construct
gactccattgaaacaaaggcaagag

SEQ ID NO: 8583 - DNA, 25 bp, Artificial Sequence
  Synthetic Construct
ccctcttttatggggcatgcattct

SEQ ID NO: 8584 - DNA, 20 bp, Artificial Sequence
  Synthetic Construct
agccacagctctgacaacag

SEQ ID NO: 8585 - DNA, 25 bp, Artificial Sequence
  Synthetic Construct
caagcagacacaaggataagaggaa

SEQ ID NO: 8586 - DNA, 24 bp, Artificial Sequence
  Synthetic Construct
aacttttgtcactgagagggttga

SEQ ID NO: 8587 - DNA, 25 bp, Artificial Sequence
  Synthetic Construct
cacctgtttaccttcctagcctctt

SEQ ID NO: 8588 - DNA, 23 bp, Artificial Sequence
  Synthetic Construct
tccttgtccacctattgcagatg

SEQ ID NO: 8589 - DNA, 20 bp, Artificial Sequence
  Synthetic Construct
ggaggcctttggaccttgga

SEQ ID NO: 8590 - DNA, 23 bp, Artificial Sequence
  Synthetic Construct
accctggaggagatgaatcttga

SEQ ID NO: 8591 - DNA, 20 bp, Artificial Sequence
  Synthetic Construct
ctgcctgcctgaagttctga

SEQ ID NO: 8592 - DNA, 24 bp, Artificial Sequence
  Synthetic Construct
gcacgctcttcaaatcaaaacttc

SEQ ID NO: 8593 - DNA, 25 bp, Artificial Sequence
  Synthetic Construct
gctaccgtttgtttcccacctatct

SEQ ID NO: 8594 - DNA, 23 bp, Artificial Sequence
  Synthetic Construct
tgtaaggggttagtcctccacaa

SEQ ID NO: 8595 - DNA, 21 bp, Artificial Sequence
  Synthetic Construct
aggaaagagagctgggaggaa

SEQ ID NO: 8596 - DNA, 22 bp, Artificial Sequence
  Synthetic Construct
gtctgcttttgggtcaggatga

SEQ ID NO: 8597 - DNA, 21 bp, Artificial Sequence
  Synthetic Construct
atccccctgctttctggacaa

SEQ ID NO: 8598 - DNA, 22 bp, Artificial Sequence
  Synthetic Construct
cctttctcaactcctggttgct

SEQ ID NO: 8599 - DNA, 25 bp, Artificial Sequence
  Synthetic Construct
cccttttcaccacactgatgtttgc

SEQ ID NO: 8600 - DNA, 22 bp, Artificial Sequence
  Synthetic Construct
aggtgaagcctcctgtcattct

SEQ ID NO: 8601 - DNA, 22 bp, Artificial Sequence
  Synthetic Construct
caggtcacagcaggaaaacaac

SEQ ID NO: 8602 - DNA, 21 bp, Artificial Sequence
  Synthetic Construct
agggagtgaatggtggcagaa

SEQ ID NO: 8603 - DNA, 21 bp, Artificial Sequence
  Synthetic Construct
acagtgaggaaggctgagcat

SEQ ID NO: 8604 - DNA, 28 bp, Artificial Sequence
  Synthetic Construct
ggccatgacattaagattgcttgaattc

SEQ ID NO: 8605 - DNA, 21 bp, Artificial Sequence
  Synthetic Construct
aggctgggctactggagatag

SEQ ID NO: 8606 - DNA, 22 bp, Artificial Sequence
  Synthetic Construct
actctgaactcgctgtgtcctt

SEQ ID NO: 8607 - DNA, 27 bp, Artificial Sequence
  Synthetic Construct
ccctctattgatcctgttggagtttgg

SEQ ID NO: 8608 - DNA, 20 bp, Artificial Sequence
  Synthetic Construct
tgaccaggtctccagtgctt

SEQ ID NO: 8609 - DNA, 22 bp, Artificial Sequence
  Synthetic Construct
cctccctccatcctgtgagata

SEQ ID NO: 8610 - DNA, 22 bp, Artificial Sequence
  Synthetic Construct
catcagcaagggccatttctga

SEQ ID NO: 8611 - DNA, 22 bp, Artificial Sequence
  Synthetic Construct
cacaacaatcctgggactgaga

SEQ ID NO: 8612 - DNA, 22 bp, Artificial Sequence
  Synthetic Construct
atgcccagtataccaggagtca

SEQ ID NO: 8613 - DNA, 27 bp, Artificial Sequence
  Synthetic Construct
gccaaaaaggattattcccaggtcttg

SEQ ID NO: 8614 - DNA, 20 bp, Artificial Sequence
  Synthetic Construct
aggctccccatggactgtca

SEQ ID NO: 8615 - DNA, 25 bp, Artificial Sequence
  Synthetic Construct
tgatttcctctgtgctttctacctt

SEQ ID NO: 8616 - DNA, 22 bp, Artificial Sequence
  Synthetic Construct
ctgatgaccacactgtctgcat

SEQ ID NO: 8617 - DNA, 24 bp, Artificial Sequence
  Synthetic Construct
cactcccttaccaagaagcagtct

SEQ ID NO: 8618 - DNA, 22 bp, Artificial Sequence
  Synthetic Construct
aaggtccgtgcaggttacaagt

SEQ ID NO: 8619 - DNA, 24 bp, Artificial Sequence
  Synthetic Construct
gggcatcatacagtgaaggacttg

SEQ ID NO: 8620 - DNA, 25 bp, Artificial Sequence
  Synthetic Construct
aattgagggcaattagctaggatca

SEQ ID NO: 8621 - DNA, 26 bp, Artificial Sequence
  Synthetic Construct
agtaagaaaaagaatgggctctcagt

SEQ ID NO: 8622 - DNA, 24 bp, Artificial Sequence
  Synthetic Construct
tcctagtgccagtatccgtttctg

SEQ ID NO: 8623 - DNA, 23 bp, Artificial Sequence
  Synthetic Construct
gtgccctcaaaaaccacttaagg

SEQ ID NO: 8624 - DNA, 26 bp, Artificial Sequence
  Synthetic Construct
cactttagagcagggtataacatgga

SEQ ID NO: 8625 - DNA, 22 bp, Artificial Sequence
  Synthetic Construct
cccagttgttgtgctgaaatgg

SEQ ID NO: 8626 - DNA, 22 bp, Artificial Sequence
  Synthetic Construct
tgggggttttttggctcatggt

SEQ ID NO: 8627 - DNA, 22 bp, Artificial Sequence
  Synthetic Construct
actttacagtggggaggctaga

SEQ ID NO: 8628 - DNA, 22 bp, Artificial Sequence
  Synthetic Construct
gccctttcccatcttgtacctt

SEQ ID NO: 8629 - DNA, 30 bp, Artificial Sequence
  Synthetic Construct
aaattagttccattttagtgatcgccttaa

SEQ ID NO: 8630 - DNA, 25 bp, Artificial Sequence
  Synthetic Construct
gcacagcactggatatcttaattgc

SEQ ID NO: 8631 - DNA, 26 bp, Artificial Sequence
  Synthetic Construct
ctggaaattacaaagctcacttgact

SEQ ID NO: 8632 - DNA, 22 bp, Artificial Sequence
  Synthetic Construct
ggtcttaccatggcgaaactct

SEQ ID NO: 8633 - DNA, 22 bp, Artificial Sequence
  Synthetic Construct
aagagggactgtggtgaaagtg

SEQ ID NO: 8634 - DNA, 22 bp, Artificial Sequence
  Synthetic Construct
acaactgcaagaacaggaccaa

SEQ ID NO: 8635 - DNA, 20 bp, Artificial Sequence
  Synthetic Construct
cagccccaagactcccaaag

SEQ ID NO: 8636 - DNA, 26 bp, Artificial Sequence
  Synthetic Construct
agccagaaggtgtatattaggattgg

SEQ ID NO: 8637 - DNA, 27 bp, Artificial Sequence
  Synthetic Construct
ggtggggagtgttttacaggaatagat

SEQ ID NO: 8638 - DNA, 23 bp, Artificial Sequence
  Synthetic Construct
gcttgcattgcttcacactatgt

SEQ ID NO: 8639 - DNA, 29 bp, Artificial Sequence
  Synthetic Construct
ggcagagttaaagttctttagatcaacca

SEQ ID NO: 8640 - DNA, 25 bp, Artificial Sequence
  Synthetic Construct
cgacgccactttatccctcttaaac

SEQ ID NO: 8641 - DNA, 21 bp, Artificial Sequence
  Synthetic Construct
acatcctcccagtcagtgcta

SEQ ID NO: 8642 - DNA, 24 bp, Artificial Sequence
  Synthetic Construct
ggtactgtccttccatccacaact

SEQ ID NO: 8643 - DNA, 22 bp, Artificial Sequence
  Synthetic Construct
ctggcacaaccttgcttagttc

SEQ ID NO: 8644 - DNA, 25 bp, Artificial Sequence
  Synthetic Construct
accaactggtcattcaggaacatag

SEQ ID NO: 8645 - DNA, 22 bp, Artificial Sequence
  Synthetic Construct
gctcaagcatcctccactcctt

SEQ ID NO: 8646 - DNA, 23 bp, Artificial Sequence
  Synthetic Construct
gctcacttgagtgccacttacag

SEQ ID NO: 8647 - DNA, 25 bp, Artificial Sequence
  Synthetic Construct
cctcccatttacagcacaattcact

SEQ ID NO: 8648 - DNA, 20 bp, Artificial Sequence
  Synthetic Construct
gccctccatgacttcgctta

SEQ ID NO: 8649 - DNA, 21 bp, Artificial Sequence
  Synthetic Construct
ccttgccactcctctccctat

SEQ ID NO: 8650 - DNA, 24 bp, Artificial Sequence
  Synthetic Construct
gtcctatggctgttctttcccata

SEQ ID NO: 8651 - DNA, 26 bp, Artificial Sequence
  Synthetic Construct
cttctcctatatcctccacagatcct

SEQ ID NO: 8652 - DNA, 22 bp, Artificial Sequence
  Synthetic Construct
ctgctgccatttgaccatatgc

SEQ ID NO: 8653 - DNA, 23 bp, Artificial Sequence
  Synthetic Construct
ccacaaaggcaaggatacaatgg

SEQ ID NO: 8654 - DNA, 24 bp, Artificial Sequence
  Synthetic Construct
caccattcaaggtgctatggagat

SEQ ID NO: 8655 - DNA, 24 bp, Artificial Sequence
  Synthetic Construct
ggtttggagttaaggaaggtttgg

SEQ ID NO: 8656 - DNA, 21 bp, Artificial Sequence
  Synthetic Construct
gccatgcactcacttgctaca

SEQ ID NO: 8657 - DNA, 25 bp, Artificial Sequence
  Synthetic Construct
caaaatgtgccggaaaaggttatgt

SEQ ID NO: 8658 - DNA, 24 bp, Artificial Sequence
  Synthetic Construct
cggctcaggtaggagatcattcta

SEQ ID NO: 8659 - DNA, 21 bp, Artificial Sequence
  Synthetic Construct
tcctgttgcccagttctgctt

SEQ ID NO: 8660 - DNA, 22 bp, Artificial Sequence
  Synthetic Construct
cttcgctgcacttgagtcaaaa

SEQ ID NO: 8661 - DNA, 24 bp, Artificial Sequence
  Synthetic Construct
gcaccctatcatcagctttacaga

SEQ ID NO: 8662 - DNA, 24 bp, Artificial Sequence
  Synthetic Construct
tcctcaccccaatctaaggacaca

SEQ ID NO: 8663 - DNA, 22 bp, Artificial Sequence
  Synthetic Construct
tgtttgtggaccatgtgggaat

SEQ ID NO: 8664 - DNA, 28 bp, Artificial Sequence
  Synthetic Construct
acagaaatatcttgtccttcagagaact

SEQ ID NO: 8665 - DNA, 27 bp, Artificial Sequence
  Synthetic Construct
cacacatgcctcattaccattaacatc

SEQ ID NO: 8666 - DNA, 27 bp, Artificial Sequence
  Synthetic Construct
ccactgattcaaggacttttgcgtaga

SEQ ID NO: 8667 - DNA, 23 bp, Artificial Sequence
  Synthetic Construct
gggcaagtagtcaacgttactga

SEQ ID NO: 8668 - DNA, 25 bp, Artificial Sequence
  Synthetic Construct
ccaagcaagttctatgactgtgaac

SEQ ID NO: 8669 - DNA, 21 bp, Artificial Sequence
  Synthetic Construct
ttccccacgttggttcctttt

SEQ ID NO: 8670 - DNA, 23 bp, Artificial Sequence
  Synthetic Construct
gagggtaggggcattatcttcag

SEQ ID NO: 8671 - DNA, 24 bp, Artificial Sequence
  Synthetic Construct
tgggatccaggccagtattatacg

SEQ ID NO: 8672 - DNA, 23 bp, Artificial Sequence
  Synthetic Construct
ctgcagtttgaccctttctacca

SEQ ID NO: 8673 - DNA, 19 bp, Artificial Sequence
  Synthetic Construct
agctctgggctcaggaagt

SEQ ID NO: 8674 - DNA, 25 bp, Artificial Sequence
  Synthetic Construct
cctcctcacagttagtgtacacctt

SEQ ID NO: 8675 - DNA, 26 bp, Artificial Sequence
  Synthetic Construct
gactgagtgcaaactaatgttgactt

SEQ ID NO: 8676 - DNA, 20 bp, Artificial Sequence
  Synthetic Construct
cagcactgcttggcatgaac

SEQ ID NO: 8677 - DNA, 23 bp, Artificial Sequence
  Synthetic Construct
aggggaagggggagctatactta

SEQ ID NO: 8678 - DNA, 22 bp, Artificial Sequence
  Synthetic Construct
tgcttgccggcttaagtgtcat

SEQ ID NO: 8679 - DNA, 25 bp, Artificial Sequence
  Synthetic Construct
gagtaattcagccatcctgctctag

SEQ ID NO: 8680 - DNA, 22 bp, Artificial Sequence
  Synthetic Construct
caacttcttgcccttgtttcgt

SEQ ID NO: 8681 - DNA, 28 bp, Artificial Sequence
  Synthetic Construct
gagtctgtaaaatggctcagaaatttcc

SEQ ID NO: 8682 - DNA, 22 bp, Artificial Sequence
  Synthetic Construct
tgcacagacagaggccaaattc

SEQ ID NO: 8683 - DNA, 27 bp, Artificial Sequence
  Synthetic Construct
gtgattctcattgcacattctttctct

SEQ ID NO: 8684 - DNA, 26 bp, Artificial Sequence
  Synthetic Construct
cagacttccacttgctctaagtaagg

SEQ ID NO: 8685 - DNA, 22 bp, Artificial Sequence
  Synthetic Construct
tgggacatggttgtgacaagga

SEQ ID NO: 8686 - DNA, 22 bp, Artificial Sequence
  Synthetic Construct
tacttggctcccagacaacatc

SEQ ID NO: 8687 - DNA, 22 bp, Artificial Sequence
  Synthetic Construct
atggcaacccactcctcccttt

SEQ ID NO: 8688 - DNA, 24 bp, Artificial Sequence
  Synthetic Construct
tcggagacacactgtagtttctca

SEQ ID NO: 8689 - DNA, 23 bp, Artificial Sequence
  Synthetic Construct
cttttcctgagtgcgcgttcctt

SEQ ID NO: 8690 - DNA, 19 bp, Artificial Sequence
  Synthetic Construct
tgcctcctcagggaagcat

SEQ ID NO: 8691 - DNA, 19 bp, Artificial Sequence
  Synthetic Construct
ggggagccaatgtgcttct

SEQ ID NO: 8692 - DNA, 24 bp, Artificial Sequence
  Synthetic Construct
gtgctgcagagtgaggagatatga

SEQ ID NO: 8693 - DNA, 21 bp, Artificial Sequence
  Synthetic Construct
cgcagctgctgtacactaacg

SEQ ID NO: 8694 - DNA, 22 bp, Artificial Sequence
  Synthetic Construct
actgcaactccttgaggtcaag

SEQ ID NO: 8695 - DNA, 22 bp, Artificial Sequence
  Synthetic Construct
tccttgacctggggatgatgga

SEQ ID NO: 8696 - DNA, 21 bp, Artificial Sequence
  Synthetic Construct
aagagccaagcttgtcaacca

SEQ ID NO: 8697 - DNA, 24 bp, Artificial Sequence
  Synthetic Construct
catggacccaagacctaggattct

SEQ ID NO: 8698 - DNA, 22 bp, Artificial Sequence
  Synthetic Construct
gtgccatctagggacctaggaa

SEQ ID NO: 8699 - DNA, 24 bp, Artificial Sequence
  Synthetic Construct
agaagaggcagtgagaacctaact

SEQ ID NO: 8700 - DNA, 25 bp, Artificial Sequence
  Synthetic Construct
cctaggtcgctttaagtcacaaagc

SEQ ID NO: 8701 - DNA, 25 bp, Artificial Sequence
  Synthetic Construct
agtgaaggcacagttttatccagtt

SEQ ID NO: 8702 - DNA, 22 bp, Artificial Sequence
  Synthetic Construct
tctctgggcttaaagggaaagc

SEQ ID NO: 8703 - DNA, 22 bp, Artificial Sequence
  Synthetic Construct
gggaagtgggcataaccttgtt

SEQ ID NO: 8704 - DNA, 23 bp, Artificial Sequence
  Synthetic Construct
gcagcaaaaatggttctcatcct

SEQ ID NO: 8705 - DNA, 25 bp, Artificial Sequence
  Synthetic Construct
ccaacctccagtaaagcatcaactc

SEQ ID NO: 8706 - DNA, 22 bp, Artificial Sequence
  Synthetic Construct
acccagcactgaccttcctaat

SEQ ID NO: 8707 - DNA, 24 bp, Artificial Sequence
  Synthetic Construct
cctccttgtcttcccactgctttt

SEQ ID NO: 8708 - DNA, 22 bp, Artificial Sequence
  Synthetic Construct
gggaaaacagactctgccttga

SEQ ID NO: 8709 - DNA, 27 bp, Artificial Sequence
  Synthetic Construct
gtaaagcttcagtcaatcagtgtgatt

SEQ ID NO: 8710 - DNA, 21 bp, Artificial Sequence
  Synthetic Construct
tggaggatttggtgccagaga

SEQ ID NO: 8711 - DNA, 20 bp, Artificial Sequence
  Synthetic Construct
tgacaccctgctgctgtcta

SEQ ID NO: 8712 - DNA, 24 bp, Artificial Sequence
  Synthetic Construct
gtttctgaagggcatatggcttca

SEQ ID NO: 8713 - DNA, 23 bp, Artificial Sequence
  Synthetic Construct
cagcaacccccaaccatgataaa

SEQ ID NO: 8714 - DNA, 22 bp, Artificial Sequence
  Synthetic Construct
ggggccatgtgagaagaaatgt

SEQ ID NO: 8715 - DNA, 22 bp, Artificial Sequence
  Synthetic Construct
tccccaccatgaactctgtcta

SEQ ID NO: 8716 - DNA, 23 bp, Artificial Sequence
  Synthetic Construct
tcctgctacaagtctcagatggt

SEQ ID NO: 8717 - DNA, 24 bp, Artificial Sequence
  Synthetic Construct
gcacccttaatgtccagacataca

SEQ ID NO: 8718 - DNA, 22 bp, Artificial Sequence
  Synthetic Construct
ttcaacagcacggtgatcctaa

SEQ ID NO: 8719 - DNA, 20 bp, Artificial Sequence
  Synthetic Construct
atgtgctggtcttggcagtt

SEQ ID NO: 8720 - DNA, 20 bp, Artificial Sequence
  Synthetic Construct
accctcctcagcacaaagca

SEQ ID NO: 8721 - DNA, 24 bp, Artificial Sequence
  Synthetic Construct
gcccccttctttcttaggataggt

SEQ ID NO: 8722 - DNA, 19 bp, Artificial Sequence
  Synthetic Construct
ccaatggggcagcaagaca

SEQ ID NO: 8723 - DNA, 21 bp, Artificial Sequence
  Synthetic Construct
ctgctgacaccaaaccagttg

SEQ ID NO: 8724 - DNA, 22 bp, Artificial Sequence
  Synthetic Construct
tgagtccaggcctagactctct

SEQ ID NO: 8725 - DNA, 22 bp, Artificial Sequence
  Synthetic Construct
tcctccaaccctgtctttgaac

SEQ ID NO: 8726 - DNA, 23 bp, Artificial Sequence
  Synthetic Construct
cagagaaggcattgacagtggat

SEQ ID NO: 8727 - DNA, 22 bp, Artificial Sequence
  Synthetic Construct
gcccctgctgaaaattctggtt

SEQ ID NO: 8728 - DNA, 21 bp, Artificial Sequence
  Synthetic Construct
agccctgcttcctcctacata

SEQ ID NO: 8729 - DNA, 22 bp, Artificial Sequence
  Synthetic Construct
gagtgcaggtgtctggaagatc

SEQ ID NO: 8730 - DNA, 25 bp, Artificial Sequence
  Synthetic Construct
ctgagtcctatctgtctctggacat

SEQ ID NO: 8731 - DNA, 24 bp, Artificial Sequence
  Synthetic Construct
agccttgaggttaaaggtcatctc

SEQ ID NO: 8732 - DNA, 24 bp, Artificial Sequence
  Synthetic Construct
gggttgatgcacatgcccttaaac

SEQ ID NO: 8733 - DNA, 24 bp, Artificial Sequence
  Synthetic Construct
ttgcaaacatgctctcattgagtt

SEQ ID NO: 8734 - DNA, 22 bp, Artificial Sequence
  Synthetic Construct
gcaaggagaaacagtgcacaag

SEQ ID NO: 8735 - DNA, 24 bp, Artificial Sequence
  Synthetic Construct
gcacttgtgggagagagaacacaa

SEQ ID NO: 8736 - DNA, 24 bp, Artificial Sequence
  Synthetic Construct
ctctgaaccctgtaactacagcaa

SEQ ID NO: 8737 - DNA, 25 bp, Artificial Sequence
  Synthetic Construct
cctgttgtttccgagaaagacaaac

SEQ ID NO: 8738 - DNA, 23 bp, Artificial Sequence
  Synthetic Construct
gaaaacttcagccaaagccatct

SEQ ID NO: 8739 - DNA, 24 bp, Artificial Sequence
  Synthetic Construct
gcccagattcttgcagaaccagaa

SEQ ID NO: 8740 - DNA, 22 bp, Artificial Sequence
  Synthetic Construct
tggccttatactggctcctgtt

SEQ ID NO: 8741 - DNA, 25 bp, Artificial Sequence
  Synthetic Construct
agtcaaccttcttacttccaaagca

SEQ ID NO: 8742 - DNA, 25 bp, Artificial Sequence
  Synthetic Construct
agaggatttctctccccacttttct

SEQ ID NO: 8743 - DNA, 24 bp, Artificial Sequence
  Synthetic Construct
gcaaccagcctagaaatcaatcca

SEQ ID NO: 8744 - DNA, 28 bp, Artificial Sequence
  Synthetic Construct
gcttgcactataggtaaaggcaaaatct

SEQ ID NO: 8745 - DNA, 24 bp, Artificial Sequence
  Synthetic Construct
ctgggaacatgactgtctaggaaa

SEQ ID NO: 8746 - DNA, 21 bp, Artificial Sequence
  Synthetic Construct
acaccctgtggagatgttcga

SEQ ID NO: 8747 - DNA, 25 bp, Artificial Sequence
  Synthetic Construct
caagtgaaaccctaagctcttcttg

SEQ ID NO: 8748 - DNA, 26 bp, Artificial Sequence
  Synthetic Construct
atgcaaagccacacagtagtttatac

SEQ ID NO: 8749 - DNA, 22 bp, Artificial Sequence
  Synthetic Construct
ggaacagaagctggtttgcttt

SEQ ID NO: 8750 - DNA, 25 bp, Artificial Sequence
  Synthetic Construct
atgcagactcacagttctaattgga

SEQ ID NO: 8751 - DNA, 26 bp, Artificial Sequence
  Synthetic Construct
ccctggagctctaagtaaacttgaag

SEQ ID NO: 8752 - DNA, 24 bp, Artificial Sequence
  Synthetic Construct
gacttcaaagctggttccattcaa

SEQ ID NO: 8753 - DNA, 22 bp, Artificial Sequence
  Synthetic Construct
cttcacctttcacttgcttgca

SEQ ID NO: 8754 - DNA, 23 bp, Artificial Sequence
  Synthetic Construct
ggttctgcagagtcattggtctt

SEQ ID NO: 8755 - DNA, 22 bp, Artificial Sequence
  Synthetic Construct
tctcagttcgcaggctaagatc

SEQ ID NO: 8756 - DNA, 20 bp, Artificial Sequence
  Synthetic Construct
agacacacctgggaccagaa

SEQ ID NO: 8757 - DNA, 23 bp, Artificial Sequence
  Synthetic Construct
cagaatggctgactttgcatgag

SEQ ID NO: 8758 - DNA, 26 bp, Artificial Sequence
  Synthetic Construct
cagtatgactgatcacaagaccaagt

SEQ ID NO: 8759 - DNA, 24 bp, Artificial Sequence
  Synthetic Construct
cgatactgcaaggcaagtcctatg

SEQ ID NO: 8760 - DNA, 22 bp, Artificial Sequence
  Synthetic Construct
ttgttcctgtgggtgtgagcta

SEQ ID NO: 8761 - DNA, 21 bp, Artificial Sequence
  Synthetic Construct
tgtgccagtcctctcccttat

SEQ ID NO: 8762 - DNA, 25 bp, Artificial Sequence
  Synthetic Construct
agttcaaaacacacaagtgctaacc

SEQ ID NO: 8763 - DNA, 24 bp, Artificial Sequence
  Synthetic Construct
gttcgtgtttattcagcagagctt

SEQ ID NO: 8764 - DNA, 20 bp, Artificial Sequence
  Synthetic Construct
gctcctgtgcaacccaaaag

SEQ ID NO: 8765 - DNA, 21 bp, Artificial Sequence
  Synthetic Construct
gtgtttgtggccatgtgtcaa

SEQ ID NO: 8766 - DNA, 20 bp, Artificial Sequence
  Synthetic Construct
aagagcaccctccaggttca

SEQ ID NO: 8767 - DNA, 24 bp, Artificial Sequence
  Synthetic Construct
agctctagatgaggctgagactaa

SEQ ID NO: 8768 - DNA, 26 bp, Artificial Sequence
  Synthetic Construct
ccttcatctcttgtgccatcttacct

SEQ ID NO: 8769 - DNA, 24 bp, Artificial Sequence
  Synthetic Construct
acctccaggacagaagtacaatct

SEQ ID NO: 8770 - DNA, 20 bp, Artificial Sequence
  Synthetic Construct
gcccctttcccgtgattctt

SEQ ID NO: 8771 - DNA, 24 bp, Artificial Sequence
  Synthetic Construct
aggtggaggagtcagatggatgta

SEQ ID NO: 8772 - DNA, 25 bp, Artificial Sequence
  Synthetic Construct
ggttagagaaaaacccacccattgt

SEQ ID NO: 8773 - DNA, 24 bp, Artificial Sequence
  Synthetic Construct
cagtgttgacagccaactctttcc

SEQ ID NO: 8774 - DNA, 22 bp, Artificial Sequence
  Synthetic Construct
ccccaatccaatccctgaagac

SEQ ID NO: 8775 - DNA, 24 bp, Artificial Sequence
  Synthetic Construct
gggtgatgtcccttcaggaagaaa

SEQ ID NO: 8776 - DNA, 20 bp, Artificial Sequence
  Synthetic Construct
tggccgtgacatcaacaact

SEQ ID NO: 8777 - DNA, 20 bp, Artificial Sequence
  Synthetic Construct
aggcacccctcctccttatc

SEQ ID NO: 8778 - DNA, 24 bp, Artificial Sequence
  Synthetic Construct
gagcagaggagtggttttaagagt

SEQ ID NO: 8779 - DNA, 19 bp, Artificial Sequence
  Synthetic Construct
aaggtccacccacctttgc

SEQ ID NO: 8780 - DNA, 30 bp, Artificial Sequence
  Synthetic Construct
ctagctactaagtactttcaaggactctac

SEQ ID NO: 8781 - DNA, 26 bp, Artificial Sequence
  Synthetic Construct
gccttggaaggttttctgggacatag

SEQ ID NO: 8782 - DNA, 25 bp, Artificial Sequence
  Synthetic Construct
acacagaggtagaagtggacttaga

SEQ ID NO: 8783 - DNA, 20 bp, Artificial Sequence
  Synthetic Construct
acctggctccctggatacca

SEQ ID NO: 8784 - DNA, 22 bp, Artificial Sequence
  Synthetic Construct
tgtgtctgcacctttcctatcg

SEQ ID NO: 8785 - DNA, 23 bp, Artificial Sequence
  Synthetic Construct
gctgggattgaaaggagatgaca

SEQ ID NO: 8786 - DNA, 27 bp, Artificial Sequence
  Synthetic Construct
tgtttgcagccaataacttatgtagtg

SEQ ID NO: 8787 - DNA, 24 bp, Artificial Sequence
  Synthetic Construct
cagtagggtgagccaagataccat

SEQ ID NO: 8788 - DNA, 22 bp, Artificial Sequence
  Synthetic Construct
aaaaccagtggacacctgtgat

SEQ ID NO: 8789 - DNA, 22 bp, Artificial Sequence
  Synthetic Construct
tgggtagctcctaacagcagtt

SEQ ID NO: 8790 - DNA, 25 bp, Artificial Sequence
  Synthetic Construct
ggcatctagaatggatttggtcaca

SEQ ID NO: 8791 - DNA, 22 bp, Artificial Sequence
  Synthetic Construct
ccttggccagaactcaaccaaa

SEQ ID NO: 8792 - DNA, 24 bp, Artificial Sequence
  Synthetic Construct
ggcagctgaaactgtagctgtaag

SEQ ID NO: 8793 - DNA, 22 bp, Artificial Sequence
  Synthetic Construct
ctggcctggaaagattgacctt

SEQ ID NO: 8794 - DNA, 28 bp, Artificial Sequence
  Synthetic Construct
cataaagtacattccatggtggcatatt

SEQ ID NO: 8795 - DNA, 19 bp, Artificial Sequence
  Synthetic Construct
ccttgggctggcttttgga

SEQ ID NO: 8796 - DNA, 23 bp, Artificial Sequence
  Synthetic Construct
gggtggcagagtttcaagataga

SEQ ID NO: 8797 - DNA, 22 bp, Artificial Sequence
  Synthetic Construct
cacacatgccttccatccatct

SEQ ID NO: 8798 - DNA, 24 bp, Artificial Sequence
  Synthetic Construct
ggtcaccttggatactctgaaacc

SEQ ID NO: 8799 - DNA, 22 bp, Artificial Sequence
  Synthetic Construct
ccgtgatcacacagctggttta

SEQ ID NO: 8800 - DNA, 24 bp, Artificial Sequence
  Synthetic Construct
cctggcaaggaaagcttctttaca

SEQ ID NO: 8801 - DNA, 21 bp, Artificial Sequence
  Synthetic Construct
tgtagtgtcgggccaaatcag

SEQ ID NO: 8802 - DNA, 26 bp, Artificial Sequence
  Synthetic Construct
ctctatctctgtctcgcttcagattc

SEQ ID NO: 8803 - DNA, 23 bp, Artificial Sequence
  Synthetic Construct
accctttgtctctcactcccttt

SEQ ID NO: 8804 - DNA, 22 bp, Artificial Sequence
  Synthetic Construct
caactggcacaaatgaggcatt

SEQ ID NO: 8805 - DNA, 28 bp, Artificial Sequence
  Synthetic Construct
gaaaattacttggaactgtaagggcatt

SEQ ID NO: 8806 - DNA, 21 bp, Artificial Sequence
  Synthetic Construct
ccaaaccctcctcccttttgt

SEQ ID NO: 8807 - DNA, 24 bp, Artificial Sequence
  Synthetic Construct
tcatagctgtggaagttgtagcaa

SEQ ID NO: 8808 - DNA, 24 bp, Artificial Sequence
  Synthetic Construct
ggcactcaaaccacacggaaatac

SEQ ID NO: 8809 - DNA, 21 bp, Artificial Sequence
  Synthetic Construct
agttttgccccagggatacag

SEQ ID NO: 8810 - DNA, 24 bp, Artificial Sequence
  Synthetic Construct
gcaaagtaccctacctaaccaaca

SEQ ID NO: 8811 - DNA, 22 bp, Artificial Sequence
  Synthetic Construct
tcccttctggctcaggatatgt

SEQ ID NO: 8812 - DNA, 24 bp, Artificial Sequence
  Synthetic Construct
gtaagtttgccaaaccctgctaaa

SEQ ID NO: 8813 - DNA, 27 bp, Artificial Sequence
  Synthetic Construct
gccacaaggaaacaaatctgacaacag

SEQ ID NO: 8814 - DNA, 23 bp, Artificial Sequence
  Synthetic Construct
ccacaccaacatagtgcacttga

SEQ ID NO: 8815 - DNA, 22 bp, Artificial Sequence
  Synthetic Construct
tttgggagtctgccttctcctt

SEQ ID NO: 8816 - DNA, 26 bp, Artificial Sequence
  Synthetic Construct
cctcgtggagaaaatacctgtgttag

SEQ ID NO: 8817 - DNA, 25 bp, Artificial Sequence
  Synthetic Construct
gtcaactgctatgtgtcagagtttg

SEQ ID NO: 8818 - DNA, 29 bp, Artificial Sequence
  Synthetic Construct
ccctggaacatgttaacagacttaattag

SEQ ID NO: 8819 - DNA, 25 bp, Artificial Sequence
  Synthetic Construct
actgttccagctcagtttcctaaac

SEQ ID NO: 8820 - DNA, 27 bp, Artificial Sequence
  Synthetic Construct
atacttataaacccaagctctgtcact

SEQ ID NO: 8821 - DNA, 22 bp, Artificial Sequence
  Synthetic Construct
gttccttagcccacatgtggtt

SEQ ID NO: 8822 - DNA, 23 bp, Artificial Sequence
  Synthetic Construct
tgagcttgtgtggaagtgattca

SEQ ID NO: 8823 - DNA, 25 bp, Artificial Sequence
  Synthetic Construct
gggttcccaatgcatacagaaatcc

SEQ ID NO: 8824 - DNA, 26 bp, Artificial Sequence
  Synthetic Construct
gtcacctttgacctgtttcttagtgt

SEQ ID NO: 8825 - DNA, 22 bp, Artificial Sequence
  Synthetic Construct
aggtgtgaacaggtgaccaact

SEQ ID NO: 8826 - DNA, 21 bp, Artificial Sequence
  Synthetic Construct
accctaggagcaaggctgtgt

SEQ ID NO: 8827 - DNA, 27 bp, Artificial Sequence
  Synthetic Construct
acagccctgtaaataccctctgggttt

SEQ ID NO: 8828 - DNA, 27 bp, Artificial Sequence
  Synthetic Construct
agactccaaatatcaagctctcagaat

SEQ ID NO: 8829 - DNA, 27 bp, Artificial Sequence
  Synthetic Construct
ctagaaagatgaagatcctgaggttca

SEQ ID NO: 8830 - DNA, 25 bp, Artificial Sequence
  Synthetic Construct
ggtgagtccatcagacattccttca

SEQ ID NO: 8831 - DNA, 23 bp, Artificial Sequence
  Synthetic Construct
acacattcccatctgcttgagat

SEQ ID NO: 8832 - DNA, 21 bp, Artificial Sequence
  Synthetic Construct
aaagctgcagcagatgagaca

SEQ ID NO: 8833 - DNA, 29 bp, Artificial Sequence
  Synthetic Construct
gattccttatcaccacccttttattcttt

SEQ ID NO: 8834 - DNA, 26 bp, Artificial Sequence
  Synthetic Construct
gctgtacagtcaaggttatccttctc

SEQ ID NO: 8835 - DNA, 23 bp, Artificial Sequence
  Synthetic Construct
gcaccccattcaatgcacacaaa

SEQ ID NO: 8836 - DNA, 22 bp, Artificial Sequence
  Synthetic Construct
acttcttctggcatgccactct

SEQ ID NO: 8837 - DNA, 24 bp, Artificial Sequence
  Synthetic Construct
gtaggggcttcagactcattacac

SEQ ID NO: 8838 - DNA, 24 bp, Artificial Sequence
  Synthetic Construct
gggagatggaggttgtgggattaa

SEQ ID NO: 8839 - DNA, 25 bp, Artificial Sequence
  Synthetic Construct
ggcagagatgattgatacggactac

SEQ ID NO: 8840 - DNA, 24 bp, Artificial Sequence
  Synthetic Construct
gcctactaagaactgctctcaact

SEQ ID NO: 8841 - DNA, 27 bp, Artificial Sequence
  Synthetic Construct
gatagaggaagaaaagtcaaggaccat

SEQ ID NO: 8842 - DNA, 23 bp, Artificial Sequence
  Synthetic Construct
ccctctggaagatgcagttacag

SEQ ID NO: 8843 - DNA, 19 bp, Artificial Sequence
  Synthetic Construct
cgactgcatcgtgcctgta

SEQ ID NO: 8844 - DNA, 27 bp, Artificial Sequence
  Synthetic Construct
ggagaggctgtgtctctagtaattgag

SEQ ID NO: 8845 - DNA, 26 bp, Artificial Sequence
  Synthetic Construct
gcaggtattgaatcacagttgtggtt

SEQ ID NO: 8846 - DNA, 26 bp, Artificial Sequence
  Synthetic Construct
gaaaacaatcaggctctttgtttcct

SEQ ID NO: 8847 - DNA, 21 bp, Artificial Sequence
  Synthetic Construct
caggagaacttgaggcaggtt

SEQ ID NO: 8848 - DNA, 23 bp, Artificial Sequence
  Synthetic Construct
gcagcctagaccataaggactac

SEQ ID NO: 8849 - DNA, 26 bp, Artificial Sequence
  Synthetic Construct
acatatgctgcttcattctgactgaa

SEQ ID NO: 8850 - DNA, 21 bp, Artificial Sequence
  Synthetic Construct
gtcatcagggttgtgcttcct

SEQ ID NO: 8851 - DNA, 25 bp, Artificial Sequence
  Synthetic Construct
cctgagggtcagattccttcacatt

SEQ ID NO: 8852 - DNA, 22 bp, Artificial Sequence
  Synthetic Construct
acaccctagctgcttctagtca

SEQ ID NO: 8853 - DNA, 25 bp, Artificial Sequence
  Synthetic Construct
ccaagctacttgaagacaccatacc

SEQ ID NO: 8854 - DNA, 24 bp, Artificial Sequence
  Synthetic Construct
cccaccccacaatgagatataagg

SEQ ID NO: 8855 - DNA, 21 bp, Artificial Sequence
  Synthetic Construct
gcagcttgctccatcaggtat

SEQ ID NO: 8856 - DNA, 24 bp, Artificial Sequence
  Synthetic Construct
gacctctgagaaacgacacttaca

SEQ ID NO: 8857 - DNA, 24 bp, Artificial Sequence
  Synthetic Construct
agcatgttttcaaggggatttgac

SEQ ID NO: 8858 - DNA, 24 bp, Artificial Sequence
  Synthetic Construct
cctgaacctggagttaaggtacca

SEQ ID NO: 8859 - DNA, 24 bp, Artificial Sequence
  Synthetic Construct
gggaatctggtgaagacaatgaga

SEQ ID NO: 8860 - DNA, 24 bp, Artificial Sequence
  Synthetic Construct
gttttgtcagcattgcatttggtt

SEQ ID NO: 8861 - DNA, 24 bp, Artificial Sequence
  Synthetic Construct
gactcaactcaaagcaaccaagga

SEQ ID NO: 8862 - DNA, 26 bp, Artificial Sequence
  Synthetic Construct
gagccaggattttagattgagcaatc

SEQ ID NO: 8863 - DNA, 27 bp, Artificial Sequence
  Synthetic Construct
ccaagtacctgatattgctccctcttt

SEQ ID NO: 8864 - DNA, 23 bp, Artificial Sequence
  Synthetic Construct
tttggtgctgaaaccaggtatga

SEQ ID NO: 8865 - DNA, 27 bp, Artificial Sequence
  Synthetic Construct
gagtgtaaacatactgggactaagtca

SEQ ID NO: 8866 - DNA, 25 bp, Artificial Sequence
  Synthetic Construct
ctgattcagtctgtgcaaaccatag

SEQ ID NO: 8867 - DNA, 23 bp, Artificial Sequence
  Synthetic Construct
cagttcaaactgtgttggctgaa

SEQ ID NO: 8868 - DNA, 22 bp, Artificial Sequence
  Synthetic Construct
tgctgcagggtggtagagtgta

SEQ ID NO: 8869 - DNA, 25 bp, Artificial Sequence
  Synthetic Construct
tgtcaagactgtttgttgggaaaag

SEQ ID NO: 8870 - DNA, 22 bp, Artificial Sequence
  Synthetic Construct
gagacaccagcagtgatacaca

SEQ ID NO: 8871 - DNA, 23 bp, Artificial Sequence
  Synthetic Construct
tgctgatcttccagtctgttcag

SEQ ID NO: 8872 - DNA, 25 bp, Artificial Sequence
  Synthetic Construct
ccctgatcaagtcctgactattctg

SEQ ID NO: 8873 - DNA, 24 bp, Artificial Sequence
  Synthetic Construct
agtggtccccagaaggtaatactc

SEQ ID NO: 8874 - DNA, 30 bp, Artificial Sequence
  Synthetic Construct
gacaggaaaggttctaagaagagaaagaag

SEQ ID NO: 8875 - DNA, 22 bp, Artificial Sequence
  Synthetic Construct
aagagaccaggaggaccactag

SEQ ID NO: 8876 - DNA, 19 bp, Artificial Sequence
  Synthetic Construct
aggtcccaaggtgctctga

SEQ ID NO: 8877 - DNA, 26 bp, Artificial Sequence
  Synthetic Construct
cctaccgactgtgctatgaggataag

SEQ ID NO: 8878 - DNA, 27 bp, Artificial Sequence
  Synthetic Construct
ccaaaaaaaggggcacaatatctagtg

SEQ ID NO: 8879 - DNA, 26 bp, Artificial Sequence
  Synthetic Construct
cctcacagcattctgaacaactatgg

SEQ ID NO: 8880 - DNA, 24 bp, Artificial Sequence
  Synthetic Construct
tgtgtttttgtggtagtgggtgtt

SEQ ID NO: 8881 - DNA, 22 bp, Artificial Sequence
  Synthetic Construct
gccctgcagttggatgtcatat

SEQ ID NO: 8882 - DNA, 25 bp, Artificial Sequence
  Synthetic Construct
aaataggcagagaatgaagctacca

SEQ ID NO: 8883 - DNA, 26 bp, Artificial Sequence
  Synthetic Construct
gggaagtggtaatcctatgccttatt

SEQ ID NO: 8884 - DNA, 27 bp, Artificial Sequence
  Synthetic Construct
acgcaccttaattagttcgtagttttg

SEQ ID NO: 8885 - DNA, 24 bp, Artificial Sequence
  Synthetic Construct
cagcaaaaggtgtttccagaaaga

SEQ ID NO: 8886 - DNA, 26 bp, Artificial Sequence
  Synthetic Construct
ggtaagaaaccagatttgggaaaagg

SEQ ID NO: 8887 - DNA, 22 bp, Artificial Sequence
  Synthetic Construct
tggaagttttgtcccagcaagt

SEQ ID NO: 8888 - DNA, 24 bp, Artificial Sequence
  Synthetic Construct
gccctttcaaatacctggaaagca

SEQ ID NO: 8889 - DNA, 24 bp, Artificial Sequence
  Synthetic Construct
ggaaggggcatggtcatactcata

SEQ ID NO: 8890 - DNA, 30 bp, Artificial Sequence
  Synthetic Construct
gcttacaagagccagataatttagtttgag

SEQ ID NO: 8891 - DNA, 22 bp, Artificial Sequence
  Synthetic Construct
gggagaatcctctgggtttgtg

SEQ ID NO: 8892 - DNA, 23 bp, Artificial Sequence
  Synthetic Construct
acggtgatcccagtctctttaac

SEQ ID NO: 8893 - DNA, 29 bp, Artificial Sequence
  Synthetic Construct
ttcgacatatgttaaaaaggggtttcttt

SEQ ID NO: 8894 - DNA, 28 bp, Artificial Sequence
  Synthetic Construct
gtcagagcttattggagaagaaactcat

SEQ ID NO: 8895 - DNA, 25 bp, Artificial Sequence
  Synthetic Construct
gagaatctgtgcactttgggaagaa

SEQ ID NO: 8896 - DNA, 20 bp, Artificial Sequence
  Synthetic Construct
aacaacaggcctgcccagaa

SEQ ID NO: 8897 - DNA, 25 bp, Artificial Sequence
  Synthetic Construct
caggtatttgatggcaccaattcat

SEQ ID NO: 8898 - DNA, 23 bp, Artificial Sequence
  Synthetic Construct
acatgctttcaagagcctcagat

SEQ ID NO: 8899 - DNA, 24 bp, Artificial Sequence
  Synthetic Construct
cagtcctccttctaactgcattcc

SEQ ID NO: 8900 - DNA, 27 bp, Artificial Sequence
  Synthetic Construct
gcaagccaaaaatgaaagagtgaatcc

SEQ ID NO: 8901 - DNA, 25 bp, Artificial Sequence
  Synthetic Construct
tgcactctttttcccagttgaaaaa

SEQ ID NO: 8902 - DNA, 24 bp, Artificial Sequence
  Synthetic Construct
gcccagacactgatgaatgtccat

SEQ ID NO: 8903 - DNA, 26 bp, Artificial Sequence
  Synthetic Construct
tcctaccaatgtcatctcatctccta

SEQ ID NO: 8904 - DNA, 29 bp, Artificial Sequence
  Synthetic Construct
tgatgttatcaagtcattcattccaagtg

SEQ ID NO: 8905 - DNA, 23 bp, Artificial Sequence
  Synthetic Construct
attcctcttggttgagggacaag

SEQ ID NO: 8906 - DNA, 30 bp, Artificial Sequence
  Synthetic Construct
cccagagacatattctatagaggagatgag

SEQ ID NO: 8907 - DNA, 24 bp, Artificial Sequence
  Synthetic Construct
ggctggagtgagggtttttagagt

SEQ ID NO: 8908 - DNA, 26 bp, Artificial Sequence
  Synthetic Construct
agtactctgcatgatcattgaaaggt

SEQ ID NO: 8909 - DNA, 30 bp, Artificial Sequence
  Synthetic Construct
ctgattagtggtgcagttttagaatacatc

SEQ ID NO: 8910 - DNA, 28 bp, Artificial Sequence
  Synthetic Construct
agggattcaacaattaatcaaacatggt

SEQ ID NO: 8911 - DNA, 23 bp, Artificial Sequence
  Synthetic Construct
ctgaaacctcagtgcaaactgtt

SEQ ID NO: 8912 - DNA, 24 bp, Artificial Sequence
  Synthetic Construct
gcagggacacatgacctattgaga

SEQ ID NO: 8913 - DNA, 29 bp, Artificial Sequence
  Synthetic Construct
ggtctggatatgtcgatagtaagaaagca

SEQ ID NO: 8914 - DNA, 22 bp, Artificial Sequence
  Synthetic Construct
gcagaaagagcaaagccatagc

SEQ ID NO: 8915 - DNA, 25 bp, Artificial Sequence
  Synthetic Construct
ggtgactcctaaattgccagacatg

SEQ ID NO: 8916 - DNA, 27 bp, Artificial Sequence
  Synthetic Construct
ccctgggttaaattttctggcttacac

SEQ ID NO: 8917 - DNA, 22 bp, Artificial Sequence
  Synthetic Construct
acctcaaccccttgtgagacaa

SEQ ID NO: 8918 - DNA, 27 bp, Artificial Sequence
  Synthetic Construct
gcctcatgctcgctgaaagtatttttg

SEQ ID NO: 8919 - DNA, 24 bp, Artificial Sequence
  Synthetic Construct
tggttggatggtcagagatttgaa

SEQ ID NO: 8920 - DNA, 20 bp, Artificial Sequence
  Synthetic Construct
tgtgcctaagcctggaactg

SEQ ID NO: 8921 - DNA, 25 bp, Artificial Sequence
  Synthetic Construct
ggctctggtttctatgaaccacctt

SEQ ID NO: 8922 - DNA, 21 bp, Artificial Sequence
  Synthetic Construct
tgacagcagcatgggaaatcc

SEQ ID NO: 8923 - DNA, 23 bp, Artificial Sequence
  Synthetic Construct
gtggcctagacagctcttaaagt

SEQ ID NO: 8924 - DNA, 22 bp, Artificial Sequence
  Synthetic Construct
tggcggaaagtgtttagctgaa

SEQ ID NO: 8925 - DNA, 26 bp, Artificial Sequence
  Synthetic Construct
tgcaatcatgtcttcatttgtttcca

SEQ ID NO: 8926 - DNA, 24 bp, Artificial Sequence
  Synthetic Construct
gtgatgccctttatcagcaagaca

SEQ ID NO: 8927 - DNA, 21 bp, Artificial Sequence
  Synthetic Construct
aggggcggagagacacaatga

SEQ ID NO: 8928 - DNA, 30 bp, Artificial Sequence
  Synthetic Construct
caagtattattttacctcccagacatcaga

SEQ ID NO: 8929 - DNA, 25 bp, Artificial Sequence
  Synthetic Construct
ggcagagattctgagccttatttgt

SEQ ID NO: 8930 - DNA, 27 bp, Artificial Sequence
  Synthetic Construct
agctcttttcacatgcaatagtgtatc

SEQ ID NO: 8931 - DNA, 29 bp, Artificial Sequence
  Synthetic Construct
tgaacatatgaaaaccatctgagtcaaga

SEQ ID NO: 8932 - DNA, 22 bp, Artificial Sequence
  Synthetic Construct
tgctctcacagctgaggaaatc

SEQ ID NO: 8933 - DNA, 26 bp, Artificial Sequence
  Synthetic Construct
aattatatggaggctgcactattcca

SEQ ID NO: 8934 - DNA, 23 bp, Artificial Sequence
  Synthetic Construct
accaggaaaaaagacaccccaaa

SEQ ID NO: 8935 - DNA, 25 bp, Artificial Sequence
  Synthetic Construct
ggtctttggtctctcctagtcattt

SEQ ID NO: 8936 - DNA, 30 bp, Artificial Sequence
  Synthetic Construct
aatctatttcacaacttgagagttttccaa

SEQ ID NO: 8937 - DNA, 24 bp, Artificial Sequence
  Synthetic Construct
tgcctctaccactgctatgattca

SEQ ID NO: 8938 - DNA, 28 bp, Artificial Sequence
  Synthetic Construct
tcagcagtttgataaaaatcaggtccta

SEQ ID NO: 8939 - DNA, 28 bp, Artificial Sequence
  Synthetic Construct
cctgatcaattccacctgctttaaatag

SEQ ID NO: 8940 - DNA, 22 bp, Artificial Sequence
  Synthetic Construct
agtctgacctccctgcttaacc

SEQ ID NO: 8941 - DNA, 21 bp, Artificial Sequence
  Synthetic Construct
aggaggcccctttctgtgtta

SEQ ID NO: 8942 - DNA, 29 bp, Artificial Sequence
  Synthetic Construct
cccttaatatcttcacttaacccctacat

SEQ ID NO: 8943 - DNA, 22 bp, Artificial Sequence
  Synthetic Construct
agcttctgcaaaaccccattcc

SEQ ID NO: 8944 - DNA, 23 bp, Artificial Sequence
  Synthetic Construct
agggaaggctaccagctctatga

SEQ ID NO: 8945 - DNA, 25 bp, Artificial Sequence
  Synthetic Construct
gacataatctgaaccagcaggtagt

SEQ ID NO: 8946 - DNA, 25 bp, Artificial Sequence
  Synthetic Construct
gcagttacaactcaggtgtctacca

SEQ ID NO: 8947 - DNA, 25 bp, Artificial Sequence
  Synthetic Construct
tcctttgacacaagaagatgaggtt

SEQ ID NO: 8948 - DNA, 25 bp, Artificial Sequence
  Synthetic Construct
tgttctttcttgccttgttccttga

SEQ ID NO: 8949 - DNA, 25 bp, Artificial Sequence
  Synthetic Construct
gtccagtctgccatcaaaaagaact

SEQ ID NO: 8950 - DNA, 22 bp, Artificial Sequence
  Synthetic Construct
gacaggcaatgtgatgcttcca

SEQ ID NO: 8951 - DNA, 26 bp, Artificial Sequence
  Synthetic Construct
tggtgtcttttgagtccattttcttg

SEQ ID NO: 8952 - DNA, 19 bp, Artificial Sequence
  Synthetic Construct
tggcccactgtgacagctt

SEQ ID NO: 8953 - DNA, 26 bp, Artificial Sequence
  Synthetic Construct
ctgttgcctaaatccctttctacatc

SEQ ID NO: 8954 - DNA, 26 bp, Artificial Sequence
  Synthetic Construct
acatttgccttcaggaagatccttag

SEQ ID NO: 8955 - DNA, 28 bp, Artificial Sequence
  Synthetic Construct
acaagtggatttctatgtgactctatca

SEQ ID NO: 8956 - DNA, 20 bp, Artificial Sequence
  Synthetic Construct
tggcctcaaacgcacactgt

SEQ ID NO: 8957 - DNA, 24 bp, Artificial Sequence
  Synthetic Construct
cggtgatcctgtacatggctaatc

SEQ ID NO: 8958 - DNA, 20 bp, Artificial Sequence
  Synthetic Construct
gccccatggagaggcctata

SEQ ID NO: 8959 - DNA, 26 bp, Artificial Sequence
  Synthetic Construct
caagtaaggtttaagccagtgatcag

SEQ ID NO: 8960 - DNA, 23 bp, Artificial Sequence
  Synthetic Construct
gcaggaatgttcaatcgcttcct

SEQ ID NO: 8961 - DNA, 26 bp, Artificial Sequence
  Synthetic Construct
gctttgttacccatatggtctagttg

SEQ ID NO: 8962 - DNA, 29 bp, Artificial Sequence
  Synthetic Construct
cagtatttcaagtgactgcagttatacag

SEQ ID NO: 8963 - DNA, 22 bp, Artificial Sequence
  Synthetic Construct
tgtagccatgactgaggcctat

SEQ ID NO: 8964 - DNA, 28 bp, Artificial Sequence
  Synthetic Construct
actgattactgaatactggccttaatct

SEQ ID NO: 8965 - DNA, 26 bp, Artificial Sequence
  Synthetic Construct
aggaagggatatgaaacatggcttaa

SEQ ID NO: 8966 - DNA, 22 bp, Artificial Sequence
  Synthetic Construct
cagggttccaatatggccaaca

SEQ ID NO: 8967 - DNA, 26 bp, Artificial Sequence
  Synthetic Construct
ccaacatatggtttcagaagcacaaa

SEQ ID NO: 8968 - DNA, 20 bp, Artificial Sequence
  Synthetic Construct
acatgttggtgggcacagaa

SEQ ID NO: 8969 - DNA, 20 bp, Artificial Sequence
  Synthetic Construct
ccctggccatcaaggagcta

SEQ ID NO: 8970 - DNA, 28 bp, Artificial Sequence
  Synthetic Construct
ggatattggcctgtagttttctctcctt

SEQ ID NO: 8971 - DNA, 28 bp, Artificial Sequence
  Synthetic Construct
gcaattgctggaccatataatgagacaa

SEQ ID NO: 8972 - DNA, 27 bp, Artificial Sequence
  Synthetic Construct
ggcagagtgatcattgattgataacca

SEQ ID NO: 8973 - DNA, 20 bp, Artificial Sequence
  Synthetic Construct
cctctgctgagctcctgtgt

SEQ ID NO: 8974 - DNA, 20 bp, Artificial Sequence
  Synthetic Construct
gcctccaccaccactacaca

SEQ ID NO: 8975 - DNA, 27 bp, Artificial Sequence
  Synthetic Construct
gtggaggaaattagatgtctgcttctg

SEQ ID NO: 8976 - DNA, 26 bp, Artificial Sequence
  Synthetic Construct
gacacacacaaaaggaactgtcagat

SEQ ID NO: 8977 - DNA, 20 bp, Artificial Sequence
  Synthetic Construct
agggcctgctgactcgttct

SEQ ID NO: 8978 - DNA, 22 bp, Artificial Sequence
  Synthetic Construct
agttctgtcccaatcccacaca

SEQ ID NO: 8979 - DNA, 23 bp, Artificial Sequence
  Synthetic Construct
gcttgaaagaagggcaaggaaac

SEQ ID NO: 8980 - DNA, 19 bp, Artificial Sequence
  Synthetic Construct
tccccactcctggcccttt

SEQ ID NO: 8981 - DNA, 24 bp, Artificial Sequence
  Synthetic Construct
actgggatttgactctggaacttg

SEQ ID NO: 8982 - DNA, 22 bp, Artificial Sequence
  Synthetic Construct
cagctagagcaaccacgatgaa

SEQ ID NO: 8983 - DNA, 23 bp, Artificial Sequence
  Synthetic Construct
gcctgaaaggtaggttgcaaacc

SEQ ID NO: 8984 - DNA, 24 bp, Artificial Sequence
  Synthetic Construct
agagtgataaaccaagcaccaaca

SEQ ID NO: 8985 - DNA, 22 bp, Artificial Sequence
  Synthetic Construct
acagcccttgtgtgcataaagg

SEQ ID NO: 8986 - DNA, 22 bp, Artificial Sequence
  Synthetic Construct
tctgcaccagtctcaggtcttc

SEQ ID NO: 8987 - DNA, 21 bp, Artificial Sequence
  Synthetic Construct
tttgcagaaagggctcaaacg

SEQ ID NO: 8988 - DNA, 18 bp, Artificial Sequence
  Synthetic Construct
gccaggcagcctcatggt

SEQ ID NO: 8989 - DNA, 19 bp, Artificial Sequence
  Synthetic Construct
tgcctccaagccacagaac

SEQ ID NO: 8990 - DNA, 19 bp, Artificial Sequence
  Synthetic Construct
ggtaccaggggcagaaggt

SEQ ID NO: 8991 - DNA, 22 bp, Artificial Sequence
  Synthetic Construct
aaagcccaagctcctcaacaag

SEQ ID NO: 8992 - DNA, 26 bp, Artificial Sequence
  Synthetic Construct
tgaaaacctaaacccttcatcaacct

SEQ ID NO: 8993 - DNA, 21 bp, Artificial Sequence
  Synthetic Construct
aagcccagagtagtgcatgca

SEQ ID NO: 8994 - DNA, 29 bp, Artificial Sequence
  Synthetic Construct
gttgacaaagtctagataacaaggagtca

SEQ ID NO: 8995 - DNA, 23 bp, Artificial Sequence
  Synthetic Construct
tcagtggcttctgcagaataaca

SEQ ID NO: 8996 - DNA, 28 bp, Artificial Sequence
  Synthetic Construct
ggagtcagacacaaataaatgggttcag

SEQ ID NO: 8997 - DNA, 21 bp, Artificial Sequence
  Synthetic Construct
ggctgggaaactgctatgcat

SEQ ID NO: 8998 - DNA, 26 bp, Artificial Sequence
  Synthetic Construct
cagatacatggaggtgaaagttgtgt

SEQ ID NO: 8999 - DNA, 24 bp, Artificial Sequence
  Synthetic Construct
cactgtgtatgactccccttaagg

SEQ ID NO: 9000 - DNA, 26 bp, Artificial Sequence
  Synthetic Construct
gctccaaaataactagcagcatgatg

SEQ ID NO: 9001 - DNA, 26 bp, Artificial Sequence
  Synthetic Construct
acaagactacaaagaggcattgaact

SEQ ID NO: 9002 - DNA, 22 bp, Artificial Sequence
  Synthetic Construct
aatgtgaggatggcaggcattg

SEQ ID NO: 9003 - DNA, 25 bp, Artificial Sequence
  Synthetic Construct
ggctgaaactaaaaatggcccagtt

SEQ ID NO: 9004 - DNA, 22 bp, Artificial Sequence
  Synthetic Construct
aggtcagggatgacaacaatcc

SEQ ID NO: 9005 - DNA, 19 bp, Artificial Sequence
  Synthetic Construct
tgcctggcacacatgatgt

SEQ ID NO: 9006 - DNA, 22 bp, Artificial Sequence
  Synthetic Construct
tgttcccatctcttgccatctc

SEQ ID NO: 9007 - DNA, 19 bp, Artificial Sequence
  Synthetic Construct
tgccagggtgggacagaca

SEQ ID NO: 9008 - DNA, 28 bp, Artificial Sequence
  Synthetic Construct
ctggtgaaccacaaacaattaaatgttt

SEQ ID NO: 9009 - DNA, 27 bp, Artificial Sequence
  Synthetic Construct
ggttgcctgagagctatacagaattgt

SEQ ID NO: 9010 - DNA, 19 bp, Artificial Sequence
  Synthetic Construct
aggcacccgcagtgattcc

SEQ ID NO: 9011 - DNA, 21 bp, Artificial Sequence
  Synthetic Construct
actggcagcaaaactcaacct

SEQ ID NO: 9012 - DNA, 23 bp, Artificial Sequence
  Synthetic Construct
tcctctaccctggaggcagtaaa

SEQ ID NO: 9013 - DNA, 18 bp, Artificial Sequence
  Synthetic Construct
gctgcaaggcccaactgt

SEQ ID NO: 9014 - DNA, 27 bp, Artificial Sequence
  Synthetic Construct
gaggactgacaggagatgttagtaaga

SEQ ID NO: 9015 - DNA, 25 bp, Artificial Sequence
  Synthetic Construct
agtacgtattcaacaggctaccatt

SEQ ID NO: 9016 - DNA, 22 bp, Artificial Sequence
  Synthetic Construct
actggaggcattttcacacctt

SEQ ID NO: 9017 - DNA, 20 bp, Artificial Sequence
  Synthetic Construct
tgtgctagcgtacccaatgg

SEQ ID NO: 9018 - DNA, 24 bp, Artificial Sequence
  Synthetic Construct
ggagaggaccacacaaagaaatgt

SEQ ID NO: 9019 - DNA, 21 bp, Artificial Sequence
  Synthetic Construct
cctaaagtgggtgggctactg

SEQ ID NO: 9020 - DNA, 27 bp, Artificial Sequence
  Synthetic Construct
tgtctcagataatgtcacggttaagtt

SEQ ID NO: 9021 - DNA, 23 bp, Artificial Sequence
  Synthetic Construct
agacccctggtttcatagagctt

SEQ ID NO: 9022 - DNA, 19 bp, Artificial Sequence
  Synthetic Construct
agcacacaggcaggaaggt

SEQ ID NO: 9023 - DNA, 21 bp, Artificial Sequence
  Synthetic Construct
aaccaccctgggagtaggaat

SEQ ID NO: 9024 - DNA, 20 bp, Artificial Sequence
  Synthetic Construct
catgagtccgaggccaccta

SEQ ID NO: 9025 - DNA, 18 bp, Artificial Sequence
  Synthetic Construct
aggggttgggtgccagtt

SEQ ID NO: 9026 - DNA, 18 bp, Artificial Sequence
  Synthetic Construct
tgatggccccagctgtct

SEQ ID NO: 9027 - DNA, 18 bp, Artificial Sequence
  Synthetic Construct
gccccaggtgtgctcagt

SEQ ID NO: 9028 - DNA, 18 bp, Artificial Sequence
  Synthetic Construct
gtggaggcctcgggagat

SEQ ID NO: 9029 - DNA, 24 bp, Artificial Sequence
  Synthetic Construct
actcgagatggaaccacttatcca

SEQ ID NO: 9030 - DNA, 20 bp, Artificial Sequence
  Synthetic Construct
ttggtgtgactgccgctttt

SEQ ID NO: 9031 - DNA, 30 bp, Artificial Sequence
  Synthetic Construct
cagactttaagaatggaaagctacattcaa

SEQ ID NO: 9032 - DNA, 21 bp, Artificial Sequence
  Synthetic Construct
aaccggggtgtccttggaatt

SEQ ID NO: 9033 - DNA, 24 bp, Artificial Sequence
  Synthetic Construct
ccacacttgccccaacttgataag

SEQ ID NO: 9034 - DNA, 25 bp, Artificial Sequence
  Synthetic Construct
gcagttgtagataccgagtgggttt

SEQ ID NO: 9035 - DNA, 23 bp, Artificial Sequence
  Synthetic Construct
ccaagatgtttccccatccatca

SEQ ID NO: 9036 - DNA, 21 bp, Artificial Sequence
  Synthetic Construct
tcacctgctcccttcctttct

SEQ ID NO: 9037 - DNA, 19 bp, Artificial Sequence
  Synthetic Construct
ggctgcaggctatgaacca

SEQ ID NO: 9038 - DNA, 26 bp, Artificial Sequence
  Synthetic Construct
agtcctgaaagacaaactaccaacat

SEQ ID NO: 9039 - DNA, 29 bp, Artificial Sequence
  Synthetic Construct
caagtgttcagtgtgaatttaaggaaatc

SEQ ID NO: 9040 - DNA, 25 bp, Artificial Sequence
  Synthetic Construct
gcacattcaagatcagagcaaagat

SEQ ID NO: 9041 - DNA, 24 bp, Artificial Sequence
  Synthetic Construct
ttgtcctcagaccactctcttttg

SEQ ID NO: 9042 - DNA, 22 bp, Artificial Sequence
  Synthetic Construct
gcccagcccatatctcattgaa

SEQ ID NO: 9043 - DNA, 24 bp, Artificial Sequence
  Synthetic Construct
tgtcacccaccattctaggttagg

SEQ ID NO: 9044 - DNA, 20 bp, Artificial Sequence
  Synthetic Construct
aaggatcccagcacctacca

SEQ ID NO: 9045 - DNA, 27 bp, Artificial Sequence
  Synthetic Construct
cctgatacttccttctagcaacacctt

SEQ ID NO: 9046 - DNA, 27 bp, Artificial Sequence
  Synthetic Construct
gctttttgattcaaactgttcccaagt

SEQ ID NO: 9047 - DNA, 19 bp, Artificial Sequence
  Synthetic Construct
atgcagctcagggcactgt

SEQ ID NO: 9048 - DNA, 22 bp, Artificial Sequence
  Synthetic Construct
ttgctgcccagacttcttagtc

SEQ ID NO: 9049 - DNA, 22 bp, Artificial Sequence
  Synthetic Construct
tgctctgccagagaaagcacaa

SEQ ID NO: 9050 - DNA, 21 bp, Artificial Sequence
  Synthetic Construct
atgtgcctcaacgccctatgg

SEQ ID NO: 9051 - DNA, 19 bp, Artificial Sequence
  Synthetic Construct
aggccctctgtccctagct

SEQ ID NO: 9052 - DNA, 21 bp, Artificial Sequence
  Synthetic Construct
caatctgtcagccaccatgct

SEQ ID NO: 9053 - DNA, 27 bp, Artificial Sequence
  Synthetic Construct
cccctttagcctcatcttatgctactg

SEQ ID NO: 9054 - DNA, 24 bp, Artificial Sequence
  Synthetic Construct
aggtgaggtctgttgggatttcag

SEQ ID NO: 9055 - DNA, 19 bp, Artificial Sequence
  Synthetic Construct
agggagcggaggccacact

SEQ ID NO: 9056 - DNA, 22 bp, Artificial Sequence
  Synthetic Construct
ccacactccccttccattatgg

SEQ ID NO: 9057 - DNA, 23 bp, Artificial Sequence
  Synthetic Construct
tgataaggcagctgagacacaaa

SEQ ID NO: 9058 - DNA, 25 bp, Artificial Sequence
  Synthetic Construct
ccatcccctcaaatcccatttctct

SEQ ID NO: 9059 - DNA, 21 bp, Artificial Sequence
  Synthetic Construct
agctccatgaggccagaaggt

SEQ ID NO: 9060 - DNA, 19 bp, Artificial Sequence
  Synthetic Construct
tgagggccagttgctgttc

SEQ ID NO: 9061 - DNA, 23 bp, Artificial Sequence
  Synthetic Construct
agctgtcctccaatccagactct

SEQ ID NO: 9062 - DNA, 20 bp, Artificial Sequence
  Synthetic Construct
tgcagcagctgaaacaacac

SEQ ID NO: 9063 - DNA, 26 bp, Artificial Sequence
  Synthetic Construct
tgagtgtactgaagcagaagttaact

SEQ ID NO: 9064 - DNA, 26 bp, Artificial Sequence
  Synthetic Construct
ctcaaatggttcagtggttcctttct

SEQ ID NO: 9065 - DNA, 19 bp, Artificial Sequence
  Synthetic Construct
acagccctgcaccaggtaa

SEQ ID NO: 9066 - DNA, 24 bp, Artificial Sequence
  Synthetic Construct
gtgtgtagtaggggtctgtagagt

SEQ ID NO: 9067 - DNA, 20 bp, Artificial Sequence
  Synthetic Construct
agagcagcgaagaggagaga

SEQ ID NO: 9068 - DNA, 23 bp, Artificial Sequence
  Synthetic Construct
cctgactccaaaaccttcactct

SEQ ID NO: 9069 - DNA, 22 bp, Artificial Sequence
  Synthetic Construct
aggctggagtaatgcccaacta

SEQ ID NO: 9070 - DNA, 30 bp, Artificial Sequence
  Synthetic Construct
cagaatacctggctatatttgtaccttgac

SEQ ID NO: 9071 - DNA, 20 bp, Artificial Sequence
  Synthetic Construct
ggcatccaccaggctaggat

SEQ ID NO: 9072 - DNA, 21 bp, Artificial Sequence
  Synthetic Construct
gttgagtttccagcccatcct

SEQ ID NO: 9073 - DNA, 23 bp, Artificial Sequence
  Synthetic Construct
ggggatagaggtttcggctttag

SEQ ID NO: 9074 - DNA, 24 bp, Artificial Sequence
  Synthetic Construct
ggcaccagcaaagagacatctaac

SEQ ID NO: 9075 - DNA, 22 bp, Artificial Sequence
  Synthetic Construct
ccatgaaggaggcttgtgttct

SEQ ID NO: 9076 - DNA, 25 bp, Artificial Sequence
  Synthetic Construct
agttctaaaaactggatgcctgttg

SEQ ID NO: 9077 - DNA, 22 bp, Artificial Sequence
  Synthetic Construct
tgtggtagccctgattcacaga

SEQ ID NO: 9078 - DNA, 30 bp, Artificial Sequence
  Synthetic Construct
cagctattctctctagaccttcctattaca

SEQ ID NO: 9079 - DNA, 24 bp, Artificial Sequence
  Synthetic Construct
caaaattctttggcactccttcca

SEQ ID NO: 9080 - DNA, 27 bp, Artificial Sequence
  Synthetic Construct
ggctgtaatgatagcctttgtgtttac

SEQ ID NO: 9081 - DNA, 28 bp, Artificial Sequence
  Synthetic Construct
gccctagcaatagtctgactatatttcc

SEQ ID NO: 9082 - DNA, 30 bp, Artificial Sequence
  Synthetic Construct
gcctttttcttcttaggaggagatttctca

SEQ ID NO: 9083 - DNA, 22 bp, Artificial Sequence
  Synthetic Construct
ccttccaacctggcagaaatgt

SEQ ID NO: 9084 - DNA, 25 bp, Artificial Sequence
  Synthetic Construct
cccacatcaacctagcaaggattct

SEQ ID NO: 9085 - DNA, 25 bp, Artificial Sequence
  Synthetic Construct
ctcactcacaccactatagcttcac

SEQ ID NO: 9086 - DNA, 22 bp, Artificial Sequence
  Synthetic Construct
aaggtgtcgtgggagaaatgag

SEQ ID NO: 9087 - DNA, 20 bp, Artificial Sequence
  Synthetic Construct
ggtcctggccagtttgactt

SEQ ID NO: 9088 - DNA, 25 bp, Artificial Sequence
  Synthetic Construct
gggtaaacagaacaaggtgattggt

SEQ ID NO: 9089 - DNA, 23 bp, Artificial Sequence
  Synthetic Construct
gtcctccatgaagaccacattgt

SEQ ID NO: 9090 - DNA, 19 bp, Artificial Sequence
  Synthetic Construct
agtgcgtgggtcctgatct

SEQ ID NO: 9091 - DNA, 20 bp, Artificial Sequence
  Synthetic Construct
aagcccaggatccctttgga

SEQ ID NO: 9092 - DNA, 28 bp, Artificial Sequence
  Synthetic Construct
ggtgttttgttattcagcaatccagact

SEQ ID NO: 9093 - DNA, 22 bp, Artificial Sequence
  Synthetic Construct
ttgtgccaacctttccattgtc

SEQ ID NO: 9094 - DNA, 21 bp, Artificial Sequence
  Synthetic Construct
tgggctgagttatgcctctca

SEQ ID NO: 9095 - DNA, 22 bp, Artificial Sequence
  Synthetic Construct
gcctacagcttgtctgcaaagt

SEQ ID NO: 9096 - DNA, 30 bp, Artificial Sequence
  Synthetic Construct
gagcagcatatttagcttttagagttagtg

SEQ ID NO: 9097 - DNA, 29 bp, Artificial Sequence
  Synthetic Construct
tccaggaaaaaaagagaggatacattttg

SEQ ID NO: 9098 - DNA, 26 bp, Artificial Sequence
  Synthetic Construct
gaaatgtagatgctgcttctgaagtt

SEQ ID NO: 9099 - DNA, 18 bp, Artificial Sequence
  Synthetic Construct
cagccctgggaccaacac

SEQ ID NO: 9100 - DNA, 22 bp, Artificial Sequence
  Synthetic Construct
ggcctcagagagtctttttcca

SEQ ID NO: 9101 - DNA, 26 bp, Artificial Sequence
  Synthetic Construct
gcagaaccccatttaagacaagttga

SEQ ID NO: 9102 - DNA, 20 bp, Artificial Sequence
  Synthetic Construct
ttggcagcaaccacaaagca

SEQ ID NO: 9103 - DNA, 27 bp, Artificial Sequence
  Synthetic Construct
ggaggttctactatctctagcctgtag

SEQ ID NO: 9104 - DNA, 27 bp, Artificial Sequence
  Synthetic Construct
ccacaaggaggaggttcagtattctct

SEQ ID NO: 9105 - DNA, 22 bp, Artificial Sequence
  Synthetic Construct
aagttggttcccacagtcttgt

SEQ ID NO: 9106 - DNA, 21 bp, Artificial Sequence
  Synthetic Construct
tggaacacagcccctttacac

SEQ ID NO: 9107 - DNA, 26 bp, Artificial Sequence
  Synthetic Construct
cctatgctttgtttcaggcttagtac

SEQ ID NO: 9108 - DNA, 30 bp, Artificial Sequence
  Synthetic Construct
gtatgcatatattgaaggagtgtggattag

SEQ ID NO: 9109 - DNA, 29 bp, Artificial Sequence
  Synthetic Construct
ggctttgctaagatattccaaatggaaca

SEQ ID NO: 9110 - DNA, 25 bp, Artificial Sequence
  Synthetic Construct
attaaaatctgaggccgatgtgttg

SEQ ID NO: 9111 - DNA, 22 bp, Artificial Sequence
  Synthetic Construct
aagagaaaccaggccacacctt

SEQ ID NO: 9112 - DNA, 26 bp, Artificial Sequence
  Synthetic Construct
ggaaaacttaaatgcaacgggagtaa

SEQ ID NO: 9113 - DNA, 27 bp, Artificial Sequence
  Synthetic Construct
acttctatatggaaagaggcagattgc

SEQ ID NO: 9114 - DNA, 22 bp, Artificial Sequence
  Synthetic Construct
aggccaactgctcctctaccta

SEQ ID NO: 9115 - DNA, 30 bp, Artificial Sequence
  Synthetic Construct
tgataacactctctcagaagtattacaaca

SEQ ID NO: 9116 - DNA, 21 bp, Artificial Sequence
  Synthetic Construct
tccagccgatgtccacctaca

SEQ ID NO: 9117 - DNA, 26 bp, Artificial Sequence
  Synthetic Construct
ccaaacgttaaggtaggaaggtgatc

SEQ ID NO: 9118 - DNA, 21 bp, Artificial Sequence
  Synthetic Construct
gggagagtccttgaggtgact

SEQ ID NO: 9119 - DNA, 21 bp, Artificial Sequence
  Synthetic Construct
agcaaggctgtgatcccagat

SEQ ID NO: 9120 - DNA, 22 bp, Artificial Sequence
  Synthetic Construct
agctcaagtccttgggttcaaa

SEQ ID NO: 9121 - DNA, 22 bp, Artificial Sequence
  Synthetic Construct
tggggaaaatgaggctccagtt

SEQ ID NO: 9122 - DNA, 24 bp, Artificial Sequence
  Synthetic Construct
acccccaccatcttgcatatacac

SEQ ID NO: 9123 - DNA, 25 bp, Artificial Sequence
  Synthetic Construct
ggaggtgcacagctacatttactct

SEQ ID NO: 9124 - DNA, 19 bp, Artificial Sequence
  Synthetic Construct
actgggcatgggtgaagca

SEQ ID NO: 9125 - DNA, 24 bp, Artificial Sequence
  Synthetic Construct
gcagagaatagctgaaccttgaga

SEQ ID NO: 9126 - DNA, 20 bp, Artificial Sequence
  Synthetic Construct
agaggctccagcacatacca

SEQ ID NO: 9127 - DNA, 21 bp, Artificial Sequence
  Synthetic Construct
agaagaaggtgagcccaatgg

SEQ ID NO: 9128 - DNA, 26 bp, Artificial Sequence
  Synthetic Construct
ggatgagaagggagtggttactatgc

SEQ ID NO: 9129 - DNA, 22 bp, Artificial Sequence
  Synthetic Construct
agggagcggagtctccaaaact

SEQ ID NO: 9130 - DNA, 29 bp, Artificial Sequence
  Synthetic Construct
gaatagaatgggttagggttagctaagta

SEQ ID NO: 9131 - DNA, 28 bp, Artificial Sequence
  Synthetic Construct
gctacagagattagtctgtgaatatcct

SEQ ID NO: 9132 - DNA, 21 bp, Artificial Sequence
  Synthetic Construct
aaggaggagggtgaggacaga

SEQ ID NO: 9133 - DNA, 23 bp, Artificial Sequence
  Synthetic Construct
tgacctgtccctcctgattctct

SEQ ID NO: 9134 - DNA, 20 bp, Artificial Sequence
  Synthetic Construct
actggggcttccatgaacac

SEQ ID NO: 9135 - DNA, 26 bp, Artificial Sequence
  Synthetic Construct
ggtttctgttctgtgggggttaagag

SEQ ID NO: 9136 - DNA, 24 bp, Artificial Sequence
  Synthetic Construct
tctttcacttgaggagaggagaga

SEQ ID NO: 9137 - DNA, 30 bp, Artificial Sequence
  Synthetic Construct
tgaaatgttttgtactcagcagctataatc

SEQ ID NO: 9138 - DNA, 30 bp, Artificial Sequence
  Synthetic Construct
gacacagtgctattattctgatgaacacta

SEQ ID NO: 9139 - DNA, 30 bp, Artificial Sequence
  Synthetic Construct
cactccagagtaagttatattgcatttgac

SEQ ID NO: 9140 - DNA, 29 bp, Artificial Sequence
  Synthetic Construct
tgtacttgagactcaatacattcctttca

SEQ ID NO: 9141 - DNA, 19 bp, Artificial Sequence
  Synthetic Construct
gccgtctcccaggttccat

SEQ ID NO: 9142 - DNA, 26 bp, Artificial Sequence
  Synthetic Construct
ctgggtagaaaaaaacaggtgatgag

SEQ ID NO: 9143 - DNA, 22 bp, Artificial Sequence
  Synthetic Construct
aaggcttccacagtcgatttgc

SEQ ID NO: 9144 - DNA, 24 bp, Artificial Sequence
  Synthetic Construct
tgcactacgtcttcagagagtttg

SEQ ID NO: 9145 - DNA, 24 bp, Artificial Sequence
  Synthetic Construct
cccttagggatgcagcagaagtaa

SEQ ID NO: 9146 - DNA, 19 bp, Artificial Sequence
  Synthetic Construct
tgtgcggccttgaacaagt

SEQ ID NO: 9147 - DNA, 23 bp, Artificial Sequence
  Synthetic Construct
agttgacttctgtgggttgatgt

SEQ ID NO: 9148 - DNA, 21 bp, Artificial Sequence
  Synthetic Construct
tgcctcagaccctcagaccaa

SEQ ID NO: 9149 - DNA, 23 bp, Artificial Sequence
  Synthetic Construct
caggtgccactaatcaacagtga

SEQ ID NO: 9150 - DNA, 19 bp, Artificial Sequence
  Synthetic Construct
cgaggcagcaaggagttca

SEQ ID NO: 9151 - DNA, 30 bp, Artificial Sequence
  Synthetic Construct
gcattggtattgtattacatcacccctctt

SEQ ID NO: 9152 - DNA, 27 bp, Artificial Sequence
  Synthetic Construct
ctcattgtagtctttgtgacgctattg

SEQ ID NO: 9153 - DNA, 27 bp, Artificial Sequence
  Synthetic Construct
cagtatctttctatctacagccacctt

SEQ ID NO: 9154 - DNA, 22 bp, Artificial Sequence
  Synthetic Construct
acctctctgctgattggacact

SEQ ID NO: 9155 - DNA, 29 bp, Artificial Sequence
  Synthetic Construct
ggcttgtgattgtcccttaatactatttg

SEQ ID NO: 9156 - DNA, 28 bp, Artificial Sequence
  Synthetic Construct
cctacatttcctcacatactgaccatac

SEQ ID NO: 9157 - DNA, 25 bp, Artificial Sequence
  Synthetic Construct
gccctgatttccttacagtgagctt

SEQ ID NO: 9158 - DNA, 22 bp, Artificial Sequence
  Synthetic Construct
ggctgcttcatcattccagttg

SEQ ID NO: 9159 - DNA, 26 bp, Artificial Sequence
  Synthetic Construct
cgagccaaaggaaacgattctaacag

SEQ ID NO: 9160 - DNA, 27 bp, Artificial Sequence
  Synthetic Construct
ggaagaagggagttaaaggataaaggt

SEQ ID NO: 9161 - DNA, 21 bp, Artificial Sequence
  Synthetic Construct
ttgctcatccctctgcaactc

SEQ ID NO: 9162 - DNA, 23 bp, Artificial Sequence
  Synthetic Construct
gccaaggaggttgagctaatttg

SEQ ID NO: 9163 - DNA, 22 bp, Artificial Sequence
  Synthetic Construct
acacttcttctccacccttggt

SEQ ID NO: 9164 - DNA, 22 bp, Artificial Sequence
  Synthetic Construct
tggtgttcccagagacccatct

SEQ ID NO: 9165 - DNA, 21 bp, Artificial Sequence
  Synthetic Construct
atggatggcagacaggctaca

SEQ ID NO: 9166 - DNA, 22 bp, Artificial Sequence
  Synthetic Construct
tccttggcatgggctctagaga

SEQ ID NO: 9167 - DNA, 24 bp, Artificial Sequence
  Synthetic Construct
ccactgaatctccagcatctagag

SEQ ID NO: 9168 - DNA, 22 bp, Artificial Sequence
  Synthetic Construct
acccaagacaagttgcggagta

SEQ ID NO: 9169 - DNA, 28 bp, Artificial Sequence
  Synthetic Construct
aatatatctatctccagagcccgttttt

SEQ ID NO: 9170 - DNA, 23 bp, Artificial Sequence
  Synthetic Construct
gtggagaggaaaaagtgctctca

SEQ ID NO: 9171 - DNA, 22 bp, Artificial Sequence
  Synthetic Construct
tgtgatcgggctgtctacatgt

SEQ ID NO: 9172 - DNA, 22 bp, Artificial Sequence
  Synthetic Construct
aggagaagactctgcagctgaa

SEQ ID NO: 9173 - DNA, 25 bp, Artificial Sequence
  Synthetic Construct
gatattcactgagatgggacacaca

SEQ ID NO: 9174 - DNA, 18 bp, Artificial Sequence
  Synthetic Construct
agggacccccgacctact

SEQ ID NO: 9175 - DNA, 22 bp, Artificial Sequence
  Synthetic Construct
tggtcccactctcacaattggt

SEQ ID NO: 9176 - DNA, 24 bp, Artificial Sequence
  Synthetic Construct
ccacgcctgaaataattccaacat

SEQ ID NO: 9177 - DNA, 21 bp, Artificial Sequence
  Synthetic Construct
gccccagctgatgatttgact

SEQ ID NO: 9178 - DNA, 29 bp, Artificial Sequence
  Synthetic Construct
cagacaatcttctgaaattctgcttctat

SEQ ID NO: 9179 - DNA, 22 bp, Artificial Sequence
  Synthetic Construct
gtgattgcgatggggagacaat

SEQ ID NO: 9180 - DNA, 25 bp, Artificial Sequence
  Synthetic Construct
tgtttagggaatgtgactggactag

SEQ ID NO: 9181 - DNA, 22 bp, Artificial Sequence
  Synthetic Construct
tgtggctgaggttgagaaatgg

SEQ ID NO: 9182 - DNA, 25 bp, Artificial Sequence
  Synthetic Construct
gggactgatgaagtagccttctgaa

SEQ ID NO: 9183 - DNA, 28 bp, Artificial Sequence
  Synthetic Construct
cgtgattttagcctccctaagtctacag

SEQ ID NO: 9184 - DNA, 22 bp, Artificial Sequence
  Synthetic Construct
tcactgtcactccaaggtctct

SEQ ID NO: 9185 - DNA, 22 bp, Artificial Sequence
  Synthetic Construct
aaagaatcccaggtcccgttct

SEQ ID NO: 9186 - DNA, 20 bp, Artificial Sequence
  Synthetic Construct
atccggggctgactcttagc

SEQ ID NO: 9187 - DNA, 24 bp, Artificial Sequence
  Synthetic Construct
gccaatgctctttcttacctctgt

SEQ ID NO: 9188 - DNA, 23 bp, Artificial Sequence
  Synthetic Construct
tctcttgcctttgggacatcttg

SEQ ID NO: 9189 - DNA, 26 bp, Artificial Sequence
  Synthetic Construct
gctttgtgagttcttccttgttgatg

SEQ ID NO: 9190 - DNA, 19 bp, Artificial Sequence
  Synthetic Construct
tggcagattgcacgtggat

SEQ ID NO: 9191 - DNA, 29 bp, Artificial Sequence
  Synthetic Construct
gccaagaactatctttccaattgtctttc

SEQ ID NO: 9192 - DNA, 22 bp, Artificial Sequence
  Synthetic Construct
gaaacaacggcgacagagttag

SEQ ID NO: 9193 - DNA, 24 bp, Artificial Sequence
  Synthetic Construct
gggtctcatggcaagtaactgaag

SEQ ID NO: 9194 - DNA, 22 bp, Artificial Sequence
  Synthetic Construct
gtgtaggtatgtggggcgattt

SEQ ID NO: 9195 - DNA, 26 bp, Artificial Sequence
  Synthetic Construct
cagtgactgctcagtgaatagttagc

SEQ ID NO: 9196 - DNA, 21 bp, Artificial Sequence
  Synthetic Construct
gccaggcttggtctcagatag

SEQ ID NO: 9197 - DNA, 24 bp, Artificial Sequence
  Synthetic Construct
ctctgtgccactatacctgtccta

SEQ ID NO: 9198 - DNA, 27 bp, Artificial Sequence
  Synthetic Construct
ggagtacagctttcccagaagtaaaat

SEQ ID NO: 9199 - DNA, 27 bp, Artificial Sequence
  Synthetic Construct
ggcaaaatagctaggcaaacaggttag

SEQ ID NO: 9200 - DNA, 25 bp, Artificial Sequence
  Synthetic Construct
ggagaagagatgaggggattactga

SEQ ID NO: 9201 - DNA, 27 bp, Artificial Sequence
  Synthetic Construct
aaataagctttggttttgtagggacaa

SEQ ID NO: 9202 - DNA, 25 bp, Artificial Sequence
  Synthetic Construct
ggaagcctcacaaaccacatgaaac

SEQ ID NO: 9203 - DNA, 20 bp, Artificial Sequence
  Synthetic Construct
gttcgacactgaggccagaa

SEQ ID NO: 9204 - DNA, 25 bp, Artificial Sequence
  Synthetic Construct
gagggtagaaaggctgctattatcc

SEQ ID NO: 9205 - DNA, 22 bp, Artificial Sequence
  Synthetic Construct
tggggttgctaaatggcacgtt

SEQ ID NO: 9206 - DNA, 22 bp, Artificial Sequence
  Synthetic Construct
tcaactgatgttgggccaaggt

SEQ ID NO: 9207 - DNA, 21 bp, Artificial Sequence
  Synthetic Construct
agggaagctgggtctggaaca

SEQ ID NO: 9208 - DNA, 22 bp, Artificial Sequence
  Synthetic Construct
tgcttgatttgtccgtgagctt

SEQ ID NO: 9209 - DNA, 30 bp, Artificial Sequence
  Synthetic Construct
ggaaagattcaaacacacatttgactgatg

SEQ ID NO: 9210 - DNA, 28 bp, Artificial Sequence
  Synthetic Construct
ggggtttggaccagatattctctaatgc

SEQ ID NO: 9211 - DNA, 26 bp, Artificial Sequence
  Synthetic Construct
gatatcactgccatgaaacagagaag

SEQ ID NO: 9212 - DNA, 25 bp, Artificial Sequence
  Synthetic Construct
ccatctatacaaggctcctctaagc

SEQ ID NO: 9213 - DNA, 21 bp, Artificial Sequence
  Synthetic Construct
tgcaatccgtgacctaatgct

SEQ ID NO: 9214 - DNA, 26 bp, Artificial Sequence
  Synthetic Construct
gggaatatggagaacagcaagatcca

SEQ ID NO: 9215 - DNA, 23 bp, Artificial Sequence
  Synthetic Construct
actttgccccttcctttaaacca

SEQ ID NO: 9216 - DNA, 21 bp, Artificial Sequence
  Synthetic Construct
atccagccactccgggtatgt

SEQ ID NO: 9217 - DNA, 22 bp, Artificial Sequence
  Synthetic Construct
gcccttgcaccagagacaaatt

SEQ ID NO: 9218 - DNA, 26 bp, Artificial Sequence
  Synthetic Construct
gggaactgtctcacaatcaaattgag

SEQ ID NO: 9219 - DNA, 20 bp, Artificial Sequence
  Synthetic Construct
atctggctctgggcatctct

SEQ ID NO: 9220 - DNA, 21 bp, Artificial Sequence
  Synthetic Construct
aggagttcgaggctgtagtgt

SEQ ID NO: 9221 - DNA, 27 bp, Artificial Sequence
  Synthetic Construct
caccaaaacagcagtcccataatattc

SEQ ID NO: 9222 - DNA, 18 bp, Artificial Sequence
  Synthetic Construct
cggcctggctccaatgtc

SEQ ID NO: 9223 - DNA, 27 bp, Artificial Sequence
  Synthetic Construct
cagccaaaccatagcaatatctctact

SEQ ID NO: 9224 - DNA, 27 bp, Artificial Sequence
  Synthetic Construct
cctaaccaaaaaagagaggccatgtac

SEQ ID NO: 9225 - DNA, 27 bp, Artificial Sequence
  Synthetic Construct
ccagataaagaggacaaaggcattagc

SEQ ID NO: 9226 - DNA, 22 bp, Artificial Sequence
  Synthetic Construct
agccggtaagtccttgcaaact

SEQ ID NO: 9227 - DNA, 21 bp, Artificial Sequence
  Synthetic Construct
ttccctgcatgccaagttcag

SEQ ID NO: 9228 - DNA, 22 bp, Artificial Sequence
  Synthetic Construct
ttggtactgcctccaaaaccat

SEQ ID NO: 9229 - DNA, 27 bp, Artificial Sequence
  Synthetic Construct
tgctgataagagaaatgacagatgtgt

SEQ ID NO: 9230 - DNA, 18 bp, Artificial Sequence
  Synthetic Construct
ccccggtgttccctctct

SEQ ID NO: 9231 - DNA, 26 bp, Artificial Sequence
  Synthetic Construct
aggaaaacaggctcagaaaagttaac

SEQ ID NO: 9232 - DNA, 22 bp, Artificial Sequence
  Synthetic Construct
ggaatggacttcactgcctctt

SEQ ID NO: 9233 - DNA, 28 bp, Artificial Sequence
  Synthetic Construct
ttgaccctgggatgagattaattcaata

SEQ ID NO: 9234 - DNA, 19 bp, Artificial Sequence
  Synthetic Construct
tggctcacggctggagtgt

SEQ ID NO: 9235 - DNA, 20 bp, Artificial Sequence
  Synthetic Construct
ccgcatctccaaggcctagt

SEQ ID NO: 9236 - DNA, 21 bp, Artificial Sequence
  Synthetic Construct
aaaggttgggcccctttcttc

SEQ ID NO: 9237 - DNA, 24 bp, Artificial Sequence
  Synthetic Construct
tcccatcctgaggagaaaggtact

SEQ ID NO: 9238 - DNA, 24 bp, Artificial Sequence
  Synthetic Construct
ctgacaggtgagatgaggagtttc

SEQ ID NO: 9239 - DNA, 21 bp, Artificial Sequence
  Synthetic Construct
tcaggctcagtggtgtgaaca

SEQ ID NO: 9240 - DNA, 23 bp, Artificial Sequence
  Synthetic Construct
cccaagaatgagactgtcaccaa

SEQ ID NO: 9241 - DNA, 22 bp, Artificial Sequence
  Synthetic Construct
tgtgtacggttcccaagccaaa

SEQ ID NO: 9242 - DNA, 21 bp, Artificial Sequence
  Synthetic Construct
cttgcaaccaccccagagatt

SEQ ID NO: 9243 - DNA, 26 bp, Artificial Sequence
  Synthetic Construct
tgatattcacaaagttgcaagtgctt

SEQ ID NO: 9244 - DNA, 24 bp, Artificial Sequence
  Synthetic Construct
tgaaggagatagacctcccagtct

SEQ ID NO: 9245 - DNA, 24 bp, Artificial Sequence
  Synthetic Construct
acggtggttattgaagtccttgtc

SEQ ID NO: 9246 - DNA, 28 bp, Artificial Sequence
  Synthetic Construct
gctgaaaagttgtacctctttactagga

SEQ ID NO: 9247 - DNA, 29 bp, Artificial Sequence
  Synthetic Construct
ctgtttatctcattgcttagaatgagcat

SEQ ID NO: 9248 - DNA, 21 bp, Artificial Sequence
  Synthetic Construct
aagcgaccacccacctgtttt

SEQ ID NO: 9249 - DNA, 20 bp, Artificial Sequence
  Synthetic Construct
tttccatggacggcctggaa

SEQ ID NO: 9250 - DNA, 19 bp, Artificial Sequence
  Synthetic Construct
agccagcatctgcaactgt

SEQ ID NO: 9251 - DNA, 28 bp, Artificial Sequence
  Synthetic Construct
cctgaactaaactacctccctgtaatgg

SEQ ID NO: 9252 - DNA, 22 bp, Artificial Sequence
  Synthetic Construct
tcccccttgctggcacatctat

SEQ ID NO: 9253 - DNA, 25 bp, Artificial Sequence
  Synthetic Construct
gtgaggtatcacttcccaaaaaggt

SEQ ID NO: 9254 - DNA, 23 bp, Artificial Sequence
  Synthetic Construct
gagagctttcatcccttctgctt

SEQ ID NO: 9255 - DNA, 21 bp, Artificial Sequence
  Synthetic Construct
tggtcacccggatggtctcta

SEQ ID NO: 9256 - DNA, 22 bp, Artificial Sequence
  Synthetic Construct
ttgggaaaaggcctgcttttcc

SEQ ID NO: 9257 - DNA, 25 bp, Artificial Sequence
  Synthetic Construct
actaaaccaagtgtccttccatgag

SEQ ID NO: 9258 - DNA, 28 bp, Artificial Sequence
  Synthetic Construct
gaagttccctaaggagagtaaaatctca

SEQ ID NO: 9259 - DNA, 21 bp, Artificial Sequence
  Synthetic Construct
ttggtctctccgttcctcagt

SEQ ID NO: 9260 - DNA, 20 bp, Artificial Sequence
  Synthetic Construct
tctgagtccaggcctgaaca

SEQ ID NO: 9261 - DNA, 24 bp, Artificial Sequence
  Synthetic Construct
ccaggcacaaaagagaccttagac

SEQ ID NO: 9262 - DNA, 27 bp, Artificial Sequence
  Synthetic Construct
caattgaaagggagttcaagacttctt

SEQ ID NO: 9263 - DNA, 23 bp, Artificial Sequence
  Synthetic Construct
gacttccagattggttgccaaag

SEQ ID NO: 9264 - DNA, 21 bp, Artificial Sequence
  Synthetic Construct
cacctacccctgtgtcttcct

SEQ ID NO: 9265 - DNA, 22 bp, Artificial Sequence
  Synthetic Construct
tccagcctcaatttccctgtgt

SEQ ID NO: 9266 - DNA, 20 bp, Artificial Sequence
  Synthetic Construct
aattggccagccaggaacag

SEQ ID NO: 9267 - DNA, 23 bp, Artificial Sequence
  Synthetic Construct
ctaatgcaactggtccactgact

SEQ ID NO: 9268 - DNA, 24 bp, Artificial Sequence
  Synthetic Construct
ccttcaggatgcttgatgaacaag

SEQ ID NO: 9269 - DNA, 21 bp, Artificial Sequence
  Synthetic Construct
aggtcactccccaagaccttt

SEQ ID NO: 9270 - DNA, 21 bp, Artificial Sequence
  Synthetic Construct
agcgcatgaacagcacagtct

SEQ ID NO: 9271 - DNA, 24 bp, Artificial Sequence
  Synthetic Construct
ccaacaccagaactctctgtttca

SEQ ID NO: 9272 - DNA, 25 bp, Artificial Sequence
  Synthetic Construct
gaagaacctctgattcatgcatgag

SEQ ID NO: 9273 - DNA, 22 bp, Artificial Sequence
  Synthetic Construct
tctcttagcaggtccagcactt

SEQ ID NO: 9274 - DNA, 30 bp, Artificial Sequence
  Synthetic Construct
ctgctgaaagatgaatcactatgaatttgg

SEQ ID NO: 9275 - DNA, 25 bp, Artificial Sequence
  Synthetic Construct
ggcctttaaaggatttctggcacaa

SEQ ID NO: 9276 - DNA, 25 bp, Artificial Sequence
  Synthetic Construct
tcgtagcacaaggagaaaatcatgt

SEQ ID NO: 9277 - DNA, 23 bp, Artificial Sequence
  Synthetic Construct
gggccctacctatgctgctttat

SEQ ID NO: 9278 - DNA, 23 bp, Artificial Sequence
  Synthetic Construct
agaataaggcaggagaggtggtt

SEQ ID NO: 9279 - DNA, 28 bp, Artificial Sequence
  Synthetic Construct
gcataaattatatcacctgctgctcttg

SEQ ID NO: 9280 - DNA, 24 bp, Artificial Sequence
  Synthetic Construct
cccactgctaggctagatggaatt

SEQ ID NO: 9281 - DNA, 20 bp, Artificial Sequence
  Synthetic Construct
ttgccaaggtgacgcaaggt

SEQ ID NO: 9282 - DNA, 26 bp, Artificial Sequence
  Synthetic Construct
aagaccttccccacaaatcattaaga

SEQ ID NO: 9283 - DNA, 27 bp, Artificial Sequence
  Synthetic Construct
aatacaaccctgatgcactttattagc

SEQ ID NO: 9284 - DNA, 26 bp, Artificial Sequence
  Synthetic Construct
gctttaaggaggagacagttcttcct

SEQ ID NO: 9285 - DNA, 29 bp, Artificial Sequence
  Synthetic Construct
gccaacccagttgttaaagtattgaaatg

SEQ ID NO: 9286 - DNA, 24 bp, Artificial Sequence
  Synthetic Construct
agattggacagggacagtctgaag

SEQ ID NO: 9287 - DNA, 25 bp, Artificial Sequence
  Synthetic Construct
cccctcttccagctttgtaaaacag

SEQ ID NO: 9288 - DNA, 24 bp, Artificial Sequence
  Synthetic Construct
ccttcataagcccagtctttcaga

SEQ ID NO: 9289 - DNA, 20 bp, Artificial Sequence
  Synthetic Construct
atggccgtccctgcctctca

SEQ ID NO: 9290 - DNA, 24 bp, Artificial Sequence
  Synthetic Construct
ccttgaacttcacaggcagaagag

SEQ ID NO: 9291 - DNA, 24 bp, Artificial Sequence
  Synthetic Construct
ggcaaagaactgtaggtggtttgt

SEQ ID NO: 9292 - DNA, 23 bp, Artificial Sequence
  Synthetic Construct
tctacacctgtaccccagcctat

SEQ ID NO: 9293 - DNA, 23 bp, Artificial Sequence
  Synthetic Construct
tgcaattagcccattcacactgt

SEQ ID NO: 9294 - DNA, 24 bp, Artificial Sequence
  Synthetic Construct
ccttcaggccttcaatgacctttg

SEQ ID NO: 9295 - DNA, 21 bp, Artificial Sequence
  Synthetic Construct
tgctgtccaccctcacatggt

SEQ ID NO: 9296 - DNA, 24 bp, Artificial Sequence
  Synthetic Construct
ggtctcctttttcttgtgctgctt

SEQ ID NO: 9297 - DNA, 21 bp, Artificial Sequence
  Synthetic Construct
tggaatggggagggaaagtct

SEQ ID NO: 9298 - DNA, 22 bp, Artificial Sequence
  Synthetic Construct
tggttgcaggtagatggcttct

SEQ ID NO: 9299 - DNA, 26 bp, Artificial Sequence
  Synthetic Construct
gcattaatggtcattgtcatcgtcat

SEQ ID NO: 9300 - DNA, 24 bp, Artificial Sequence
  Synthetic Construct
gggggtttgctttggaaagttctc

SEQ ID NO: 9301 - DNA, 21 bp, Artificial Sequence
  Synthetic Construct
tggggcttgtctgagaccttt

SEQ ID NO: 9302 - DNA, 22 bp, Artificial Sequence
  Synthetic Construct
gtccctgcagaggtcaaacata

SEQ ID NO: 9303 - DNA, 24 bp, Artificial Sequence
  Synthetic Construct
cagatacctgctccagtagttgtg

SEQ ID NO: 9304 - DNA, 20 bp, Artificial Sequence
  Synthetic Construct
aagcccctcccctgctagac

SEQ ID NO: 9305 - DNA, 24 bp, Artificial Sequence
  Synthetic Construct
ccctgtgattatgacttgctttgg

SEQ ID NO: 9306 - DNA, 26 bp, Artificial Sequence
  Synthetic Construct
ggctttctaaacaaacagcacagctt

SEQ ID NO: 9307 - DNA, 27 bp, Artificial Sequence
  Synthetic Construct
ccacgtagatatcaatacatggtggtt

SEQ ID NO: 9308 - DNA, 20 bp, Artificial Sequence
  Synthetic Construct
cgccgctctaaagcccacta

SEQ ID NO: 9309 - DNA, 22 bp, Artificial Sequence
  Synthetic Construct
gatgcagtacccgctaatgtga

SEQ ID NO: 9310 - DNA, 30 bp, Artificial Sequence
  Synthetic Construct
ccaggaatcatctacttaaactatcttcct

SEQ ID NO: 9311 - DNA, 27 bp, Artificial Sequence
  Synthetic Construct
gcaacatcattctgctgataacttttg

SEQ ID NO: 9312 - DNA, 26 bp, Artificial Sequence
  Synthetic Construct
gctctctttaccactgcacttactac

SEQ ID NO: 9313 - DNA, 23 bp, Artificial Sequence
  Synthetic Construct
tggtatcctccccagacaaaggt

SEQ ID NO: 9314 - DNA, 22 bp, Artificial Sequence
  Synthetic Construct
cctcctctgaatccacgtctgt

SEQ ID NO: 9315 - DNA, 22 bp, Artificial Sequence
  Synthetic Construct
cccttcacctgtttcctgacaa

SEQ ID NO: 9316 - DNA, 25 bp, Artificial Sequence
  Synthetic Construct
acagagaaagaccacctttgttagc

SEQ ID NO: 9317 - DNA, 23 bp, Artificial Sequence
  Synthetic Construct
cccaatactgtctcactggcaat

SEQ ID NO: 9318 - DNA, 20 bp, Artificial Sequence
  Synthetic Construct
tgtgtgtctgccagcaccat

SEQ ID NO: 9319 - DNA, 29 bp, Artificial Sequence
  Synthetic Construct
gtgtatttgagatttacttgttgctgaag

SEQ ID NO: 9320 - DNA, 30 bp, Artificial Sequence
  Synthetic Construct
gtgcatactatatccttcattacctctgaa

SEQ ID NO: 9321 - DNA, 29 bp, Artificial Sequence
  Synthetic Construct
gtgtcttatcaggtgaagtgaatttcttg

SEQ ID NO: 9322 - DNA, 20 bp, Artificial Sequence
  Synthetic Construct
tgggaccccagcatttgcat

SEQ ID NO: 9323 - DNA, 30 bp, Artificial Sequence
  Synthetic Construct
ccaaacacatatgttaagtttagcatttgg

SEQ ID NO: 9324 - DNA, 29 bp, Artificial Sequence
  Synthetic Construct
ggttcacaaaacaatcatggaatggtatc

SEQ ID NO: 9325 - DNA, 28 bp, Artificial Sequence
  Synthetic Construct
gctgtacaactgaataggaaacaacagt

SEQ ID NO: 9326 - DNA, 19 bp, Artificial Sequence
  Synthetic Construct
aggctggctgaggattggt

SEQ ID NO: 9327 - DNA, 20 bp, Artificial Sequence
  Synthetic Construct
gagggccctctttgccatct

SEQ ID NO: 9328 - DNA, 23 bp, Artificial Sequence
  Synthetic Construct
tgtgtttccctttggcttttcag

SEQ ID NO: 9329 - DNA, 28 bp, Artificial Sequence
  Synthetic Construct
ccatgtatcacctataaactgcagtttg

SEQ ID NO: 9330 - DNA, 23 bp, Artificial Sequence
  Synthetic Construct
ggcaagtggcagcaatatttacc

SEQ ID NO: 9331 - DNA, 19 bp, Artificial Sequence
  Synthetic Construct
cggtccccagctgtgttct

SEQ ID NO: 9332 - DNA, 30 bp, Artificial Sequence
  Synthetic Construct
gacaattcacagattagtagttgacttcca

SEQ ID NO: 9333 - DNA, 26 bp, Artificial Sequence
  Synthetic Construct
ccgtttttctctgtcagtcctatctc

SEQ ID NO: 9334 - DNA, 21 bp, Artificial Sequence
  Synthetic Construct
tgggcagggaaagggtacaca

SEQ ID NO: 9335 - DNA, 24 bp, Artificial Sequence
  Synthetic Construct
gggggccatttcaagtttttttgc

SEQ ID NO: 9336 - DNA, 18 bp, Artificial Sequence
  Synthetic Construct
cagggaaggcggcctaga

SEQ ID NO: 9337 - DNA, 21 bp, Artificial Sequence
  Synthetic Construct
cgcatgcactcccagaggtat

SEQ ID NO: 9338 - DNA, 28 bp, Artificial Sequence
  Synthetic Construct
gcacctcataaaaagatgctctgagcta

SEQ ID NO: 9339 - DNA, 21 bp, Artificial Sequence
  Synthetic Construct
agaaggggacaggacagtgat

SEQ ID NO: 9340 - DNA, 22 bp, Artificial Sequence
  Synthetic Construct
gagactgaagggtgtggaggta

SEQ ID NO: 9341 - DNA, 20 bp, Artificial Sequence
  Synthetic Construct
cctccacagagccctaggaa

SEQ ID NO: 9342 - DNA, 28 bp, Artificial Sequence
  Synthetic Construct
cagctacatccttgtagattagcatgag

SEQ ID NO: 9343 - DNA, 23 bp, Artificial Sequence
  Synthetic Construct
ccagcttgagagaggactggatt

SEQ ID NO: 9344 - DNA, 24 bp, Artificial Sequence
  Synthetic Construct
gtttttgggagttcagtcaaagct

SEQ ID NO: 9345 - DNA, 26 bp, Artificial Sequence
  Synthetic Construct
ggaaactgataacccctagccttctg

SEQ ID NO: 9346 - DNA, 18 bp, Artificial Sequence
  Synthetic Construct
gctggcggagacctctct

SEQ ID NO: 9347 - DNA, 26 bp, Artificial Sequence
  Synthetic Construct
ccctagagaaagtagtgcctcccaaa

SEQ ID NO: 9348 - DNA, 24 bp, Artificial Sequence
  Synthetic Construct
ggagaaactgacttgccccaaatc

SEQ ID NO: 9349 - DNA, 23 bp, Artificial Sequence
  Synthetic Construct
gctcagaatgctcttcccagtca

SEQ ID NO: 9350 - DNA, 22 bp, Artificial Sequence
  Synthetic Construct
ggttgaggagctgagcagtttc

SEQ ID NO: 9351 - DNA, 21 bp, Artificial Sequence
  Synthetic Construct
cgcaggacacagaatgggaaa

SEQ ID NO: 9352 - DNA, 27 bp, Artificial Sequence
  Synthetic Construct
tcttctcatcgaatcttcatggaatcc

SEQ ID NO: 9353 - DNA, 23 bp, Artificial Sequence
  Synthetic Construct
caaccaaacccattttgcagtga

SEQ ID NO: 9354 - DNA, 22 bp, Artificial Sequence
  Synthetic Construct
acggacactctggcctttttat

SEQ ID NO: 9355 - DNA, 26 bp, Artificial Sequence
  Synthetic Construct
ccacagctcctgacttcataaaacct

SEQ ID NO: 9356 - DNA, 29 bp, Artificial Sequence
  Synthetic Construct
gtgggtagattattgctgagggatatttg

SEQ ID NO: 9357 - DNA, 27 bp, Artificial Sequence
  Synthetic Construct
ggtctatttccctaacccttgaatctg

SEQ ID NO: 9358 - DNA, 21 bp, Artificial Sequence
  Synthetic Construct
ccaaccctcttccaccccata

SEQ ID NO: 9359 - DNA, 20 bp, Artificial Sequence
  Synthetic Construct
tgggggcttcctaggaggta

SEQ ID NO: 9360 - DNA, 21 bp, Artificial Sequence
  Synthetic Construct
agagcccccctctttaaacgt

SEQ ID NO: 9361 - DNA, 22 bp, Artificial Sequence
  Synthetic Construct
acagcttggatgaaggcagatc

SEQ ID NO: 9362 - DNA, 21 bp, Artificial Sequence
  Synthetic Construct
agggcagtggtggtgagatct

SEQ ID NO: 9363 - DNA, 21 bp, Artificial Sequence
  Synthetic Construct
ttccaggcagagggcaatgaa

SEQ ID NO: 9364 - DNA, 21 bp, Artificial Sequence
  Synthetic Construct
tgaaagacatccggcccacat

SEQ ID NO: 9365 - DNA, 24 bp, Artificial Sequence
  Synthetic Construct
aggagtgagaagggagactcaatc

SEQ ID NO: 9366 - DNA, 24 bp, Artificial Sequence
  Synthetic Construct
ctgagagaatcaggtgacattgga

SEQ ID NO: 9367 - DNA, 24 bp, Artificial Sequence
  Synthetic Construct
aggtaggcctgactgagaagttga

SEQ ID NO: 9368 - DNA, 27 bp, Artificial Sequence
  Synthetic Construct
gggggttggagaaatgatggaaatacc

SEQ ID NO: 9369 - DNA, 26 bp, Artificial Sequence
  Synthetic Construct
gctcagacccagcaacaaatattcac

SEQ ID NO: 9370 - DNA, 28 bp, Artificial Sequence
  Synthetic Construct
ggaatgtaggaggataacttggtatcat

SEQ ID NO: 9371 - DNA, 21 bp, Artificial Sequence
  Synthetic Construct
tcccaaagcccctgattctga

SEQ ID NO: 9372 - DNA, 26 bp, Artificial Sequence
  Synthetic Construct
cctctaagcagtgacttagagatcct

SEQ ID NO: 9373 - DNA, 22 bp, Artificial Sequence
  Synthetic Construct
tgctcctggatgacacaacttc

SEQ ID NO: 9374 - DNA, 21 bp, Artificial Sequence
  Synthetic Construct
tcccagtgcagcacttcttgt

SEQ ID NO: 9375 - DNA, 26 bp, Artificial Sequence
  Synthetic Construct
ctcacagcatggaagttctactcaag

SEQ ID NO: 9376 - DNA, 24 bp, Artificial Sequence
  Synthetic Construct
ccattccccattggcccatattag

SEQ ID NO: 9377 - DNA, 24 bp, Artificial Sequence
  Synthetic Construct
tgatagggaggtgaaggctttctc

SEQ ID NO: 9378 - DNA, 22 bp, Artificial Sequence
  Synthetic Construct
ctcaagaacagtgggcaaaagc

SEQ ID NO: 9379 - DNA, 20 bp, Artificial Sequence
  Synthetic Construct
tggttcctgctgagggtttg

SEQ ID NO: 9380 - DNA, 25 bp, Artificial Sequence
  Synthetic Construct
cgatccaactgcatactgctagatg

SEQ ID NO: 9381 - DNA, 23 bp, Artificial Sequence
  Synthetic Construct
gcccggcctgctcaattttttta

SEQ ID NO: 9382 - DNA, 26 bp, Artificial Sequence
  Synthetic Construct
ctccacataagactatgctcctcttc

SEQ ID NO: 9383 - DNA, 22 bp, Artificial Sequence
  Synthetic Construct
ggccaacaaaatgtgccattcc

SEQ ID NO: 9384 - DNA, 19 bp, Artificial Sequence
  Synthetic Construct
tccctgacccagcccgaat

SEQ ID NO: 9385 - DNA, 24 bp, Artificial Sequence
  Synthetic Construct
tcagcacccaggtttttactacag

SEQ ID NO: 9386 - DNA, 22 bp, Artificial Sequence
  Synthetic Construct
agatgccttgtctaccgcaaag

SEQ ID NO: 9387 - DNA, 26 bp, Artificial Sequence
  Synthetic Construct
tgcccaacatagactggaatattctg

SEQ ID NO: 9388 - DNA, 21 bp, Artificial Sequence
  Synthetic Construct
atgtctgccagggtcacaaaa

SEQ ID NO: 9389 - DNA, 22 bp, Artificial Sequence
  Synthetic Construct
tccccagggcagatcaaaggaa

SEQ ID NO: 9390 - DNA, 22 bp, Artificial Sequence
  Synthetic Construct
ctgtgtccatcctctgtgcttt

SEQ ID NO: 9391 - DNA, 28 bp, Artificial Sequence
  Synthetic Construct
tcaggccaattattacatactgactcaa

SEQ ID NO: 9392 - DNA, 21 bp, Artificial Sequence
  Synthetic Construct
agagccatcacttgccatcct

SEQ ID NO: 9393 - DNA, 28 bp, Artificial Sequence
  Synthetic Construct
tctcggatccagggattatatacagtag

SEQ ID NO: 9394 - DNA, 27 bp, Artificial Sequence
  Synthetic Construct
ccttgggagtaatacatctttctttgc

SEQ ID NO: 9395 - DNA, 23 bp, Artificial Sequence
  Synthetic Construct
ccaaaacaaaccatgggctcttt

SEQ ID NO: 9396 - DNA, 26 bp, Artificial Sequence
  Synthetic Construct
gctcatgctcccatctagcctttatc

SEQ ID NO: 9397 - DNA, 24 bp, Artificial Sequence
  Synthetic Construct
ccctgcctcacaattcaattagga

SEQ ID NO: 9398 - DNA, 27 bp, Artificial Sequence
  Synthetic Construct
gggatcttaaacctctctgagatagac

SEQ ID NO: 9399 - DNA, 26 bp, Artificial Sequence
  Synthetic Construct
gcaaaagagttaggtgctgactcaca

SEQ ID NO: 9400 - DNA, 21 bp, Artificial Sequence
  Synthetic Construct
tgccttgtccaagagcttcag

SEQ ID NO: 9401 - DNA, 29 bp, Artificial Sequence
  Synthetic Construct
ccaaacacatttcatatcagagcacaagt

SEQ ID NO: 9402 - DNA, 24 bp, Artificial Sequence
  Synthetic Construct
gcaaccaagcaagattctgtctca

SEQ ID NO: 9403 - DNA, 19 bp, Artificial Sequence
  Synthetic Construct
cagaggtggccacacaaca

SEQ ID NO: 9404 - DNA, 20 bp, Artificial Sequence
  Synthetic Construct
tcctcgctctgccagttagt

SEQ ID NO: 9405 - DNA, 20 bp, Artificial Sequence
  Synthetic Construct
gccagaggtgccctttacag

SEQ ID NO: 9406 - DNA, 23 bp, Artificial Sequence
  Synthetic Construct
gacagtaattctggcgctttctc

SEQ ID NO: 9407 - DNA, 30 bp, Artificial Sequence
  Synthetic Construct
gggtcttctaaaagtcttctagaaaagtct

SEQ ID NO: 9408 - DNA, 25 bp, Artificial Sequence
  Synthetic Construct
accctgagatcttaaggtgtcattg

SEQ ID NO: 9409 - DNA, 25 bp, Artificial Sequence
  Synthetic Construct
ctgcatgacagaaggggtagaaaac

SEQ ID NO: 9410 - DNA, 26 bp, Artificial Sequence
  Synthetic Construct
ctctatccctgagacacacttagtca

SEQ ID NO: 9411 - DNA, 19 bp, Artificial Sequence
  Synthetic Construct
agggggccctcctgtcaaa

SEQ ID NO: 9412 - DNA, 18 bp, Artificial Sequence
  Synthetic Construct
cgccagccccttcttcag

SEQ ID NO: 9413 - DNA, 23 bp, Artificial Sequence
  Synthetic Construct
tgtgaaggactgatggctacaga

SEQ ID NO: 9414 - DNA, 27 bp, Artificial Sequence
  Synthetic Construct
ccaagctatttttggcttcaggtacag

SEQ ID NO: 9415 - DNA, 19 bp, Artificial Sequence
  Synthetic Construct
gctgttggggctgccaaaa

SEQ ID NO: 9416 - DNA, 22 bp, Artificial Sequence
  Synthetic Construct
tcccctgccaactgttctttga

SEQ ID NO: 9417 - DNA, 20 bp, Artificial Sequence
  Synthetic Construct
tggcttttgagcagcaagca

SEQ ID NO: 9418 - DNA, 20 bp, Artificial Sequence
  Synthetic Construct
tgtggtgagcagggatcaca

SEQ ID NO: 9419 - DNA, 20 bp, Artificial Sequence
  Synthetic Construct
tggctgagaccctggcatct

SEQ ID NO: 9420 - DNA, 29 bp, Artificial Sequence
  Synthetic Construct
ggtgacaacacatgattactaatgctctt

SEQ ID NO: 9421 - DNA, 23 bp, Artificial Sequence
  Synthetic Construct
ctctgagagccttcatctttggt

SEQ ID NO: 9422 - DNA, 24 bp, Artificial Sequence
  Synthetic Construct
gcttgaatccttgttgtggagtga

SEQ ID NO: 9423 - DNA, 25 bp, Artificial Sequence
  Synthetic Construct
ccaaatgacagaaacactggtctct

SEQ ID NO: 9424 - DNA, 22 bp, Artificial Sequence
  Synthetic Construct
tgatgaggtgaggctctgtgat

SEQ ID NO: 9425 - DNA, 19 bp, Artificial Sequence
  Synthetic Construct
tggccacgacagtgcagaa

SEQ ID NO: 9426 - DNA, 22 bp, Artificial Sequence
  Synthetic Construct
tgctgtgtcctgtcgttcatct

SEQ ID NO: 9427 - DNA, 25 bp, Artificial Sequence
  Synthetic Construct
gctgacaaagagcctgacatacatc

SEQ ID NO: 9428 - DNA, 20 bp, Artificial Sequence
  Synthetic Construct
ggtccaaggagggaggaaga

SEQ ID NO: 9429 - DNA, 27 bp, Artificial Sequence
  Synthetic Construct
cgaatggtacttttagcaggctacact

SEQ ID NO: 9430 - DNA, 28 bp, Artificial Sequence
  Synthetic Construct
ccataagccaattcagcctctttataaa

SEQ ID NO: 9431 - DNA, 21 bp, Artificial Sequence
  Synthetic Construct
tgctgtcaccttgcctggtat

SEQ ID NO: 9432 - DNA, 21 bp, Artificial Sequence
  Synthetic Construct
aggtacagggcagaggatcag

SEQ ID NO: 9433 - DNA, 24 bp, Artificial Sequence
  Synthetic Construct
accaggtttcctcttccctttcct

SEQ ID NO: 9434 - DNA, 23 bp, Artificial Sequence
  Synthetic Construct
acgctttgcctctattcatagct

SEQ ID NO: 9435 - DNA, 25 bp, Artificial Sequence
  Synthetic Construct
ttctgtctccatttcccttttctca

SEQ ID NO: 9436 - DNA, 21 bp, Artificial Sequence
  Synthetic Construct
ccccattcgtgaaggctctac

SEQ ID NO: 9437 - DNA, 19 bp, Artificial Sequence
  Synthetic Construct
gaggtgaggctgggtctca

SEQ ID NO: 9438 - DNA, 26 bp, Artificial Sequence
  Synthetic Construct
gctctccaaagagaatgtggacttta

SEQ ID NO: 9439 - DNA, 26 bp, Artificial Sequence
  Synthetic Construct
cattgtccagccttttctcttaatgg

SEQ ID NO: 9440 - DNA, 19 bp, Artificial Sequence
  Synthetic Construct
gccaccagagccctccatt

SEQ ID NO: 9441 - DNA, 22 bp, Artificial Sequence
  Synthetic Construct
gactgcacgaatgtgtgaaagc

SEQ ID NO: 9442 - DNA, 30 bp, Artificial Sequence
  Synthetic Construct
aacaaaggcttgtcctagaaaaatcatatt

SEQ ID NO: 9443 - DNA, 20 bp, Artificial Sequence
  Synthetic Construct
acaaccatggagggctgcaa

SEQ ID NO: 9444 - DNA, 24 bp, Artificial Sequence
  Synthetic Construct
gcacttttcgtgtgtaaggaacag

SEQ ID NO: 9445 - DNA, 25 bp, Artificial Sequence
  Synthetic Construct
gagagggtcatatatgggggaatga

SEQ ID NO: 9446 - DNA, 23 bp, Artificial Sequence
  Synthetic Construct
ccaaaggcaaagactaccctttg

SEQ ID NO: 9447 - DNA, 22 bp, Artificial Sequence
  Synthetic Construct
tgttggctagtcttgcaacaga

SEQ ID NO: 9448 - DNA, 26 bp, Artificial Sequence
  Synthetic Construct
gaaattttcttggaaacgcaaaacca

SEQ ID NO: 9449 - DNA, 25 bp, Artificial Sequence
  Synthetic Construct
cctggacactgcatgaagtattctg

SEQ ID NO: 9450 - DNA, 25 bp, Artificial Sequence
  Synthetic Construct
cctctgaatttcaaactccctttgg

SEQ ID NO: 9451 - DNA, 28 bp, Artificial Sequence
  Synthetic Construct
ggcataagattacacactgggttagatc

SEQ ID NO: 9452 - DNA, 24 bp, Artificial Sequence
  Synthetic Construct
tgaacactctttcctggtgatgtg

SEQ ID NO: 9453 - DNA, 20 bp, Artificial Sequence
  Synthetic Construct
ctggcctggctaggattcct

SEQ ID NO: 9454 - DNA, 24 bp, Artificial Sequence
  Synthetic Construct
ccaaacctattctgggagccgaaa

SEQ ID NO: 9455 - DNA, 27 bp, Artificial Sequence
  Synthetic Construct
cgctggtaaagttgagtcttatttcac

SEQ ID NO: 9456 - DNA, 22 bp, Artificial Sequence
  Synthetic Construct
cctatcctggacccaagatgct

SEQ ID NO: 9457 - DNA, 19 bp, Artificial Sequence
  Synthetic Construct
atgcccggccatcctgaat

SEQ ID NO: 9458 - DNA, 19 bp, Artificial Sequence
  Synthetic Construct
aggtggaggaggccttgag

SEQ ID NO: 9459 - DNA, 19 bp, Artificial Sequence
  Synthetic Construct
ggagcggaagtgagcatgt

SEQ ID NO: 9460 - DNA, 28 bp, Artificial Sequence
  Synthetic Construct
gattttggagggacaggaaattaaagag

SEQ ID NO: 9461 - DNA, 19 bp, Artificial Sequence
  Synthetic Construct
cctgctgtgctcagttcca

SEQ ID NO: 9462 - DNA, 22 bp, Artificial Sequence
  Synthetic Construct
gggtgtgggaaggctatatgag

SEQ ID NO: 9463 - DNA, 21 bp, Artificial Sequence
  Synthetic Construct
ggtacccgcatgttgctatgg

SEQ ID NO: 9464 - DNA, 19 bp, Artificial Sequence
  Synthetic Construct
atccctcccagccacaact

SEQ ID NO: 9465 - DNA, 26 bp, Artificial Sequence
  Synthetic Construct
ctatctacatcccattggccataact

SEQ ID NO: 9466 - DNA, 21 bp, Artificial Sequence
  Synthetic Construct
agggaaggggccataacttct

SEQ ID NO: 9467 - DNA, 27 bp, Artificial Sequence
  Synthetic Construct
cagttaggaagccgatgaaattagttt

SEQ ID NO: 9468 - DNA, 25 bp, Artificial Sequence
  Synthetic Construct
caaccctactaactgcacagagaag

SEQ ID NO: 9469 - DNA, 20 bp, Artificial Sequence
  Synthetic Construct
ctctgagcgctgttcctgaa

SEQ ID NO: 9470 - DNA, 19 bp, Artificial Sequence
  Synthetic Construct
ggagccactgcagctttct

SEQ ID NO: 9471 - DNA, 19 bp, Artificial Sequence
  Synthetic Construct
aggcatggcaaggctacct

SEQ ID NO: 9472 - DNA, 29 bp, Artificial Sequence
  Synthetic Construct
ctctgattctgttttacagcaaaatgaga

SEQ ID NO: 9473 - DNA, 22 bp, Artificial Sequence
  Synthetic Construct
ctcccctgcctcccaaatttaa

SEQ ID NO: 9474 - DNA, 21 bp, Artificial Sequence
  Synthetic Construct
agaccacactcaacccagaga

SEQ ID NO: 9475 - DNA, 27 bp, Artificial Sequence
  Synthetic Construct
tccatgataagcaggtctatacaatcc

SEQ ID NO: 9476 - DNA, 18 bp, Artificial Sequence
  Synthetic Construct
agcggcatccctgtcctt

SEQ ID NO: 9477 - DNA, 20 bp, Artificial Sequence
  Synthetic Construct
gctgcctagctgggtaacct

SEQ ID NO: 9478 - DNA, 24 bp, Artificial Sequence
  Synthetic Construct
gacaatcggatgaggagcagatac

SEQ ID NO: 9479 - DNA, 22 bp, Artificial Sequence
  Synthetic Construct
ggaaactgaggaggcattctca

SEQ ID NO: 9480 - DNA, 24 bp, Artificial Sequence
  Synthetic Construct
cacagaattgacccctcacttcca

SEQ ID NO: 9481 - DNA, 21 bp, Artificial Sequence
  Synthetic Construct
actttctggtggcatgagcaa

SEQ ID NO: 9482 - DNA, 23 bp, Artificial Sequence
  Synthetic Construct
aacccaccaaaatctgacttcct

SEQ ID NO: 9483 - DNA, 18 bp, Artificial Sequence
  Synthetic Construct
gggggagggaggaaacgt

SEQ ID NO: 9484 - DNA, 25 bp, Artificial Sequence
  Synthetic Construct
gtgctatgtggggagtagattggaa

SEQ ID NO: 9485 - DNA, 20 bp, Artificial Sequence
  Synthetic Construct
ctctgcgctgcaaagttgtc

SEQ ID NO: 9486 - DNA, 30 bp, Artificial Sequence
  Synthetic Construct
cccactcctcataataggtatttgaggaaa

SEQ ID NO: 9487 - DNA, 27 bp, Artificial Sequence
  Synthetic Construct
caggtattacgcttaagtgttcattgc

SEQ ID NO: 9488 - DNA, 26 bp, Artificial Sequence
  Synthetic Construct
ccaaggattttctcctctcctcagat

SEQ ID NO: 9489 - DNA, 23 bp, Artificial Sequence
  Synthetic Construct
tccctcagctctgaagacctact

SEQ ID NO: 9490 - DNA, 25 bp, Artificial Sequence
  Synthetic Construct
gcttgtgaatcaaactgtgaaagct

SEQ ID NO: 9491 - DNA, 22 bp, Artificial Sequence
  Synthetic Construct
gtggtccaacaacggtaagtgt

SEQ ID NO: 9492 - DNA, 24 bp, Artificial Sequence
  Synthetic Construct
ggaatggggtctatgttggaaaga

SEQ ID NO: 9493 - DNA, 20 bp, Artificial Sequence
  Synthetic Construct
ccccagtttcttggcactgt

SEQ ID NO: 9494 - DNA, 26 bp, Artificial Sequence
  Synthetic Construct
gaatttcattcatgcctacgacttca

SEQ ID NO: 9495 - DNA, 24 bp, Artificial Sequence
  Synthetic Construct
ccttgctagattgcaggcttcttg

SEQ ID NO: 9496 - DNA, 20 bp, Artificial Sequence
  Synthetic Construct
aggtgggggtgatggtgact

SEQ ID NO: 9497 - DNA, 22 bp, Artificial Sequence
  Synthetic Construct
ggagggtctagagctggatcct

SEQ ID NO: 9498 - DNA, 19 bp, Artificial Sequence
  Synthetic Construct
caggaggccgtccaattgg

SEQ ID NO: 9499 - DNA, 27 bp, Artificial Sequence
  Synthetic Construct
gttttaaaggttcaactgcctttacct

SEQ ID NO: 9500 - DNA, 23 bp, Artificial Sequence
  Synthetic Construct
ggagatcttcccatgaaccactt

SEQ ID NO: 9501 - DNA, 22 bp, Artificial Sequence
  Synthetic Construct
aaagtggtggctcctgtagaga

SEQ ID NO: 9502 - DNA, 25 bp, Artificial Sequence
  Synthetic Construct
gaaagtctttgttccctgcagatac

SEQ ID NO: 9503 - DNA, 23 bp, Artificial Sequence
  Synthetic Construct
cccacaagtggcagagaagaaaa

SEQ ID NO: 9504 - DNA, 26 bp, Artificial Sequence
  Synthetic Construct
gcaaagagaagcatttgttcctttcc

SEQ ID NO: 9505 - DNA, 23 bp, Artificial Sequence
  Synthetic Construct
gctatgggggaggctttattcaa

SEQ ID NO: 9506 - DNA, 23 bp, Artificial Sequence
  Synthetic Construct
acaagctggcagatagggaagag

SEQ ID NO: 9507 - DNA, 22 bp, Artificial Sequence
  Synthetic Construct
cagacatgtcatggctcctgaa

SEQ ID NO: 9508 - DNA, 24 bp, Artificial Sequence
  Synthetic Construct
gtggcagttctagtggcttctagt

SEQ ID NO: 9509 - DNA, 23 bp, Artificial Sequence
  Synthetic Construct
agactcagcactggaagaaacac

SEQ ID NO: 9510 - DNA, 24 bp, Artificial Sequence
  Synthetic Construct
ctgccatgacaaatccttctacac

SEQ ID NO: 9511 - DNA, 30 bp, Artificial Sequence
  Synthetic Construct
gggacttacgatgccataataaagaatttg

SEQ ID NO: 9512 - DNA, 24 bp, Artificial Sequence
  Synthetic Construct
cctagagaaccggtaaagcagtac

SEQ ID NO: 9513 - DNA, 22 bp, Artificial Sequence
  Synthetic Construct
aggcaattgctacctcgatcca

SEQ ID NO: 9514 - DNA, 24 bp, Artificial Sequence
  Synthetic Construct
gtgactacaggagcagcatatctg

SEQ ID NO: 9515 - DNA, 19 bp, Artificial Sequence
  Synthetic Construct
caggcagggacagctgaaa

SEQ ID NO: 9516 - DNA, 29 bp, Artificial Sequence
  Synthetic Construct
tcttaccataattccagagaacagtacat

SEQ ID NO: 9517 - DNA, 25 bp, Artificial Sequence
  Synthetic Construct
acttctgaaagaaagaaggccaaga

SEQ ID NO: 9518 - DNA, 22 bp, Artificial Sequence
  Synthetic Construct
tggtacagtgagggtagaacca

SEQ ID NO: 9519 - DNA, 26 bp, Artificial Sequence
  Synthetic Construct
gccgtgattatgactggcattacatc

SEQ ID NO: 9520 - DNA, 29 bp, Artificial Sequence
  Synthetic Construct
cctgcattacaaatggttttcttcctgtt

SEQ ID NO: 9521 - DNA, 22 bp, Artificial Sequence
  Synthetic Construct
gccttcttcctcctgctttgtt

SEQ ID NO: 9522 - DNA, 29 bp, Artificial Sequence
  Synthetic Construct
caaggagtgactagtctgactttaaatct

SEQ ID NO: 9523 - DNA, 21 bp, Artificial Sequence
  Synthetic Construct
ccccctcatcaatgcctcctt

SEQ ID NO: 9524 - DNA, 23 bp, Artificial Sequence
  Synthetic Construct
gtgactcccaccaaatacaggat

SEQ ID NO: 9525 - DNA, 21 bp, Artificial Sequence
  Synthetic Construct
tccctgtcctatgcacccaaa

SEQ ID NO: 9526 - DNA, 20 bp, Artificial Sequence
  Synthetic Construct
ccaccctaccccacctgtac

SEQ ID NO: 9527 - DNA, 22 bp, Artificial Sequence
  Synthetic Construct
tctgcgattttcccccatgtct

SEQ ID NO: 9528 - DNA, 22 bp, Artificial Sequence
  Synthetic Construct
cgcacccggcccattattataa

SEQ ID NO: 9529 - DNA, 21 bp, Artificial Sequence
  Synthetic Construct
ttcgtcctagtccctgtgtga

SEQ ID NO: 9530 - DNA, 27 bp, Artificial Sequence
  Synthetic Construct
aacacatacatgttaacacacctatgc

SEQ ID NO: 9531 - DNA, 26 bp, Artificial Sequence
  Synthetic Construct
cctggtaagtttgccttctatgtttc

SEQ ID NO: 9532 - DNA, 25 bp, Artificial Sequence
  Synthetic Construct
gggaaagctttctacatgctttgag

SEQ ID NO: 9533 - DNA, 22 bp, Artificial Sequence
  Synthetic Construct
actgtacactggctgttttgca

SEQ ID NO: 9534 - DNA, 21 bp, Artificial Sequence
  Synthetic Construct
tcttggcattgcaacctccat

SEQ ID NO: 9535 - DNA, 24 bp, Artificial Sequence
  Synthetic Construct
gtggacgaggagaaatgagagctt

SEQ ID NO: 9536 - DNA, 20 bp, Artificial Sequence
  Synthetic Construct
agtgccgcatccctatgtca

SEQ ID NO: 9537 - DNA, 25 bp, Artificial Sequence
  Synthetic Construct
cctaaccttaggggatgctcatctt

SEQ ID NO: 9538 - DNA, 19 bp, Artificial Sequence
  Synthetic Construct
agggcacagggctcagctt

SEQ ID NO: 9539 - DNA, 22 bp, Artificial Sequence
  Synthetic Construct
tggactagaggatcccccagtt

SEQ ID NO: 9540 - DNA, 21 bp, Artificial Sequence
  Synthetic Construct
tgctggggagattccttgaac

SEQ ID NO: 9541 - DNA, 24 bp, Artificial Sequence
  Synthetic Construct
gtggtggagcaaagttcctctaga

SEQ ID NO: 9542 - DNA, 26 bp, Artificial Sequence
  Synthetic Construct
gctccacagaattactcccagtgatc

SEQ ID NO: 9543 - DNA, 20 bp, Artificial Sequence
  Synthetic Construct
tctgcacctctgcacttgct

SEQ ID NO: 9544 - DNA, 24 bp, Artificial Sequence
  Synthetic Construct
catcaccctcaattcttgcagatg

SEQ ID NO: 9545 - DNA, 26 bp, Artificial Sequence
  Synthetic Construct
gctgcatcgagaaaataagaatcact

SEQ ID NO: 9546 - DNA, 25 bp, Artificial Sequence
  Synthetic Construct
gggagaactgaaggtgtctgactat

SEQ ID NO: 9547 - DNA, 19 bp, Artificial Sequence
  Synthetic Construct
gccaacacctgcccagttg

SEQ ID NO: 9548 - DNA, 24 bp, Artificial Sequence
  Synthetic Construct
gcaacatagcaactgaggctcaga

SEQ ID NO: 9549 - DNA, 19 bp, Artificial Sequence
  Synthetic Construct
agggactctgcccctagct

SEQ ID NO: 9550 - DNA, 24 bp, Artificial Sequence
  Synthetic Construct
gccccttgaaatactgtgaaatcc

SEQ ID NO: 9551 - DNA, 21 bp, Artificial Sequence
  Synthetic Construct
atggaccccactccctatgtt

SEQ ID NO: 9552 - DNA, 26 bp, Artificial Sequence
  Synthetic Construct
ggcacagctgagatgttgaattactc

SEQ ID NO: 9553 - DNA, 19 bp, Artificial Sequence
  Synthetic Construct
tttgggccgaggcatcaca

SEQ ID NO: 9554 - DNA, 22 bp, Artificial Sequence
  Synthetic Construct
acccactggattctcccttagt

SEQ ID NO: 9555 - DNA, 29 bp, Artificial Sequence
  Synthetic Construct
ccacttccaagaagatagttcattcatca

SEQ ID NO: 9556 - DNA, 20 bp, Artificial Sequence
  Synthetic Construct
cctttgctgcttccggatgt

SEQ ID NO: 9557 - DNA, 24 bp, Artificial Sequence
  Synthetic Construct
tgaagttcgacctgaaagaacact

SEQ ID NO: 9558 - DNA, 24 bp, Artificial Sequence
  Synthetic Construct
agcaatcccgtcctacctctaaac

SEQ ID NO: 9559 - DNA, 21 bp, Artificial Sequence
  Synthetic Construct
cccaggcatgagaaggaacct

SEQ ID NO: 9560 - DNA, 18 bp, Artificial Sequence
  Synthetic Construct
tggctgacgctgcactgt

SEQ ID NO: 9561 - DNA, 19 bp, Artificial Sequence
  Synthetic Construct
cctgtgtggcatgcagtct

SEQ ID NO: 9562 - DNA, 20 bp, Artificial Sequence
  Synthetic Construct
gggttacctcagctgttgca

SEQ ID NO: 9563 - DNA, 24 bp, Artificial Sequence
  Synthetic Construct
gcattacagtccccctgaaaagct

SEQ ID NO: 9564 - DNA, 27 bp, Artificial Sequence
  Synthetic Construct
ctgtcacaaaggctgtccttaataaat

SEQ ID NO: 9565 - DNA, 23 bp, Artificial Sequence
  Synthetic Construct
ccttgctggtgagacctaagact

SEQ ID NO: 9566 - DNA, 21 bp, Artificial Sequence
  Synthetic Construct
tcgtcctgccaactgacagtt

SEQ ID NO: 9567 - DNA, 22 bp, Artificial Sequence
  Synthetic Construct
ctgtcagggtctgcatgtgtat

SEQ ID NO: 9568 - DNA, 25 bp, Artificial Sequence
  Synthetic Construct
cacttttccactgaagatccaagca

SEQ ID NO: 9569 - DNA, 22 bp, Artificial Sequence
  Synthetic Construct
ctgggagctggaacttcaaagt

SEQ ID NO: 9570 - DNA, 28 bp, Artificial Sequence
  Synthetic Construct
cctttttcctctcctttaatcaaccaat

SEQ ID NO: 9571 - DNA, 26 bp, Artificial Sequence
  Synthetic Construct
cctgcttgttcataggcatgaaaatg

SEQ ID NO: 9572 - DNA, 23 bp, Artificial Sequence
  Synthetic Construct
tcagaggctgtaccttgacaatc

SEQ ID NO: 9573 - DNA, 24 bp, Artificial Sequence
  Synthetic Construct
tgacatccagcaactagacagaga

SEQ ID NO: 9574 - DNA, 26 bp, Artificial Sequence
  Synthetic Construct
ttcacttcaagttttcaagctgcata

SEQ ID NO: 9575 - DNA, 22 bp, Artificial Sequence
  Synthetic Construct
cacttcagggccacttactcaa

SEQ ID NO: 9576 - DNA, 22 bp, Artificial Sequence
  Synthetic Construct
tcagctcctttcaaagcaaggt

SEQ ID NO: 9577 - DNA, 24 bp, Artificial Sequence
  Synthetic Construct
ggtcacacacaagccatgtctaga

SEQ ID NO: 9578 - DNA, 28 bp, Artificial Sequence
  Synthetic Construct
gaaagagcattggatatttatggagcaa

SEQ ID NO: 9579 - DNA, 25 bp, Artificial Sequence
  Synthetic Construct
ccagaaagcaggtttcacctttagc

SEQ ID NO: 9580 - DNA, 22 bp, Artificial Sequence
  Synthetic Construct
gtcagactggctaagcaacaca

SEQ ID NO: 9581 - DNA, 23 bp, Artificial Sequence
  Synthetic Construct
gcttctgcttcttcctagcacat

SEQ ID NO: 9582 - DNA, 29 bp, Artificial Sequence
  Synthetic Construct
tcactttataaactgcaatggaattcagt

SEQ ID NO: 9583 - DNA, 21 bp, Artificial Sequence
  Synthetic Construct
cctgaagctcagagccaacct

SEQ ID NO: 9584 - DNA, 24 bp, Artificial Sequence
  Synthetic Construct
gtgaagcagagatgaagcaccaaa

SEQ ID NO: 9585 - DNA, 22 bp, Artificial Sequence
  Synthetic Construct
aggtcactgggaactgttcctt

SEQ ID NO: 9586 - DNA, 20 bp, Artificial Sequence
  Synthetic Construct
agactgaaggccctgaagga

SEQ ID NO: 9587 - DNA, 24 bp, Artificial Sequence
  Synthetic Construct
gcatagtagggaaaagggaccttt

SEQ ID NO: 9588 - DNA, 20 bp, Artificial Sequence
  Synthetic Construct
agtgatggcgtgttgggatt

SEQ ID NO: 9589 - DNA, 27 bp, Artificial Sequence
  Synthetic Construct
cagaaacagtgatctatcagttgcaat

SEQ ID NO: 9590 - DNA, 22 bp, Artificial Sequence
  Synthetic Construct
cactgctttgtggaccaggtta

SEQ ID NO: 9591 - DNA, 21 bp, Artificial Sequence
  Synthetic Construct
aaggcatctctcacacaagca

SEQ ID NO: 9592 - DNA, 26 bp, Artificial Sequence
  Synthetic Construct
cattaaccttacaagcagagggagaa

SEQ ID NO: 9593 - DNA, 25 bp, Artificial Sequence
  Synthetic Construct
gcacagttgttagagaaagtttgga

SEQ ID NO: 9594 - DNA, 26 bp, Artificial Sequence
  Synthetic Construct
ggagagcaccttctctcttacataag

SEQ ID NO: 9595 - DNA, 23 bp, Artificial Sequence
  Synthetic Construct
tgggcttcctcccacaattttac

SEQ ID NO: 9596 - DNA, 28 bp, Artificial Sequence
  Synthetic Construct
cagacagattttactctgagttgtgtca

SEQ ID NO: 9597 - DNA, 21 bp, Artificial Sequence
  Synthetic Construct
aagcacgtcccagtagtttcc

SEQ ID NO: 9598 - DNA, 22 bp, Artificial Sequence
  Synthetic Construct
caaactgtggcaatgcgaatga

SEQ ID NO: 9599 - DNA, 24 bp, Artificial Sequence
  Synthetic Construct
gccagcctcaagatttgtggtcaa

SEQ ID NO: 9600 - DNA, 25 bp, Artificial Sequence
  Synthetic Construct
gtgcttgtgagtttttgagcctaga

SEQ ID NO: 9601 - DNA, 22 bp, Artificial Sequence
  Synthetic Construct
ggaccttggccattatcattgc

SEQ ID NO: 9602 - DNA, 24 bp, Artificial Sequence
  Synthetic Construct
tctaccatggctccaggtttaaac

SEQ ID NO: 9603 - DNA, 22 bp, Artificial Sequence
  Synthetic Construct
agaggaccaaggacgttcgtaa

SEQ ID NO: 9604 - DNA, 21 bp, Artificial Sequence
  Synthetic Construct
tcacagaaatgcgaccacaga

SEQ ID NO: 9605 - DNA, 24 bp, Artificial Sequence
  Synthetic Construct
tgaatttggtagggaggacacaaa

SEQ ID NO: 9606 - DNA, 24 bp, Artificial Sequence
  Synthetic Construct
tggatggacgggggtactatttct

SEQ ID NO: 9607 - DNA, 24 bp, Artificial Sequence
  Synthetic Construct
attatggctcactgtagcctcaaa

SEQ ID NO: 9608 - DNA, 20 bp, Artificial Sequence
  Synthetic Construct
catggctggcagttggtact

SEQ ID NO: 9609 - DNA, 20 bp, Artificial Sequence
  Synthetic Construct
gcagtcaagcctcctttcca

SEQ ID NO: 9610 - DNA, 24 bp, Artificial Sequence
  Synthetic Construct
gccaacctaaagcaagctcaaacc

SEQ ID NO: 9611 - DNA, 29 bp, Artificial Sequence
  Synthetic Construct
ctgatttggggagagtaaaatgtcattag

SEQ ID NO: 9612 - DNA, 20 bp, Artificial Sequence
  Synthetic Construct
ttgggtggcatcctgcaatg

SEQ ID NO: 9613 - DNA, 29 bp, Artificial Sequence
  Synthetic Construct
ggctgagtaaactggcttatctctgaaat

SEQ ID NO: 9614 - DNA, 24 bp, Artificial Sequence
  Synthetic Construct
acccacagactcgtcttgataggt

SEQ ID NO: 9615 - DNA, 22 bp, Artificial Sequence
  Synthetic Construct
tgcccggtcttctgttcctaaa

SEQ ID NO: 9616 - DNA, 22 bp, Artificial Sequence
  Synthetic Construct
tgccccttcactctgttgatga

SEQ ID NO: 9617 - DNA, 22 bp, Artificial Sequence
  Synthetic Construct
acaagctgcagcctactaacac

SEQ ID NO: 9618 - DNA, 20 bp, Artificial Sequence
  Synthetic Construct
atggggctgagtgacaagga

SEQ ID NO: 9619 - DNA, 22 bp, Artificial Sequence
  Synthetic Construct
tcccacccgcatagaaaagatg

SEQ ID NO: 9620 - DNA, 25 bp, Artificial Sequence
  Synthetic Construct
gcaaacttttgactgacgttctcaa

SEQ ID NO: 9621 - DNA, 25 bp, Artificial Sequence
  Synthetic Construct
gacttgaaaagttctccccaaatgc

SEQ ID NO: 9622 - DNA, 28 bp, Artificial Sequence
  Synthetic Construct
ggtttaagaaagccttagaactccatct

SEQ ID NO: 9623 - DNA, 23 bp, Artificial Sequence
  Synthetic Construct
cactgctgtgccagaaaaacttg

SEQ ID NO: 9624 - DNA, 21 bp, Artificial Sequence
  Synthetic Construct
agggaacaggagcctgctact

SEQ ID NO: 9625 - DNA, 21 bp, Artificial Sequence
  Synthetic Construct
agtagcgtccagtgtgacaga

SEQ ID NO: 9626 - DNA, 24 bp, Artificial Sequence
  Synthetic Construct
gggggctacattaactctgttgga

SEQ ID NO: 9627 - DNA, 28 bp, Artificial Sequence
  Synthetic Construct
gtaggattcttgtcttagcatgtctttg

SEQ ID NO: 9628 - DNA, 21 bp, Artificial Sequence
  Synthetic Construct
tcctgacccaggtttgttcgt

SEQ ID NO: 9629 - DNA, 21 bp, Artificial Sequence
  Synthetic Construct
aaccccagtgcctgcaaatgt

SEQ ID NO: 9630 - DNA, 21 bp, Artificial Sequence
  Synthetic Construct
agcctagtgacagcacctgaa

SEQ ID NO: 9631 - DNA, 26 bp, Artificial Sequence
  Synthetic Construct
gcagtcacttccagagtcattacttc

SEQ ID NO: 9632 - DNA, 24 bp, Artificial Sequence
  Synthetic Construct
agttgcagtctaggttttgttggt

SEQ ID NO: 9633 - DNA, 20 bp, Artificial Sequence
  Synthetic Construct
aaagtgtggccagtgtttgc

SEQ ID NO: 9634 - DNA, 23 bp, Artificial Sequence
  Synthetic Construct
tgggaggagagagccatattcca

SEQ ID NO: 9635 - DNA, 27 bp, Artificial Sequence
  Synthetic Construct
acttggcatttaatgggaactatttcc

SEQ ID NO: 9636 - DNA, 28 bp, Artificial Sequence
  Synthetic Construct
ggagaaatgagatagacgtgttgtgttc

SEQ ID NO: 9637 - DNA, 26 bp, Artificial Sequence
  Synthetic Construct
ctcatcagagctcagtatggggacat

SEQ ID NO: 9638 - DNA, 21 bp, Artificial Sequence
  Synthetic Construct
aggaccttgaggtggcctgaa

SEQ ID NO: 9639 - DNA, 20 bp, Artificial Sequence
  Synthetic Construct
tttgcatcctgccacatcct

SEQ ID NO: 9640 - DNA, 23 bp, Artificial Sequence
  Synthetic Construct
acacactcatactcctcccatct

SEQ ID NO: 9641 - DNA, 19 bp, Artificial Sequence
  Synthetic Construct
gccagaccatcctgcatgt

SEQ ID NO: 9642 - DNA, 24 bp, Artificial Sequence
  Synthetic Construct
gtggaagtgacaatgtgtgatagc

SEQ ID NO: 9643 - DNA, 28 bp, Artificial Sequence
  Synthetic Construct
gagaaaagatccttgaagcatagtgttt

SEQ ID NO: 9644 - DNA, 30 bp, Artificial Sequence
  Synthetic Construct
gcctaatccataaccaagaattaccctcta

SEQ ID NO: 9645 - DNA, 19 bp, Artificial Sequence
  Synthetic Construct
tttcctgcaggccctttcg

SEQ ID NO: 9646 - DNA, 18 bp, Artificial Sequence
  Synthetic Construct
aagcctcgctcccttcct

SEQ ID NO: 9647 - DNA, 25 bp, Artificial Sequence
  Synthetic Construct
gcatggcacacaatgagaagatgag

SEQ ID NO: 9648 - DNA, 20 bp, Artificial Sequence
  Synthetic Construct
tcctgggctcaagggatcct

SEQ ID NO: 9649 - DNA, 25 bp, Artificial Sequence
  Synthetic Construct
atgacaagatgagtctggtttcagt

SEQ ID NO: 9650 - DNA, 28 bp, Artificial Sequence
  Synthetic Construct
gctgtccaaaaaatattctcctgtccat

SEQ ID NO: 9651 - DNA, 20 bp, Artificial Sequence
  Synthetic Construct
gtggagccacaacagcaaga

SEQ ID NO: 9652 - DNA, 26 bp, Artificial Sequence
  Synthetic Construct
ccccaaaatagtcgaaggttcaaagc

SEQ ID NO: 9653 - DNA, 30 bp, Artificial Sequence
  Synthetic Construct
tccttaggtacttattattgcacacaagta

SEQ ID NO: 9654 - DNA, 24 bp, Artificial Sequence
  Synthetic Construct
aggcaccctctctctagattcaac

SEQ ID NO: 9655 - DNA, 28 bp, Artificial Sequence
  Synthetic Construct
ctgagtgacttatgactcagtttttctg

SEQ ID NO: 9656 - DNA, 22 bp, Artificial Sequence
  Synthetic Construct
cacccctacgtgttcaatcagt

SEQ ID NO: 9657 - DNA, 22 bp, Artificial Sequence
  Synthetic Construct
gcaggtgcatagctgggacaga

SEQ ID NO: 9658 - DNA, 27 bp, Artificial Sequence
  Synthetic Construct
ggcattaccctaggaattcaggaagaa

SEQ ID NO: 9659 - DNA, 22 bp, Artificial Sequence
  Synthetic Construct
gacctggaaattaggcccttca

SEQ ID NO: 9660 - DNA, 30 bp, Artificial Sequence
  Synthetic Construct
gcagtcttcaaaaatttttaagggcagatt

SEQ ID NO: 9661 - DNA, 22 bp, Artificial Sequence
  Synthetic Construct
agttcaggctgcagtacagttg

SEQ ID NO: 9662 - DNA, 24 bp, Artificial Sequence
  Synthetic Construct
ggagatagagggcctatccttcct

SEQ ID NO: 9663 - DNA, 22 bp, Artificial Sequence
  Synthetic Construct
tctgctcacaacctagcaacct

SEQ ID NO: 9664 - DNA, 23 bp, Artificial Sequence
  Synthetic Construct
tcctcctttctcccccaactagt

SEQ ID NO: 9665 - DNA, 30 bp, Artificial Sequence
  Synthetic Construct
gtagagcagatgtttgtaatatgggtttta

SEQ ID NO: 9666 - DNA, 23 bp, Artificial Sequence
  Synthetic Construct
ggttcaacagagctgagatctga

SEQ ID NO: 9667 - DNA, 20 bp, Artificial Sequence
  Synthetic Construct
tccccaccacccatcttgat

SEQ ID NO: 9668 - DNA, 25 bp, Artificial Sequence
  Synthetic Construct
ctagactgagtcatgcattctcaca

SEQ ID NO: 9669 - DNA, 23 bp, Artificial Sequence
  Synthetic Construct
aatcctgactcccaaagcatcaa

SEQ ID NO: 9670 - DNA, 25 bp, Artificial Sequence
  Synthetic Construct
ttaagggaagggcataggaaaaagt

SEQ ID NO: 9671 - DNA, 24 bp, Artificial Sequence
  Synthetic Construct
gcacttcccacagattaggaacca

SEQ ID NO: 9672 - DNA, 19 bp, Artificial Sequence
  Synthetic Construct
tccaggtctgggcccacaa

SEQ ID NO: 9673 - DNA, 25 bp, Artificial Sequence
  Synthetic Construct
tccttgtctaatacccctgcaattt

SEQ ID NO: 9674 - DNA, 25 bp, Artificial Sequence
  Synthetic Construct
ggagttgctcaaattcttggagcaa

SEQ ID NO: 9675 - DNA, 26 bp, Artificial Sequence
  Synthetic Construct
ccactgacatcatttttcaggtcttg

SEQ ID NO: 9676 - DNA, 19 bp, Artificial Sequence
  Synthetic Construct
gcctctgcagtgggatcag

SEQ ID NO: 9677 - DNA, 22 bp, Artificial Sequence
  Synthetic Construct
tgagtaactgtggccactgaga

SEQ ID NO: 9678 - DNA, 22 bp, Artificial Sequence
  Synthetic Construct
tcctggggccaagactcctaaa

SEQ ID NO: 9679 - DNA, 29 bp, Artificial Sequence
  Synthetic Construct
gcttcagaaatgatatgtgttcaagagta

SEQ ID NO: 9680 - DNA, 22 bp, Artificial Sequence
  Synthetic Construct
ccgctctacaggtttcaacagt

SEQ ID NO: 9681 - DNA, 26 bp, Artificial Sequence
  Synthetic Construct
gctctctgtttacttccagtgttcca

SEQ ID NO: 9682 - DNA, 23 bp, Artificial Sequence
  Synthetic Construct
gcttttaccccaactgtctcact

SEQ ID NO: 9683 - DNA, 22 bp, Artificial Sequence
  Synthetic Construct
agccttcactggattgcctatc

SEQ ID NO: 9684 - DNA, 18 bp, Artificial Sequence
  Synthetic Construct
aggtgcctgccctaacct

SEQ ID NO: 9685 - DNA, 26 bp, Artificial Sequence
  Synthetic Construct
cttgcatttcctatgtaatggccaaa

SEQ ID NO: 9686 - DNA, 23 bp, Artificial Sequence
  Synthetic Construct
agattgtcacatgggcatgttgt

SEQ ID NO: 9687 - DNA, 24 bp, Artificial Sequence
  Synthetic Construct
gaaatcttgctggtgggattcagt

SEQ ID NO: 9688 - DNA, 28 bp, Artificial Sequence
  Synthetic Construct
caatacagatttgaggggatcagaattg

SEQ ID NO: 9689 - DNA, 27 bp, Artificial Sequence
  Synthetic Construct
gcaactgcattagtggtattcatgtca

SEQ ID NO: 9690 - DNA, 20 bp, Artificial Sequence
  Synthetic Construct
gcccaggatcctgcactagt

SEQ ID NO: 9691 - DNA, 19 bp, Artificial Sequence
  Synthetic Construct
agggaggcgcctggcatct

SEQ ID NO: 9692 - DNA, 22 bp, Artificial Sequence
  Synthetic Construct
accagactgaaagccagaagac

SEQ ID NO: 9693 - DNA, 25 bp, Artificial Sequence
  Synthetic Construct
ggtgtcagataacctgagagccatt

SEQ ID NO: 9694 - DNA, 24 bp, Artificial Sequence
  Synthetic Construct
ccagcctaaggactgtgtaagaag

SEQ ID NO: 9695 - DNA, 27 bp, Artificial Sequence
  Synthetic Construct
cacagttcaatctgtaatagcttgctt

SEQ ID NO: 9696 - DNA, 23 bp, Artificial Sequence
  Synthetic Construct
gctgcaaatccattctccttctc

SEQ ID NO: 9697 - DNA, 25 bp, Artificial Sequence
  Synthetic Construct
ctgattctgccacctatactgaact

SEQ ID NO: 9698 - DNA, 24 bp, Artificial Sequence
  Synthetic Construct
gctggagaagctggaaaggagttt

SEQ ID NO: 9699 - DNA, 22 bp, Artificial Sequence
  Synthetic Construct
ggccccaggaaaaacggaaaat

SEQ ID NO: 9700 - DNA, 21 bp, Artificial Sequence
  Synthetic Construct
ctggggttgagagtgggtaga

SEQ ID NO: 9701 - DNA, 22 bp, Artificial Sequence
  Synthetic Construct
cctaacccctgcctttctagca

SEQ ID NO: 9702 - DNA, 30 bp, Artificial Sequence
  Synthetic Construct
gcagatcacttaccttaggatagcatacac

SEQ ID NO: 9703 - DNA, 19 bp, Artificial Sequence
  Synthetic Construct
gccccagccgtcacattct

SEQ ID NO: 9704 - DNA, 30 bp, Artificial Sequence
  Synthetic Construct
gttttaaggcaaagacagagaattcattga

SEQ ID NO: 9705 - DNA, 22 bp, Artificial Sequence
  Synthetic Construct
gcctgaatcccatgcctaccaa

SEQ ID NO: 9706 - DNA, 19 bp, Artificial Sequence
  Synthetic Construct
atggcaggggcggggtaca

SEQ ID NO: 9707 - DNA, 26 bp, Artificial Sequence
  Synthetic Construct
ccaagccataaatgcactaggattgc

SEQ ID NO: 9708 - DNA, 23 bp, Artificial Sequence
  Synthetic Construct
ctctcaaaccggaactcatttgc

SEQ ID NO: 9709 - DNA, 22 bp, Artificial Sequence
  Synthetic Construct
aaggtcttctgagagggaaggt

SEQ ID NO: 9710 - DNA, 28 bp, Artificial Sequence
  Synthetic Construct
tgtggaacagagcaatttaaatggaaat

SEQ ID NO: 9711 - DNA, 23 bp, Artificial Sequence
  Synthetic Construct
gtccacagattgatcaccatgca

SEQ ID NO: 9712 - DNA, 30 bp, Artificial Sequence
  Synthetic Construct
ctgcttaatcatttgggttaagtggtatta

SEQ ID NO: 9713 - DNA, 27 bp, Artificial Sequence
  Synthetic Construct
acttcagacaagtatagctcccagctt

SEQ ID NO: 9714 - DNA, 22 bp, Artificial Sequence
  Synthetic Construct
ctggggtcatggtttcaaggaa

SEQ ID NO: 9715 - DNA, 22 bp, Artificial Sequence
  Synthetic Construct
gctgtgttgagaacaggctgaa

SEQ ID NO: 9716 - DNA, 22 bp, Artificial Sequence
  Synthetic Construct
aggcttagtctggcagcttgtt

SEQ ID NO: 9717 - DNA, 30 bp, Artificial Sequence
  Synthetic Construct
gcaaaagagctatatctccattctattcac

SEQ ID NO: 9718 - DNA, 25 bp, Artificial Sequence
  Synthetic Construct
ggaaaaggaggtacaggagagaaaa

SEQ ID NO: 9719 - DNA, 28 bp, Artificial Sequence
  Synthetic Construct
ggatgtatagggacagttttcctgaaag

SEQ ID NO: 9720 - DNA, 25 bp, Artificial Sequence
  Synthetic Construct
cctgatgcctgtctgatttgaactg

SEQ ID NO: 9721 - DNA, 22 bp, Artificial Sequence
  Synthetic Construct
actcctgggctcaagtaatcct

SEQ ID NO: 9722 - DNA, 20 bp, Artificial Sequence
  Synthetic Construct
actcccagcaccaagtcagt

SEQ ID NO: 9723 - DNA, 22 bp, Artificial Sequence
  Synthetic Construct
agcaatgtgaccagggtgaagt

SEQ ID NO: 9724 - DNA, 28 bp, Artificial Sequence
  Synthetic Construct
ctacagaatttagttgtggggaactaga

SEQ ID NO: 9725 - DNA, 24 bp, Artificial Sequence
  Synthetic Construct
aggaaactgagaactgtcctctct

SEQ ID NO: 9726 - DNA, 29 bp, Artificial Sequence
  Synthetic Construct
tggagtgttcatataccctttgaagataa

SEQ ID NO: 9727 - DNA, 20 bp, Artificial Sequence
  Synthetic Construct
gcgaaaaacacgcccttgat

SEQ ID NO: 9728 - DNA, 28 bp, Artificial Sequence
  Synthetic Construct
agcatttcagtccatagtaaacaagaag

SEQ ID NO: 9729 - DNA, 23 bp, Artificial Sequence
  Synthetic Construct
agccaggtcctttccttcaaagc

SEQ ID NO: 9730 - DNA, 30 bp, Artificial Sequence
  Synthetic Construct
gatttataatgtaaaggcttgctctgtttg

SEQ ID NO: 9731 - DNA, 24 bp, Artificial Sequence
  Synthetic Construct
gctacgaacacaagaaggctttcc

SEQ ID NO: 9732 - DNA, 24 bp, Artificial Sequence
  Synthetic Construct
cccaagtagctggaactataagca

SEQ ID NO: 9733 - DNA, 26 bp, Artificial Sequence
  Synthetic Construct
agtagttacagtcatccctccttacc

SEQ ID NO: 9734 - DNA, 22 bp, Artificial Sequence
  Synthetic Construct
tgtaggacacggggtaggaaat

SEQ ID NO: 9735 - DNA, 22 bp, Artificial Sequence
  Synthetic Construct
gccctaggagtgttaacagctt

SEQ ID NO: 9736 - DNA, 26 bp, Artificial Sequence
  Synthetic Construct
cacaaccagaagatgatatccaggtt

SEQ ID NO: 9737 - DNA, 29 bp, Artificial Sequence
  Synthetic Construct
gcactcaaatctaattaacggctacaaca

SEQ ID NO: 9738 - DNA, 19 bp, Artificial Sequence
  Synthetic Construct
gccaagggtggtgcagtgt

SEQ ID NO: 9739 - DNA, 18 bp, Artificial Sequence
  Synthetic Construct
gccagcctctgccaggta

SEQ ID NO: 9740 - DNA, 20 bp, Artificial Sequence
  Synthetic Construct
gcatgggaagcgaccattgg

SEQ ID NO: 9741 - DNA, 26 bp, Artificial Sequence
  Synthetic Construct
ttccagtaggagttgtgtgaatgtta

SEQ ID NO: 9742 - DNA, 30 bp, Artificial Sequence
  Synthetic Construct
gtcaatcttaacacttcatatgtggagaac

SEQ ID NO: 9743 - DNA, 22 bp, Artificial Sequence
  Synthetic Construct
gaacccaatcccttgcaatggt

SEQ ID NO: 9744 - DNA, 27 bp, Artificial Sequence
  Synthetic Construct
gaaaccctataagctagaagggatcag

SEQ ID NO: 9745 - DNA, 27 bp, Artificial Sequence
  Synthetic Construct
gtttcaggtaaagccctgttactatgt

SEQ ID NO: 9746 - DNA, 25 bp, Artificial Sequence
  Synthetic Construct
gtcttgccttgtttgggtaatacca

SEQ ID NO: 9747 - DNA, 20 bp, Artificial Sequence
  Synthetic Construct
tgctggtggtgggttgatga

SEQ ID NO: 9748 - DNA, 24 bp, Artificial Sequence
  Synthetic Construct
accctctcctgatcccactttacc

SEQ ID NO: 9749 - DNA, 29 bp, Artificial Sequence
  Synthetic Construct
gaagaaatcttaagtccttactgctttgt

SEQ ID NO: 9750 - DNA, 22 bp, Artificial Sequence
  Synthetic Construct
gagggaggtgtcctcatagtct

SEQ ID NO: 9751 - DNA, 20 bp, Artificial Sequence
  Synthetic Construct
ccacgcgatgctgtctcatc

SEQ ID NO: 9752 - DNA, 29 bp, Artificial Sequence
  Synthetic Construct
ggaatctaaaaggaaatactggtggttct

SEQ ID NO: 9753 - DNA, 22 bp, Artificial Sequence
  Synthetic Construct
aacagccctggataaggcaaga

SEQ ID NO: 9754 - DNA, 29 bp, Artificial Sequence
  Synthetic Construct
tgacttaaagtagctatggcagagatatt

SEQ ID NO: 9755 - DNA, 22 bp, Artificial Sequence
  Synthetic Construct
gctccccaaatcagctctagca

SEQ ID NO: 9756 - DNA, 21 bp, Artificial Sequence
  Synthetic Construct
cgtctggtgtggtttgctaga

SEQ ID NO: 9757 - DNA, 23 bp, Artificial Sequence
  Synthetic Construct
tgctaggacctgttgactgaaga

SEQ ID NO: 9758 - DNA, 22 bp, Artificial Sequence
  Synthetic Construct
aagacagcctgagaagcacaga

SEQ ID NO: 9759 - DNA, 26 bp, Artificial Sequence
  Synthetic Construct
caacactagctttttttctccttggt

SEQ ID NO: 9760 - DNA, 20 bp, Artificial Sequence
  Synthetic Construct
tctgtggctgggaggaaacc

SEQ ID NO: 9761 - DNA, 28 bp, Artificial Sequence
  Synthetic Construct
ggtttgaatttacatgcatcaggtgtac

SEQ ID NO: 9762 - DNA, 24 bp, Artificial Sequence
  Synthetic Construct
gacagagggtctcagtatcaagct

SEQ ID NO: 9763 - DNA, 22 bp, Artificial Sequence
  Synthetic Construct
cgtggccattttcctgaaccta

SEQ ID NO: 9764 - DNA, 21 bp, Artificial Sequence
  Synthetic Construct
ctccagctgctctgtcttcag

SEQ ID NO: 9765 - DNA, 30 bp, Artificial Sequence
  Synthetic Construct
agtagaaagctctaggaggtttatattgtg

SEQ ID NO: 9766 - DNA, 20 bp, Artificial Sequence
  Synthetic Construct
ctgccccaagttctgtggat

SEQ ID NO: 9767 - DNA, 27 bp, Artificial Sequence
  Synthetic Construct
gagctttgatgtttgtgagctctattt

SEQ ID NO: 9768 - DNA, 19 bp, Artificial Sequence
  Synthetic Construct
agttgcctggctggtttgg

SEQ ID NO: 9769 - DNA, 18 bp, Artificial Sequence
  Synthetic Construct
agcctctgtggggcatgt

SEQ ID NO: 9770 - DNA, 21 bp, Artificial Sequence
  Synthetic Construct
tgggacacacatctgctagga

SEQ ID NO: 9771 - DNA, 24 bp, Artificial Sequence
  Synthetic Construct
gatctccctgcttctacccttaac

SEQ ID NO: 9772 - DNA, 18 bp, Artificial Sequence
  Synthetic Construct
tacgggctgggacatggt

SEQ ID NO: 9773 - DNA, 19 bp, Artificial Sequence
  Synthetic Construct
tgggtgactgaggctgact

SEQ ID NO: 9774 - DNA, 18 bp, Artificial Sequence
  Synthetic Construct
cagtgcagcccccatgct

SEQ ID NO: 9775 - DNA, 30 bp, Artificial Sequence
  Synthetic Construct
cagactcctctgcttataagaattatacca

SEQ ID NO: 9776 - DNA, 24 bp, Artificial Sequence
  Synthetic Construct
gggtcttggagtagatggtttgga

SEQ ID NO: 9777 - DNA, 23 bp, Artificial Sequence
  Synthetic Construct
atcagcctctctcagaactcaga

SEQ ID NO: 9778 - DNA, 25 bp, Artificial Sequence
  Synthetic Construct
gtcgttggaaatacaaagccactaa

SEQ ID NO: 9779 - DNA, 26 bp, Artificial Sequence
  Synthetic Construct
ctgggcaatcataaagatctcaaggt

SEQ ID NO: 9780 - DNA, 23 bp, Artificial Sequence
  Synthetic Construct
tctcacacattgtttccccaagt

SEQ ID NO: 9781 - DNA, 25 bp, Artificial Sequence
  Synthetic Construct
ggctgggtcactttgatctccttat

SEQ ID NO: 9782 - DNA, 27 bp, Artificial Sequence
  Synthetic Construct
cccacctttcatcttttaccacaagct

SEQ ID NO: 9783 - DNA, 22 bp, Artificial Sequence
  Synthetic Construct
gaaagtggtgatttgccaacca

SEQ ID NO: 9784 - DNA, 30 bp, Artificial Sequence
  Synthetic Construct
ttgattaattaccacacagtgaatacacat

SEQ ID NO: 9785 - DNA, 25 bp, Artificial Sequence
  Synthetic Construct
aaggcaaattctctctctagagcaa

SEQ ID NO: 9786 - DNA, 20 bp, Artificial Sequence
  Synthetic Construct
tgcgatggctcatgcttctg

SEQ ID NO: 9787 - DNA, 22 bp, Artificial Sequence
  Synthetic Construct
gccgccctacagattcctaact

SEQ ID NO: 9788 - DNA, 19 bp, Artificial Sequence
  Synthetic Construct
aagggccagccacctgcaa

SEQ ID NO: 9789 - DNA, 20 bp, Artificial Sequence
  Synthetic Construct
gctcatcggtgcccaaagtc

SEQ ID NO: 9790 - DNA, 22 bp, Artificial Sequence
  Synthetic Construct
gggcaggacgagagaagaaaaa

SEQ ID NO: 9791 - DNA, 25 bp, Artificial Sequence
  Synthetic Construct
gagaaagtgaaatgcgcaaatgtga

SEQ ID NO: 9792 - DNA, 27 bp, Artificial Sequence
  Synthetic Construct
aaattgctgggtaaaacatcgaataca

SEQ ID NO: 9793 - DNA, 22 bp, Artificial Sequence
  Synthetic Construct
tgcccgagaatctcctggtgaa

SEQ ID NO: 9794 - DNA, 27 bp, Artificial Sequence
  Synthetic Construct
aggtcttcaatgtgttgtaatcactga

SEQ ID NO: 9795 - DNA, 26 bp, Artificial Sequence
  Synthetic Construct
gagaaggcccatttttacatcaggaa

SEQ ID NO: 9796 - DNA, 25 bp, Artificial Sequence
  Synthetic Construct
ccatcctgtctccattcatcatggt

SEQ ID NO: 9797 - DNA, 24 bp, Artificial Sequence
  Synthetic Construct
ggaaaaatggatcttgctcatgca

SEQ ID NO: 9798 - DNA, 19 bp, Artificial Sequence
  Synthetic Construct
tgcatgcccaggctgatct

SEQ ID NO: 9799 - DNA, 27 bp, Artificial Sequence
  Synthetic Construct
cccctttttaggtgtgtaatcctaggt

SEQ ID NO: 9800 - DNA, 29 bp, Artificial Sequence
  Synthetic Construct
acaatttaagggtaaaggaaatgcaattg

SEQ ID NO: 9801 - DNA, 25 bp, Artificial Sequence
  Synthetic Construct
cgtgagtaacccttcacttctgatg

SEQ ID NO: 9802 - DNA, 27 bp, Artificial Sequence
  Synthetic Construct
ggtcaatctttatttgcctacctttca

SEQ ID NO: 9803 - DNA, 22 bp, Artificial Sequence
  Synthetic Construct
agcacctgaagaacgcgattga

SEQ ID NO: 9804 - DNA, 29 bp, Artificial Sequence
  Synthetic Construct
ccaatgaaagaagggactatgtagctcat

SEQ ID NO: 9805 - DNA, 29 bp, Artificial Sequence
  Synthetic Construct
ggttgtttagttagcagagacaatgaaac

SEQ ID NO: 9806 - DNA, 25 bp, Artificial Sequence
  Synthetic Construct
gcacttactatcctggcactattct

SEQ ID NO: 9807 - DNA, 20 bp, Artificial Sequence
  Synthetic Construct
gccacaagccatgcaatgca

SEQ ID NO: 9808 - DNA, 22 bp, Artificial Sequence
  Synthetic Construct
tgccattgggagagtggttgat

SEQ ID NO: 9809 - DNA, 24 bp, Artificial Sequence
  Synthetic Construct
agttgaaatgatctctgcccacat

SEQ ID NO: 9810 - DNA, 19 bp, Artificial Sequence
  Synthetic Construct
agtgtgccgcgatcttcct

SEQ ID NO: 9811 - DNA, 21 bp, Artificial Sequence
  Synthetic Construct
gtcagaggccaccatcacttg

SEQ ID NO: 9812 - DNA, 30 bp, Artificial Sequence
  Synthetic Construct
gctttaaaaataagcactgcatttaattgc

SEQ ID NO: 9813 - DNA, 21 bp, Artificial Sequence
  Synthetic Construct
cccagcagagtgtctggaaca

SEQ ID NO: 9814 - DNA, 23 bp, Artificial Sequence
  Synthetic Construct
gtgatgcttccaacaaggctctt

SEQ ID NO: 9815 - DNA, 30 bp, Artificial Sequence
  Synthetic Construct
actcagaattagctaaattttgcattagga

SEQ ID NO: 9816 - DNA, 24 bp, Artificial Sequence
  Synthetic Construct
gtgaccacatgtgatttccttggt

SEQ ID NO: 9817 - DNA, 24 bp, Artificial Sequence
  Synthetic Construct
acgtctgacatctaccttcaggtt

SEQ ID NO: 9818 - DNA, 22 bp, Artificial Sequence
  Synthetic Construct
tgctgtgagcagacactcttag

SEQ ID NO: 9819 - DNA, 22 bp, Artificial Sequence
  Synthetic Construct
agctttcactgtgggccatatt

SEQ ID NO: 9820 - DNA, 26 bp, Artificial Sequence
  Synthetic Construct
gaaaatggtgaggggattaactcagt

SEQ ID NO: 9821 - DNA, 22 bp, Artificial Sequence
  Synthetic Construct
ctgtgtcggaaagggaaacgat

SEQ ID NO: 9822 - DNA, 20 bp, Artificial Sequence
  Synthetic Construct
aggcagagcacagaggactt

SEQ ID NO: 9823 - DNA, 18 bp, Artificial Sequence
  Synthetic Construct
gcccaggctggtcttgca

SEQ ID NO: 9824 - DNA, 24 bp, Artificial Sequence
  Synthetic Construct
acttgactgccctagctaaaaagg

SEQ ID NO: 9825 - DNA, 28 bp, Artificial Sequence
  Synthetic Construct
ggcatcagcatttgtgactaagtttacc

SEQ ID NO: 9826 - DNA, 24 bp, Artificial Sequence
  Synthetic Construct
tccagcttcctctccatcaaaatg

SEQ ID NO: 9827 - DNA, 19 bp, Artificial Sequence
  Synthetic Construct
tgcccatgggtcccaagat

SEQ ID NO: 9828 - DNA, 26 bp, Artificial Sequence
  Synthetic Construct
ccaagatactgtgctctgtactgaga

SEQ ID NO: 9829 - DNA, 21 bp, Artificial Sequence
  Synthetic Construct
atggccacccaagttctcttg

SEQ ID NO: 9830 - DNA, 20 bp, Artificial Sequence
  Synthetic Construct
gcattggtacaggccgttca

SEQ ID NO: 9831 - DNA, 18 bp, Artificial Sequence
  Synthetic Construct
tggcagctcccacacaca

SEQ ID NO: 9832 - DNA, 23 bp, Artificial Sequence
  Synthetic Construct
agtggacatccctgcttatcagt

SEQ ID NO: 9833 - DNA, 24 bp, Artificial Sequence
  Synthetic Construct
ggcagagaacagcaaatgcaaagg

SEQ ID NO: 9834 - DNA, 19 bp, Artificial Sequence
  Synthetic Construct
agggcaggtgtcagcagaa

SEQ ID NO: 9835 - DNA, 23 bp, Artificial Sequence
  Synthetic Construct
tgagtcctagaggagcagtgagt

SEQ ID NO: 9836 - DNA, 23 bp, Artificial Sequence
  Synthetic Construct
gcttgttgctgcaacacagtgat

SEQ ID NO: 9837 - DNA, 27 bp, Artificial Sequence
  Synthetic Construct
gctgagctgttttctcttaaagcaaca

SEQ ID NO: 9838 - DNA, 21 bp, Artificial Sequence
  Synthetic Construct
tttggcctgctccttctgtct

SEQ ID NO: 9839 - DNA, 28 bp, Artificial Sequence
  Synthetic Construct
cagccaaaataggaggattctattctgt

SEQ ID NO: 9840 - DNA, 27 bp, Artificial Sequence
  Synthetic Construct
cactcgacgaaagtgagacattatcag

SEQ ID NO: 9841 - DNA, 22 bp, Artificial Sequence
  Synthetic Construct
gctcccacctattcctgaaggt

SEQ ID NO: 9842 - DNA, 26 bp, Artificial Sequence
  Synthetic Construct
gagtagtgggaaatcattctgatcca

SEQ ID NO: 9843 - DNA, 22 bp, Artificial Sequence
  Synthetic Construct
agtagacggggatggcaataca

SEQ ID NO: 9844 - DNA, 24 bp, Artificial Sequence
  Synthetic Construct
ggatttacccgtgaaagtcaagct

SEQ ID NO: 9845 - DNA, 24 bp, Artificial Sequence
  Synthetic Construct
gttccattggcctatgtggaatct

SEQ ID NO: 9846 - DNA, 19 bp, Artificial Sequence
  Synthetic Construct
tggtgtgggcgcctaaact

SEQ ID NO: 9847 - DNA, 23 bp, Artificial Sequence
  Synthetic Construct
cttcatcccagaagtgacatgca

SEQ ID NO: 9848 - DNA, 19 bp, Artificial Sequence
  Synthetic Construct
gggtcacctcccccgaaac

SEQ ID NO: 9849 - DNA, 21 bp, Artificial Sequence
  Synthetic Construct
agcgtcccgatgagataagga

SEQ ID NO: 9850 - DNA, 25 bp, Artificial Sequence
  Synthetic Construct
gcaagagtacttcagaggtgataca

SEQ ID NO: 9851 - DNA, 18 bp, Artificial Sequence
  Synthetic Construct
agctgcctggcacaagct

SEQ ID NO: 9852 - DNA, 22 bp, Artificial Sequence
  Synthetic Construct
gtcaagaaggtgccttgtggta

SEQ ID NO: 9853 - DNA, 27 bp, Artificial Sequence
  Synthetic Construct
gcacaagttgatctaatgcctatttgg

SEQ ID NO: 9854 - DNA, 22 bp, Artificial Sequence
  Synthetic Construct
gcccatgggttctgctttattg

SEQ ID NO: 9855 - DNA, 25 bp, Artificial Sequence
  Synthetic Construct
cactggtcccctttctacatagttg

SEQ ID NO: 9856 - DNA, 30 bp, Artificial Sequence
  Synthetic Construct
aaatctcatagttcattagtatgcgttgtt

SEQ ID NO: 9857 - DNA, 24 bp, Artificial Sequence
  Synthetic Construct
caccacttccatcatggttcatca

SEQ ID NO: 9858 - DNA, 24 bp, Artificial Sequence
  Synthetic Construct
ggcctgaggaattttggctattca

SEQ ID NO: 9859 - DNA, 26 bp, Artificial Sequence
  Synthetic Construct
caactgttccttactccctcttaacc

SEQ ID NO: 9860 - DNA, 21 bp, Artificial Sequence
  Synthetic Construct
ttgtatgcagccctggttcat

SEQ ID NO: 9861 - DNA, 21 bp, Artificial Sequence
  Synthetic Construct
tcttggccacctgtgaaagac

SEQ ID NO: 9862 - DNA, 27 bp, Artificial Sequence
  Synthetic Construct
cctctactccatcttttcacatgtgaa

SEQ ID NO: 9863 - DNA, 22 bp, Artificial Sequence
  Synthetic Construct
aacaagagtggctggtcaacct

SEQ ID NO: 9864 - DNA, 20 bp, Artificial Sequence
  Synthetic Construct
aagccaccccctcctcttca

SEQ ID NO: 9865 - DNA, 27 bp, Artificial Sequence
  Synthetic Construct
gccaagggtcttttgcttatcttttgg

SEQ ID NO: 9866 - DNA, 26 bp, Artificial Sequence
  Synthetic Construct
gccaatatgaaaagctgctccacaaa

SEQ ID NO: 9867 - DNA, 22 bp, Artificial Sequence
  Synthetic Construct
ctgtgtgggtctcatggagaag

SEQ ID NO: 9868 - DNA, 22 bp, Artificial Sequence
  Synthetic Construct
cacaactcagggccagtcaaat

SEQ ID NO: 9869 - DNA, 25 bp, Artificial Sequence
  Synthetic Construct
ccaggtgccacttcaaatattgaaa

SEQ ID NO: 9870 - DNA, 26 bp, Artificial Sequence
  Synthetic Construct
gcagaaaatgccaaagaaacaatggt

SEQ ID NO: 9871 - DNA, 24 bp, Artificial Sequence
  Synthetic Construct
ccattagacagagattggcactct

SEQ ID NO: 9872 - DNA, 29 bp, Artificial Sequence
  Synthetic Construct
gcccactattaatcttgatgaaacaacac

SEQ ID NO: 9873 - DNA, 27 bp, Artificial Sequence
  Synthetic Construct
cactttttaacattaccctgcagttga

SEQ ID NO: 9874 - DNA, 26 bp, Artificial Sequence
  Synthetic Construct
gaatgtgtgtacatatgggagaggaa

SEQ ID NO: 9875 - DNA, 27 bp, Artificial Sequence
  Synthetic Construct
ggcagaatggaaatacagcaaacagtt

SEQ ID NO: 9876 - DNA, 26 bp, Artificial Sequence
  Synthetic Construct
gagtacgcagcaagtaaaagtaaact

SEQ ID NO: 9877 - DNA, 23 bp, Artificial Sequence
  Synthetic Construct
gtgtgtctgtcttccctctaacc

SEQ ID NO: 9878 - DNA, 27 bp, Artificial Sequence
  Synthetic Construct
caaggatttaccacctctagagatagc

SEQ ID NO: 9879 - DNA, 23 bp, Artificial Sequence
  Synthetic Construct
cagacactgtctgtgagtagcat

SEQ ID NO: 9880 - DNA, 23 bp, Artificial Sequence
  Synthetic Construct
caggacgtttcttcaccacacaa

SEQ ID NO: 9881 - DNA, 26 bp, Artificial Sequence
  Synthetic Construct
tgtatgtgctcaactctatgctgatc

SEQ ID NO: 9882 - DNA, 20 bp, Artificial Sequence
  Synthetic Construct
ggcctggggtcttacatgca

SEQ ID NO: 9883 - DNA, 28 bp, Artificial Sequence
  Synthetic Construct
gagttcgtgaacaaatagagtgtgtaat

SEQ ID NO: 9884 - DNA, 20 bp, Artificial Sequence
  Synthetic Construct
tggggctcaccgctttatgg

SEQ ID NO: 9885 - DNA, 23 bp, Artificial Sequence
  Synthetic Construct
tggaggtgaccgaggaactatac

SEQ ID NO: 9886 - DNA, 19 bp, Artificial Sequence
  Synthetic Construct
gccaagatgccgtctcact

SEQ ID NO: 9887 - DNA, 22 bp, Artificial Sequence
  Synthetic Construct
gactgaaagttgaggggaagca

SEQ ID NO: 9888 - DNA, 25 bp, Artificial Sequence
  Synthetic Construct
tggaatatgaatgtggaggggatga

SEQ ID NO: 9889 - DNA, 24 bp, Artificial Sequence
  Synthetic Construct
ttcctccccaggttaatgagtagt

SEQ ID NO: 9890 - DNA, 22 bp, Artificial Sequence
  Synthetic Construct
gctctgggcttcattcatcaca

SEQ ID NO: 9891 - DNA, 22 bp, Artificial Sequence
  Synthetic Construct
cccttcccttctcacagatgac

SEQ ID NO: 9892 - DNA, 25 bp, Artificial Sequence
  Synthetic Construct
gcaagtctcccatcaagagtttaga

SEQ ID NO: 9893 - DNA, 30 bp, Artificial Sequence
  Synthetic Construct
gaccatcaataggggattctttaattaagc

SEQ ID NO: 9894 - DNA, 25 bp, Artificial Sequence
  Synthetic Construct
gcagaattcacagggcgtttttgtc

SEQ ID NO: 9895 - DNA, 26 bp, Artificial Sequence
  Synthetic Construct
tcccataatgagtcaggtgttctatg

SEQ ID NO: 9896 - DNA, 25 bp, Artificial Sequence
  Synthetic Construct
tctgtagaattcctccaccatcttg

SEQ ID NO: 9897 - DNA, 24 bp, Artificial Sequence
  Synthetic Construct
gctcctgacttattgcctcaaacc

SEQ ID NO: 9898 - DNA, 21 bp, Artificial Sequence
  Synthetic Construct
tctcccttcgctggagattga

SEQ ID NO: 9899 - DNA, 25 bp, Artificial Sequence
  Synthetic Construct
ccttcaaatttcttgccatcaccat

SEQ ID NO: 9900 - DNA, 22 bp, Artificial Sequence
  Synthetic Construct
aggacacagaccatgggcttaa

SEQ ID NO: 9901 - DNA, 24 bp, Artificial Sequence
  Synthetic Construct
agcactacgtgactgtcagaatcc

SEQ ID NO: 9902 - DNA, 20 bp, Artificial Sequence
  Synthetic Construct
acacgccctctacctttcca

SEQ ID NO: 9903 - DNA, 22 bp, Artificial Sequence
  Synthetic Construct
gagcctggctacaacatagtgt

SEQ ID NO: 9904 - DNA, 20 bp, Artificial Sequence
  Synthetic Construct
agggctgaccggtgagttca

SEQ ID NO: 9905 - DNA, 28 bp, Artificial Sequence
  Synthetic Construct
cctggagttaaatctcatctcagactgt

SEQ ID NO: 9906 - DNA, 28 bp, Artificial Sequence
  Synthetic Construct
tcacattgaaatagtgacaacacaactt

SEQ ID NO: 9907 - DNA, 23 bp, Artificial Sequence
  Synthetic Construct
gcagtcgggcagtaagaaatttc

SEQ ID NO: 9908 - DNA, 19 bp, Artificial Sequence
  Synthetic Construct
aggccctgtgtccgaaaga

SEQ ID NO: 9909 - DNA, 19 bp, Artificial Sequence
  Synthetic Construct
aggaaaggaggcggaacca

SEQ ID NO: 9910 - DNA, 22 bp, Artificial Sequence
  Synthetic Construct
gcatgacgttggcacatcactt

SEQ ID NO: 9911 - DNA, 25 bp, Artificial Sequence
  Synthetic Construct
ctctcatcgcaccattgtcttatgg

SEQ ID NO: 9912 - DNA, 26 bp, Artificial Sequence
  Synthetic Construct
gctgctaacagaatcctttctaagca

SEQ ID NO: 9913 - DNA, 28 bp, Artificial Sequence
  Synthetic Construct
cacaagccctaatataacactcttcttg

SEQ ID NO: 9914 - DNA, 20 bp, Artificial Sequence
  Synthetic Construct
atgagccaggcatcctgctt

SEQ ID NO: 9915 - DNA, 18 bp, Artificial Sequence
  Synthetic Construct
tctgtggacccgctgcat

SEQ ID NO: 9916 - DNA, 25 bp, Artificial Sequence
  Synthetic Construct
ctcccaatgtcagttaagcaagtgt

SEQ ID NO: 9917 - DNA, 29 bp, Artificial Sequence
  Synthetic Construct
ctctctctctctgaattttgatgttacct

SEQ ID NO: 9918 - DNA, 23 bp, Artificial Sequence
  Synthetic Construct
gcattcagatgggacctgggtaa

SEQ ID NO: 9919 - DNA, 27 bp, Artificial Sequence
  Synthetic Construct
gttggcatccagatatacagacaaagt

SEQ ID NO: 9920 - DNA, 22 bp, Artificial Sequence
  Synthetic Construct
ggcaaagaacagagagcagtga

SEQ ID NO: 9921 - DNA, 25 bp, Artificial Sequence
  Synthetic Construct
cttctgccatcttagttgtgtgagt

SEQ ID NO: 9922 - DNA, 27 bp, Artificial Sequence
  Synthetic Construct
gcaacaaaacaagtctagatcctgact

SEQ ID NO: 9923 - DNA, 21 bp, Artificial Sequence
  Synthetic Construct
tgggcctctattgctccacaa

SEQ ID NO: 9924 - DNA, 27 bp, Artificial Sequence
  Synthetic Construct
ccacttttcctgaaatacctagatcct

SEQ ID NO: 9925 - DNA, 21 bp, Artificial Sequence
  Synthetic Construct
ccacaggatggctgagaggat

SEQ ID NO: 9926 - DNA, 24 bp, Artificial Sequence
  Synthetic Construct
gtcatccttcattgggtgaatggt

SEQ ID NO: 9927 - DNA, 22 bp, Artificial Sequence
  Synthetic Construct
ttccagcatcgtgggagcattt

SEQ ID NO: 9928 - DNA, 26 bp, Artificial Sequence
  Synthetic Construct
ccttacctctctgctatcacttatgc

SEQ ID NO: 9929 - DNA, 22 bp, Artificial Sequence
  Synthetic Construct
tctcaggacaccatgggaatga

SEQ ID NO: 9930 - DNA, 21 bp, Artificial Sequence
  Synthetic Construct
actgcaggggtttcacttgtg

SEQ ID NO: 9931 - DNA, 26 bp, Artificial Sequence
  Synthetic Construct
gcatgcctgcaatcctaagtattcag

SEQ ID NO: 9932 - DNA, 29 bp, Artificial Sequence
  Synthetic Construct
gcctcaggacttaggtatgatttttagca

SEQ ID NO: 9933 - DNA, 28 bp, Artificial Sequence
  Synthetic Construct
catcaagatgatctttgatgtggaaagt

SEQ ID NO: 9934 - DNA, 22 bp, Artificial Sequence
  Synthetic Construct
ccagctgttgagagtgttgact

SEQ ID NO: 9935 - DNA, 21 bp, Artificial Sequence
  Synthetic Construct
aggtgagctggggagacttag

SEQ ID NO: 9936 - DNA, 26 bp, Artificial Sequence
  Synthetic Construct
ggaaccatgatgagctgaagttcttg

SEQ ID NO: 9937 - DNA, 22 bp, Artificial Sequence
  Synthetic Construct
gcactggcaaaactcaggaaga

SEQ ID NO: 9938 - DNA, 25 bp, Artificial Sequence
  Synthetic Construct
gcagagcctaaaatatttgctgtct

SEQ ID NO: 9939 - DNA, 24 bp, Artificial Sequence
  Synthetic Construct
cagattcacaggcatggtcagaag

SEQ ID NO: 9940 - DNA, 23 bp, Artificial Sequence
  Synthetic Construct
gcttccagaggattccagatgtc

SEQ ID NO: 9941 - DNA, 20 bp, Artificial Sequence
  Synthetic Construct
aggggtgcttggctccatct

SEQ ID NO: 9942 - DNA, 25 bp, Artificial Sequence
  Synthetic Construct
acccagagttaaagccaaaataggt

SEQ ID NO: 9943 - DNA, 22 bp, Artificial Sequence
  Synthetic Construct
ctttgtgactccaagccttcca

SEQ ID NO: 9944 - DNA, 22 bp, Artificial Sequence
  Synthetic Construct
gtggaaggactcaacacccaat

SEQ ID NO: 9945 - DNA, 22 bp, Artificial Sequence
  Synthetic Construct
ctgcttccagtgctctaagtga

SEQ ID NO: 9946 - DNA, 25 bp, Artificial Sequence
  Synthetic Construct
gttgatgaacctgttaatgcacgta

SEQ ID NO: 9947 - DNA, 24 bp, Artificial Sequence
  Synthetic Construct
cagtctgttgcactacaaggtaga

SEQ ID NO: 9948 - DNA, 22 bp, Artificial Sequence
  Synthetic Construct
agtgttaggacaagggcttgag

SEQ ID NO: 9949 - DNA, 21 bp, Artificial Sequence
  Synthetic Construct
tgtgggacctcgtggatttgt

SEQ ID NO: 9950 - DNA, 27 bp, Artificial Sequence
  Synthetic Construct
gactttgaccagcactatactgtaaca

SEQ ID NO: 9951 - DNA, 25 bp, Artificial Sequence
  Synthetic Construct
gccatcacagttgtccttaatatgc

SEQ ID NO: 9952 - DNA, 22 bp, Artificial Sequence
  Synthetic Construct
gcagaatccagccctctcattt

SEQ ID NO: 9953 - DNA, 26 bp, Artificial Sequence
  Synthetic Construct
ctgggatttctgaacttatgctgaga

SEQ ID NO: 9954 - DNA, 24 bp, Artificial Sequence
  Synthetic Construct
gccctttggtttgcaaagaaaaca

SEQ ID NO: 9955 - DNA, 22 bp, Artificial Sequence
  Synthetic Construct
tgcccacaacctctgactaagt

SEQ ID NO: 9956 - DNA, 22 bp, Artificial Sequence
  Synthetic Construct
gtggggaagggataaggtagga

SEQ ID NO: 9957 - DNA, 30 bp, Artificial Sequence
  Synthetic Construct
gatgcatagaaatgtcccaaatatttctga

SEQ ID NO: 9958 - DNA, 24 bp, Artificial Sequence
  Synthetic Construct
agcccagatacttgtcccatcaac

SEQ ID NO: 9959 - DNA, 30 bp, Artificial Sequence
  Synthetic Construct
tgagcatcaaagagtagttttcaatatgac

SEQ ID NO: 9960 - DNA, 27 bp, Artificial Sequence
  Synthetic Construct
tgacaaaaatccaaggttcttttcact

SEQ ID NO: 9961 - DNA, 27 bp, Artificial Sequence
  Synthetic Construct
gcccagtattgaacttctcccttagga

SEQ ID NO: 9962 - DNA, 25 bp, Artificial Sequence
  Synthetic Construct
tctacccctgatgtaacttggctat

SEQ ID NO: 9963 - DNA, 21 bp, Artificial Sequence
  Synthetic Construct
agagcttccctacacctgctt

SEQ ID NO: 9964 - DNA, 23 bp, Artificial Sequence
  Synthetic Construct
attctggaaccaactctgcgtat

SEQ ID NO: 9965 - DNA, 20 bp, Artificial Sequence
  Synthetic Construct
cctgaaggggtgctctgtga

SEQ ID NO: 9966 - DNA, 25 bp, Artificial Sequence
  Synthetic Construct
cagagaagtcactcttggggactat

SEQ ID NO: 9967 - DNA, 22 bp, Artificial Sequence
  Synthetic Construct
tccacacccaaggaccatatgt

SEQ ID NO: 9968 - DNA, 29 bp, Artificial Sequence
  Synthetic Construct
ggaaataataaatgataagggcctgaaca

SEQ ID NO: 9969 - DNA, 22 bp, Artificial Sequence
  Synthetic Construct
gaagcttccccacccactaaaa

SEQ ID NO: 9970 - DNA, 27 bp, Artificial Sequence
  Synthetic Construct
ggaataaatcagcaaacatgccttgga

SEQ ID NO: 9971 - DNA, 19 bp, Artificial Sequence
  Synthetic Construct
tgcatgggcacgtggttgt

SEQ ID NO: 9972 - DNA, 25 bp, Artificial Sequence
  Synthetic Construct
gctactccattcacagttctctgtt

SEQ ID NO: 9973 - DNA, 22 bp, Artificial Sequence
  Synthetic Construct
tgaggaaggcatgaaggaacct

SEQ ID NO: 9974 - DNA, 24 bp, Artificial Sequence
  Synthetic Construct
ggggtcagagaattgagttatgct

SEQ ID NO: 9975 - DNA, 28 bp, Artificial Sequence
  Synthetic Construct
ccagggcacaagatcttatttttatcac

SEQ ID NO: 9976 - DNA, 22 bp, Artificial Sequence
  Synthetic Construct
ggcaaagaagtcaaggctcctt

SEQ ID NO: 9977 - DNA, 23 bp, Artificial Sequence
  Synthetic Construct
agcctctcccttggtgtttaagc

SEQ ID NO: 9978 - DNA, 24 bp, Artificial Sequence
  Synthetic Construct
gagctatgtataggacgccacttt

SEQ ID NO: 9979 - DNA, 24 bp, Artificial Sequence
  Synthetic Construct
ccttgtggatgacaggagtttcct

SEQ ID NO: 9980 - DNA, 24 bp, Artificial Sequence
  Synthetic Construct
gcatgactgagactggatgttcca

SEQ ID NO: 9981 - DNA, 22 bp, Artificial Sequence
  Synthetic Construct
ccatccccaagctcttttgtgt

SEQ ID NO: 9982 - DNA, 25 bp, Artificial Sequence
  Synthetic Construct
ctggcttgctatgctgttttattgt

SEQ ID NO: 9983 - DNA, 30 bp, Artificial Sequence
  Synthetic Construct
agcaaggcagttattaattgtttaggatta

SEQ ID NO: 9984 - DNA, 29 bp, Artificial Sequence
  Synthetic Construct
cctccaggtagagattctaagtagacaga

SEQ ID NO: 9985 - DNA, 22 bp, Artificial Sequence
  Synthetic Construct
tctcccatccaccatctttgca

SEQ ID NO: 9986 - DNA, 24 bp, Artificial Sequence
  Synthetic Construct
ggagatggaaagcaacccacagaa

SEQ ID NO: 9987 - DNA, 19 bp, Artificial Sequence
  Synthetic Construct
cctcccagctgccttcaca

SEQ ID NO: 9988 - DNA, 22 bp, Artificial Sequence
  Synthetic Construct
gcttcaggccagtagtttgaga

SEQ ID NO: 9989 - DNA, 18 bp, Artificial Sequence
  Synthetic Construct
tggatggcagggcatgga

SEQ ID NO: 9990 - DNA, 25 bp, Artificial Sequence
  Synthetic Construct
tggtcaagaagtcctctttctatgg

SEQ ID NO: 9991 - DNA, 24 bp, Artificial Sequence
  Synthetic Construct
agggaagggagtactcaagctatg

SEQ ID NO: 9992 - DNA, 27 bp, Artificial Sequence
  Synthetic Construct
aaatgttcaggtttctcccatcatttt

SEQ ID NO: 9993 - DNA, 20 bp, Artificial Sequence
  Synthetic Construct
tgcgtcaggactgagaacct

SEQ ID NO: 9994 - DNA, 22 bp, Artificial Sequence
  Synthetic Construct
ggcagatggcttgatgactgtt

SEQ ID NO: 9995 - DNA, 27 bp, Artificial Sequence
  Synthetic Construct
cctctaacatctattacctgcattggt

SEQ ID NO: 9996 - DNA, 24 bp, Artificial Sequence
  Synthetic Construct
ctctagtctccacttctccagaga

SEQ ID NO: 9997 - DNA, 20 bp, Artificial Sequence
  Synthetic Construct
tcaacaagccaggcatccat

SEQ ID NO: 9998 - DNA, 26 bp, Artificial Sequence
  Synthetic Construct
ggtacctgttcatcaaaacctgtttc

SEQ ID NO: 9999 - DNA, 22 bp, Artificial Sequence
  Synthetic Construct
acacagagcatcctccctactc

SEQ ID NO: 10000 - DNA, 28 bp, Artificial Sequence
  Synthetic Construct
cccctcacctaatttttcactgttgttg

SEQ ID NO: 10001 - DNA, 29 bp, Artificial Sequence
  Synthetic Construct
ccttcatctttgggataaaatctaagctt

SEQ ID NO: 10002 - DNA, 22 bp, Artificial Sequence
  Synthetic Construct
cctagctctgtctgctgagaga

SEQ ID NO: 10003 - DNA, 25 bp, Artificial Sequence
  Synthetic Construct
gggtttgcctcatcttacttttcaa

SEQ ID NO: 10004 - DNA, 24 bp, Artificial Sequence
  Synthetic Construct
tggccacattttctatttgtgcat

SEQ ID NO: 10005 - DNA, 21 bp, Artificial Sequence
  Synthetic Construct
gctgtgtccatgcctgtggta

SEQ ID NO: 10006 - DNA, 23 bp, Artificial Sequence
  Synthetic Construct
ggcaaagcaaatgcgtcttttcc

SEQ ID NO: 10007 - DNA, 28 bp, Artificial Sequence
  Synthetic Construct
gcaatcattcatatactcagcgaacatg

SEQ ID NO: 10008 - DNA, 25 bp, Artificial Sequence
  Synthetic Construct
tcccacaaggtctaaaatgattgga

SEQ ID NO: 10009 - DNA, 25 bp, Artificial Sequence
  Synthetic Construct
gcctggctatcactcatgtttcttt

SEQ ID NO: 10010 - DNA, 21 bp, Artificial Sequence
  Synthetic Construct
tgttgtcaagccctccacatt

SEQ ID NO: 10011 - DNA, 24 bp, Artificial Sequence
  Synthetic Construct
tcctgaattgcattctctggttct

SEQ ID NO: 10012 - DNA, 20 bp, Artificial Sequence
  Synthetic Construct
agctgagaaggctccacact

SEQ ID NO: 10013 - DNA, 20 bp, Artificial Sequence
  Synthetic Construct
aggcccagcttagctcttca

SEQ ID NO: 10014 - DNA, 23 bp, Artificial Sequence
  Synthetic Construct
tggcataggtgtttctgcaaatg

SEQ ID NO: 10015 - DNA, 26 bp, Artificial Sequence
  Synthetic Construct
gcctcacattgttcactctggtctac

SEQ ID NO: 10016 - DNA, 26 bp, Artificial Sequence
  Synthetic Construct
ggcaagttggtagcagaatatttgag

SEQ ID NO: 10017 - DNA, 29 bp, Artificial Sequence
  Synthetic Construct
gggtatttctttaacgacaaattccttga

SEQ ID NO: 10018 - DNA, 26 bp, Artificial Sequence
  Synthetic Construct
gtgacagacactgaattctggcaatt

SEQ ID NO: 10019 - DNA, 22 bp, Artificial Sequence
  Synthetic Construct
acgtagagggctcttgagtttg

SEQ ID NO: 10020 - DNA, 22 bp, Artificial Sequence
  Synthetic Construct
tgaggagtcagagccaaagaca

SEQ ID NO: 10021 - DNA, 26 bp, Artificial Sequence
  Synthetic Construct
agggagtgaaattatgagtgcttttg

SEQ ID NO: 10022 - DNA, 24 bp, Artificial Sequence
  Synthetic Construct
ggatgggcttacacactttactgt

SEQ ID NO: 10023 - DNA, 22 bp, Artificial Sequence
  Synthetic Construct
ggatttgccagcctctttctct

SEQ ID NO: 10024 - DNA, 24 bp, Artificial Sequence
  Synthetic Construct
gcggtgtgattaatgtgggaatcc

SEQ ID NO: 10025 - DNA, 26 bp, Artificial Sequence
  Synthetic Construct
gctatttcaataacacctggcaggaa

SEQ ID NO: 10026 - DNA, 22 bp, Artificial Sequence
  Synthetic Construct
cagggctactgctcaccaaata

SEQ ID NO: 10027 - DNA, 21 bp, Artificial Sequence
  Synthetic Construct
tctttcagcctccgtctccta

SEQ ID NO: 10028 - DNA, 18 bp, Artificial Sequence
  Synthetic Construct
gaccagggcccacaccat

SEQ ID NO: 10029 - DNA, 23 bp, Artificial Sequence
  Synthetic Construct
tcggcagttcagtacatgtgatg

SEQ ID NO: 10030 - DNA, 21 bp, Artificial Sequence
  Synthetic Construct
ggccgttttgagctacaactg

SEQ ID NO: 10031 - DNA, 23 bp, Artificial Sequence
  Synthetic Construct
gtcagcaaacatccagtgacctt

SEQ ID NO: 10032 - DNA, 26 bp, Artificial Sequence
  Synthetic Construct
gttttaaagtgatgccctctttcaga

SEQ ID NO: 10033 - DNA, 27 bp, Artificial Sequence
  Synthetic Construct
gcacttttacaaaatttcacccagttt

SEQ ID NO: 10034 - DNA, 21 bp, Artificial Sequence
  Synthetic Construct
tgccagcaccctctactttcc

SEQ ID NO: 10035 - DNA, 26 bp, Artificial Sequence
  Synthetic Construct
gcttacattccctgtgatgctcttag

SEQ ID NO: 10036 - DNA, 22 bp, Artificial Sequence
  Synthetic Construct
accccacccaaaacattcaact

SEQ ID NO: 10037 - DNA, 18 bp, Artificial Sequence
  Synthetic Construct
ccggtacccacccagctt

SEQ ID NO: 10038 - DNA, 26 bp, Artificial Sequence
  Synthetic Construct
gaggtggagaccctatagcctttatc

SEQ ID NO: 10039 - DNA, 24 bp, Artificial Sequence
  Synthetic Construct
ggaaagggcctactgacttctttc

SEQ ID NO: 10040 - DNA, 18 bp, Artificial Sequence
  Synthetic Construct
agcgaggcgggtgacgtt

SEQ ID NO: 10041 - DNA, 22 bp, Artificial Sequence
  Synthetic Construct
agccctgagtcagatgcctatt

SEQ ID NO: 10042 - DNA, 28 bp, Artificial Sequence
  Synthetic Construct
aaaataaccactggcaacttataaagct

SEQ ID NO: 10043 - DNA, 24 bp, Artificial Sequence
  Synthetic Construct
cagcacaggtaatcagttccatga

SEQ ID NO: 10044 - DNA, 24 bp, Artificial Sequence
  Synthetic Construct
ggaagagtgggaaggactttgtct

SEQ ID NO: 10045 - DNA, 20 bp, Artificial Sequence
  Synthetic Construct
ctgctgaagctcaggggttt

SEQ ID NO: 10046 - DNA, 24 bp, Artificial Sequence
  Synthetic Construct
ccctactttcctacaccctcattc

SEQ ID NO: 10047 - DNA, 27 bp, Artificial Sequence
  Synthetic Construct
ccatttgcaagaatcaaggagatttcc

SEQ ID NO: 10048 - DNA, 24 bp, Artificial Sequence
  Synthetic Construct
tgcctttgcctgtgttcttattca

SEQ ID NO: 10049 - DNA, 30 bp, Artificial Sequence
  Synthetic Construct
cctgtcttctcttttctaggtttggatgat

SEQ ID NO: 10050 - DNA, 24 bp, Artificial Sequence
  Synthetic Construct
tccttcctcacccttcactcttct

SEQ ID NO: 10051 - DNA, 30 bp, Artificial Sequence
  Synthetic Construct
ccttagcagctatattctataacgtcaaac

SEQ ID NO: 10052 - DNA, 23 bp, Artificial Sequence
  Synthetic Construct
tggtagagacacatctccaacca

SEQ ID NO: 10053 - DNA, 22 bp, Artificial Sequence
  Synthetic Construct
ccttggaaaagccagttttgct

SEQ ID NO: 10054 - DNA, 26 bp, Artificial Sequence
  Synthetic Construct
cctactgattgtggatgtgatgtttc

SEQ ID NO: 10055 - DNA, 24 bp, Artificial Sequence
  Synthetic Construct
catgactcagattctgcccatcaa

SEQ ID NO: 10056 - DNA, 19 bp, Artificial Sequence
  Synthetic Construct
agtgccagcacctgtagga

SEQ ID NO: 10057 - DNA, 25 bp, Artificial Sequence
  Synthetic Construct
gggacagggatcaatcataacatct

SEQ ID NO: 10058 - DNA, 28 bp, Artificial Sequence
  Synthetic Construct
ctcttggtgaaactgaaatcctattgag

SEQ ID NO: 10059 - DNA, 22 bp, Artificial Sequence
  Synthetic Construct
gcctgagagcttgcattcctaa

SEQ ID NO: 10060 - DNA, 19 bp, Artificial Sequence
  Synthetic Construct
tgggctcagcctccatcac

SEQ ID NO: 10061 - DNA, 27 bp, Artificial Sequence
  Synthetic Construct
gtttcctatccctcagtgatgatacat

SEQ ID NO: 10062 - DNA, 29 bp, Artificial Sequence
  Synthetic Construct
caagctatggtgaatgagttagtaaagtt

SEQ ID NO: 10063 - DNA, 28 bp, Artificial Sequence
  Synthetic Construct
agagatctgactcgtagaagaaagaaag

SEQ ID NO: 10064 - DNA, 24 bp, Artificial Sequence
  Synthetic Construct
gggagaagaatgatgggagacagt

SEQ ID NO: 10065 - DNA, 22 bp, Artificial Sequence
  Synthetic Construct
cacattcccctcaaggtgacat

SEQ ID NO: 10066 - DNA, 24 bp, Artificial Sequence
  Synthetic Construct
ccattacatccctgctaggtagga

SEQ ID NO: 10067 - DNA, 27 bp, Artificial Sequence
  Synthetic Construct
ggtataggagaagcttggagtctctct

SEQ ID NO: 10068 - DNA, 29 bp, Artificial Sequence
  Synthetic Construct
cccagtggctaggtttttattatgttctg

SEQ ID NO: 10069 - DNA, 21 bp, Artificial Sequence
  Synthetic Construct
gtgacagctgagccactagac

SEQ ID NO: 10070 - DNA, 21 bp, Artificial Sequence
  Synthetic Construct
cctgagctccctgtgtaagga

SEQ ID NO: 10071 - DNA, 25 bp, Artificial Sequence
  Synthetic Construct
gtggctatacattggccttatcaca

SEQ ID NO: 10072 - DNA, 29 bp, Artificial Sequence
  Synthetic Construct
cttaagttcatacctgagagtgtacttgt

SEQ ID NO: 10073 - DNA, 18 bp, Artificial Sequence
  Synthetic Construct
ctgcacccccagctgatg

SEQ ID NO: 10074 - DNA, 28 bp, Artificial Sequence
  Synthetic Construct
ctggaaaggtaagagaaaaaagcacttt

SEQ ID NO: 10075 - DNA, 29 bp, Artificial Sequence
  Synthetic Construct
ggctattacctatctcccagtagaacaaa

SEQ ID NO: 10076 - DNA, 19 bp, Artificial Sequence
  Synthetic Construct
aagggcctgtgagctcact

SEQ ID NO: 10077 - DNA, 22 bp, Artificial Sequence
  Synthetic Construct
ccaagccagtatcccatgtgaa

SEQ ID NO: 10078 - DNA, 29 bp, Artificial Sequence
  Synthetic Construct
cttttctctcacataccttaatggatagc

SEQ ID NO: 10079 - DNA, 28 bp, Artificial Sequence
  Synthetic Construct
ctgagaagcgtaaaaaaacctttaacct

SEQ ID NO: 10080 - DNA, 21 bp, Artificial Sequence
  Synthetic Construct
acctcacacctggaccatcaa

SEQ ID NO: 10081 - DNA, 21 bp, Artificial Sequence
  Synthetic Construct
tgcatggaaagggggctacct

SEQ ID NO: 10082 - DNA, 27 bp, Artificial Sequence
  Synthetic Construct
catgctccatgatccttacagcaagga

SEQ ID NO: 10083 - DNA, 26 bp, Artificial Sequence
  Synthetic Construct
gggtctggagatactgtagcaaatct

SEQ ID NO: 10084 - DNA, 24 bp, Artificial Sequence
  Synthetic Construct
acctcctgttctttctgtgttcag

SEQ ID NO: 10085 - DNA, 24 bp, Artificial Sequence
  Synthetic Construct
gctctgttttaccacggtgctttc

SEQ ID NO: 10086 - DNA, 24 bp, Artificial Sequence
  Synthetic Construct
agctaaagtgctgtccacaataca

SEQ ID NO: 10087 - DNA, 24 bp, Artificial Sequence
  Synthetic Construct
actcatttgtgcttgaaggttcca

SEQ ID NO: 10088 - DNA, 20 bp, Artificial Sequence
  Synthetic Construct
ggtgtcctcactcggtctca

SEQ ID NO: 10089 - DNA, 29 bp, Artificial Sequence
  Synthetic Construct
ccttgataacacaaagttgccaataaaat

SEQ ID NO: 10090 - DNA, 22 bp, Artificial Sequence
  Synthetic Construct
gaaggagacggagcaagatcag

SEQ ID NO: 10091 - DNA, 22 bp, Artificial Sequence
  Synthetic Construct
aacaaggcagcagtctctatgg

SEQ ID NO: 10092 - DNA, 26 bp, Artificial Sequence
  Synthetic Construct
ccttgccatttaccttgtatttgact

SEQ ID NO: 10093 - DNA, 22 bp, Artificial Sequence
  Synthetic Construct
gctaccatgcccagtcaagtct

SEQ ID NO: 10094 - DNA, 23 bp, Artificial Sequence
  Synthetic Construct
gtttcccatttggaggtgaggaa

SEQ ID NO: 10095 - DNA, 23 bp, Artificial Sequence
  Synthetic Construct
ggcaaaacccaaatggacgatga

SEQ ID NO: 10096 - DNA, 23 bp, Artificial Sequence
  Synthetic Construct
ccacactcaggattcttggaaca

SEQ ID NO: 10097 - DNA, 25 bp, Artificial Sequence
  Synthetic Construct
aatttgtgacaggcatatgcacaat

SEQ ID NO: 10098 - DNA, 27 bp, Artificial Sequence
  Synthetic Construct
gtttgtgtctgcaatgattatgcaaaa

SEQ ID NO: 10099 - DNA, 22 bp, Artificial Sequence
  Synthetic Construct
caactccatgagctcagctgta

SEQ ID NO: 10100 - DNA, 28 bp, Artificial Sequence
  Synthetic Construct
tgcatatatcttgcagtaacttcccatt

SEQ ID NO: 10101 - DNA, 27 bp, Artificial Sequence
  Synthetic Construct
cccagaaggcttccaatttgaacaata

SEQ ID NO: 10102 - DNA, 25 bp, Artificial Sequence
  Synthetic Construct
ttccatggccttggagaaaaataac

SEQ ID NO: 10103 - DNA, 25 bp, Artificial Sequence
  Synthetic Construct
ggagggaaaactgaggaagtagatg

SEQ ID NO: 10104 - DNA, 23 bp, Artificial Sequence
  Synthetic Construct
gcactaacctgctttaggaatgc

SEQ ID NO: 10105 - DNA, 23 bp, Artificial Sequence
  Synthetic Construct
tctccaaactcttcccctaggtt

SEQ ID NO: 10106 - DNA, 26 bp, Artificial Sequence
  Synthetic Construct
ggccatttttttcccctctagaaacc

SEQ ID NO: 10107 - DNA, 30 bp, Artificial Sequence
  Synthetic Construct
gtatggataaataaatgaagggtccaatgg

SEQ ID NO: 10108 - DNA, 23 bp, Artificial Sequence
  Synthetic Construct
agctccctcagggactaagttct

SEQ ID NO: 10109 - DNA, 22 bp, Artificial Sequence
  Synthetic Construct
ctgtttgtcacagtgggaagga

SEQ ID NO: 10110 - DNA, 21 bp, Artificial Sequence
  Synthetic Construct
ctctcccactgctctgttctg

SEQ ID NO: 10111 - DNA, 19 bp, Artificial Sequence
  Synthetic Construct
gggcatggggtcacttgga

SEQ ID NO: 10112 - DNA, 26 bp, Artificial Sequence
  Synthetic Construct
gaaagtttccagtttgctagcttgta

SEQ ID NO: 10113 - DNA, 23 bp, Artificial Sequence
  Synthetic Construct
tctggacttcaggcttggactag

SEQ ID NO: 10114 - DNA, 23 bp, Artificial Sequence
  Synthetic Construct
ccactgaatagggggaaaatggt

SEQ ID NO: 10115 - DNA, 22 bp, Artificial Sequence
  Synthetic Construct
gcttagaccaaccagctatgct

SEQ ID NO: 10116 - DNA, 24 bp, Artificial Sequence
  Synthetic Construct
ccactgcaagagagatggttccta

SEQ ID NO: 10117 - DNA, 30 bp, Artificial Sequence
  Synthetic Construct
tttacaaagttaagagagctttctgttgat

SEQ ID NO: 10118 - DNA, 24 bp, Artificial Sequence
  Synthetic Construct
tttccaagaagagccacaatacct

SEQ ID NO: 10119 - DNA, 23 bp, Artificial Sequence
  Synthetic Construct
tccacatgcaagagaaagaagct

SEQ ID NO: 10120 - DNA, 22 bp, Artificial Sequence
  Synthetic Construct
tgaggtactatcaggccatcgt

SEQ ID NO: 10121 - DNA, 27 bp, Artificial Sequence
  Synthetic Construct
gccctaggaatattggaaaacccttca

SEQ ID NO: 10122 - DNA, 24 bp, Artificial Sequence
  Synthetic Construct
gcctgtgttctcacctgtgaaatg

SEQ ID NO: 10123 - DNA, 24 bp, Artificial Sequence
  Synthetic Construct
ggcccatgtagtgcttgacttttg

SEQ ID NO: 10124 - DNA, 24 bp, Artificial Sequence
  Synthetic Construct
cacccacttccatacagtgttgag

SEQ ID NO: 10125 - DNA, 22 bp, Artificial Sequence
  Synthetic Construct
aggccagagttggggaattaca

SEQ ID NO: 10126 - DNA, 22 bp, Artificial Sequence
  Synthetic Construct
cttgactttggcattgcatcca

SEQ ID NO: 10127 - DNA, 26 bp, Artificial Sequence
  Synthetic Construct
catgagctctttctagtgaacagtgt

SEQ ID NO: 10128 - DNA, 18 bp, Artificial Sequence
  Synthetic Construct
gccagcgctcctctctca

SEQ ID NO: 10129 - DNA, 22 bp, Artificial Sequence
  Synthetic Construct
acgcttctaacagcctcttctc

SEQ ID NO: 10130 - DNA, 23 bp, Artificial Sequence
  Synthetic Construct
aggagaagagtccagtctgtctt

SEQ ID NO: 10131 - DNA, 25 bp, Artificial Sequence
  Synthetic Construct
cacagttgagtcgtcttctcttctc

SEQ ID NO: 10132 - DNA, 23 bp, Artificial Sequence
  Synthetic Construct
acccgagctctatccccatatgg

SEQ ID NO: 10133 - DNA, 22 bp, Artificial Sequence
  Synthetic Construct
ctccaccttccccttgacattt

SEQ ID NO: 10134 - DNA, 21 bp, Artificial Sequence
  Synthetic Construct
tgcaggctccagcagctagta

SEQ ID NO: 10135 - DNA, 22 bp, Artificial Sequence
  Synthetic Construct
ttggccaggaattctccttcct

SEQ ID NO: 10136 - DNA, 27 bp, Artificial Sequence
  Synthetic Construct
gtgcaagaggatcgtattacattgaca

SEQ ID NO: 10137 - DNA, 28 bp, Artificial Sequence
  Synthetic Construct
ggaaaaaggaatcctgttaaagccgaat

SEQ ID NO: 10138 - DNA, 26 bp, Artificial Sequence
  Synthetic Construct
aaactgctatcagtgaaaacctgaag

SEQ ID NO: 10139 - DNA, 19 bp, Artificial Sequence
  Synthetic Construct
cacctctgagccccagtct

SEQ ID NO: 10140 - DNA, 24 bp, Artificial Sequence
  Synthetic Construct
gcaggaagaggcactatcttgcta

SEQ ID NO: 10141 - DNA, 25 bp, Artificial Sequence
  Synthetic Construct
ggttttgatgctgggacacctacta

SEQ ID NO: 10142 - DNA, 29 bp, Artificial Sequence
  Synthetic Construct
ggtttttgttctcctgcttccattatagg

SEQ ID NO: 10143 - DNA, 26 bp, Artificial Sequence
  Synthetic Construct
tccaattcagggagagaatgatcatc

SEQ ID NO: 10144 - DNA, 20 bp, Artificial Sequence
  Synthetic Construct
tgggagctctgtcactgaca

SEQ ID NO: 10145 - DNA, 22 bp, Artificial Sequence
  Synthetic Construct
tccaggtctgcatgtccttttt

SEQ ID NO: 10146 - DNA, 26 bp, Artificial Sequence
  Synthetic Construct
ggtccctgatccactagtaacttcct

SEQ ID NO: 10147 - DNA, 24 bp, Artificial Sequence
  Synthetic Construct
ctcagtttatcagcatgggagtga

SEQ ID NO: 10148 - DNA, 21 bp, Artificial Sequence
  Synthetic Construct
tctccctggtgtgtcttctgt

SEQ ID NO: 10149 - DNA, 28 bp, Artificial Sequence
  Synthetic Construct
gcacaaggagagtagggatttttacctt

SEQ ID NO: 10150 - DNA, 23 bp, Artificial Sequence
  Synthetic Construct
gagcagtgactgtcattgacatg

SEQ ID NO: 10151 - DNA, 20 bp, Artificial Sequence
  Synthetic Construct
cctctgtgcccctcaagttg

SEQ ID NO: 10152 - DNA, 22 bp, Artificial Sequence
  Synthetic Construct
ccaagcctctcagtgaatccaa

SEQ ID NO: 10153 - DNA, 28 bp, Artificial Sequence
  Synthetic Construct
gatggaaaaacctatgtgagttctaggt

SEQ ID NO: 10154 - DNA, 23 bp, Artificial Sequence
  Synthetic Construct
tgaaaccaaggcctagaggagtt

SEQ ID NO: 10155 - DNA, 25 bp, Artificial Sequence
  Synthetic Construct
cttatcagcaggtactatgctccaa

SEQ ID NO: 10156 - DNA, 24 bp, Artificial Sequence
  Synthetic Construct
cctgggttcattttctgtgaacag

SEQ ID NO: 10157 - DNA, 30 bp, Artificial Sequence
  Synthetic Construct
gattcttagttaaaaggaaaggctgttagg

SEQ ID NO: 10158 - DNA, 22 bp, Artificial Sequence
  Synthetic Construct
gctcaggatttggggtagtgaa

SEQ ID NO: 10159 - DNA, 20 bp, Artificial Sequence
  Synthetic Construct
aactgtggcctgacctggat

SEQ ID NO: 10160 - DNA, 25 bp, Artificial Sequence
  Synthetic Construct
ggtggttggatgttcttgtcaaaag

SEQ ID NO: 10161 - DNA, 30 bp, Artificial Sequence
  Synthetic Construct
gaagtggatccatttaagagatagtttgga

SEQ ID NO: 10162 - DNA, 22 bp, Artificial Sequence
  Synthetic Construct
tctcttgctgccttctgacaat

SEQ ID NO: 10163 - DNA, 22 bp, Artificial Sequence
  Synthetic Construct
ctgaccattgctgctcaagtgt

SEQ ID NO: 10164 - DNA, 28 bp, Artificial Sequence
  Synthetic Construct
cacatctctgagtgattctgagttacta

SEQ ID NO: 10165 - DNA, 28 bp, Artificial Sequence
  Synthetic Construct
gaagccaggtattctttaaactgaaaga

SEQ ID NO: 10166 - DNA, 22 bp, Artificial Sequence
  Synthetic Construct
ctcacactgcctgcaatgagat

SEQ ID NO: 10167 - DNA, 24 bp, Artificial Sequence
  Synthetic Construct
cagcagggaggtatggattaaagg

SEQ ID NO: 10168 - DNA, 29 bp, Artificial Sequence
  Synthetic Construct
ctctaatagtctatgggattttggctttc

SEQ ID NO: 10169 - DNA, 22 bp, Artificial Sequence
  Synthetic Construct
acctgactctcagccaacattg

SEQ ID NO: 10170 - DNA, 28 bp, Artificial Sequence
  Synthetic Construct
ctgagttatagagccatcgagtaacttg

SEQ ID NO: 10171 - DNA, 19 bp, Artificial Sequence
  Synthetic Construct
gcagccacatccctcacaa

SEQ ID NO: 10172 - DNA, 23 bp, Artificial Sequence
  Synthetic Construct
actggaaaatccaacagcaggta

SEQ ID NO: 10173 - DNA, 18 bp, Artificial Sequence
  Synthetic Construct
agtgccctgccaggttct

SEQ ID NO: 10174 - DNA, 22 bp, Artificial Sequence
  Synthetic Construct
accttgtgttcaggcaggaact

SEQ ID NO: 10175 - DNA, 21 bp, Artificial Sequence
  Synthetic Construct
ccgtgcatctctgctcattga

SEQ ID NO: 10176 - DNA, 26 bp, Artificial Sequence
  Synthetic Construct
gcaaggtctcaatctaagtcctggat

SEQ ID NO: 10177 - DNA, 28 bp, Artificial Sequence
  Synthetic Construct
ctttaaatggtccacaactcttttccaa

SEQ ID NO: 10178 - DNA, 26 bp, Artificial Sequence
  Synthetic Construct
ggaacaaataagaggagagggtgtga

SEQ ID NO: 10179 - DNA, 24 bp, Artificial Sequence
  Synthetic Construct
gatgcctgtggccttatgtatagg

SEQ ID NO: 10180 - DNA, 27 bp, Artificial Sequence
  Synthetic Construct
agcaccatgaaaactctttcataacat

SEQ ID NO: 10181 - DNA, 20 bp, Artificial Sequence
  Synthetic Construct
tccagcccctgtcttatgct

SEQ ID NO: 10182 - DNA, 23 bp, Artificial Sequence
  Synthetic Construct
ccccaactccatcttaggtacca

SEQ ID NO: 10183 - DNA, 30 bp, Artificial Sequence
  Synthetic Construct
aaagccttgtatcatattcagaagattcag

SEQ ID NO: 10184 - DNA, 20 bp, Artificial Sequence
  Synthetic Construct
gaaaaaagccgggcaaagca

SEQ ID NO: 10185 - DNA, 28 bp, Artificial Sequence
  Synthetic Construct
ggtcttccacctatctacagatggaagt

SEQ ID NO: 10186 - DNA, 22 bp, Artificial Sequence
  Synthetic Construct
ctgacttcagtgtccacatgct

SEQ ID NO: 10187 - DNA, 25 bp, Artificial Sequence
  Synthetic Construct
gattccagaatgtaggcaaaaagct

SEQ ID NO: 10188 - DNA, 23 bp, Artificial Sequence
  Synthetic Construct
gcagaagtgtggaggcacaaaat

SEQ ID NO: 10189 - DNA, 26 bp, Artificial Sequence
  Synthetic Construct
ctgcctcttatcagtaatgagctgat

SEQ ID NO: 10190 - DNA, 25 bp, Artificial Sequence
  Synthetic Construct
ttctgtctcctccctacctatacac

SEQ ID NO: 10191 - DNA, 30 bp, Artificial Sequence
  Synthetic Construct
tgctgttaggatatagacaaagatctttca

SEQ ID NO: 10192 - DNA, 19 bp, Artificial Sequence
  Synthetic Construct
agcagccaacagtgccaat

SEQ ID NO: 10193 - DNA, 18 bp, Artificial Sequence
  Synthetic Construct
aggtggccccagcacttc

SEQ ID NO: 10194 - DNA, 27 bp, Artificial Sequence
  Synthetic Construct
gttcctgcagaataagggagaccaaag

SEQ ID NO: 10195 - DNA, 26 bp, Artificial Sequence
  Synthetic Construct
tgaacgttgaaagactcacctaaagt

SEQ ID NO: 10196 - DNA, 25 bp, Artificial Sequence
  Synthetic Construct
gctaccgccttgttaactaacaaaa

SEQ ID NO: 10197 - DNA, 23 bp, Artificial Sequence
  Synthetic Construct
tcccgaaattcatctctgcactt

SEQ ID NO: 10198 - DNA, 27 bp, Artificial Sequence
  Synthetic Construct
tgctatcacaggtgatttgtttagcta

SEQ ID NO: 10199 - DNA, 25 bp, Artificial Sequence
  Synthetic Construct
ccttaagaggctttgtgcttttacc

SEQ ID NO: 10200 - DNA, 19 bp, Artificial Sequence
  Synthetic Construct
tccgtgcaggagggttgta

SEQ ID NO: 10201 - DNA, 20 bp, Artificial Sequence
  Synthetic Construct
ggggcagtgtacaggcaaat

SEQ ID NO: 10202 - DNA, 25 bp, Artificial Sequence
  Synthetic Construct
ccacatcctctttcattgtcaatcc

SEQ ID NO: 10203 - DNA, 19 bp, Artificial Sequence
  Synthetic Construct
acacaggccaccgtcttct

SEQ ID NO: 10204 - DNA, 25 bp, Artificial Sequence
  Synthetic Construct
gcttgctgtaaatccaccagttaca

SEQ ID NO: 10205 - DNA, 24 bp, Artificial Sequence
  Synthetic Construct
gtgtgaatgaacaccatccacctt

SEQ ID NO: 10206 - DNA, 25 bp, Artificial Sequence
  Synthetic Construct
ggctcaagaccacttcattctgtgt

SEQ ID NO: 10207 - DNA, 25 bp, Artificial Sequence
  Synthetic Construct
gcttcaagggcatatttaggaggtt

SEQ ID NO: 10208 - DNA, 19 bp, Artificial Sequence
  Synthetic Construct
agggctgggggaatgagaa

SEQ ID NO: 10209 - DNA, 26 bp, Artificial Sequence
  Synthetic Construct
cgaagacacatttagcatgactacac

SEQ ID NO: 10210 - DNA, 20 bp, Artificial Sequence
  Synthetic Construct
gggtggtctgtgcagtttgt

SEQ ID NO: 10211 - DNA, 24 bp, Artificial Sequence
  Synthetic Construct
cactggtgattggaagagcagttg

SEQ ID NO: 10212 - DNA, 28 bp, Artificial Sequence
  Synthetic Construct
tgggaaagtgacttttgatttgatatcc

SEQ ID NO: 10213 - DNA, 23 bp, Artificial Sequence
  Synthetic Construct
tgggcgagagtgagactacatct

SEQ ID NO: 10214 - DNA, 22 bp, Artificial Sequence
  Synthetic Construct
gcaactgcatccattggatcct

SEQ ID NO: 10215 - DNA, 26 bp, Artificial Sequence
  Synthetic Construct
tggcttacacttgtaatgtcaccatt

SEQ ID NO: 10216 - DNA, 30 bp, Artificial Sequence
  Synthetic Construct
tcaagtatttctttctagtgacccaaaaac

SEQ ID NO: 10217 - DNA, 23 bp, Artificial Sequence
  Synthetic Construct
gttaaagggtctgctgttttgca

SEQ ID NO: 10218 - DNA, 26 bp, Artificial Sequence
  Synthetic Construct
cgctcactgacactgggtattaatgg

SEQ ID NO: 10219 - DNA, 22 bp, Artificial Sequence
  Synthetic Construct
ttgtgggacagtgaggagacaa

SEQ ID NO: 10220 - DNA, 24 bp, Artificial Sequence
  Synthetic Construct
cgacatgaccaagtgtgcttgtag

SEQ ID NO: 10221 - DNA, 30 bp, Artificial Sequence
  Synthetic Construct
gctttcaagattgcattagtcgtattaggt

SEQ ID NO: 10222 - DNA, 22 bp, Artificial Sequence
  Synthetic Construct
tgcttacctgctgcttgtacgt

SEQ ID NO: 10223 - DNA, 28 bp, Artificial Sequence
  Synthetic Construct
gcatgctatgaattctaccaaaccattg

SEQ ID NO: 10224 - DNA, 25 bp, Artificial Sequence
  Synthetic Construct
gctgagaatgacttccatgttcttg

SEQ ID NO: 10225 - DNA, 24 bp, Artificial Sequence
  Synthetic Construct
ctgggaccatctaccttgatcatc

SEQ ID NO: 10226 - DNA, 22 bp, Artificial Sequence
  Synthetic Construct
aaaccaggagggggtgtaatca

SEQ ID NO: 10227 - DNA, 21 bp, Artificial Sequence
  Synthetic Construct
cctggtgtggtggtgtttttc

SEQ ID NO: 10228 - DNA, 23 bp, Artificial Sequence
  Synthetic Construct
tccttcatatcaccctgctgaca

SEQ ID NO: 10229 - DNA, 21 bp, Artificial Sequence
  Synthetic Construct
ccccatcttccctagctctga

SEQ ID NO: 10230 - DNA, 18 bp, Artificial Sequence
  Synthetic Construct
agccaaggcggtcctttc

SEQ ID NO: 10231 - DNA, 23 bp, Artificial Sequence
  Synthetic Construct
actgctgaagacaagggattcac

SEQ ID NO: 10232 - DNA, 25 bp, Artificial Sequence
  Synthetic Construct
gtgggttttcactatgtggactttg

SEQ ID NO: 10233 - DNA, 24 bp, Artificial Sequence
  Synthetic Construct
gcacaaggattagtgggtggatag

SEQ ID NO: 10234 - DNA, 23 bp, Artificial Sequence
  Synthetic Construct
agggcttcataggagggaaactg

SEQ ID NO: 10235 - DNA, 20 bp, Artificial Sequence
  Synthetic Construct
tccccttgccaggaggttgt

SEQ ID NO: 10236 - DNA, 22 bp, Artificial Sequence
  Synthetic Construct
ccagaactgctcacaggtacac

SEQ ID NO: 10237 - DNA, 22 bp, Artificial Sequence
  Synthetic Construct
gtggaaagagcacacacaaaca

SEQ ID NO: 10238 - DNA, 22 bp, Artificial Sequence
  Synthetic Construct
tttccaccaaatgcccctcttg

SEQ ID NO: 10239 - DNA, 19 bp, Artificial Sequence
  Synthetic Construct
agccccactgccatttgct

SEQ ID NO: 10240 - DNA, 20 bp, Artificial Sequence
  Synthetic Construct
aaatgccgcagtcctgtcat

SEQ ID NO: 10241 - DNA, 25 bp, Artificial Sequence
  Synthetic Construct
gctgtttcttccaggaaaggaaacc

SEQ ID NO: 10242 - DNA, 24 bp, Artificial Sequence
  Synthetic Construct
tgtaccaatctgtctagggtgtga

SEQ ID NO: 10243 - DNA, 26 bp, Artificial Sequence
  Synthetic Construct
ccagtgaggacctgcatgataaatca

SEQ ID NO: 10244 - DNA, 30 bp, Artificial Sequence
  Synthetic Construct
agcttgtataactgagtttcaaatgaagac

SEQ ID NO: 10245 - DNA, 28 bp, Artificial Sequence
  Synthetic Construct
agaaaactccacaaaaattgaagacgat

SEQ ID NO: 10246 - DNA, 19 bp, Artificial Sequence
  Synthetic Construct
ataggggccgcgtactaca

SEQ ID NO: 10247 - DNA, 20 bp, Artificial Sequence
  Synthetic Construct
ggggccaagagctactgtgt

SEQ ID NO: 10248 - DNA, 27 bp, Artificial Sequence
  Synthetic Construct
ttgggcaagagatgatagtaacatagg

SEQ ID NO: 10249 - DNA, 20 bp, Artificial Sequence
  Synthetic Construct
tgcactccagaccccacttt

SEQ ID NO: 10250 - DNA, 20 bp, Artificial Sequence
  Synthetic Construct
tccaggcttctcaggtttgc

SEQ ID NO: 10251 - DNA, 22 bp, Artificial Sequence
  Synthetic Construct
cttactgtccttgctggaacca

SEQ ID NO: 10252 - DNA, 22 bp, Artificial Sequence
  Synthetic Construct
tcaggcccagagaggttgattc

SEQ ID NO: 10253 - DNA, 26 bp, Artificial Sequence
  Synthetic Construct
acctaggaaaaggaattcaggtgaat

SEQ ID NO: 10254 - DNA, 27 bp, Artificial Sequence
  Synthetic Construct
cctttggtttgtaagctgaggttttca

SEQ ID NO: 10255 - DNA, 29 bp, Artificial Sequence
  Synthetic Construct
ccattatgggtaaataagtctccctctag

SEQ ID NO: 10256 - DNA, 20 bp, Artificial Sequence
  Synthetic Construct
tgtcccaggatccagtgtga

SEQ ID NO: 10257 - DNA, 22 bp, Artificial Sequence
  Synthetic Construct
agcctccactttctggattcca

SEQ ID NO: 10258 - DNA, 25 bp, Artificial Sequence
  Synthetic Construct
ccacggactgtctcactttttatgc

SEQ ID NO: 10259 - DNA, 21 bp, Artificial Sequence
  Synthetic Construct
tcacagcctgtccatctcact

SEQ ID NO: 10260 - DNA, 24 bp, Artificial Sequence
  Synthetic Construct
tggctctacctggaatatctgcta

SEQ ID NO: 10261 - DNA, 23 bp, Artificial Sequence
  Synthetic Construct
gagctttcgttttgacccagaag

SEQ ID NO: 10262 - DNA, 28 bp, Artificial Sequence
  Synthetic Construct
ccttacaccttaggggaaaaaaatgtac

SEQ ID NO: 10263 - DNA, 23 bp, Artificial Sequence
  Synthetic Construct
gctgcttaatgggatgttttgca

SEQ ID NO: 10264 - DNA, 26 bp, Artificial Sequence
  Synthetic Construct
ctctcatcctaccttgactcttatgc

SEQ ID NO: 10265 - DNA, 28 bp, Artificial Sequence
  Synthetic Construct
ctttatgatgcaggaagtcagcttatag

SEQ ID NO: 10266 - DNA, 25 bp, Artificial Sequence
  Synthetic Construct
gctccttctagtttcgtgcctttct

SEQ ID NO: 10267 - DNA, 27 bp, Artificial Sequence
  Synthetic Construct
gattagcctcatgaatcctttttccaa

SEQ ID NO: 10268 - DNA, 29 bp, Artificial Sequence
  Synthetic Construct
ctgtacgcactttataataccttggtctt

SEQ ID NO: 10269 - DNA, 21 bp, Artificial Sequence
  Synthetic Construct
tcggggtgtccacattactca

SEQ ID NO: 10270 - DNA, 19 bp, Artificial Sequence
  Synthetic Construct
gcccgacagacaacaacct

SEQ ID NO: 10271 - DNA, 21 bp, Artificial Sequence
  Synthetic Construct
agccacctgccagagaagcta

SEQ ID NO: 10272 - DNA, 23 bp, Artificial Sequence
  Synthetic Construct
ggcagattgcagagtttctgttt

SEQ ID NO: 10273 - DNA, 22 bp, Artificial Sequence
  Synthetic Construct
aggatgacttggttgccctgta

SEQ ID NO: 10274 - DNA, 24 bp, Artificial Sequence
  Synthetic Construct
ctcatgtacacaagtgcagctttt

SEQ ID NO: 10275 - DNA, 28 bp, Artificial Sequence
  Synthetic Construct
gccagatatgacatttagagatggttct

SEQ ID NO: 10276 - DNA, 19 bp, Artificial Sequence
  Synthetic Construct
cctgaggtgaggccccttt

SEQ ID NO: 10277 - DNA, 18 bp, Artificial Sequence
  Synthetic Construct
cgtggcctcggaaactgt

SEQ ID NO: 10278 - DNA, 24 bp, Artificial Sequence
  Synthetic Construct
gggtgccacacaataccctttagt

SEQ ID NO: 10279 - DNA, 28 bp, Artificial Sequence
  Synthetic Construct
gagttcacatgtctgaatctaagctttt

SEQ ID NO: 10280 - DNA, 20 bp, Artificial Sequence
  Synthetic Construct
acttgctggagcctccctaa

SEQ ID NO: 10281 - DNA, 22 bp, Artificial Sequence
  Synthetic Construct
cacatgtcagtagaggcaccat

SEQ ID NO: 10282 - DNA, 23 bp, Artificial Sequence
  Synthetic Construct
gctggatctgcactctctttgaa

SEQ ID NO: 10283 - DNA, 23 bp, Artificial Sequence
  Synthetic Construct
gacttcagccaccacaaatacac

SEQ ID NO: 10284 - DNA, 21 bp, Artificial Sequence
  Synthetic Construct
cctgcctgctgggtatctgta

SEQ ID NO: 10285 - DNA, 30 bp, Artificial Sequence
  Synthetic Construct
tgaaatgctttaaataaagggattggctta

SEQ ID NO: 10286 - DNA, 24 bp, Artificial Sequence
  Synthetic Construct
ggtgtacagcagagtatacatgca

SEQ ID NO: 10287 - DNA, 28 bp, Artificial Sequence
  Synthetic Construct
aaactccagtgaacttttgataactgtt

SEQ ID NO: 10288 - DNA, 18 bp, Artificial Sequence
  Synthetic Construct
aggctagagcgcggcaaa

SEQ ID NO: 10289 - DNA, 21 bp, Artificial Sequence
  Synthetic Construct
tgggagcctcacctgtctttg

SEQ ID NO: 10290 - DNA, 26 bp, Artificial Sequence
  Synthetic Construct
gccagactataacccctgatgaagga

SEQ ID NO: 10291 - DNA, 22 bp, Artificial Sequence
  Synthetic Construct
cagtatagccagtgtgctgaca

SEQ ID NO: 10292 - DNA, 27 bp, Artificial Sequence
  Synthetic Construct
gcaagttaaaactgagctaatgacact

SEQ ID NO: 10293 - DNA, 27 bp, Artificial Sequence
  Synthetic Construct
tgtatagattagcagctacctgtctgt

SEQ ID NO: 10294 - DNA, 22 bp, Artificial Sequence
  Synthetic Construct
ggatgggaaactcagccattcg

SEQ ID NO: 10295 - DNA, 20 bp, Artificial Sequence
  Synthetic Construct
atggggaggccaagttatgc

SEQ ID NO: 10296 - DNA, 28 bp, Artificial Sequence
  Synthetic Construct
gcctcagagtctcctagatgtttttctc

SEQ ID NO: 10297 - DNA, 23 bp, Artificial Sequence
  Synthetic Construct
ggaaaagagtttgtggccaaagg

SEQ ID NO: 10298 - DNA, 23 bp, Artificial Sequence
  Synthetic Construct
tcagtgagcctgtctagaaacct

SEQ ID NO: 10299 - DNA, 26 bp, Artificial Sequence
  Synthetic Construct
cagctcatgattttgtcagaggttct

SEQ ID NO: 10300 - DNA, 26 bp, Artificial Sequence
  Synthetic Construct
acattggggtagaacttttgtttctg

SEQ ID NO: 10301 - DNA, 26 bp, Artificial Sequence
  Synthetic Construct
tcccatatgttatcccatttgtgctt

SEQ ID NO: 10302 - DNA, 20 bp, Artificial Sequence
  Synthetic Construct
cgagcttgctccaggacaca

SEQ ID NO: 10303 - DNA, 20 bp, Artificial Sequence
  Synthetic Construct
cccatgtgctgactgctcaa

SEQ ID NO: 10304 - DNA, 20 bp, Artificial Sequence
  Synthetic Construct
cctgggtcctcagtgagact

SEQ ID NO: 10305 - DNA, 22 bp, Artificial Sequence
  Synthetic Construct
ccctggctgtgaggttttagat

SEQ ID NO: 10306 - DNA, 25 bp, Artificial Sequence
  Synthetic Construct
acataataccaaaacagggcacttg

SEQ ID NO: 10307 - DNA, 21 bp, Artificial Sequence
  Synthetic Construct
accacctcccagtactgttgt

SEQ ID NO: 10308 - DNA, 22 bp, Artificial Sequence
  Synthetic Construct
tcagctactgggcaagaggaat

SEQ ID NO: 10309 - DNA, 30 bp, Artificial Sequence
  Synthetic Construct
gtagtcattttcaagggcaataaaaagttt

SEQ ID NO: 10310 - DNA, 24 bp, Artificial Sequence
  Synthetic Construct
ccactgagagctgaatcaggctat

SEQ ID NO: 10311 - DNA, 28 bp, Artificial Sequence
  Synthetic Construct
gcctgcaaaatctgtcttagaggatgag

SEQ ID NO: 10312 - DNA, 26 bp, Artificial Sequence
  Synthetic Construct
ggatttcattctggcattgtgtagga

SEQ ID NO: 10313 - DNA, 25 bp, Artificial Sequence
  Synthetic Construct
cacagatgcattcactcaaggaaga

SEQ ID NO: 10314 - DNA, 30 bp, Artificial Sequence
  Synthetic Construct
ggatagtttttgggtaagaatttgaactgt

SEQ ID NO: 10315 - DNA, 19 bp, Artificial Sequence
  Synthetic Construct
gattgccatgggccatcct

SEQ ID NO: 10316 - DNA, 28 bp, Artificial Sequence
  Synthetic Construct
gtttcttttaaagtagctccagaaacct

SEQ ID NO: 10317 - DNA, 30 bp, Artificial Sequence
  Synthetic Construct
ctttgtatttagccagattttcctgattgt

SEQ ID NO: 10318 - DNA, 26 bp, Artificial Sequence
  Synthetic Construct
gttaggcaattagtacagtcgttgag

SEQ ID NO: 10319 - DNA, 25 bp, Artificial Sequence
  Synthetic Construct
tccagggtgttctccattgattaag

SEQ ID NO: 10320 - DNA, 22 bp, Artificial Sequence
  Synthetic Construct
gcacacacctccaccaaaagtt

SEQ ID NO: 10321 - DNA, 24 bp, Artificial Sequence
  Synthetic Construct
gcaaacaagtctggaaagatgcat

SEQ ID NO: 10322 - DNA, 24 bp, Artificial Sequence
  Synthetic Construct
tgaactgctctgtggaaacttagt

SEQ ID NO: 10323 - DNA, 25 bp, Artificial Sequence
  Synthetic Construct
cccttgcaattagttagagccacat

SEQ ID NO: 10324 - DNA, 23 bp, Artificial Sequence
  Synthetic Construct
ccctgcaacaagttcttctcact

SEQ ID NO: 10325 - DNA, 22 bp, Artificial Sequence
  Synthetic Construct
cccttcagcacgttcttatcct

SEQ ID NO: 10326 - DNA, 24 bp, Artificial Sequence
  Synthetic Construct
cacagtctgcacgaatgttatgtg

SEQ ID NO: 10327 - DNA, 24 bp, Artificial Sequence
  Synthetic Construct
tgcattgtttcacactgtgaagtt

SEQ ID NO: 10328 - DNA, 29 bp, Artificial Sequence
  Synthetic Construct
ggctttatttctcactgatgggaatagca

SEQ ID NO: 10329 - DNA, 26 bp, Artificial Sequence
  Synthetic Construct
gtggttgcatattgatttgcttagga

SEQ ID NO: 10330 - DNA, 22 bp, Artificial Sequence
  Synthetic Construct
ggctgtacctccctttcaaact

SEQ ID NO: 10331 - DNA, 23 bp, Artificial Sequence
  Synthetic Construct
cacttttaacaccgcctgaggta

SEQ ID NO: 10332 - DNA, 22 bp, Artificial Sequence
  Synthetic Construct
cccatcccagaaacactgaagt

SEQ ID NO: 10333 - DNA, 22 bp, Artificial Sequence
  Synthetic Construct
tcaggcagaccaagatgtgaga

SEQ ID NO: 10334 - DNA, 21 bp, Artificial Sequence
  Synthetic Construct
tgctctgaggcccataaacac

SEQ ID NO: 10335 - DNA, 22 bp, Artificial Sequence
  Synthetic Construct
ttcagccttgcaagagcttcct

SEQ ID NO: 10336 - DNA, 20 bp, Artificial Sequence
  Synthetic Construct
tggtaggtccaaggcactgt

SEQ ID NO: 10337 - DNA, 19 bp, Artificial Sequence
  Synthetic Construct
agtgtcccccacccactct

SEQ ID NO: 10338 - DNA, 28 bp, Artificial Sequence
  Synthetic Construct
ggtacaaatcagagcacagattttcttt

SEQ ID NO: 10339 - DNA, 26 bp, Artificial Sequence
  Synthetic Construct
ctgtttcttgaagctgagactttcac

SEQ ID NO: 10340 - DNA, 22 bp, Artificial Sequence
  Synthetic Construct
ttctcgaacaaggaggcacagt

SEQ ID NO: 10341 - DNA, 19 bp, Artificial Sequence
  Synthetic Construct
acgttcacacagccgtgaa

SEQ ID NO: 10342 - DNA, 20 bp, Artificial Sequence
  Synthetic Construct
gccatggacagtgcccttca

SEQ ID NO: 10343 - DNA, 26 bp, Artificial Sequence
  Synthetic Construct
gccattttctacaggagcatgaagag

SEQ ID NO: 10344 - DNA, 24 bp, Artificial Sequence
  Synthetic Construct
ccctttggagtaggagccttcaaa

SEQ ID NO: 10345 - DNA, 26 bp, Artificial Sequence
  Synthetic Construct
gcttccacaaactgaaaacagagaga

SEQ ID NO: 10346 - DNA, 22 bp, Artificial Sequence
  Synthetic Construct
tgcagaagcgttagttgctttg

SEQ ID NO: 10347 - DNA, 20 bp, Artificial Sequence
  Synthetic Construct
ggagcagagcgttgcttagg

SEQ ID NO: 10348 - DNA, 25 bp, Artificial Sequence
  Synthetic Construct
ggatgaggaggacacatgtcattgt

SEQ ID NO: 10349 - DNA, 30 bp, Artificial Sequence
  Synthetic Construct
cgaatatctgacttagtcctaaaacaacag

SEQ ID NO: 10350 - DNA, 29 bp, Artificial Sequence
  Synthetic Construct
gcctctagtataatggggtataccttgtc

SEQ ID NO: 10351 - DNA, 25 bp, Artificial Sequence
  Synthetic Construct
gccccaattccactggactaaattc

SEQ ID NO: 10352 - DNA, 29 bp, Artificial Sequence
  Synthetic Construct
tgattcgaataactaggggagtatagact

SEQ ID NO: 10353 - DNA, 22 bp, Artificial Sequence
  Synthetic Construct
acacacttttccacctgcatct

SEQ ID NO: 10354 - DNA, 22 bp, Artificial Sequence
  Synthetic Construct
ttctgcactttgtgtcctgtca

SEQ ID NO: 10355 - DNA, 24 bp, Artificial Sequence
  Synthetic Construct
tccttgttcctaggagatcaatgc

SEQ ID NO: 10356 - DNA, 25 bp, Artificial Sequence
  Synthetic Construct
gcacacatcctgtagtgatttccaa

SEQ ID NO: 10357 - DNA, 25 bp, Artificial Sequence
  Synthetic Construct
cacaatacacagaaacctggaagca

SEQ ID NO: 10358 - DNA, 21 bp, Artificial Sequence
  Synthetic Construct
gctggggagaaggaatttgct

SEQ ID NO: 10359 - DNA, 26 bp, Artificial Sequence
  Synthetic Construct
cccttagcagtacttttccagttagg

SEQ ID NO: 10360 - DNA, 24 bp, Artificial Sequence
  Synthetic Construct
aggcatccgaccaaagagtcttag

SEQ ID NO: 10361 - DNA, 28 bp, Artificial Sequence
  Synthetic Construct
acaagcttaaactcatatagcctcttct

SEQ ID NO: 10362 - DNA, 29 bp, Artificial Sequence
  Synthetic Construct
gctagttcttcaactggaaatgatgaaaa

SEQ ID NO: 10363 - DNA, 23 bp, Artificial Sequence
  Synthetic Construct
agagctagagtacagcaggaagt

SEQ ID NO: 10364 - DNA, 28 bp, Artificial Sequence
  Synthetic Construct
ctcatttctttgtgttttaggggtatgt

SEQ ID NO: 10365 - DNA, 22 bp, Artificial Sequence
  Synthetic Construct
gggcagctctgaactgtcattg

SEQ ID NO: 10366 - DNA, 30 bp, Artificial Sequence
  Synthetic Construct
ctctcccatttcttaattcctcagactttt

SEQ ID NO: 10367 - DNA, 24 bp, Artificial Sequence
  Synthetic Construct
ctgccatcaacacatttcctttcc

SEQ ID NO: 10368 - DNA, 22 bp, Artificial Sequence
  Synthetic Construct
agtcccaatgcctcactttggt

SEQ ID NO: 10369 - DNA, 19 bp, Artificial Sequence
  Synthetic Construct
tccggagccctgaggagtt

SEQ ID NO: 10370 - DNA, 27 bp, Artificial Sequence
  Synthetic Construct
ccaaccatgaatttgtgttaagcacta

SEQ ID NO: 10371 - DNA, 23 bp, Artificial Sequence
  Synthetic Construct
attctgtgggaggatgactttgg

SEQ ID NO: 10372 - DNA, 22 bp, Artificial Sequence
  Synthetic Construct
ccaggcatacaaccatgtcaga

SEQ ID NO: 10373 - DNA, 26 bp, Artificial Sequence
  Synthetic Construct
ctcttacacctagacaagctgatcag

SEQ ID NO: 10374 - DNA, 26 bp, Artificial Sequence
  Synthetic Construct
gttctcagggatatttctgccatcag

SEQ ID NO: 10375 - DNA, 22 bp, Artificial Sequence
  Synthetic Construct
tccctctgaaggcagacatgga

SEQ ID NO: 10376 - DNA, 22 bp, Artificial Sequence
  Synthetic Construct
caaggaaggcttcagctatggt

SEQ ID NO: 10377 - DNA, 26 bp, Artificial Sequence
  Synthetic Construct
ttggagttctccaaatagccctattt

SEQ ID NO: 10378 - DNA, 23 bp, Artificial Sequence
  Synthetic Construct
aagaagggcctctgcattatcag

SEQ ID NO: 10379 - DNA, 24 bp, Artificial Sequence
  Synthetic Construct
gccctgacagtgatgtttgttctc

SEQ ID NO: 10380 - DNA, 26 bp, Artificial Sequence
  Synthetic Construct
catagaaatcaggcaattgacaagct

SEQ ID NO: 10381 - DNA, 21 bp, Artificial Sequence
  Synthetic Construct
cgcaaggagctcaagttcaag

SEQ ID NO: 10382 - DNA, 29 bp, Artificial Sequence
  Synthetic Construct
gttacaaaatagtcagaagtctggtctca

SEQ ID NO: 10383 - DNA, 18 bp, Artificial Sequence
  Synthetic Construct
gcagcaggcagggagaag

SEQ ID NO: 10384 - DNA, 24 bp, Artificial Sequence
  Synthetic Construct
acaaccacagaaggatgtcaactg

SEQ ID NO: 10385 - DNA, 26 bp, Artificial Sequence
  Synthetic Construct
gcttatgggagaaactatggattcca

SEQ ID NO: 10386 - DNA, 19 bp, Artificial Sequence
  Synthetic Construct
agaggtggtcgggcatgga

SEQ ID NO: 10387 - DNA, 23 bp, Artificial Sequence
  Synthetic Construct
tggttctaaaagccatccttgca

SEQ ID NO: 10388 - DNA, 22 bp, Artificial Sequence
  Synthetic Construct
tcatctctcccctctcaacgaa

SEQ ID NO: 10389 - DNA, 24 bp, Artificial Sequence
  Synthetic Construct
gccccaagagatgtttttattgca

SEQ ID NO: 10390 - DNA, 24 bp, Artificial Sequence
  Synthetic Construct
gccagcttcaaatgcctctatctc

SEQ ID NO: 10391 - DNA, 20 bp, Artificial Sequence
  Synthetic Construct
aacacaggaggggcaggata

SEQ ID NO: 10392 - DNA, 22 bp, Artificial Sequence
  Synthetic Construct
ctaagcacagctggtgttttgg

SEQ ID NO: 10393 - DNA, 22 bp, Artificial Sequence
  Synthetic Construct
tctgcttccactggagtttgag

SEQ ID NO: 10394 - DNA, 24 bp, Artificial Sequence
  Synthetic Construct
tcagaaaggcagtagaagctcaat

SEQ ID NO: 10395 - DNA, 21 bp, Artificial Sequence
  Synthetic Construct
tgaaggcttggtcaacttggt

SEQ ID NO: 10396 - DNA, 30 bp, Artificial Sequence
  Synthetic Construct
gacctagatgatctcatatcttgcataaac

SEQ ID NO: 10397 - DNA, 24 bp, Artificial Sequence
  Synthetic Construct
gcgaggcctcaattacatgtacac

SEQ ID NO: 10398 - DNA, 24 bp, Artificial Sequence
  Synthetic Construct
gactggtactgggaagactgttgt

SEQ ID NO: 10399 - DNA, 24 bp, Artificial Sequence
  Synthetic Construct
gaccaaatccaggggtcaattttc

SEQ ID NO: 10400 - DNA, 24 bp, Artificial Sequence
  Synthetic Construct
ggaaccaaagcatcaagaaggaaa

SEQ ID NO: 10401 - DNA, 21 bp, Artificial Sequence
  Synthetic Construct
tctgcttgcctggctgagtaa

SEQ ID NO: 10402 - DNA, 22 bp, Artificial Sequence
  Synthetic Construct
tcctggcagattcacccaactc

SEQ ID NO: 10403 - DNA, 21 bp, Artificial Sequence
  Synthetic Construct
agaaaaggggcttggaatgca

SEQ ID NO: 10404 - DNA, 26 bp, Artificial Sequence
  Synthetic Construct
gcattgatacagtttctggcaaattc

SEQ ID NO: 10405 - DNA, 24 bp, Artificial Sequence
  Synthetic Construct
cctctccctcaacaacccagtttt

SEQ ID NO: 10406 - DNA, 29 bp, Artificial Sequence
  Synthetic Construct
cagaaaaattagtttccactccacttctc

SEQ ID NO: 10407 - DNA, 20 bp, Artificial Sequence
  Synthetic Construct
gcagccatccaggagcagaa

SEQ ID NO: 10408 - DNA, 24 bp, Artificial Sequence
  Synthetic Construct
gggtctgtggaattttccttctga

SEQ ID NO: 10409 - DNA, 25 bp, Artificial Sequence
  Synthetic Construct
ccactctggctaatttaagcacaaa

SEQ ID NO: 10410 - DNA, 27 bp, Artificial Sequence
  Synthetic Construct
ggaagaagagctcattgtcaaatactg

SEQ ID NO: 10411 - DNA, 28 bp, Artificial Sequence
  Synthetic Construct
ttttcaattcctgactccattgaagtac

SEQ ID NO: 10412 - DNA, 24 bp, Artificial Sequence
  Synthetic Construct
acaaaaaggctccctaaactagct

SEQ ID NO: 10413 - DNA, 20 bp, Artificial Sequence
  Synthetic Construct
caccatgatgccaggggaaa

SEQ ID NO: 10414 - DNA, 21 bp, Artificial Sequence
  Synthetic Construct
aggctcctaagctgcatttgg

SEQ ID NO: 10415 - DNA, 22 bp, Artificial Sequence
  Synthetic Construct
tgccagggaagtgacatttcca

SEQ ID NO: 10416 - DNA, 25 bp, Artificial Sequence
  Synthetic Construct
gtgacttcaggtgagaaaagatgct

SEQ ID NO: 10417 - DNA, 18 bp, Artificial Sequence
  Synthetic Construct
gggcgaccgtccacatgt

SEQ ID NO: 10418 - DNA, 22 bp, Artificial Sequence
  Synthetic Construct
ctggaaaactggcccaataggt

SEQ ID NO: 10419 - DNA, 28 bp, Artificial Sequence
  Synthetic Construct
ccatggttatctgttcagttactttcaa

SEQ ID NO: 10420 - DNA, 22 bp, Artificial Sequence
  Synthetic Construct
gcacctactttgtgcctagagt

SEQ ID NO: 10421 - DNA, 22 bp, Artificial Sequence
  Synthetic Construct
cttctgcccccaaacaaaggaa

SEQ ID NO: 10422 - DNA, 24 bp, Artificial Sequence
  Synthetic Construct
ctgtgtccattccttctccaatga

SEQ ID NO: 10423 - DNA, 22 bp, Artificial Sequence
  Synthetic Construct
gctggctggcactgttacatat

SEQ ID NO: 10424 - DNA, 26 bp, Artificial Sequence
  Synthetic Construct
gcaattgacctagtatctgactgcaa

SEQ ID NO: 10425 - DNA, 22 bp, Artificial Sequence
  Synthetic Construct
cacagcatggttgagacctgtt

SEQ ID NO: 10426 - DNA, 25 bp, Artificial Sequence
  Synthetic Construct
ggtgcactggaagtaaccatagcaa

SEQ ID NO: 10427 - DNA, 24 bp, Artificial Sequence
  Synthetic Construct
gccttcacacaacaaacctgactt

SEQ ID NO: 10428 - DNA, 22 bp, Artificial Sequence
  Synthetic Construct
acctgttgactttgggctgcat

SEQ ID NO: 10429 - DNA, 25 bp, Artificial Sequence
  Synthetic Construct
gctgaaactctgggcatgttattct

SEQ ID NO: 10430 - DNA, 22 bp, Artificial Sequence
  Synthetic Construct
gacacatgggacttgcaattcg

SEQ ID NO: 10431 - DNA, 22 bp, Artificial Sequence
  Synthetic Construct
tgcgcctactttcccgttaagg

SEQ ID NO: 10432 - DNA, 23 bp, Artificial Sequence
  Synthetic Construct
agtgcctgattggtattggcttt

SEQ ID NO: 10433 - DNA, 21 bp, Artificial Sequence
  Synthetic Construct
accatgaaattgtgcgcaaca

SEQ ID NO: 10434 - DNA, 24 bp, Artificial Sequence
  Synthetic Construct
cacactatacctccagccagaatc

SEQ ID NO: 10435 - DNA, 24 bp, Artificial Sequence
  Synthetic Construct
gggagagcaaagggtacttaggaa

SEQ ID NO: 10436 - DNA, 19 bp, Artificial Sequence
  Synthetic Construct
gggctcaggtggagtttcc

SEQ ID NO: 10437 - DNA, 25 bp, Artificial Sequence
  Synthetic Construct
tgctcagttcctcttaaccattacc

SEQ ID NO: 10438 - DNA, 20 bp, Artificial Sequence
  Synthetic Construct
gctgagctcttgccatggtt

SEQ ID NO: 10439 - DNA, 25 bp, Artificial Sequence
  Synthetic Construct
cagatcttgggaatcatggttctct

SEQ ID NO: 10440 - DNA, 23 bp, Artificial Sequence
  Synthetic Construct
agccctcgataatgtcagtgatc

SEQ ID NO: 10441 - DNA, 19 bp, Artificial Sequence
  Synthetic Construct
actccctgcctccctgcat

SEQ ID NO: 10442 - DNA, 28 bp, Artificial Sequence
  Synthetic Construct
ggataccatcatagttctgggaatggat

SEQ ID NO: 10443 - DNA, 23 bp, Artificial Sequence
  Synthetic Construct
ttccccaggctcaggtcataaga

SEQ ID NO: 10444 - DNA, 21 bp, Artificial Sequence
  Synthetic Construct
accactccggagcaaacaaca

SEQ ID NO: 10445 - DNA, 24 bp, Artificial Sequence
  Synthetic Construct
gctgtttaccagaggaggacatca

SEQ ID NO: 10446 - DNA, 22 bp, Artificial Sequence
  Synthetic Construct
agtgcaggagagaagtgatggt

SEQ ID NO: 10447 - DNA, 22 bp, Artificial Sequence
  Synthetic Construct
tggaagcatgaagtgggttctc

SEQ ID NO: 10448 - DNA, 28 bp, Artificial Sequence
  Synthetic Construct
gcaaaaacaactcctggtaacttcattg

SEQ ID NO: 10449 - DNA, 30 bp, Artificial Sequence
  Synthetic Construct
cctgcattatcagttttcagagcaaaagaa

SEQ ID NO: 10450 - DNA, 20 bp, Artificial Sequence
  Synthetic Construct
tgcctggggttgggagaaga

SEQ ID NO: 10451 - DNA, 25 bp, Artificial Sequence
  Synthetic Construct
tttcttatggaaaggggacaactca

SEQ ID NO: 10452 - DNA, 27 bp, Artificial Sequence
  Synthetic Construct
acctagtaggctgtagtagaacaactt

SEQ ID NO: 10453 - DNA, 20 bp, Artificial Sequence
  Synthetic Construct
acacaaccccacacaaccat

SEQ ID NO: 10454 - DNA, 23 bp, Artificial Sequence
  Synthetic Construct
gctttagctactgtggtcacctt

SEQ ID NO: 10455 - DNA, 24 bp, Artificial Sequence
  Synthetic Construct
ctatcacttacacccacccctttc

SEQ ID NO: 10456 - DNA, 22 bp, Artificial Sequence
  Synthetic Construct
tctggcctgataacctgctgat

SEQ ID NO: 10457 - DNA, 25 bp, Artificial Sequence
  Synthetic Construct
ggaagactgtcacatctctggtgat

SEQ ID NO: 10458 - DNA, 29 bp, Artificial Sequence
  Synthetic Construct
gtaatgttagtagccagatcagctatact

SEQ ID NO: 10459 - DNA, 25 bp, Artificial Sequence
  Synthetic Construct
cttggaaaaggtaccatgaggatga

SEQ ID NO: 10460 - DNA, 25 bp, Artificial Sequence
  Synthetic Construct
gcagaaatgcttccaccaacttcct

SEQ ID NO: 10461 - DNA, 22 bp, Artificial Sequence
  Synthetic Construct
tctgagccaggcatgtctatgg

SEQ ID NO: 10462 - DNA, 27 bp, Artificial Sequence
  Synthetic Construct
ggaactgaggatcagaaaggtatttgg

SEQ ID NO: 10463 - DNA, 25 bp, Artificial Sequence
  Synthetic Construct
gttctaagaagacgagcagcatctt

SEQ ID NO: 10464 - DNA, 24 bp, Artificial Sequence
  Synthetic Construct
tgagcaactcttccttccataggt

SEQ ID NO: 10465 - DNA, 24 bp, Artificial Sequence
  Synthetic Construct
ggttggggaataaaggggaaaagc

SEQ ID NO: 10466 - DNA, 24 bp, Artificial Sequence
  Synthetic Construct
ggtggacccttcttcattcttgac

SEQ ID NO: 10467 - DNA, 25 bp, Artificial Sequence
  Synthetic Construct
tgcagactaaagaagagggaaagtg

SEQ ID NO: 10468 - DNA, 20 bp, Artificial Sequence
  Synthetic Construct
tcccaccccatcagcaaagg

SEQ ID NO: 10469 - DNA, 19 bp, Artificial Sequence
  Synthetic Construct
agtgcagggctggaaactc

SEQ ID NO: 10470 - DNA, 22 bp, Artificial Sequence
  Synthetic Construct
tctcccatcaatcccagttgca

SEQ ID NO: 10471 - DNA, 27 bp, Artificial Sequence
  Synthetic Construct
agattttctctcagcaactacttctca

SEQ ID NO: 10472 - DNA, 22 bp, Artificial Sequence
  Synthetic Construct
ggacaaggggcatgtacaaaac

SEQ ID NO: 10473 - DNA, 19 bp, Artificial Sequence
  Synthetic Construct
tgtgggagggtgagaccaa

SEQ ID NO: 10474 - DNA, 22 bp, Artificial Sequence
  Synthetic Construct
tggctcatcatcatgggtctgt

SEQ ID NO: 10475 - DNA, 26 bp, Artificial Sequence
  Synthetic Construct
atagtataacaagcaagtgggatggt

SEQ ID NO: 10476 - DNA, 27 bp, Artificial Sequence
  Synthetic Construct
gagagttctgtacctgtgtgtatcttc

SEQ ID NO: 10477 - DNA, 27 bp, Artificial Sequence
  Synthetic Construct
caggattttagacctagcacatacaga

SEQ ID NO: 10478 - DNA, 26 bp, Artificial Sequence
  Synthetic Construct
agaaaagatctcctggaggaaatgac

SEQ ID NO: 10479 - DNA, 23 bp, Artificial Sequence
  Synthetic Construct
caactgctcctgaatcccttttg

SEQ ID NO: 10480 - DNA, 23 bp, Artificial Sequence
  Synthetic Construct
aaatcctgccacctctgtaaaca

SEQ ID NO: 10481 - DNA, 22 bp, Artificial Sequence
  Synthetic Construct
gggtctgtaaagggctctgttc

SEQ ID NO: 10482 - DNA, 27 bp, Artificial Sequence
  Synthetic Construct
gacctgagaaaagagtgttatccaaga

SEQ ID NO: 10483 - DNA, 20 bp, Artificial Sequence
  Synthetic Construct
cctggtctgtgcttcaccaa

SEQ ID NO: 10484 - DNA, 25 bp, Artificial Sequence
  Synthetic Construct
ctcacagttaagcgacctctttcag

SEQ ID NO: 10485 - DNA, 24 bp, Artificial Sequence
  Synthetic Construct
ggatattcagctgctcctgtgaga

SEQ ID NO: 10486 - DNA, 26 bp, Artificial Sequence
  Synthetic Construct
cataggacaatgagacccatgtactt

SEQ ID NO: 10487 - DNA, 22 bp, Artificial Sequence
  Synthetic Construct
cagagttccagaagtggcttct

SEQ ID NO: 10488 - DNA, 26 bp, Artificial Sequence
  Synthetic Construct
aagtttattactgccagagactttgc

SEQ ID NO: 10489 - DNA, 22 bp, Artificial Sequence
  Synthetic Construct
acgacctttgctgagagaaggt

SEQ ID NO: 10490 - DNA, 22 bp, Artificial Sequence
  Synthetic Construct
ctgttcagggcttgatctccat

SEQ ID NO: 10491 - DNA, 21 bp, Artificial Sequence
  Synthetic Construct
cttcagtggcaaggagacctt

SEQ ID NO: 10492 - DNA, 25 bp, Artificial Sequence
  Synthetic Construct
ggaccattttcagcaacacccctat

SEQ ID NO: 10493 - DNA, 30 bp, Artificial Sequence
  Synthetic Construct
tgttaaaagtttttcgtctagaaagaggaa

SEQ ID NO: 10494 - DNA, 23 bp, Artificial Sequence
  Synthetic Construct
ctccttttctttgcctcctttgc

SEQ ID NO: 10495 - DNA, 18 bp, Artificial Sequence
  Synthetic Construct
tcccctccccagctgaca

SEQ ID NO: 10496 - DNA, 20 bp, Artificial Sequence
  Synthetic Construct
gcccatgccaacaaggtgaa

SEQ ID NO: 10497 - DNA, 24 bp, Artificial Sequence
  Synthetic Construct
cctagacgagctgatctgagtaca

SEQ ID NO: 10498 - DNA, 27 bp, Artificial Sequence
  Synthetic Construct
ctgttaagtgccaactcttttgtctct

SEQ ID NO: 10499 - DNA, 27 bp, Artificial Sequence
  Synthetic Construct
aggttgttctagcaaagatgaaaactg

SEQ ID NO: 10500 - DNA, 25 bp, Artificial Sequence
  Synthetic Construct
cctgtgcaatcaattccatgccata

SEQ ID NO: 10501 - DNA, 24 bp, Artificial Sequence
  Synthetic Construct
acttcatattgcctgagccaaaga

SEQ ID NO: 10502 - DNA, 29 bp, Artificial Sequence
  Synthetic Construct
cgcataaagactgtttcagttatctgcta

SEQ ID NO: 10503 - DNA, 24 bp, Artificial Sequence
  Synthetic Construct
ggaatgtgagtttcctgtgaccta

SEQ ID NO: 10504 - DNA, 22 bp, Artificial Sequence
  Synthetic Construct
gcacacaaagcactcacaatcc

SEQ ID NO: 10505 - DNA, 25 bp, Artificial Sequence
  Synthetic Construct
aggtattttgggacagacactgatt

SEQ ID NO: 10506 - DNA, 22 bp, Artificial Sequence
  Synthetic Construct
atctcctgtcccagcatctttg

SEQ ID NO: 10507 - DNA, 27 bp, Artificial Sequence
  Synthetic Construct
ttcagagctcaatactgtaaggatgag

SEQ ID NO: 10508 - DNA, 24 bp, Artificial Sequence
  Synthetic Construct
gctacacaaactgcatctcttgga

SEQ ID NO: 10509 - DNA, 26 bp, Artificial Sequence
  Synthetic Construct
gactcacaattttcaggcaagaaaca

SEQ ID NO: 10510 - DNA, 29 bp, Artificial Sequence
  Synthetic Construct
gcataacatctggcttttaaaatctgact

SEQ ID NO: 10511 - DNA, 19 bp, Artificial Sequence
  Synthetic Construct
agactggcagggagtgtgt

SEQ ID NO: 10512 - DNA, 22 bp, Artificial Sequence
  Synthetic Construct
ggcatttctaggatgcgtggaa

SEQ ID NO: 10513 - DNA, 22 bp, Artificial Sequence
  Synthetic Construct
tgtgcactaacagcccatgtac

SEQ ID NO: 10514 - DNA, 24 bp, Artificial Sequence
  Synthetic Construct
tctgaacctgggtggaacaatagg

SEQ ID NO: 10515 - DNA, 29 bp, Artificial Sequence
  Synthetic Construct
gcagttgatagctttacactcttgaatct

SEQ ID NO: 10516 - DNA, 27 bp, Artificial Sequence
  Synthetic Construct
gaggaaatatgagacctccatttttgg

SEQ ID NO: 10517 - DNA, 26 bp, Artificial Sequence
  Synthetic Construct
gctaggaacacagaaacattgttgca

SEQ ID NO: 10518 - DNA, 20 bp, Artificial Sequence
  Synthetic Construct
tgattggagaggccctgcta

SEQ ID NO: 10519 - DNA, 27 bp, Artificial Sequence
  Synthetic Construct
agattaaacacagctttggggttttac

SEQ ID NO: 10520 - DNA, 22 bp, Artificial Sequence
  Synthetic Construct
ggacatcaacaaggctcaggat

SEQ ID NO: 10521 - DNA, 26 bp, Artificial Sequence
  Synthetic Construct
gaattgccacaatagtctcagctttg

SEQ ID NO: 10522 - DNA, 19 bp, Artificial Sequence
  Synthetic Construct
tgctgccaaaggccaggaa

SEQ ID NO: 10523 - DNA, 23 bp, Artificial Sequence
  Synthetic Construct
tggcacctaggaggcatttattg

SEQ ID NO: 10524 - DNA, 22 bp, Artificial Sequence
  Synthetic Construct
tcggttctttggcctgatgatt

SEQ ID NO: 10525 - DNA, 26 bp, Artificial Sequence
  Synthetic Construct
ggccaattactgaatagccaggtact

SEQ ID NO: 10526 - DNA, 22 bp, Artificial Sequence
  Synthetic Construct
cgtcacattctgcagaccacat

SEQ ID NO: 10527 - DNA, 24 bp, Artificial Sequence
  Synthetic Construct
cttgtcttctcaggttgcttgttt

SEQ ID NO: 10528 - DNA, 19 bp, Artificial Sequence
  Synthetic Construct
tgcctgtgttcccctctct

SEQ ID NO: 10529 - DNA, 29 bp, Artificial Sequence
  Synthetic Construct
ggaattgatttggttggcactataatagc

SEQ ID NO: 10530 - DNA, 22 bp, Artificial Sequence
  Synthetic Construct
tgcaatgccagacagcctgata

SEQ ID NO: 10531 - DNA, 28 bp, Artificial Sequence
  Synthetic Construct
aactatttcaggagaaaggagtgattga

SEQ ID NO: 10532 - DNA, 20 bp, Artificial Sequence
  Synthetic Construct
aaatcagtgcggtgcttgct

SEQ ID NO: 10533 - DNA, 22 bp, Artificial Sequence
  Synthetic Construct
cctcctttctgttctgcttgga

SEQ ID NO: 10534 - DNA, 24 bp, Artificial Sequence
  Synthetic Construct
ggttagcccttgggtagaatcaga

SEQ ID NO: 10535 - DNA, 19 bp, Artificial Sequence
  Synthetic Construct
agggcctgctggactctca

SEQ ID NO: 10536 - DNA, 22 bp, Artificial Sequence
  Synthetic Construct
gtgctacaagccactgttacgt

SEQ ID NO: 10537 - DNA, 25 bp, Artificial Sequence
  Synthetic Construct
aataccttcctccgattgctttttg

SEQ ID NO: 10538 - DNA, 23 bp, Artificial Sequence
  Synthetic Construct
agcagtggagccatgagatctca

SEQ ID NO: 10539 - DNA, 22 bp, Artificial Sequence
  Synthetic Construct
ctctttccccagtcacccaatg

SEQ ID NO: 10540 - DNA, 27 bp, Artificial Sequence
  Synthetic Construct
cctttttttctgagtaacctggaactg

SEQ ID NO: 10541 - DNA, 24 bp, Artificial Sequence
  Synthetic Construct
tttaatgccgtgcatcattcaagt

SEQ ID NO: 10542 - DNA, 24 bp, Artificial Sequence
  Synthetic Construct
ccgagccttagaaagaccccatat

SEQ ID NO: 10543 - DNA, 24 bp, Artificial Sequence
  Synthetic Construct
tcatgaatcccgatgacatcactt

SEQ ID NO: 10544 - DNA, 20 bp, Artificial Sequence
  Synthetic Construct
atgctggcaccaagattcca

SEQ ID NO: 10545 - DNA, 21 bp, Artificial Sequence
  Synthetic Construct
agcagtggtgtgtgctacagt

SEQ ID NO: 10546 - DNA, 20 bp, Artificial Sequence
  Synthetic Construct
tgctggttgggtcagatgga

SEQ ID NO: 10547 - DNA, 22 bp, Artificial Sequence
  Synthetic Construct
ggtagcacagggcaaagttagg

SEQ ID NO: 10548 - DNA, 25 bp, Artificial Sequence
  Synthetic Construct
cctgaccatgggttcaataattcca

SEQ ID NO: 10549 - DNA, 22 bp, Artificial Sequence
  Synthetic Construct
tgtggagaccaagacctttcca

SEQ ID NO: 10550 - DNA, 21 bp, Artificial Sequence
  Synthetic Construct
aagctgtgtgtggcctctaag

SEQ ID NO: 10551 - DNA, 21 bp, Artificial Sequence
  Synthetic Construct
agccagagcagctgaacagta

SEQ ID NO: 10552 - DNA, 26 bp, Artificial Sequence
  Synthetic Construct
ctgaggagaggagtcatatccttagg

SEQ ID NO: 10553 - DNA, 24 bp, Artificial Sequence
  Synthetic Construct
tcctagctcagccacagtggaata

SEQ ID NO: 10554 - DNA, 20 bp, Artificial Sequence
  Synthetic Construct
gggagcacagttctgtgaca

SEQ ID NO: 10555 - DNA, 25 bp, Artificial Sequence
  Synthetic Construct
ttaaccactgtttcttgccaattgt

SEQ ID NO: 10556 - DNA, 25 bp, Artificial Sequence
  Synthetic Construct
tgagttgttttttgccttgattcct

SEQ ID NO: 10557 - DNA, 24 bp, Artificial Sequence
  Synthetic Construct
ctggatgaacctagccaagatcag

SEQ ID NO: 10558 - DNA, 24 bp, Artificial Sequence
  Synthetic Construct
accagcatcagagatcctaagtct

SEQ ID NO: 10559 - DNA, 22 bp, Artificial Sequence
  Synthetic Construct
tgtctcgcttctctctggatgt

SEQ ID NO: 10560 - DNA, 22 bp, Artificial Sequence
  Synthetic Construct
tcctgtggtgaatgctgtagct

SEQ ID NO: 10561 - DNA, 26 bp, Artificial Sequence
  Synthetic Construct
tgagaggtttagatccaggtaagtga

SEQ ID NO: 10562 - DNA, 29 bp, Artificial Sequence
  Synthetic Construct
gctgcttctttcaaataatttgagggaaa

SEQ ID NO: 10563 - DNA, 19 bp, Artificial Sequence
  Synthetic Construct
ggagcctgccacagatggt

SEQ ID NO: 10564 - DNA, 25 bp, Artificial Sequence
  Synthetic Construct
tgacagactttggcacctatattca

SEQ ID NO: 10565 - DNA, 24 bp, Artificial Sequence
  Synthetic Construct
ggcagctgggattggtattgttct

SEQ ID NO: 10566 - DNA, 28 bp, Artificial Sequence
  Synthetic Construct
gagccactacgttaaaattaagaacaca

SEQ ID NO: 10567 - DNA, 24 bp, Artificial Sequence
  Synthetic Construct
gttagattccagtctcccctgtga

SEQ ID NO: 10568 - DNA, 30 bp, Artificial Sequence
  Synthetic Construct
ctggattcattaattcctacttgccttcta

SEQ ID NO: 10569 - DNA, 19 bp, Artificial Sequence
  Synthetic Construct
accacctgccccccactga

SEQ ID NO: 10570 - DNA, 22 bp, Artificial Sequence
  Synthetic Construct
cttcaaagcccacctgaaagtg

SEQ ID NO: 10571 - DNA, 24 bp, Artificial Sequence
  Synthetic Construct
gggggaaactgcaccttgtatttg

SEQ ID NO: 10572 - DNA, 30 bp, Artificial Sequence
  Synthetic Construct
cactacttgttggtctgagaattaggaaag

SEQ ID NO: 10573 - DNA, 29 bp, Artificial Sequence
  Synthetic Construct
ggctgtccataaccttcttttagatctag

SEQ ID NO: 10574 - DNA, 22 bp, Artificial Sequence
  Synthetic Construct
gggcttttctttgtgtgccttt

SEQ ID NO: 10575 - DNA, 20 bp, Artificial Sequence
  Synthetic Construct
gggaatcccctgccaacctt

SEQ ID NO: 10576 - DNA, 19 bp, Artificial Sequence
  Synthetic Construct
ccccttggtgcctgtgatg

SEQ ID NO: 10577 - DNA, 23 bp, Artificial Sequence
  Synthetic Construct
agagcattctggaaaaggtgtga

SEQ ID NO: 10578 - DNA, 22 bp, Artificial Sequence
  Synthetic Construct
ggtcatccacaagcacctgaat

SEQ ID NO: 10579 - DNA, 24 bp, Artificial Sequence
  Synthetic Construct
gcacaccatagtggcatattttgg

SEQ ID NO: 10580 - DNA, 23 bp, Artificial Sequence
  Synthetic Construct
gacacgtatctgacaggggattt

SEQ ID NO: 10581 - DNA, 18 bp, Artificial Sequence
  Synthetic Construct
aggccctggttgcatgga

SEQ ID NO: 10582 - DNA, 21 bp, Artificial Sequence
  Synthetic Construct
tcggaggtcacagctctcata

SEQ ID NO: 10583 - DNA, 26 bp, Artificial Sequence
  Synthetic Construct
ggagtactttgtcatatcccaatgga

SEQ ID NO: 10584 - DNA, 21 bp, Artificial Sequence
  Synthetic Construct
aggacaggcctatccagtcaa

SEQ ID NO: 10585 - DNA, 24 bp, Artificial Sequence
  Synthetic Construct
ccagggctacagagttagatgagt

SEQ ID NO: 10586 - DNA, 29 bp, Artificial Sequence
  Synthetic Construct
ccaaaacagaaatgtccaacatatttagc

SEQ ID NO: 10587 - DNA, 28 bp, Artificial Sequence
  Synthetic Construct
agatggataaggtgtgaggatttattga

SEQ ID NO: 10588 - DNA, 22 bp, Artificial Sequence
  Synthetic Construct
cctgtcccccaagaatcttacc

SEQ ID NO: 10589 - DNA, 20 bp, Artificial Sequence
  Synthetic Construct
ttctgctcgtgggctccttt

SEQ ID NO: 10590 - DNA, 21 bp, Artificial Sequence
  Synthetic Construct
acaggaaggagccttgtgaag

SEQ ID NO: 10591 - DNA, 19 bp, Artificial Sequence
  Synthetic Construct
aggcctgttcctgccttga

SEQ ID NO: 10592 - DNA, 22 bp, Artificial Sequence
  Synthetic Construct
gtgaacgacggggatgtttaca

SEQ ID NO: 10593 - DNA, 24 bp, Artificial Sequence
  Synthetic Construct
gagtggcaggatagggattaggtt

SEQ ID NO: 10594 - DNA, 21 bp, Artificial Sequence
  Synthetic Construct
ctaaggaagtgtggccatgct

SEQ ID NO: 10595 - DNA, 24 bp, Artificial Sequence
  Synthetic Construct
tcaatttcccaagagctggtaagg

SEQ ID NO: 10596 - DNA, 19 bp, Artificial Sequence
  Synthetic Construct
tgggggctgcccatcaatt

SEQ ID NO: 10597 - DNA, 23 bp, Artificial Sequence
  Synthetic Construct
gcattgattagggatgcgacctt

SEQ ID NO: 10598 - DNA, 21 bp, Artificial Sequence
  Synthetic Construct
tcaggactccagtctcatgca

SEQ ID NO: 10599 - DNA, 19 bp, Artificial Sequence
  Synthetic Construct
tccgcacaggaggctctgt

SEQ ID NO: 10600 - DNA, 24 bp, Artificial Sequence
  Synthetic Construct
cctgctgcagagtccttcattctt

SEQ ID NO: 10601 - DNA, 21 bp, Artificial Sequence
  Synthetic Construct
tttggccattcctccaacact

SEQ ID NO: 10602 - DNA, 24 bp, Artificial Sequence
  Synthetic Construct
ctttcactgaagctctcctactgt

SEQ ID NO: 10603 - DNA, 25 bp, Artificial Sequence
  Synthetic Construct
gtctaagtaagggtgtgatggtgtt

SEQ ID NO: 10604 - DNA, 30 bp, Artificial Sequence
  Synthetic Construct
cacataaacagctggagaatgttaaagatg

SEQ ID NO: 10605 - DNA, 23 bp, Artificial Sequence
  Synthetic Construct
gaggggtgtcaggtatgtttagg

SEQ ID NO: 10606 - DNA, 21 bp, Artificial Sequence
  Synthetic Construct
ctgggttatggcatgcaagga

SEQ ID NO: 10607 - DNA, 27 bp, Artificial Sequence
  Synthetic Construct
gggaaacatacactttaggtgctctgt

SEQ ID NO: 10608 - DNA, 24 bp, Artificial Sequence
  Synthetic Construct
gggaatctgaactcctgagtgtgt

SEQ ID NO: 10609 - DNA, 25 bp, Artificial Sequence
  Synthetic Construct
cctggaaagggtaaaacttgctgat

SEQ ID NO: 10610 - DNA, 22 bp, Artificial Sequence
  Synthetic Construct
gactcagcatgactccaatgca

SEQ ID NO: 10611 - DNA, 25 bp, Artificial Sequence
  Synthetic Construct
gctcaccagcttgctttagaactga

SEQ ID NO: 10612 - DNA, 22 bp, Artificial Sequence
  Synthetic Construct
tcctgctctggctctattctgt

SEQ ID NO: 10613 - DNA, 28 bp, Artificial Sequence
  Synthetic Construct
ggggttaatggtctgtagactgaaatca

SEQ ID NO: 10614 - DNA, 30 bp, Artificial Sequence
  Synthetic Construct
cagcttggtagagattttaggaagaatgtt

SEQ ID NO: 10615 - DNA, 25 bp, Artificial Sequence
  Synthetic Construct
tgggactaggacctagagaaatagg

SEQ ID NO: 10616 - DNA, 19 bp, Artificial Sequence
  Synthetic Construct
gcgtgggaccctctcttct

SEQ ID NO: 10617 - DNA, 22 bp, Artificial Sequence
  Synthetic Construct
tggacctgggtctttcagaagt

SEQ ID NO: 10618 - DNA, 21 bp, Artificial Sequence
  Synthetic Construct
agcttgactttggagcttgct

SEQ ID NO: 10619 - DNA, 21 bp, Artificial Sequence
  Synthetic Construct
tgctcaagggaaggagttgtg

SEQ ID NO: 10620 - DNA, 29 bp, Artificial Sequence
  Synthetic Construct
gggaataggagttagatgaactggaattg

SEQ ID NO: 10621 - DNA, 21 bp, Artificial Sequence
  Synthetic Construct
aagagggagcaaagccttctc

SEQ ID NO: 10622 - DNA, 26 bp, Artificial Sequence
  Synthetic Construct
gagcacctgtccatttgtatttaggt

SEQ ID NO: 10623 - DNA, 28 bp, Artificial Sequence
  Synthetic Construct
cgtgagcatttctaaatgattgtggaat

SEQ ID NO: 10624 - DNA, 20 bp, Artificial Sequence
  Synthetic Construct
tgggagggtggttccaaaga

SEQ ID NO: 10625 - DNA, 20 bp, Artificial Sequence
  Synthetic Construct
cagaacctgctgcagacact

SEQ ID NO: 10626 - DNA, 23 bp, Artificial Sequence
  Synthetic Construct
gttctggtgtttctgaccctcaa

SEQ ID NO: 10627 - DNA, 21 bp, Artificial Sequence
  Synthetic Construct
tccaagccctggcctaaaagt

SEQ ID NO: 10628 - DNA, 22 bp, Artificial Sequence
  Synthetic Construct
agcagctcctgtagtccttgaa

SEQ ID NO: 10629 - DNA, 26 bp, Artificial Sequence
  Synthetic Construct
gtgagaaccaagaccttctaatcagt

SEQ ID NO: 10630 - DNA, 21 bp, Artificial Sequence
  Synthetic Construct
gcaggaagcaactttgtgctt

SEQ ID NO: 10631 - DNA, 24 bp, Artificial Sequence
  Synthetic Construct
ccagaagggattaagcacaaagtg

SEQ ID NO: 10632 - DNA, 21 bp, Artificial Sequence
  Synthetic Construct
accaacacctgcctcattggt

SEQ ID NO: 10633 - DNA, 22 bp, Artificial Sequence
  Synthetic Construct
ctcttcagttgcgccttttgag

SEQ ID NO: 10634 - DNA, 25 bp, Artificial Sequence
  Synthetic Construct
agccattgtatcttttgcagttacc

SEQ ID NO: 10635 - DNA, 27 bp, Artificial Sequence
  Synthetic Construct
ggaaccttgagaagtcttcatcatttc

SEQ ID NO: 10636 - DNA, 21 bp, Artificial Sequence
  Synthetic Construct
tgctgccactgtgacaaagca

SEQ ID NO: 10637 - DNA, 27 bp, Artificial Sequence
  Synthetic Construct
ctgtttccctatctgaatccctgttac

SEQ ID NO: 10638 - DNA, 30 bp, Artificial Sequence
  Synthetic Construct
aagaaacaaaacaaaacattaagctgtctt

SEQ ID NO: 10639 - DNA, 23 bp, Artificial Sequence
  Synthetic Construct
agaacactagcaggcagtaagga

SEQ ID NO: 10640 - DNA, 26 bp, Artificial Sequence
  Synthetic Construct
ccaaaccaactgaaaacctgtattgg

SEQ ID NO: 10641 - DNA, 25 bp, Artificial Sequence
  Synthetic Construct
caggagaccaggtttctagtttctg

SEQ ID NO: 10642 - DNA, 27 bp, Artificial Sequence
  Synthetic Construct
ttagtgtatggggtctagaatggattg

SEQ ID NO: 10643 - DNA, 20 bp, Artificial Sequence
  Synthetic Construct
gcctctatgccaggccaagt

SEQ ID NO: 10644 - DNA, 20 bp, Artificial Sequence
  Synthetic Construct
tgggagcatggcctgatgga

SEQ ID NO: 10645 - DNA, 22 bp, Artificial Sequence
  Synthetic Construct
tgccattcctcactcagtgcat

SEQ ID NO: 10646 - DNA, 21 bp, Artificial Sequence
  Synthetic Construct
ccattgacatgtggccttcga

SEQ ID NO: 10647 - DNA, 19 bp, Artificial Sequence
  Synthetic Construct
agcacctgcaaaccgttga

SEQ ID NO: 10648 - DNA, 23 bp, Artificial Sequence
  Synthetic Construct
gaggagcaggagagatgaatctg

SEQ ID NO: 10649 - DNA, 22 bp, Artificial Sequence
  Synthetic Construct
agtcaagcccctcttccatagg

SEQ ID NO: 10650 - DNA, 23 bp, Artificial Sequence
  Synthetic Construct
ggacagacatattggtccccatt

SEQ ID NO: 10651 - DNA, 24 bp, Artificial Sequence
  Synthetic Construct
ggagaagggtgagaaaagaacaga

SEQ ID NO: 10652 - DNA, 24 bp, Artificial Sequence
  Synthetic Construct
ggtggaaggtcacgaacatcaaac

SEQ ID NO: 10653 - DNA, 30 bp, Artificial Sequence
  Synthetic Construct
cataaaagtagggttgtaacggaaatacag

SEQ ID NO: 10654 - DNA, 18 bp, Artificial Sequence
  Synthetic Construct
gctggctggctccaagct

SEQ ID NO: 10655 - DNA, 24 bp, Artificial Sequence
  Synthetic Construct
gcaccctttccccagagctttaaa

SEQ ID NO: 10656 - DNA, 26 bp, Artificial Sequence
  Synthetic Construct
agctgtagagtgagacttaggaatca

SEQ ID NO: 10657 - DNA, 28 bp, Artificial Sequence
  Synthetic Construct
ttcctataactaactcgctcagtttaca

SEQ ID NO: 10658 - DNA, 24 bp, Artificial Sequence
  Synthetic Construct
gtggcttcaggatttagagaaggt

SEQ ID NO: 10659 - DNA, 22 bp, Artificial Sequence
  Synthetic Construct
tgttttacagagctgggggttt

SEQ ID NO: 10660 - DNA, 24 bp, Artificial Sequence
  Synthetic Construct
cctgtctgtaggaccaggtttcta

SEQ ID NO: 10661 - DNA, 26 bp, Artificial Sequence
  Synthetic Construct
acacagctccaagtaaatgataggaa

SEQ ID NO: 10662 - DNA, 22 bp, Artificial Sequence
  Synthetic Construct
gggggcttaagcaagaaacact

SEQ ID NO: 10663 - DNA, 25 bp, Artificial Sequence
  Synthetic Construct
gtctcaaacacaccatgctcttttc

SEQ ID NO: 10664 - DNA, 19 bp, Artificial Sequence
  Synthetic Construct
tgctccagtggtccttcca

SEQ ID NO: 10665 - DNA, 21 bp, Artificial Sequence
  Synthetic Construct
acagcagggttgaggaatgga

SEQ ID NO: 10666 - DNA, 30 bp, Artificial Sequence
  Synthetic Construct
tgttcaaacatacagtatagtctacatggt

SEQ ID NO: 10667 - DNA, 20 bp, Artificial Sequence
  Synthetic Construct
agccgcttccacctcttttg

SEQ ID NO: 10668 - DNA, 22 bp, Artificial Sequence
  Synthetic Construct
aaagatggctggtgcagtagga

SEQ ID NO: 10669 - DNA, 22 bp, Artificial Sequence
  Synthetic Construct
cagactcaccctccctccttac

SEQ ID NO: 10670 - DNA, 23 bp, Artificial Sequence
  Synthetic Construct
cgattatgaggcccaccaaggta

SEQ ID NO: 10671 - DNA, 21 bp, Artificial Sequence
  Synthetic Construct
gcccatctgctccttcctact

SEQ ID NO: 10672 - DNA, 25 bp, Artificial Sequence
  Synthetic Construct
ggcagaaatcattgatgctgtgact

SEQ ID NO: 10673 - DNA, 20 bp, Artificial Sequence
  Synthetic Construct
agtcagccactgggaaggaa

SEQ ID NO: 10674 - DNA, 25 bp, Artificial Sequence
  Synthetic Construct
gaaccctcctctgaacctgaataag

SEQ ID NO: 10675 - DNA, 25 bp, Artificial Sequence
  Synthetic Construct
caactgaaaaggactagaggtagca

SEQ ID NO: 10676 - DNA, 23 bp, Artificial Sequence
  Synthetic Construct
tcctccttcatcccaatcaagga

SEQ ID NO: 10677 - DNA, 20 bp, Artificial Sequence
  Synthetic Construct
ccccaaacaaggaggcagaa

SEQ ID NO: 10678 - DNA, 25 bp, Artificial Sequence
  Synthetic Construct
ccatctccatgttgcagaaggactt

SEQ ID NO: 10679 - DNA, 27 bp, Artificial Sequence
  Synthetic Construct
cgtgctagagatacagtagctgtcaag

SEQ ID NO: 10680 - DNA, 20 bp, Artificial Sequence
  Synthetic Construct
aggatcccgccacaaaagga

SEQ ID NO: 10681 - DNA, 23 bp, Artificial Sequence
  Synthetic Construct
acagattggaactgccacagaac

SEQ ID NO: 10682 - DNA, 22 bp, Artificial Sequence
  Synthetic Construct
aggtggggaagatcagctatgg

SEQ ID NO: 10683 - DNA, 30 bp, Artificial Sequence
  Synthetic Construct
cagtgtggaaaatactattccaaagataca

SEQ ID NO: 10684 - DNA, 20 bp, Artificial Sequence
  Synthetic Construct
atctcagggtcctgcaagga

SEQ ID NO: 10685 - DNA, 23 bp, Artificial Sequence
  Synthetic Construct
tcctagtcatcttggcagtgtct

SEQ ID NO: 10686 - DNA, 23 bp, Artificial Sequence
  Synthetic Construct
acccaggattggtcactgaagga

SEQ ID NO: 10687 - DNA, 24 bp, Artificial Sequence
  Synthetic Construct
ggaccatggttgatagcaagtact

SEQ ID NO: 10688 - DNA, 24 bp, Artificial Sequence
  Synthetic Construct
caggcaagtcaattttccatttgc

SEQ ID NO: 10689 - DNA, 24 bp, Artificial Sequence
  Synthetic Construct
gtccttgccttacagagcttaagg

SEQ ID NO: 10690 - DNA, 23 bp, Artificial Sequence
  Synthetic Construct
tccgagtccaccaaatcctagga

SEQ ID NO: 10691 - DNA, 23 bp, Artificial Sequence
  Synthetic Construct
atctgccttgtgctagacatgaa

SEQ ID NO: 10692 - DNA, 26 bp, Artificial Sequence
  Synthetic Construct
ccctcacacctcaggatgtttttctc

SEQ ID NO: 10693 - DNA, 22 bp, Artificial Sequence
  Synthetic Construct
gccttggttcttgtcctacagt

SEQ ID NO: 10694 - DNA, 24 bp, Artificial Sequence
  Synthetic Construct
tgctgcagacacttaatacacact

SEQ ID NO: 10695 - DNA, 19 bp, Artificial Sequence
  Synthetic Construct
ttgggtgccgtggctcaca

SEQ ID NO: 10696 - DNA, 29 bp, Artificial Sequence
  Synthetic Construct
tttaaacattccaatttagcacgtttcaa

SEQ ID NO: 10697 - DNA, 20 bp, Artificial Sequence
  Synthetic Construct
tcaggtgcctggcagtaagt

SEQ ID NO: 10698 - DNA, 24 bp, Artificial Sequence
  Synthetic Construct
gatttgctgaacgagatggatcct

SEQ ID NO: 10699 - DNA, 30 bp, Artificial Sequence
  Synthetic Construct
gcagatcatatcatggaggaatcattgtgt

SEQ ID NO: 10700 - DNA, 25 bp, Artificial Sequence
  Synthetic Construct
ccacaacagtgtatctgatcacaga

SEQ ID NO: 10701 - DNA, 20 bp, Artificial Sequence
  Synthetic Construct
ttcgctgctgcttctccttt

SEQ ID NO: 10702 - DNA, 23 bp, Artificial Sequence
  Synthetic Construct
aaggtgtgagtaggtgggtctga

SEQ ID NO: 10703 - DNA, 20 bp, Artificial Sequence
  Synthetic Construct
tgcagccgagaccccaagaa

SEQ ID NO: 10704 - DNA, 22 bp, Artificial Sequence
  Synthetic Construct
agagtgcatgaggcttggatct

SEQ ID NO: 10705 - DNA, 29 bp, Artificial Sequence
  Synthetic Construct
ttttgggggaaattgacaactttagatta

SEQ ID NO: 10706 - DNA, 22 bp, Artificial Sequence
  Synthetic Construct
cctttgctcagcaactgaacag

SEQ ID NO: 10707 - DNA, 22 bp, Artificial Sequence
  Synthetic Construct
catcgaatctccacacccacat

SEQ ID NO: 10708 - DNA, 21 bp, Artificial Sequence
  Synthetic Construct
ccatcactgactgcgtggtaa

SEQ ID NO: 10709 - DNA, 23 bp, Artificial Sequence
  Synthetic Construct
caccataccccatgaagagttca

SEQ ID NO: 10710 - DNA, 22 bp, Artificial Sequence
  Synthetic Construct
ctgggccaattccttgtgaaga

SEQ ID NO: 10711 - DNA, 29 bp, Artificial Sequence
  Synthetic Construct
tgaaattcgagagagagcttacatttcta

SEQ ID NO: 10712 - DNA, 21 bp, Artificial Sequence
  Synthetic Construct
ctctcagccagctacctagga

SEQ ID NO: 10713 - DNA, 21 bp, Artificial Sequence
  Synthetic Construct
acatcctcttgtcccctgcat

SEQ ID NO: 10714 - DNA, 21 bp, Artificial Sequence
  Synthetic Construct
taggtctgcccgccttacagt

SEQ ID NO: 10715 - DNA, 23 bp, Artificial Sequence
  Synthetic Construct
agagtccaggcttctctctctct

SEQ ID NO: 10716 - DNA, 24 bp, Artificial Sequence
  Synthetic Construct
ggcagagctcatctttgaaatgag

SEQ ID NO: 10717 - DNA, 24 bp, Artificial Sequence
  Synthetic Construct
tgagagaacagggcaaggtaaaac

SEQ ID NO: 10718 - DNA, 20 bp, Artificial Sequence
  Synthetic Construct
tctccccaccgacaaacctt

SEQ ID NO: 10719 - DNA, 22 bp, Artificial Sequence
  Synthetic Construct
gttcacagggaaagtgctgagt

SEQ ID NO: 10720 - DNA, 24 bp, Artificial Sequence
  Synthetic Construct
ccctctgttttaggaagagaagca

SEQ ID NO: 10721 - DNA, 26 bp, Artificial Sequence
  Synthetic Construct
atctctggtaatggcttaagaaacca

SEQ ID NO: 10722 - DNA, 24 bp, Artificial Sequence
  Synthetic Construct
ctaggtcactgtggaagacacttt

SEQ ID NO: 10723 - DNA, 23 bp, Artificial Sequence
  Synthetic Construct
gaatttgcacagcgctttatggt

SEQ ID NO: 10724 - DNA, 20 bp, Artificial Sequence
  Synthetic Construct
ccccggtgcatttcctagga

SEQ ID NO: 10725 - DNA, 21 bp, Artificial Sequence
  Synthetic Construct
gcccatcagctgtctgtttgc

SEQ ID NO: 10726 - DNA, 24 bp, Artificial Sequence
  Synthetic Construct
ccacatgctttgtcactggcatac

SEQ ID NO: 10727 - DNA, 28 bp, Artificial Sequence
  Synthetic Construct
ctcttagggatccaagaatagttgttga

SEQ ID NO: 10728 - DNA, 26 bp, Artificial Sequence
  Synthetic Construct
ggattgaaaagagcagggatgacaga

SEQ ID NO: 10729 - DNA, 21 bp, Artificial Sequence
  Synthetic Construct
tcccctggaggaatggtttct

SEQ ID NO: 10730 - DNA, 18 bp, Artificial Sequence
  Synthetic Construct
tccaagggtgcccagtga

SEQ ID NO: 10731 - DNA, 21 bp, Artificial Sequence
  Synthetic Construct
cccagtgtagaccgtcatgga

SEQ ID NO: 10732 - DNA, 28 bp, Artificial Sequence
  Synthetic Construct
tgtgagtgtcccaaactttaagatacaa

SEQ ID NO: 10733 - DNA, 30 bp, Artificial Sequence
  Synthetic Construct
gggtgtgaatgaactatttacatgaagaag

SEQ ID NO: 10734 - DNA, 18 bp, Artificial Sequence
  Synthetic Construct
cctgcccgtccacctaca

SEQ ID NO: 10735 - DNA, 24 bp, Artificial Sequence
  Synthetic Construct
gggcaagtagtgtttcgtggctta

SEQ ID NO: 10736 - DNA, 24 bp, Artificial Sequence
  Synthetic Construct
cccctagccttgaattgcctctat

SEQ ID NO: 10737 - DNA, 22 bp, Artificial Sequence
  Synthetic Construct
ttccctaagtgtgggccaaagg

SEQ ID NO: 10738 - DNA, 30 bp, Artificial Sequence
  Synthetic Construct
ctttgaattcagccttccttacataattct

SEQ ID NO: 10739 - DNA, 24 bp, Artificial Sequence
  Synthetic Construct
agtgattgtctggaacatgcaaga

SEQ ID NO: 10740 - DNA, 24 bp, Artificial Sequence
  Synthetic Construct
cacaggctcatcagacaagaggat

SEQ ID NO: 10741 - DNA, 23 bp, Artificial Sequence
  Synthetic Construct
tggcaaagaggctaaggacattg

SEQ ID NO: 10742 - DNA, 21 bp, Artificial Sequence
  Synthetic Construct
ccctggcatcataggggctta

SEQ ID NO: 10743 - DNA, 24 bp, Artificial Sequence
  Synthetic Construct
agaagtggtaccattttgctcagt

SEQ ID NO: 10744 - DNA, 18 bp, Artificial Sequence
  Synthetic Construct
aggtgcatggccctctct

SEQ ID NO: 10745 - DNA, 27 bp, Artificial Sequence
  Synthetic Construct
caggataaccaaagtacaaaggaccat

SEQ ID NO: 10746 - DNA, 22 bp, Artificial Sequence
  Synthetic Construct
cctcaatcacctgtcccttgtt

SEQ ID NO: 10747 - DNA, 27 bp, Artificial Sequence
  Synthetic Construct
ggtgtcaagtcaaattaacttgccatt

SEQ ID NO: 10748 - DNA, 24 bp, Artificial Sequence
  Synthetic Construct
ccacttgtctgtcccttcttagct

SEQ ID NO: 10749 - DNA, 22 bp, Artificial Sequence
  Synthetic Construct
gggggaaagctggtgttctact

SEQ ID NO: 10750 - DNA, 30 bp, Artificial Sequence
  Synthetic Construct
cccaagtactactaatacattaccctcact

SEQ ID NO: 10751 - DNA, 29 bp, Artificial Sequence
  Synthetic Construct
ggaaagctattgaatggttataacgacat

SEQ ID NO: 10752 - DNA, 26 bp, Artificial Sequence
  Synthetic Construct
cgtagatttggatggaagtgggagta

SEQ ID NO: 10753 - DNA, 29 bp, Artificial Sequence
  Synthetic Construct
tcattccagctctaagtaatagcttactg

SEQ ID NO: 10754 - DNA, 25 bp, Artificial Sequence
  Synthetic Construct
cagcataaggtagtctacccaccaa

SEQ ID NO: 10755 - DNA, 19 bp, Artificial Sequence
  Synthetic Construct
accaggggcctgagaactg

SEQ ID NO: 10756 - DNA, 22 bp, Artificial Sequence
  Synthetic Construct
ctgtggtgattcctgtgtgtct

SEQ ID NO: 10757 - DNA, 26 bp, Artificial Sequence
  Synthetic Construct
gcaaataacctgaagacgctcatagg

SEQ ID NO: 10758 - DNA, 19 bp, Artificial Sequence
  Synthetic Construct
gcaaggaaaggggcttcca

SEQ ID NO: 10759 - DNA, 24 bp, Artificial Sequence
  Synthetic Construct
ggaggttctcctgaatgtgtgtag

SEQ ID NO: 10760 - DNA, 21 bp, Artificial Sequence
  Synthetic Construct
agctcagccaaccacaatgtg

SEQ ID NO: 10761 - DNA, 24 bp, Artificial Sequence
  Synthetic Construct
cacactggatgggatcatcaactc

SEQ ID NO: 10762 - DNA, 22 bp, Artificial Sequence
  Synthetic Construct
aggcatgcaacctagcaatgag

SEQ ID NO: 10763 - DNA, 20 bp, Artificial Sequence
  Synthetic Construct
ctgccagtcacagcttcagt

SEQ ID NO: 10764 - DNA, 27 bp, Artificial Sequence
  Synthetic Construct
ccaagagctaaaattccgtgactctct

SEQ ID NO: 10765 - DNA, 27 bp, Artificial Sequence
  Synthetic Construct
gctccggagttatttttaatgcacaac

SEQ ID NO: 10766 - DNA, 23 bp, Artificial Sequence
  Synthetic Construct
agggatcataggggactgaatcc

SEQ ID NO: 10767 - DNA, 21 bp, Artificial Sequence
  Synthetic Construct
accaggagacctcagcaacca

SEQ ID NO: 10768 - DNA, 27 bp, Artificial Sequence
  Synthetic Construct
cagaacttgtgagcaaatgattgagtt

SEQ ID NO: 10769 - DNA, 26 bp, Artificial Sequence
  Synthetic Construct
cccaggccaactaattttctcatctg

SEQ ID NO: 10770 - DNA, 26 bp, Artificial Sequence
  Synthetic Construct
aattccaaaactggatggagaatgtg

SEQ ID NO: 10771 - DNA, 24 bp, Artificial Sequence
  Synthetic Construct
cataggtgaagtgcttagcaatgg

SEQ ID NO: 10772 - DNA, 24 bp, Artificial Sequence
  Synthetic Construct
gggctaaagtacaggttgttagca

SEQ ID NO: 10773 - DNA, 23 bp, Artificial Sequence
  Synthetic Construct
gtcatcacccaatgagcctatga

SEQ ID NO: 10774 - DNA, 30 bp, Artificial Sequence
  Synthetic Construct
ggcatgacttacaactacttaacaggttac

SEQ ID NO: 10775 - DNA, 22 bp, Artificial Sequence
  Synthetic Construct
agagtcacctgtgagtgtggtt

SEQ ID NO: 10776 - DNA, 27 bp, Artificial Sequence
  Synthetic Construct
gagcataaatggacaagaattctgctt

SEQ ID NO: 10777 - DNA, 25 bp, Artificial Sequence
  Synthetic Construct
cctctcattactctcccttcactct

SEQ ID NO: 10778 - DNA, 23 bp, Artificial Sequence
  Synthetic Construct
ggcactgaagaagcaaacagaca

SEQ ID NO: 10779 - DNA, 29 bp, Artificial Sequence
  Synthetic Construct
ggagaaaaaacagggaggtttatttttca

SEQ ID NO: 10780 - DNA, 18 bp, Artificial Sequence
  Synthetic Construct
ccttggccagctgggttt

SEQ ID NO: 10781 - DNA, 21 bp, Artificial Sequence
  Synthetic Construct
atggggaggcctgtcttaaga

SEQ ID NO: 10782 - DNA, 21 bp, Artificial Sequence
  Synthetic Construct
tgcctcctaacggccaaatag

SEQ ID NO: 10783 - DNA, 21 bp, Artificial Sequence
  Synthetic Construct
ccaagtcttgggagggtcttg

SEQ ID NO: 10784 - DNA, 18 bp, Artificial Sequence
  Synthetic Construct
cggcagtgggctttccaa

SEQ ID NO: 10785 - DNA, 22 bp, Artificial Sequence
  Synthetic Construct
tgtgtgtctggtggctgataca

SEQ ID NO: 10786 - DNA, 20 bp, Artificial Sequence
  Synthetic Construct
gatttggggtgccctttcct

SEQ ID NO: 10787 - DNA, 21 bp, Artificial Sequence
  Synthetic Construct
gccagtgcagagaggagagaa

SEQ ID NO: 10788 - DNA, 27 bp, Artificial Sequence
  Synthetic Construct
tcacctaagctggtaggataaaaacaa

SEQ ID NO: 10789 - DNA, 24 bp, Artificial Sequence
  Synthetic Construct
gagatactgtacacccagcaactg

SEQ ID NO: 10790 - DNA, 28 bp, Artificial Sequence
  Synthetic Construct
gaccttcatgcaaatactgtttctcaaa

SEQ ID NO: 10791 - DNA, 22 bp, Artificial Sequence
  Synthetic Construct
cacccaagtactcatccaccaa

SEQ ID NO: 10792 - DNA, 26 bp, Artificial Sequence
  Synthetic Construct
caaggcaaatgaagtcacttcctaag

SEQ ID NO: 10793 - DNA, 28 bp, Artificial Sequence
  Synthetic Construct
ctgctaaagaaagggtctaaggtttaga

SEQ ID NO: 10794 - DNA, 24 bp, Artificial Sequence
  Synthetic Construct
gtgtcatcacctagacttccagtt

SEQ ID NO: 10795 - DNA, 21 bp, Artificial Sequence
  Synthetic Construct
atccactttcccagggccaaa

SEQ ID NO: 10796 - DNA, 22 bp, Artificial Sequence
  Synthetic Construct
atgtgaggtagcctgtgttcag

SEQ ID NO: 10797 - DNA, 23 bp, Artificial Sequence
  Synthetic Construct
ggagccagtaccaggatatgctt

SEQ ID NO: 10798 - DNA, 30 bp, Artificial Sequence
  Synthetic Construct
tgagatgtaatatcatgaagttaggtgtgt

SEQ ID NO: 10799 - DNA, 22 bp, Artificial Sequence
  Synthetic Construct
tgaaaacggcatccccttcaga

SEQ ID NO: 10800 - DNA, 20 bp, Artificial Sequence
  Synthetic Construct
gcggcacagatggaaatgca

SEQ ID NO: 10801 - DNA, 20 bp, Artificial Sequence
  Synthetic Construct
ttcaatgcaccgcccaactt

SEQ ID NO: 10802 - DNA, 20 bp, Artificial Sequence
  Synthetic Construct
gaggaagagcaggccatcag

SEQ ID NO: 10803 - DNA, 24 bp, Artificial Sequence
  Synthetic Construct
actgtctaggactcgaggaatgga

SEQ ID NO: 10804 - DNA, 20 bp, Artificial Sequence
  Synthetic Construct
aggttgaccgccagattcct

SEQ ID NO: 10805 - DNA, 21 bp, Artificial Sequence
  Synthetic Construct
acccaatctctgcccccagta

SEQ ID NO: 10806 - DNA, 24 bp, Artificial Sequence
  Synthetic Construct
tgaacaatgagggtttgtgtgaca

SEQ ID NO: 10807 - DNA, 21 bp, Artificial Sequence
  Synthetic Construct
tctccagctctgggcctttaa

SEQ ID NO: 10808 - DNA, 22 bp, Artificial Sequence
  Synthetic Construct
aaagagctgcaggtcatccttt

SEQ ID NO: 10809 - DNA, 22 bp, Artificial Sequence
  Synthetic Construct
gagggacagcctggtattttgt

SEQ ID NO: 10810 - DNA, 29 bp, Artificial Sequence
  Synthetic Construct
cctgttgtactgaaagaagggatgatgag

SEQ ID NO: 10811 - DNA, 23 bp, Artificial Sequence
  Synthetic Construct
tcctcaaatccccccatctgtgt

SEQ ID NO: 10812 - DNA, 27 bp, Artificial Sequence
  Synthetic Construct
gagtagctgctccaaatatctgaagag

SEQ ID NO: 10813 - DNA, 19 bp, Artificial Sequence
  Synthetic Construct
acctcgactggcctctgtt

SEQ ID NO: 10814 - DNA, 20 bp, Artificial Sequence
  Synthetic Construct
ttgcgtgtacctgggttgct

SEQ ID NO: 10815 - DNA, 28 bp, Artificial Sequence
  Synthetic Construct
ctccaaaatcagagtaaattcagttgct

SEQ ID NO: 10816 - DNA, 19 bp, Artificial Sequence
  Synthetic Construct
ccagtgcctggctctcctt

SEQ ID NO: 10817 - DNA, 24 bp, Artificial Sequence
  Synthetic Construct
agtctgggtacaagctcaagttag

SEQ ID NO: 10818 - DNA, 27 bp, Artificial Sequence
  Synthetic Construct
ggtaaccaagaggtaagacagttttcc

SEQ ID NO: 10819 - DNA, 24 bp, Artificial Sequence
  Synthetic Construct
catcttgatttgatggcagagcaa

SEQ ID NO: 10820 - DNA, 24 bp, Artificial Sequence
  Synthetic Construct
accagatgatcaggagcacagaca

SEQ ID NO: 10821 - DNA, 21 bp, Artificial Sequence
  Synthetic Construct
tcaatcccagctgcagtggtt

SEQ ID NO: 10822 - DNA, 22 bp, Artificial Sequence
  Synthetic Construct
gctccacagaagctagctagga

SEQ ID NO: 10823 - DNA, 28 bp, Artificial Sequence
  Synthetic Construct
catttgtgttaataaacggcaagaacat

SEQ ID NO: 10824 - DNA, 24 bp, Artificial Sequence
  Synthetic Construct
cctgagccttgtgatcttctggat

SEQ ID NO: 10825 - DNA, 23 bp, Artificial Sequence
  Synthetic Construct
tgggccaagtcatgtaatgagtt

SEQ ID NO: 10826 - DNA, 20 bp, Artificial Sequence
  Synthetic Construct
ggcgagagagagccctctac

SEQ ID NO: 10827 - DNA, 28 bp, Artificial Sequence
  Synthetic Construct
tgaactatgctcattttaccaagaagga

SEQ ID NO: 10828 - DNA, 23 bp, Artificial Sequence
  Synthetic Construct
ccaccaacacccttctctactgt

SEQ ID NO: 10829 - DNA, 24 bp, Artificial Sequence
  Synthetic Construct
tgttggtttcctcaagttgtctga

SEQ ID NO: 10830 - DNA, 23 bp, Artificial Sequence
  Synthetic Construct
ccctgtcttcatccatagcgttt

SEQ ID NO: 10831 - DNA, 26 bp, Artificial Sequence
  Synthetic Construct
ggtgacactcagaacaatgtgcattc

SEQ ID NO: 10832 - DNA, 24 bp, Artificial Sequence
  Synthetic Construct
tctttgccataattgggcatgaac

SEQ ID NO: 10833 - DNA, 22 bp, Artificial Sequence
  Synthetic Construct
agcaacagaggaaagacaagct

SEQ ID NO: 10834 - DNA, 24 bp, Artificial Sequence
  Synthetic Construct
gcccttgatgctgtggaatccatt

SEQ ID NO: 10835 - DNA, 27 bp, Artificial Sequence
  Synthetic Construct
gactatgtctggtgcatttaaattgga

SEQ ID NO: 10836 - DNA, 22 bp, Artificial Sequence
  Synthetic Construct
caatgggcacagaactgttcag

SEQ ID NO: 10837 - DNA, 20 bp, Artificial Sequence
  Synthetic Construct
ccagcaggggccattatagc

SEQ ID NO: 10838 - DNA, 23 bp, Artificial Sequence
  Synthetic Construct
gccttaagtcccagtgatctgtt

SEQ ID NO: 10839 - DNA, 25 bp, Artificial Sequence
  Synthetic Construct
ccattgtatagccccaatcctagct

SEQ ID NO: 10840 - DNA, 27 bp, Artificial Sequence
  Synthetic Construct
gactgcacctctaacttagataatgct

SEQ ID NO: 10841 - DNA, 26 bp, Artificial Sequence
  Synthetic Construct
caggaagtgaaagctatggcagaatt

SEQ ID NO: 10842 - DNA, 24 bp, Artificial Sequence
  Synthetic Construct
ccagatatgcgcacttctctctca

SEQ ID NO: 10843 - DNA, 18 bp, Artificial Sequence
  Synthetic Construct
agtgctgggcctggaaga

SEQ ID NO: 10844 - DNA, 28 bp, Artificial Sequence
  Synthetic Construct
gggggcatttttatgatagctgcttttc

SEQ ID NO: 10845 - DNA, 23 bp, Artificial Sequence
  Synthetic Construct
cctgtttcacagacgtggaaagg

SEQ ID NO: 10846 - DNA, 25 bp, Artificial Sequence
  Synthetic Construct
ggctgagaggctgtgttttagaaac

SEQ ID NO: 10847 - DNA, 22 bp, Artificial Sequence
  Synthetic Construct
tcagtagctggggcttgtatgt

SEQ ID NO: 10848 - DNA, 24 bp, Artificial Sequence
  Synthetic Construct
cacaagtaatgcttctggctttcc

SEQ ID NO: 10849 - DNA, 25 bp, Artificial Sequence
  Synthetic Construct
tgctttcctgatcatgttgattcct

SEQ ID NO: 10850 - DNA, 23 bp, Artificial Sequence
  Synthetic Construct
gtacaagacaaagggcctgatgt

SEQ ID NO: 10851 - DNA, 24 bp, Artificial Sequence
  Synthetic Construct
caacctccgttcctcaaacataac

SEQ ID NO: 10852 - DNA, 25 bp, Artificial Sequence
  Synthetic Construct
gagttttctttgggaagcaagttca

SEQ ID NO: 10853 - DNA, 20 bp, Artificial Sequence
  Synthetic Construct
tccagccatccccaccaaga

SEQ ID NO: 10854 - DNA, 26 bp, Artificial Sequence
  Synthetic Construct
gggtaccttgactctggaactgagat

SEQ ID NO: 10855 - DNA, 21 bp, Artificial Sequence
  Synthetic Construct
ccccacccttccaagacatca

SEQ ID NO: 10856 - DNA, 28 bp, Artificial Sequence
  Synthetic Construct
gcaaggagctacaaataatctggattcc

SEQ ID NO: 10857 - DNA, 20 bp, Artificial Sequence
  Synthetic Construct
ctctgcagccatgtctggaa

SEQ ID NO: 10858 - DNA, 21 bp, Artificial Sequence
  Synthetic Construct
tgttagaggagcccccagcat

SEQ ID NO: 10859 - DNA, 22 bp, Artificial Sequence
  Synthetic Construct
agaaccatagtgcctggaatgc

SEQ ID NO: 10860 - DNA, 21 bp, Artificial Sequence
  Synthetic Construct
gggaccaaagtcaaggcatgt

SEQ ID NO: 10861 - DNA, 22 bp, Artificial Sequence
  Synthetic Construct
gccgagctaggaattcttctca

SEQ ID NO: 10862 - DNA, 18 bp, Artificial Sequence
  Synthetic Construct
tggggcaaagggcatcag

SEQ ID NO: 10863 - DNA, 22 bp, Artificial Sequence
  Synthetic Construct
tttcccaggtcaccttgactgt

SEQ ID NO: 10864 - DNA, 18 bp, Artificial Sequence
  Synthetic Construct
tcacccccgtctcttgct

SEQ ID NO: 10865 - DNA, 24 bp, Artificial Sequence
  Synthetic Construct
agcccacactaggatgtttatcac

SEQ ID NO: 10866 - DNA, 21 bp, Artificial Sequence
  Synthetic Construct
tcactcttgggagcagaagga

SEQ ID NO: 10867 - DNA, 22 bp, Artificial Sequence
  Synthetic Construct
aattgccttggtgggaccctta

SEQ ID NO: 10868 - DNA, 26 bp, Artificial Sequence
  Synthetic Construct
ccacctgatttttagaaaccctgcat

SEQ ID NO: 10869 - DNA, 21 bp, Artificial Sequence
  Synthetic Construct
caccctgtgatgcactgactt

SEQ ID NO: 10870 - DNA, 22 bp, Artificial Sequence
  Synthetic Construct
cacatgcctggtggttaatgct

SEQ ID NO: 10871 - DNA, 19 bp, Artificial Sequence
  Synthetic Construct
aggggccccagtgcacact

SEQ ID NO: 10872 - DNA, 24 bp, Artificial Sequence
  Synthetic Construct
acaggtttgtcttaggaggtagga

SEQ ID NO: 10873 - DNA, 21 bp, Artificial Sequence
  Synthetic Construct
tcagagcctgggatgcaatgg

SEQ ID NO: 10874 - DNA, 19 bp, Artificial Sequence
  Synthetic Construct
gatggccaccgctgagaag

SEQ ID NO: 10875 - DNA, 22 bp, Artificial Sequence
  Synthetic Construct
ttttgccttggagcatgtacct

SEQ ID NO: 10876 - DNA, 21 bp, Artificial Sequence
  Synthetic Construct
accatgctacaggccaccata

SEQ ID NO: 10877 - DNA, 26 bp, Artificial Sequence
  Synthetic Construct
cattaaatggctacacagtccatgtc

SEQ ID NO: 10878 - DNA, 24 bp, Artificial Sequence
  Synthetic Construct
tggggggggtgatattacaagact

SEQ ID NO: 10879 - DNA, 22 bp, Artificial Sequence
  Synthetic Construct
gctggccactgttaaaaaccaa

SEQ ID NO: 10880 - DNA, 26 bp, Artificial Sequence
  Synthetic Construct
aattcatttgtgtttcccctcttctc

SEQ ID NO: 10881 - DNA, 27 bp, Artificial Sequence
  Synthetic Construct
gggttagagtttttaagggttttggaa

SEQ ID NO: 10882 - DNA, 23 bp, Artificial Sequence
  Synthetic Construct
gccacaaccagcttcttttactt

SEQ ID NO: 10883 - DNA, 18 bp, Artificial Sequence
  Synthetic Construct
cagggcctggcacactgt

SEQ ID NO: 10884 - DNA, 21 bp, Artificial Sequence
  Synthetic Construct
acaggggtagagagaccgttt

SEQ ID NO: 10885 - DNA, 26 bp, Artificial Sequence
  Synthetic Construct
tcaacacctgtaggtaataacttgct

SEQ ID NO: 10886 - DNA, 22 bp, Artificial Sequence
  Synthetic Construct
cacaagtcagtgtgccaaggaa

SEQ ID NO: 10887 - DNA, 24 bp, Artificial Sequence
  Synthetic Construct
gctctcccttcttccttgggataa

SEQ ID NO: 10888 - DNA, 22 bp, Artificial Sequence
  Synthetic Construct
tgtcccaggtccttcagaaaca

SEQ ID NO: 10889 - DNA, 20 bp, Artificial Sequence
  Synthetic Construct
ttcccaatggccgaaaacca

SEQ ID NO: 10890 - DNA, 29 bp, Artificial Sequence
  Synthetic Construct
gcctgatgtatttactcctagagctgtag

SEQ ID NO: 10891 - DNA, 23 bp, Artificial Sequence
  Synthetic Construct
ttgtggctagacagcatgaatca

SEQ ID NO: 10892 - DNA, 24 bp, Artificial Sequence
  Synthetic Construct
agcagggctaccattgaacttagg

SEQ ID NO: 10893 - DNA, 28 bp, Artificial Sequence
  Synthetic Construct
actattaatagcaccgtaggtccctact

SEQ ID NO: 10894 - DNA, 22 bp, Artificial Sequence
  Synthetic Construct
cggaatgcctccagactgaatt

SEQ ID NO: 10895 - DNA, 23 bp, Artificial Sequence
  Synthetic Construct
ggctgtagggagagtgatctcaa

SEQ ID NO: 10896 - DNA, 24 bp, Artificial Sequence
  Synthetic Construct
cccagaagtactcatcaccattga

SEQ ID NO: 10897 - DNA, 25 bp, Artificial Sequence
  Synthetic Construct
gggccaagaaaaatcctgagtgttg

SEQ ID NO: 10898 - DNA, 26 bp, Artificial Sequence
  Synthetic Construct
gagaaagacagtctttgtacctttgg

SEQ ID NO: 10899 - DNA, 29 bp, Artificial Sequence
  Synthetic Construct
ttgtctctgaatatgaatagcatccttct

SEQ ID NO: 10900 - DNA, 23 bp, Artificial Sequence
  Synthetic Construct
tggtggactggtttttcctgatg

SEQ ID NO: 10901 - DNA, 29 bp, Artificial Sequence
  Synthetic Construct
gagaaatggaatttaaaagttgggtgctt

SEQ ID NO: 10902 - DNA, 23 bp, Artificial Sequence
  Synthetic Construct
gggttgatgtgaggatcagtcaa

SEQ ID NO: 10903 - DNA, 22 bp, Artificial Sequence
  Synthetic Construct
tggagtcaggtccaatcacatg

SEQ ID NO: 10904 - DNA, 30 bp, Artificial Sequence
  Synthetic Construct
gcttcttgagtacagtttttctcaatctgt

SEQ ID NO: 10905 - DNA, 23 bp, Artificial Sequence
  Synthetic Construct
tggctctccaacatatgttcaca

SEQ ID NO: 10906 - DNA, 21 bp, Artificial Sequence
  Synthetic Construct
ctgtctagtggcatgctcaca

SEQ ID NO: 10907 - DNA, 24 bp, Artificial Sequence
  Synthetic Construct
cactaagtcgaggcttgactctgt

SEQ ID NO: 10908 - DNA, 21 bp, Artificial Sequence
  Synthetic Construct
tttgctccacactgcatttgg

SEQ ID NO: 10909 - DNA, 22 bp, Artificial Sequence
  Synthetic Construct
tgggatagagtgggcagtttct

SEQ ID NO: 10910 - DNA, 20 bp, Artificial Sequence
  Synthetic Construct
accaaccgaggtcgctcctt

SEQ ID NO: 10911 - DNA, 30 bp, Artificial Sequence
  Synthetic Construct
acttaccttttatcttatttccagggaaga

SEQ ID NO: 10912 - DNA, 28 bp, Artificial Sequence
  Synthetic Construct
ggagccaagtttatgcttgatcttaagg

SEQ ID NO: 10913 - DNA, 21 bp, Artificial Sequence
  Synthetic Construct
aactggcagcaggaagagtca

SEQ ID NO: 10914 - DNA, 19 bp, Artificial Sequence
  Synthetic Construct
ggggagccagccactaagg

SEQ ID NO: 10915 - DNA, 20 bp, Artificial Sequence
  Synthetic Construct
atggggcctcggtgaattgt

SEQ ID NO: 10916 - DNA, 29 bp, Artificial Sequence
  Synthetic Construct
gggagactcaagtagaacatgtctgtagt

SEQ ID NO: 10917 - DNA, 24 bp, Artificial Sequence
  Synthetic Construct
gggtcttaaaagccccacattctt

SEQ ID NO: 10918 - DNA, 22 bp, Artificial Sequence
  Synthetic Construct
tggacacacctgctaggagaca

SEQ ID NO: 10919 - DNA, 30 bp, Artificial Sequence
  Synthetic Construct
ctgctttgcatatatggtgagaaatacata

SEQ ID NO: 10920 - DNA, 26 bp, Artificial Sequence
  Synthetic Construct
cccttgaactgtggactatcctgatc

SEQ ID NO: 10921 - DNA, 26 bp, Artificial Sequence
  Synthetic Construct
ggttctcaggaaggcatcatgctata

SEQ ID NO: 10922 - DNA, 25 bp, Artificial Sequence
  Synthetic Construct
gagtgagttgcctaaccttcaaaga

SEQ ID NO: 10923 - DNA, 25 bp, Artificial Sequence
  Synthetic Construct
gtgtggaggtggtttagtacaaaca

SEQ ID NO: 10924 - DNA, 29 bp, Artificial Sequence
  Synthetic Construct
gctgttggaatagaaattagcactaagtc

SEQ ID NO: 10925 - DNA, 26 bp, Artificial Sequence
  Synthetic Construct
caatacattcatcaccccttctcgat

SEQ ID NO: 10926 - DNA, 21 bp, Artificial Sequence
  Synthetic Construct
gccaaagaggagccctttcaa

SEQ ID NO: 10927 - DNA, 30 bp, Artificial Sequence
  Synthetic Construct
gcaagtgcttattgaatgctttctaagtgt

SEQ ID NO: 10928 - DNA, 24 bp, Artificial Sequence
  Synthetic Construct
cactgtcttcccagcccttaatct

SEQ ID NO: 10929 - DNA, 27 bp, Artificial Sequence
  Synthetic Construct
tcacaatcagatgacactgagacttag

SEQ ID NO: 10930 - DNA, 18 bp, Artificial Sequence
  Synthetic Construct
cccagaccaggccttcca

SEQ ID NO: 10931 - DNA, 22 bp, Artificial Sequence
  Synthetic Construct
ggtaaaagctggccatccatgt

SEQ ID NO: 10932 - DNA, 25 bp, Artificial Sequence
  Synthetic Construct
cactcttatcaagcaggatgttcca

SEQ ID NO: 10933 - DNA, 23 bp, Artificial Sequence
  Synthetic Construct
tgacattcagcatttcccttcgt

SEQ ID NO: 10934 - DNA, 25 bp, Artificial Sequence
  Synthetic Construct
cagatccatattctgacgacctgat

SEQ ID NO: 10935 - DNA, 22 bp, Artificial Sequence
  Synthetic Construct
ctcaacagctttggtgcagatg

SEQ ID NO: 10936 - DNA, 25 bp, Artificial Sequence
  Synthetic Construct
ggtagcagaccttcactatgtagtc

SEQ ID NO: 10937 - DNA, 24 bp, Artificial Sequence
  Synthetic Construct
cttccaagggatttccaccagaag

SEQ ID NO: 10938 - DNA, 29 bp, Artificial Sequence
  Synthetic Construct
ccctgacaatgataatacctctgcttgag

SEQ ID NO: 10939 - DNA, 28 bp, Artificial Sequence
  Synthetic Construct
gtcagttaccctttccaatcatatgact

SEQ ID NO: 10940 - DNA, 19 bp, Artificial Sequence
  Synthetic Construct
aggcctgcctctcctaagc

SEQ ID NO: 10941 - DNA, 24 bp, Artificial Sequence
  Synthetic Construct
ggaagaggaagggtctcattttcc

SEQ ID NO: 10942 - DNA, 21 bp, Artificial Sequence
  Synthetic Construct
catgcaggagagcaccacttt

SEQ ID NO: 10943 - DNA, 22 bp, Artificial Sequence
  Synthetic Construct
aaattcgacagcctcccagaca

SEQ ID NO: 10944 - DNA, 24 bp, Artificial Sequence
  Synthetic Construct
ctctatctgtgaagcagcagagtt

SEQ ID NO: 10945 - DNA, 27 bp, Artificial Sequence
  Synthetic Construct
caactgtagagttccatcaagagtcat

SEQ ID NO: 10946 - DNA, 25 bp, Artificial Sequence
  Synthetic Construct
acgtcaaccttgtttatctcccata

SEQ ID NO: 10947 - DNA, 18 bp, Artificial Sequence
  Synthetic Construct
agtccctgggccttgtca

SEQ ID NO: 10948 - DNA, 25 bp, Artificial Sequence
  Synthetic Construct
aggaagaccctgtatctacaaaacc

SEQ ID NO: 10949 - DNA, 28 bp, Artificial Sequence
  Synthetic Construct
gacctgagaaagcatgatatgtctttca

SEQ ID NO: 10950 - DNA, 22 bp, Artificial Sequence
  Synthetic Construct
ccccttgcaccactcaaatcta

SEQ ID NO: 10951 - DNA, 24 bp, Artificial Sequence
  Synthetic Construct
cctgtttattcctcccctgatcct

SEQ ID NO: 10952 - DNA, 26 bp, Artificial Sequence
  Synthetic Construct
tgtggtctcacatatagtctgttctg

SEQ ID NO: 10953 - DNA, 29 bp, Artificial Sequence
  Synthetic Construct
cgtcgattcttcttttgtacctagagaga

SEQ ID NO: 10954 - DNA, 21 bp, Artificial Sequence
  Synthetic Construct
gcctttgcaatggaggatgct

SEQ ID NO: 10955 - DNA, 30 bp, Artificial Sequence
  Synthetic Construct
ggagcaagaaaatgagtacaattccttcta

SEQ ID NO: 10956 - DNA, 27 bp, Artificial Sequence
  Synthetic Construct
gttttgttttcaacaacccacttttga

SEQ ID NO: 10957 - DNA, 24 bp, Artificial Sequence
  Synthetic Construct
ggagccaggtgacaaaagtcaaag

SEQ ID NO: 10958 - DNA, 21 bp, Artificial Sequence
  Synthetic Construct
acagggcagaaccagaagact

SEQ ID NO: 10959 - DNA, 23 bp, Artificial Sequence
  Synthetic Construct
ggcttcagcaaatgcatcagaca

SEQ ID NO: 10960 - DNA, 21 bp, Artificial Sequence
  Synthetic Construct
tgggagctgcaggactaagca

SEQ ID NO: 10961 - DNA, 26 bp, Artificial Sequence
  Synthetic Construct
gaaatctatcacctcatttgcaccaa

SEQ ID NO: 10962 - DNA, 23 bp, Artificial Sequence
  Synthetic Construct
agcctaggtgacaagagtgaaac

SEQ ID NO: 10963 - DNA, 30 bp, Artificial Sequence
  Synthetic Construct
aatcatatctgcttcaaattgtttgatcac

SEQ ID NO: 10964 - DNA, 28 bp, Artificial Sequence
  Synthetic Construct
gctctaagacataagtccttctctcagt

SEQ ID NO: 10965 - DNA, 30 bp, Artificial Sequence
  Synthetic Construct
ggaatatgtttttgctgactccaaagtaag

SEQ ID NO: 10966 - DNA, 22 bp, Artificial Sequence
  Synthetic Construct
gctcagccaagggtaactcttt

SEQ ID NO: 10967 - DNA, 22 bp, Artificial Sequence
  Synthetic Construct
cctcctgtcccttctcttctca

SEQ ID NO: 10968 - DNA, 26 bp, Artificial Sequence
  Synthetic Construct
ggtttttggagtctgaatgaaaaacg

SEQ ID NO: 10969 - DNA, 22 bp, Artificial Sequence
  Synthetic Construct
cttccatccatccccaccaaag

SEQ ID NO: 10970 - DNA, 29 bp, Artificial Sequence
  Synthetic Construct
cataagcagaacaagtagagtcattttga

SEQ ID NO: 10971 - DNA, 25 bp, Artificial Sequence
  Synthetic Construct
gagggaaatgcagctttgttatgaa

SEQ ID NO: 10972 - DNA, 25 bp, Artificial Sequence
  Synthetic Construct
caatggcaaattctcgggactatac

SEQ ID NO: 10973 - DNA, 28 bp, Artificial Sequence
  Synthetic Construct
aaaatgtttgagtccctatccactaaac

SEQ ID NO: 10974 - DNA, 23 bp, Artificial Sequence
  Synthetic Construct
gagaataagggcatgccatctga

SEQ ID NO: 10975 - DNA, 19 bp, Artificial Sequence
  Synthetic Construct
ttgggggctttggcaactg

SEQ ID NO: 10976 - DNA, 26 bp, Artificial Sequence
  Synthetic Construct
ggctcacattctctggagaataaacc

SEQ ID NO: 10977 - DNA, 24 bp, Artificial Sequence
  Synthetic Construct
gggaggtagagtgttttcaagaca

SEQ ID NO: 10978 - DNA, 19 bp, Artificial Sequence
  Synthetic Construct
tggcctgtggatgttgcaa

SEQ ID NO: 10979 - DNA, 29 bp, Artificial Sequence
  Synthetic Construct
gagggttgatcattttggatttcatactg

SEQ ID NO: 10980 - DNA, 21 bp, Artificial Sequence
  Synthetic Construct
tgcctgtggcttggagcaaat

SEQ ID NO: 10981 - DNA, 19 bp, Artificial Sequence
  Synthetic Construct
cctgccacccagtcctgaa

SEQ ID NO: 10982 - DNA, 22 bp, Artificial Sequence
  Synthetic Construct
agcgtgtttgccctcaagttga

SEQ ID NO: 10983 - DNA, 21 bp, Artificial Sequence
  Synthetic Construct
tcagaaggcatggaccacact

SEQ ID NO: 10984 - DNA, 25 bp, Artificial Sequence
  Synthetic Construct
cgcagtattggatgcttttgtctca

SEQ ID NO: 10985 - DNA, 21 bp, Artificial Sequence
  Synthetic Construct
tggcccaggagagcattttca

SEQ ID NO: 10986 - DNA, 30 bp, Artificial Sequence
  Synthetic Construct
cagagaccttcgattaatgttctatagaga

SEQ ID NO: 10987 - DNA, 25 bp, Artificial Sequence
  Synthetic Construct
ctcttggcccaaaagtaagagatct

SEQ ID NO: 10988 - DNA, 27 bp, Artificial Sequence
  Synthetic Construct
ggaaggtcctgattcctagtattttgg

SEQ ID NO: 10989 - DNA, 23 bp, Artificial Sequence
  Synthetic Construct
gatgggagcagcaatgtttcttc

SEQ ID NO: 10990 - DNA, 22 bp, Artificial Sequence
  Synthetic Construct
aggggagatgtgttcgggaaaa

SEQ ID NO: 10991 - DNA, 25 bp, Artificial Sequence
  Synthetic Construct
ggtgaggacaatacagcatgatagg

SEQ ID NO: 10992 - DNA, 29 bp, Artificial Sequence
  Synthetic Construct
tgcattccatatttagtcagagactacag

SEQ ID NO: 10993 - DNA, 30 bp, Artificial Sequence
  Synthetic Construct
gcttgtcataaatgcaaagaatcctacttc

SEQ ID NO: 10994 - DNA, 26 bp, Artificial Sequence
  Synthetic Construct
gcaatccaatcctgctccttagaaca

SEQ ID NO: 10995 - DNA, 22 bp, Artificial Sequence
  Synthetic Construct
ccaagtatcagggcagggaaag

SEQ ID NO: 10996 - DNA, 27 bp, Artificial Sequence
  Synthetic Construct
cactttttggagcggaatttactaagt

SEQ ID NO: 10997 - DNA, 26 bp, Artificial Sequence
  Synthetic Construct
cccaagtaaggcataatctccaatgc

SEQ ID NO: 10998 - DNA, 26 bp, Artificial Sequence
  Synthetic Construct
ggaaagcagtacttgtgacaaacttg

SEQ ID NO: 10999 - DNA, 28 bp, Artificial Sequence
  Synthetic Construct
gactttgtggagtaaaatcttcattcct

SEQ ID NO: 11000 - DNA, 21 bp, Artificial Sequence
  Synthetic Construct
ggagactggtttggggctgaa

SEQ ID NO: 11001 - DNA, 25 bp, Artificial Sequence
  Synthetic Construct
aggaccactgtatcactacaaatcc

SEQ ID NO: 11002 - DNA, 30 bp, Artificial Sequence
  Synthetic Construct
agacttttcatccatctgaatactactcaa

SEQ ID NO: 11003 - DNA, 25 bp, Artificial Sequence
  Synthetic Construct
gaggtgtgttttttacccagattcc

SEQ ID NO: 11004 - DNA, 18 bp, Artificial Sequence
  Synthetic Construct
agcaggcccagtgtacct

SEQ ID NO: 11005 - DNA, 22 bp, Artificial Sequence
  Synthetic Construct
tcttgcctggagtaccaaagtc

SEQ ID NO: 11006 - DNA, 25 bp, Artificial Sequence
  Synthetic Construct
gtaagggaggatggtgattgattca

SEQ ID NO: 11007 - DNA, 27 bp, Artificial Sequence
  Synthetic Construct
cctgatagcctgttcttcatacaaaag

SEQ ID NO: 11008 - DNA, 24 bp, Artificial Sequence
  Synthetic Construct
tccaacctggagtttcagaatcac

SEQ ID NO: 11009 - DNA, 23 bp, Artificial Sequence
  Synthetic Construct
acccaagacctcacagagtagtt

SEQ ID NO: 11010 - DNA, 24 bp, Artificial Sequence
  Synthetic Construct
acgttaacatcacagctagggaat

SEQ ID NO: 11011 - DNA, 19 bp, Artificial Sequence
  Synthetic Construct
ccagcgtgggtttggagaa

SEQ ID NO: 11012 - DNA, 20 bp, Artificial Sequence
  Synthetic Construct
ttgcccacctctgtctcact

SEQ ID NO: 11013 - DNA, 18 bp, Artificial Sequence
  Synthetic Construct
accacctgcctccacact

SEQ ID NO: 11014 - DNA, 22 bp, Artificial Sequence
  Synthetic Construct
aggccaggtacatggtgatgtt

SEQ ID NO: 11015 - DNA, 25 bp, Artificial Sequence
  Synthetic Construct
ccatagcagctgaggataaaacaga

SEQ ID NO: 11016 - DNA, 20 bp, Artificial Sequence
  Synthetic Construct
cctcactgtgctccagcttt

SEQ ID NO: 11017 - DNA, 24 bp, Artificial Sequence
  Synthetic Construct
ggtttggttgcgttgcaataaatg

SEQ ID NO: 11018 - DNA, 24 bp, Artificial Sequence
  Synthetic Construct
ccagcctcagctctagaaaagtga

SEQ ID NO: 11019 - DNA, 24 bp, Artificial Sequence
  Synthetic Construct
gctgttggcttgatttccctgact

SEQ ID NO: 11020 - DNA, 29 bp, Artificial Sequence
  Synthetic Construct
gatggaattaattgaaactacagccttca

SEQ ID NO: 11021 - DNA, 26 bp, Artificial Sequence
  Synthetic Construct
gtgtggcttgtcaatacatgctatca

SEQ ID NO: 11022 - DNA, 23 bp, Artificial Sequence
  Synthetic Construct
tggtccatctggcactgtatcca

SEQ ID NO: 11023 - DNA, 27 bp, Artificial Sequence
  Synthetic Construct
ggtggcagagttttgagaagttatgtg

SEQ ID NO: 11024 - DNA, 22 bp, Artificial Sequence
  Synthetic Construct
gattttgcacaaggggaaagca

SEQ ID NO: 11025 - DNA, 24 bp, Artificial Sequence
  Synthetic Construct
cccttatcttggttgctctgcatt

SEQ ID NO: 11026 - DNA, 23 bp, Artificial Sequence
  Synthetic Construct
ctgggaggttcaggaagtttgag

SEQ ID NO: 11027 - DNA, 26 bp, Artificial Sequence
  Synthetic Construct
gctgaatgactgtaaatctgccatca

SEQ ID NO: 11028 - DNA, 26 bp, Artificial Sequence
  Synthetic Construct
aaatctccaaggaaaagagccttttc

SEQ ID NO: 11029 - DNA, 25 bp, Artificial Sequence
  Synthetic Construct
ttggaagaagcaatgatctcaacac

SEQ ID NO: 11030 - DNA, 21 bp, Artificial Sequence
  Synthetic Construct
tgtggctgtagaggctgagaa

SEQ ID NO: 11031 - DNA, 26 bp, Artificial Sequence
  Synthetic Construct
agattcaatctagtcaagctgtcctt

SEQ ID NO: 11032 - DNA, 26 bp, Artificial Sequence
  Synthetic Construct
gactcacacacaaaatacttcatggt

SEQ ID NO: 11033 - DNA, 19 bp, Artificial Sequence
  Synthetic Construct
agccacgcttgtgctctga

SEQ ID NO: 11034 - DNA, 26 bp, Artificial Sequence
  Synthetic Construct
gggtttgctctagggaaatgtaactt

SEQ ID NO: 11035 - DNA, 24 bp, Artificial Sequence
  Synthetic Construct
agctgggttctgaaggatgaagag

SEQ ID NO: 11036 - DNA, 22 bp, Artificial Sequence
  Synthetic Construct
aggaaaacagtgagcagttgca

SEQ ID NO: 11037 - DNA, 26 bp, Artificial Sequence
  Synthetic Construct
cttttgcaggagctattgcagttaat

SEQ ID NO: 11038 - DNA, 20 bp, Artificial Sequence
  Synthetic Construct
tgcacttccatgcagctgat

SEQ ID NO: 11039 - DNA, 24 bp, Artificial Sequence
  Synthetic Construct
gctccttgcatggataaccagaaa

SEQ ID NO: 11040 - DNA, 25 bp, Artificial Sequence
  Synthetic Construct
cccaaacttcatggtcatacttcca

SEQ ID NO: 11041 - DNA, 29 bp, Artificial Sequence
  Synthetic Construct
gtgtctatagccctttagtttgttcattt

SEQ ID NO: 11042 - DNA, 19 bp, Artificial Sequence
  Synthetic Construct
agggttccgtgagcacctt

SEQ ID NO: 11043 - DNA, 20 bp, Artificial Sequence
  Synthetic Construct
actccctgcacacacacact

SEQ ID NO: 11044 - DNA, 27 bp, Artificial Sequence
  Synthetic Construct
ccccttatctaaacctctacctaacca

SEQ ID NO: 11045 - DNA, 24 bp, Artificial Sequence
  Synthetic Construct
tcctcgacagaagggatgacaact

SEQ ID NO: 11046 - DNA, 24 bp, Artificial Sequence
  Synthetic Construct
ggcatttttgacagctgcatggaa

SEQ ID NO: 11047 - DNA, 27 bp, Artificial Sequence
  Synthetic Construct
gcaataaaaattcaaacaggcatcagt

SEQ ID NO: 11048 - DNA, 22 bp, Artificial Sequence
  Synthetic Construct
tcccagttccatggccatagtt

SEQ ID NO: 11049 - DNA, 21 bp, Artificial Sequence
  Synthetic Construct
agctcttcaccaggaccatgt

SEQ ID NO: 11050 - DNA, 21 bp, Artificial Sequence
  Synthetic Construct
aggcaacccaggtatctctgt

SEQ ID NO: 11051 - DNA, 22 bp, Artificial Sequence
  Synthetic Construct
gccagcagcatagcatttccaa

SEQ ID NO: 11052 - DNA, 29 bp, Artificial Sequence
  Synthetic Construct
ccttcctatctcttcgcacatttaattgt

SEQ ID NO: 11053 - DNA, 24 bp, Artificial Sequence
  Synthetic Construct
gttaaacagcagggaatggaatgg

SEQ ID NO: 11054 - DNA, 27 bp, Artificial Sequence
  Synthetic Construct
gtgttctactgagacaagaagggaaaa

SEQ ID NO: 11055 - DNA, 23 bp, Artificial Sequence
  Synthetic Construct
ctactgcaggtaaacagccctta

SEQ ID NO: 11056 - DNA, 22 bp, Artificial Sequence
  Synthetic Construct
tgtaaggccctacccagatcca

SEQ ID NO: 11057 - DNA, 19 bp, Artificial Sequence
  Synthetic Construct
gcccccttgccatgtgatg

SEQ ID NO: 11058 - DNA, 22 bp, Artificial Sequence
  Synthetic Construct
gtgaccaccacactgatgtcaa

SEQ ID NO: 11059 - DNA, 24 bp, Artificial Sequence
  Synthetic Construct
ccctcaagcatgtatgagcaggta

SEQ ID NO: 11060 - DNA, 24 bp, Artificial Sequence
  Synthetic Construct
ttgcatttctcgaatcccatttgg

SEQ ID NO: 11061 - DNA, 21 bp, Artificial Sequence
  Synthetic Construct
agggtcacaacagcctttctc

SEQ ID NO: 11062 - DNA, 22 bp, Artificial Sequence
  Synthetic Construct
gacttttgctgcagtgcatgag

SEQ ID NO: 11063 - DNA, 30 bp, Artificial Sequence
  Synthetic Construct
gtccaaatttactcagaggtacagtgaatt

SEQ ID NO: 11064 - DNA, 23 bp, Artificial Sequence
  Synthetic Construct
gacatctggaaccttctcatgca

SEQ ID NO: 11065 - DNA, 24 bp, Artificial Sequence
  Synthetic Construct
cggcaagtgggaatgtgatctaca

SEQ ID NO: 11066 - DNA, 21 bp, Artificial Sequence
  Synthetic Construct
atccatcctcagccacaagtg

SEQ ID NO: 11067 - DNA, 21 bp, Artificial Sequence
  Synthetic Construct
cctcacagtcagtctgccttt

SEQ ID NO: 11068 - DNA, 25 bp, Artificial Sequence
  Synthetic Construct
gcctccacaataagatgtctatcca

SEQ ID NO: 11069 - DNA, 21 bp, Artificial Sequence
  Synthetic Construct
ggccacggcagaacattgtaa

SEQ ID NO: 11070 - DNA, 30 bp, Artificial Sequence
  Synthetic Construct
aaaatgacagtaacatctgtatccaaaagt

SEQ ID NO: 11071 - DNA, 22 bp, Artificial Sequence
  Synthetic Construct
gtgagctgtgatcacaccacta

SEQ ID NO: 11072 - DNA, 24 bp, Artificial Sequence
  Synthetic Construct
ccaggatacagggtgatactagct

SEQ ID NO: 11073 - DNA, 22 bp, Artificial Sequence
  Synthetic Construct
ggcttttcctgtggcttggtta

SEQ ID NO: 11074 - DNA, 24 bp, Artificial Sequence
  Synthetic Construct
ccctaaacgtatgaccacaaactg

SEQ ID NO: 11075 - DNA, 22 bp, Artificial Sequence
  Synthetic Construct
ggtaagctgagacccatttgct

SEQ ID NO: 11076 - DNA, 23 bp, Artificial Sequence
  Synthetic Construct
tgatcctgtgttggctcaacatt

SEQ ID NO: 11077 - DNA, 23 bp, Artificial Sequence
  Synthetic Construct
tgcgagaaagaactgaaccaagt

SEQ ID NO: 11078 - DNA, 18 bp, Artificial Sequence
  Synthetic Construct
tcagtcctggccctgtgt

SEQ ID NO: 11079 - DNA, 30 bp, Artificial Sequence
  Synthetic Construct
cctgacataaagtcttacgtcaatttactt

SEQ ID NO: 11080 - DNA, 20 bp, Artificial Sequence
  Synthetic Construct
gctctgtgcctgctgatgtg

SEQ ID NO: 11081 - DNA, 30 bp, Artificial Sequence
  Synthetic Construct
gagtttggaataaatacgacaaccacatac

SEQ ID NO: 11082 - DNA, 28 bp, Artificial Sequence
  Synthetic Construct
ccctggattagtaagaatgggcttcaag

SEQ ID NO: 11083 - DNA, 22 bp, Artificial Sequence
  Synthetic Construct
cctgtcaccaattggcaatacg

SEQ ID NO: 11084 - DNA, 22 bp, Artificial Sequence
  Synthetic Construct
gagctgcctgtaacctcttctt

SEQ ID NO: 11085 - DNA, 21 bp, Artificial Sequence
  Synthetic Construct
actgatggtgggcttcatgct

SEQ ID NO: 11086 - DNA, 22 bp, Artificial Sequence
  Synthetic Construct
ccccaaagcaattctccctgta

SEQ ID NO: 11087 - DNA, 24 bp, Artificial Sequence
  Synthetic Construct
gctccttttatgttgggggaaagg

SEQ ID NO: 11088 - DNA, 19 bp, Artificial Sequence
  Synthetic Construct
tggggccaagcacttgcat

SEQ ID NO: 11089 - DNA, 20 bp, Artificial Sequence
  Synthetic Construct
gggatccctggggagctatg

SEQ ID NO: 11090 - DNA, 22 bp, Artificial Sequence
  Synthetic Construct
ttcagacccaagcactggagat

SEQ ID NO: 11091 - DNA, 28 bp, Artificial Sequence
  Synthetic Construct
ctcttagatagttccagttctgtggtta

SEQ ID NO: 11092 - DNA, 24 bp, Artificial Sequence
  Synthetic Construct
gccttccttctacaaaaccctgtt

SEQ ID NO: 11093 - DNA, 29 bp, Artificial Sequence
  Synthetic Construct
tgaaactttaaattattccaggccttgag

SEQ ID NO: 11094 - DNA, 26 bp, Artificial Sequence
  Synthetic Construct
gacagtggggaagaaaacatttttca

SEQ ID NO: 11095 - DNA, 26 bp, Artificial Sequence
  Synthetic Construct
gccttctaaagtctcctcactttacc

SEQ ID NO: 11096 - DNA, 21 bp, Artificial Sequence
  Synthetic Construct
agtgcctaccaggtgctaggt

SEQ ID NO: 11097 - DNA, 21 bp, Artificial Sequence
  Synthetic Construct
gcagaatccagtgcagatcct

SEQ ID NO: 11098 - DNA, 21 bp, Artificial Sequence
  Synthetic Construct
agggttcccaagtcagaaggt

SEQ ID NO: 11099 - DNA, 23 bp, Artificial Sequence
  Synthetic Construct
aaggctgccttagggaactatgc

SEQ ID NO: 11100 - DNA, 19 bp, Artificial Sequence
  Synthetic Construct
agtggctggtgggctgaca

SEQ ID NO: 11101 - DNA, 26 bp, Artificial Sequence
  Synthetic Construct
tgaacatgccttgctagttattctct

SEQ ID NO: 11102 - DNA, 22 bp, Artificial Sequence
  Synthetic Construct
acccctgcaagaggatgaagta

SEQ ID NO: 11103 - DNA, 28 bp, Artificial Sequence
  Synthetic Construct
agtaaaaaactggctcctaaatctctct

SEQ ID NO: 11104 - DNA, 21 bp, Artificial Sequence
  Synthetic Construct
ccaatccaacggaaccccata

SEQ ID NO: 11105 - DNA, 24 bp, Artificial Sequence
  Synthetic Construct
ttgagaattgctcttggacacaga

SEQ ID NO: 11106 - DNA, 20 bp, Artificial Sequence
  Synthetic Construct
cgtttccaggcacactgaga

SEQ ID NO: 11107 - DNA, 28 bp, Artificial Sequence
  Synthetic Construct
gagtctccatccaaatgtatcctatcag

SEQ ID NO: 11108 - DNA, 21 bp, Artificial Sequence
  Synthetic Construct
aggctcgggctataacagaga

SEQ ID NO: 11109 - DNA, 24 bp, Artificial Sequence
  Synthetic Construct
ggaatcatccagcctgatggcaaa

SEQ ID NO: 11110 - DNA, 23 bp, Artificial Sequence
  Synthetic Construct
aggcctatttcttcagccacatt

SEQ ID NO: 11111 - DNA, 20 bp, Artificial Sequence
  Synthetic Construct
gctgtgaagacgcacatgga

SEQ ID NO: 11112 - DNA, 21 bp, Artificial Sequence
  Synthetic Construct
catgtcacacagagcctcaca

SEQ ID NO: 11113 - DNA, 20 bp, Artificial Sequence
  Synthetic Construct
tgcgggcatggtttggttct

SEQ ID NO: 11114 - DNA, 28 bp, Artificial Sequence
  Synthetic Construct
ccaaagcaagacatagcaaatagttctt

SEQ ID NO: 11115 - DNA, 19 bp, Artificial Sequence
  Synthetic Construct
cagccaccagcaagaccaa

SEQ ID NO: 11116 - DNA, 24 bp, Artificial Sequence
  Synthetic Construct
cacggtggagataaaacccaactg

SEQ ID NO: 11117 - DNA, 24 bp, Artificial Sequence
  Synthetic Construct
gacccttcaggctacaatctacac

SEQ ID NO: 11118 - DNA, 30 bp, Artificial Sequence
  Synthetic Construct
gtcctagtatatacatgtaggagcccatac

SEQ ID NO: 11119 - DNA, 25 bp, Artificial Sequence
  Synthetic Construct
gtggtacaaacatggctcactacag

SEQ ID NO: 11120 - DNA, 25 bp, Artificial Sequence
  Synthetic Construct
ctgttatccccttctcccatcaatc

SEQ ID NO: 11121 - DNA, 23 bp, Artificial Sequence
  Synthetic Construct
agcctctctctgccatacaggaa

SEQ ID NO: 11122 - DNA, 24 bp, Artificial Sequence
  Synthetic Construct
acctgtaaagcacagtctctctca

SEQ ID NO: 11123 - DNA, 28 bp, Artificial Sequence
  Synthetic Construct
cctcatggtcacctgataattccttcag

SEQ ID NO: 11124 - DNA, 18 bp, Artificial Sequence
  Synthetic Construct
gcccaggctggtcacaaa

SEQ ID NO: 11125 - DNA, 23 bp, Artificial Sequence
  Synthetic Construct
tgtgttgtgtgaggaagctatgg

SEQ ID NO: 11126 - DNA, 19 bp, Artificial Sequence
  Synthetic Construct
agagcctgcgcccgacgta

SEQ ID NO: 11127 - DNA, 22 bp, Artificial Sequence
  Synthetic Construct
aagctgaactgcagggaagatc

SEQ ID NO: 11128 - DNA, 21 bp, Artificial Sequence
  Synthetic Construct
tgacagggcgcttcctttaga

SEQ ID NO: 11129 - DNA, 25 bp, Artificial Sequence
  Synthetic Construct
cccacagtgtgtacttgagtatctc

SEQ ID NO: 11130 - DNA, 21 bp, Artificial Sequence
  Synthetic Construct
tgctttcagccaaggcaactg

SEQ ID NO: 11131 - DNA, 19 bp, Artificial Sequence
  Synthetic Construct
ggtcctgtccttgcaagca

SEQ ID NO: 11132 - DNA, 25 bp, Artificial Sequence
  Synthetic Construct
gctccagtgaaaccacatttattcc

SEQ ID NO: 11133 - DNA, 21 bp, Artificial Sequence
  Synthetic Construct
cccgatgaaaggaagcaacct

SEQ ID NO: 11134 - DNA, 25 bp, Artificial Sequence
  Synthetic Construct
gacaaaagggctgttttcacagttc

SEQ ID NO: 11135 - DNA, 19 bp, Artificial Sequence
  Synthetic Construct
tgtgcggcagatgctcagt

SEQ ID NO: 11136 - DNA, 22 bp, Artificial Sequence
  Synthetic Construct
ggaaacgggcttagtgatgcta

SEQ ID NO: 11137 - DNA, 26 bp, Artificial Sequence
  Synthetic Construct
gacagccacagtgcttagaaaaatat

SEQ ID NO: 11138 - DNA, 30 bp, Artificial Sequence
  Synthetic Construct
ttactgatggagatagaagttagtttagca

SEQ ID NO: 11139 - DNA, 26 bp, Artificial Sequence
  Synthetic Construct
cagcttaaagtaaaatgctccactga

SEQ ID NO: 11140 - DNA, 25 bp, Artificial Sequence
  Synthetic Construct
gggaaatcacaaacggtagggtagt

SEQ ID NO: 11141 - DNA, 24 bp, Artificial Sequence
  Synthetic Construct
tgagcatcaccatgtaaccaaagt

SEQ ID NO: 11142 - DNA, 29 bp, Artificial Sequence
  Synthetic Construct
gaagacactctgaaaaacctatctactgt

SEQ ID NO: 11143 - DNA, 22 bp, Artificial Sequence
  Synthetic Construct
gccatggtgacccaagtgttaa

SEQ ID NO: 11144 - DNA, 22 bp, Artificial Sequence
  Synthetic Construct
tggctggaacttatgggtcaga

SEQ ID NO: 11145 - DNA, 27 bp, Artificial Sequence
  Synthetic Construct
agataaccacgaaaaggtcattgagaa

SEQ ID NO: 11146 - DNA, 25 bp, Artificial Sequence
  Synthetic Construct
ttatctctccagctgtgagaaactc

SEQ ID NO: 11147 - DNA, 25 bp, Artificial Sequence
  Synthetic Construct
cacatccctgactctttggttatgt

SEQ ID NO: 11148 - DNA, 24 bp, Artificial Sequence
  Synthetic Construct
gcctctgtcatggctatgtttgtg

SEQ ID NO: 11149 - DNA, 25 bp, Artificial Sequence
  Synthetic Construct
gaagagcctgctttgacaaatactt

SEQ ID NO: 11150 - DNA, 22 bp, Artificial Sequence
  Synthetic Construct
gcagaaccctggtttagaggaa

SEQ ID NO: 11151 - DNA, 26 bp, Artificial Sequence
  Synthetic Construct
gggtgatcctgaaaaacactgtaagt

SEQ ID NO: 11152 - DNA, 19 bp, Artificial Sequence
  Synthetic Construct
cccggctctgaggtttagc

SEQ ID NO: 11153 - DNA, 24 bp, Artificial Sequence
  Synthetic Construct
gctggacacccctgatttaaggta

SEQ ID NO: 11154 - DNA, 28 bp, Artificial Sequence
  Synthetic Construct
gctagcctggaaaatatttgtccaatag

SEQ ID NO: 11155 - DNA, 26 bp, Artificial Sequence
  Synthetic Construct
gagcatgagagaatgtggttagactt

SEQ ID NO: 11156 - DNA, 21 bp, Artificial Sequence
  Synthetic Construct
acagtcctctcctggctagtg

SEQ ID NO: 11157 - DNA, 21 bp, Artificial Sequence
  Synthetic Construct
gctggctggctcatgaatcct

SEQ ID NO: 11158 - DNA, 23 bp, Artificial Sequence
  Synthetic Construct
tgtaacgttccctctctctccaa

SEQ ID NO: 11159 - DNA, 27 bp, Artificial Sequence
  Synthetic Construct
gtctacacaacattgctgattctgaga

SEQ ID NO: 11160 - DNA, 21 bp, Artificial Sequence
  Synthetic Construct
atggccaaggttgggtttctg

SEQ ID NO: 11161 - DNA, 22 bp, Artificial Sequence
  Synthetic Construct
ccaatcctgcaatgccaagttc

SEQ ID NO: 11162 - DNA, 19 bp, Artificial Sequence
  Synthetic Construct
cagacaggcgagcgtatgg

SEQ ID NO: 11163 - DNA, 19 bp, Artificial Sequence
  Synthetic Construct
gcatcggcagagagcttct

SEQ ID NO: 11164 - DNA, 27 bp, Artificial Sequence
  Synthetic Construct
gtgagtaagagagccaagattcagatg

SEQ ID NO: 11165 - DNA, 25 bp, Artificial Sequence
  Synthetic Construct
caaggagctttcattcccttaatcg

SEQ ID NO: 11166 - DNA, 22 bp, Artificial Sequence
  Synthetic Construct
gccaggaatgatctggaaatgc

SEQ ID NO: 11167 - DNA, 29 bp, Artificial Sequence
  Synthetic Construct
attacacaataattgcatcagatgttcct

SEQ ID NO: 11168 - DNA, 21 bp, Artificial Sequence
  Synthetic Construct
tccccaaacaggcttgacagt

SEQ ID NO: 11169 - DNA, 24 bp, Artificial Sequence
  Synthetic Construct
ctgtttctccaacctccagattgg

SEQ ID NO: 11170 - DNA, 23 bp, Artificial Sequence
  Synthetic Construct
ccttggcatttgttggtggctaa

SEQ ID NO: 11171 - DNA, 26 bp, Artificial Sequence
  Synthetic Construct
aaatgacaaacaaatgatgccaacac

SEQ ID NO: 11172 - DNA, 26 bp, Artificial Sequence
  Synthetic Construct
aaaggtgtgctgataatgtgcataaa

SEQ ID NO: 11173 - DNA, 19 bp, Artificial Sequence
  Synthetic Construct
agtatcccacgccctggtt

SEQ ID NO: 11174 - DNA, 19 bp, Artificial Sequence
  Synthetic Construct
acctgtcgatgggcatggt

SEQ ID NO: 11175 - DNA, 23 bp, Artificial Sequence
  Synthetic Construct
agggattcctaccaccagcttga

SEQ ID NO: 11176 - DNA, 22 bp, Artificial Sequence
  Synthetic Construct
tgaccacttcctctcactgaca

SEQ ID NO: 11177 - DNA, 28 bp, Artificial Sequence
  Synthetic Construct
gcctattataaccttctgcccacattcc

SEQ ID NO: 11178 - DNA, 24 bp, Artificial Sequence
  Synthetic Construct
tctagactctgacagcctattggt

SEQ ID NO: 11179 - DNA, 22 bp, Artificial Sequence
  Synthetic Construct
ttccctcgtgcttgtagtgaca

SEQ ID NO: 11180 - DNA, 20 bp, Artificial Sequence
  Synthetic Construct
gccttctcagccttgtttgc

SEQ ID NO: 11181 - DNA, 26 bp, Artificial Sequence
  Synthetic Construct
accgcagagtaatctatagtcacaga

SEQ ID NO: 11182 - DNA, 25 bp, Artificial Sequence
  Synthetic Construct
tgatcccatcactggagctaaaaac

SEQ ID NO: 11183 - DNA, 23 bp, Artificial Sequence
  Synthetic Construct
gggcaggacagttacataaacca

SEQ ID NO: 11184 - DNA, 26 bp, Artificial Sequence
  Synthetic Construct
gacaaatctggctgtcatttctggat

SEQ ID NO: 11185 - DNA, 20 bp, Artificial Sequence
  Synthetic Construct
tctgtggctctcaggcttct

SEQ ID NO: 11186 - DNA, 29 bp, Artificial Sequence
  Synthetic Construct
tttttgagagaaggtcttactatgtcact

SEQ ID NO: 11187 - DNA, 22 bp, Artificial Sequence
  Synthetic Construct
gacagagccaggattcaaagct

SEQ ID NO: 11188 - DNA, 28 bp, Artificial Sequence
  Synthetic Construct
cactatttccttagcccttgatctatct

SEQ ID NO: 11189 - DNA, 18 bp, Artificial Sequence
  Synthetic Construct
cgcctccgcccatgaaaa

SEQ ID NO: 11190 - DNA, 24 bp, Artificial Sequence
  Synthetic Construct
ccccatcatacacaaaagcctttt

SEQ ID NO: 11191 - DNA, 22 bp, Artificial Sequence
  Synthetic Construct
gagtggaccctcctaagtgttg

SEQ ID NO: 11192 - DNA, 25 bp, Artificial Sequence
  Synthetic Construct
gcaatggcctagttaatgtgactct

SEQ ID NO: 11193 - DNA, 24 bp, Artificial Sequence
  Synthetic Construct
gtaaacatgggctgatgaattgca

SEQ ID NO: 11194 - DNA, 25 bp, Artificial Sequence
  Synthetic Construct
actcttggatgctgctacaatttgt

SEQ ID NO: 11195 - DNA, 29 bp, Artificial Sequence
  Synthetic Construct
ggagcaggtaagctatgaatatgataggt

SEQ ID NO: 11196 - DNA, 24 bp, Artificial Sequence
  Synthetic Construct
gccctgtgaatgtcgtgaatccta

SEQ ID NO: 11197 - DNA, 25 bp, Artificial Sequence
  Synthetic Construct
ccatgtaagtccatggtgacttctc

SEQ ID NO: 11198 - DNA, 20 bp, Artificial Sequence
  Synthetic Construct
acccacgggcagaactaagt

SEQ ID NO: 11199 - DNA, 19 bp, Artificial Sequence
  Synthetic Construct
tgaggcatgcggtgtagct

SEQ ID NO: 11200 - DNA, 21 bp, Artificial Sequence
  Synthetic Construct
tcaccaagcacagagcatgag

SEQ ID NO: 11201 - DNA, 21 bp, Artificial Sequence
  Synthetic Construct
tctccgaggtcagaggactct

SEQ ID NO: 11202 - DNA, 22 bp, Artificial Sequence
  Synthetic Construct
tcaaagggctcggagatttcac

SEQ ID NO: 11203 - DNA, 22 bp, Artificial Sequence
  Synthetic Construct
ctgcttttcccctctcaaagct

SEQ ID NO: 11204 - DNA, 26 bp, Artificial Sequence
  Synthetic Construct
gttcattgtggggaattctttgagtt

SEQ ID NO: 11205 - DNA, 22 bp, Artificial Sequence
  Synthetic Construct
cagcactgctaacacctggatt

SEQ ID NO: 11206 - DNA, 24 bp, Artificial Sequence
  Synthetic Construct
agtaatgtgggacatgggtaacag

SEQ ID NO: 11207 - DNA, 26 bp, Artificial Sequence
  Synthetic Construct
ttgcatccaaatagttcgattggttt

SEQ ID NO: 11208 - DNA, 22 bp, Artificial Sequence
  Synthetic Construct
gggggcatttctctctcctttt

SEQ ID NO: 11209 - DNA, 25 bp, Artificial Sequence
  Synthetic Construct
gcttccatcaactcctagccaaaca

SEQ ID NO: 11210 - DNA, 24 bp, Artificial Sequence
  Synthetic Construct
ggggcgacagaatgacagtctaaa

SEQ ID NO: 11211 - DNA, 20 bp, Artificial Sequence
  Synthetic Construct
accctgcccagtctgtgctt

SEQ ID NO: 11212 - DNA, 25 bp, Artificial Sequence
  Synthetic Construct
gatccagggtagctttgaaaatcag

SEQ ID NO: 11213 - DNA, 26 bp, Artificial Sequence
  Synthetic Construct
aggactttcttcccccttttatccta

SEQ ID NO: 11214 - DNA, 24 bp, Artificial Sequence
  Synthetic Construct
cagtctaggaatcctggcaagatc

SEQ ID NO: 11215 - DNA, 19 bp, Artificial Sequence
  Synthetic Construct
tgcaagggcccatctcaag

SEQ ID NO: 11216 - DNA, 21 bp, Artificial Sequence
  Synthetic Construct
aacgactcaccgactgcagaa

SEQ ID NO: 11217 - DNA, 30 bp, Artificial Sequence
  Synthetic Construct
ctggaaatcaaagattttactgttgaatcc

SEQ ID NO: 11218 - DNA, 27 bp, Artificial Sequence
  Synthetic Construct
caccttctgactatactcacacacaaa

SEQ ID NO: 11219 - DNA, 26 bp, Artificial Sequence
  Synthetic Construct
gcagggtatagcttagcataatgaga

SEQ ID NO: 11220 - DNA, 26 bp, Artificial Sequence
  Synthetic Construct
ccacaaacaaacctccagggtagtag

SEQ ID NO: 11221 - DNA, 28 bp, Artificial Sequence
  Synthetic Construct
gagctctaaagtagaagaggaagcttag

SEQ ID NO: 11222 - DNA, 24 bp, Artificial Sequence
  Synthetic Construct
tggtgcagagattgaggcatcttg

SEQ ID NO: 11223 - DNA, 20 bp, Artificial Sequence
  Synthetic Construct
accttggaagaggcctgagt

SEQ ID NO: 11224 - DNA, 24 bp, Artificial Sequence
  Synthetic Construct
ggtgctttgacaccaagagatcgt

SEQ ID NO: 11225 - DNA, 18 bp, Artificial Sequence
  Synthetic Construct
ccgcagttggtgggaact

SEQ ID NO: 11226 - DNA, 27 bp, Artificial Sequence
  Synthetic Construct
actaaacattccctaggtctctaaagc

SEQ ID NO: 11227 - DNA, 25 bp, Artificial Sequence
  Synthetic Construct
gtgcggcctgaaagaaatatactct

SEQ ID NO: 11228 - DNA, 23 bp, Artificial Sequence
  Synthetic Construct
gtctggactgtgtttgagaaggt

SEQ ID NO: 11229 - DNA, 26 bp, Artificial Sequence
  Synthetic Construct
cacaaacacaaaccagaaatcctttg

SEQ ID NO: 11230 - DNA, 27 bp, Artificial Sequence
  Synthetic Construct
ggaatcaagacaacttcaaagcgaaac

SEQ ID NO: 11231 - DNA, 25 bp, Artificial Sequence
  Synthetic Construct
acagctatgaactcatgaccagttg

SEQ ID NO: 11232 - DNA, 29 bp, Artificial Sequence
  Synthetic Construct
tcctggataagggttctaacattttgtag

SEQ ID NO: 11233 - DNA, 21 bp, Artificial Sequence
  Synthetic Construct
ctgaacagggtgagggaggta

SEQ ID NO: 11234 - DNA, 27 bp, Artificial Sequence
  Synthetic Construct
tctccatccaagcataaaatcctatca

SEQ ID NO: 11235 - DNA, 24 bp, Artificial Sequence
  Synthetic Construct
acctcttccagcccacattttacg

SEQ ID NO: 11236 - DNA, 27 bp, Artificial Sequence
  Synthetic Construct
tttacagtgtgttctatggagttttgg

SEQ ID NO: 11237 - DNA, 22 bp, Artificial Sequence
  Synthetic Construct
aaggagcactaggcctccaaaa

SEQ ID NO: 11238 - DNA, 22 bp, Artificial Sequence
  Synthetic Construct
ggagacacggcatcatttagca

SEQ ID NO: 11239 - DNA, 23 bp, Artificial Sequence
  Synthetic Construct
agatgcccacagaactaaagctt

SEQ ID NO: 11240 - DNA, 25 bp, Artificial Sequence
  Synthetic Construct
gagtgctatgtcctaagcatcatgt

SEQ ID NO: 11241 - DNA, 22 bp, Artificial Sequence
  Synthetic Construct
ttgtcactgcaccaaggttctg

SEQ ID NO: 11242 - DNA, 20 bp, Artificial Sequence
  Synthetic Construct
tgacgtgatggggagatggt

SEQ ID NO: 11243 - DNA, 21 bp, Artificial Sequence
  Synthetic Construct
tgaccagcaatgctcccctat

SEQ ID NO: 11244 - DNA, 22 bp, Artificial Sequence
  Synthetic Construct
gcacccaggtcaaaacccaaaa

SEQ ID NO: 11245 - DNA, 21 bp, Artificial Sequence
  Synthetic Construct
cccagccactgatctccattt

SEQ ID NO: 11246 - DNA, 26 bp, Artificial Sequence
  Synthetic Construct
gctcctaaatggcagtcattcaaacc

SEQ ID NO: 11247 - DNA, 23 bp, Artificial Sequence
  Synthetic Construct
agggaggtggtaggaagtaagag

SEQ ID NO: 11248 - DNA, 20 bp, Artificial Sequence
  Synthetic Construct
ccacaggcctagtgggttca

SEQ ID NO: 11249 - DNA, 25 bp, Artificial Sequence
  Synthetic Construct
cccaggtatgtgactggacttcaaa

SEQ ID NO: 11250 - DNA, 18 bp, Artificial Sequence
  Synthetic Construct
cagccagccccacactac

SEQ ID NO: 11251 - DNA, 23 bp, Artificial Sequence
  Synthetic Construct
ggaggtattcccagaacacatgt

SEQ ID NO: 11252 - DNA, 24 bp, Artificial Sequence
  Synthetic Construct
ctggaactttaacctgagcctaca

SEQ ID NO: 11253 - DNA, 24 bp, Artificial Sequence
  Synthetic Construct
gagtctctggctgtgaagaaaaca

SEQ ID NO: 11254 - DNA, 26 bp, Artificial Sequence
  Synthetic Construct
cctttctctactttacctgcaaaacc

SEQ ID NO: 11255 - DNA, 22 bp, Artificial Sequence
  Synthetic Construct
cctgagtgtgagctgatttgca

SEQ ID NO: 11256 - DNA, 21 bp, Artificial Sequence
  Synthetic Construct
agggcagggttagacatgaga

SEQ ID NO: 11257 - DNA, 24 bp, Artificial Sequence
  Synthetic Construct
tttgaactccctctgctagattcc

SEQ ID NO: 11258 - DNA, 21 bp, Artificial Sequence
  Synthetic Construct
catcccgtctttctcctgcat

SEQ ID NO: 11259 - DNA, 19 bp, Artificial Sequence
  Synthetic Construct
ggcatggtggcatcttggt

SEQ ID NO: 11260 - DNA, 19 bp, Artificial Sequence
  Synthetic Construct
agcgccaacctgacaagtg

SEQ ID NO: 11261 - DNA, 22 bp, Artificial Sequence
  Synthetic Construct
agaagacacacgaacccacatc

SEQ ID NO: 11262 - DNA, 28 bp, Artificial Sequence
  Synthetic Construct
gcaagacagttctgaaatcacagacttc

SEQ ID NO: 11263 - DNA, 21 bp, Artificial Sequence
  Synthetic Construct
tgggtttgtcctggcctgata

SEQ ID NO: 11264 - DNA, 23 bp, Artificial Sequence
  Synthetic Construct
acccaggtttcaacagaactgaa

SEQ ID NO: 11265 - DNA, 26 bp, Artificial Sequence
  Synthetic Construct
gtgttttctgtaaaggactgcagagt

SEQ ID NO: 11266 - DNA, 26 bp, Artificial Sequence
  Synthetic Construct
gcataaccaaagtgttgcagtaaaag

SEQ ID NO: 11267 - DNA, 29 bp, Artificial Sequence
  Synthetic Construct
cctgtttcctaatttcaaggatgctgttg

SEQ ID NO: 11268 - DNA, 25 bp, Artificial Sequence
  Synthetic Construct
cttccatctttcagcaccatttcac

SEQ ID NO: 11269 - DNA, 25 bp, Artificial Sequence
  Synthetic Construct
caagtgtttctttacctccagcaaa

SEQ ID NO: 11270 - DNA, 22 bp, Artificial Sequence
  Synthetic Construct
tggtggtgctggctgttatagt

SEQ ID NO: 11271 - DNA, 24 bp, Artificial Sequence
  Synthetic Construct
gctggaatgcctctcaaagatgct

SEQ ID NO: 11272 - DNA, 24 bp, Artificial Sequence
  Synthetic Construct
tcccttctctctccttccataagc

SEQ ID NO: 11273 - DNA, 21 bp, Artificial Sequence
  Synthetic Construct
tgcagaggctgtaggatagca

SEQ ID NO: 11274 - DNA, 19 bp, Artificial Sequence
  Synthetic Construct
ggcatggctgtcccttcct

SEQ ID NO: 11275 - DNA, 25 bp, Artificial Sequence
  Synthetic Construct
ccggtacaattcgacttgactgaac

SEQ ID NO: 11276 - DNA, 21 bp, Artificial Sequence
  Synthetic Construct
gaaaccaggacaagcgtcact

SEQ ID NO: 11277 - DNA, 23 bp, Artificial Sequence
  Synthetic Construct
gtctgcagcaaatacagcttcag

SEQ ID NO: 11278 - DNA, 25 bp, Artificial Sequence
  Synthetic Construct
ggcaaacaaactgaacactcattgg

SEQ ID NO: 11279 - DNA, 27 bp, Artificial Sequence
  Synthetic Construct
cacgtaaaatgaaattggttccatgtg

SEQ ID NO: 11280 - DNA, 24 bp, Artificial Sequence
  Synthetic Construct
gctcaaacagtttgatctcaacca

SEQ ID NO: 11281 - DNA, 24 bp, Artificial Sequence
  Synthetic Construct
cagcctttttctgtcagagatgga

SEQ ID NO: 11282 - DNA, 30 bp, Artificial Sequence
  Synthetic Construct
gcagcagatttcatcttaaatcatcagaag

SEQ ID NO: 11283 - DNA, 24 bp, Artificial Sequence
  Synthetic Construct
cctagtgctttgttcacccttttc

SEQ ID NO: 11284 - DNA, 20 bp, Artificial Sequence
  Synthetic Construct
ctggctgggttgtgatagca

SEQ ID NO: 11285 - DNA, 22 bp, Artificial Sequence
  Synthetic Construct
aggaagccaggagtctcaacca

SEQ ID NO: 11286 - DNA, 28 bp, Artificial Sequence
  Synthetic Construct
ggaaacttgaagcgaagagtttatctgt

SEQ ID NO: 11287 - DNA, 23 bp, Artificial Sequence
  Synthetic Construct
cttcctgaagacaatggcagaga

SEQ ID NO: 11288 - DNA, 21 bp, Artificial Sequence
  Synthetic Construct
tggtggggccattcctatagt

SEQ ID NO: 11289 - DNA, 22 bp, Artificial Sequence
  Synthetic Construct
ctttctgcctgccctttttgtg

SEQ ID NO: 11290 - DNA, 26 bp, Artificial Sequence
  Synthetic Construct
gcgctgagccaatttttgtagagatg

SEQ ID NO: 11291 - DNA, 22 bp, Artificial Sequence
  Synthetic Construct
ggtttgcagtgggttcttgatg

SEQ ID NO: 11292 - DNA, 22 bp, Artificial Sequence
  Synthetic Construct
ggagcattccctgtcacaaacc

SEQ ID NO: 11293 - DNA, 23 bp, Artificial Sequence
  Synthetic Construct
ggctgtattctggtgtcctggta

SEQ ID NO: 11294 - DNA, 27 bp, Artificial Sequence
  Synthetic Construct
ggagcactcccactaataaaagtgttc

SEQ ID NO: 11295 - DNA, 22 bp, Artificial Sequence
  Synthetic Construct
cgcatcgtgaagcttgggttaa

SEQ ID NO: 11296 - DNA, 27 bp, Artificial Sequence
  Synthetic Construct
gcaggaggttattaaaggcaaaaacct

SEQ ID NO: 11297 - DNA, 18 bp, Artificial Sequence
  Synthetic Construct
ggccccaggatgcaggat

SEQ ID NO: 11298 - DNA, 25 bp, Artificial Sequence
  Synthetic Construct
acagtatcaagagttggttggctaa

SEQ ID NO: 11299 - DNA, 26 bp, Artificial Sequence
  Synthetic Construct
gaaattttgaaatgcagctggacaaa

SEQ ID NO: 11300 - DNA, 25 bp, Artificial Sequence
  Synthetic Construct
ctcccaacaaagctgaaagaaaacc

SEQ ID NO: 11301 - DNA, 19 bp, Artificial Sequence
  Synthetic Construct
agtcgcgtagggtgttgga

SEQ ID NO: 11302 - DNA, 29 bp, Artificial Sequence
  Synthetic Construct
ctgttgaaaatgtgaagatgaatctctga

SEQ ID NO: 11303 - DNA, 27 bp, Artificial Sequence
  Synthetic Construct
catgtggtagcttgggttaataatgtg

SEQ ID NO: 11304 - DNA, 25 bp, Artificial Sequence
  Synthetic Construct
gctccagcagaccttcttcatttac

SEQ ID NO: 11305 - DNA, 26 bp, Artificial Sequence
  Synthetic Construct
ggctttggatcaaaggatgagtttgg

SEQ ID NO: 11306 - DNA, 28 bp, Artificial Sequence
  Synthetic Construct
caattattcctattcactccttggcatt

SEQ ID NO: 11307 - DNA, 26 bp, Artificial Sequence
  Synthetic Construct
aaacaggattctcaggaacatgtttc

SEQ ID NO: 11308 - DNA, 22 bp, Artificial Sequence
  Synthetic Construct
caaacagctgcctctgttacct

SEQ ID NO: 11309 - DNA, 24 bp, Artificial Sequence
  Synthetic Construct
cctcagtgtcccaaaatggtgcta

SEQ ID NO: 11310 - DNA, 26 bp, Artificial Sequence
  Synthetic Construct
actttcttcactagtttcagcagcta

SEQ ID NO: 11311 - DNA, 24 bp, Artificial Sequence
  Synthetic Construct
gctgcttctgaaaagttgcatagc

SEQ ID NO: 11312 - DNA, 24 bp, Artificial Sequence
  Synthetic Construct
ccctcttctgaagctgagatacca

SEQ ID NO: 11313 - DNA, 19 bp, Artificial Sequence
  Synthetic Construct
tggggggtggactggatga

SEQ ID NO: 11314 - DNA, 23 bp, Artificial Sequence
  Synthetic Construct
agggagagggggtcttttatctc

SEQ ID NO: 11315 - DNA, 26 bp, Artificial Sequence
  Synthetic Construct
ggtcagctgtatccaaactgttcttc

SEQ ID NO: 11316 - DNA, 25 bp, Artificial Sequence
  Synthetic Construct
gcagggctaccattatgttgtcaga

SEQ ID NO: 11317 - DNA, 20 bp, Artificial Sequence
  Synthetic Construct
caccgcatcacagtggaaga

SEQ ID NO: 11318 - DNA, 22 bp, Artificial Sequence
  Synthetic Construct
gactttggttgcaccggaaaag

SEQ ID NO: 11319 - DNA, 26 bp, Artificial Sequence
  Synthetic Construct
ggaaaccattaaggtcacagaaatgg

SEQ ID NO: 11320 - DNA, 22 bp, Artificial Sequence
  Synthetic Construct
gggaaaggtttgggtcatgaca

SEQ ID NO: 11321 - DNA, 22 bp, Artificial Sequence
  Synthetic Construct
ctgctgtcattgttgtgccttt

SEQ ID NO: 11322 - DNA, 25 bp, Artificial Sequence
  Synthetic Construct
gccaaggtgttacccaagagtcatt

SEQ ID NO: 11323 - DNA, 29 bp, Artificial Sequence
  Synthetic Construct
gaaaagtcatttgtccagtagagtttctc

SEQ ID NO: 11324 - DNA, 26 bp, Artificial Sequence
  Synthetic Construct
catgaccaataaggactccagtactg

SEQ ID NO: 11325 - DNA, 22 bp, Artificial Sequence
  Synthetic Construct
gctcctaagctagcagtatgca

SEQ ID NO: 11326 - DNA, 22 bp, Artificial Sequence
  Synthetic Construct
ggttaggtcttgttgccttcgt

SEQ ID NO: 11327 - DNA, 25 bp, Artificial Sequence
  Synthetic Construct
cgctgcctgcaatgaattgttagag

SEQ ID NO: 11328 - DNA, 22 bp, Artificial Sequence
  Synthetic Construct
ggtagctgcagatcttggtgaa

SEQ ID NO: 11329 - DNA, 23 bp, Artificial Sequence
  Synthetic Construct
actgtttgacatgcactgaacag

SEQ ID NO: 11330 - DNA, 24 bp, Artificial Sequence
  Synthetic Construct
tgtctgaccacagtggaatatcac

SEQ ID NO: 11331 - DNA, 25 bp, Artificial Sequence
  Synthetic Construct
tgaaggtacaacaggagaagaagtc

SEQ ID NO: 11332 - DNA, 22 bp, Artificial Sequence
  Synthetic Construct
actgagactcagacagcgaagt

SEQ ID NO: 11333 - DNA, 23 bp, Artificial Sequence
  Synthetic Construct
ctgtgagggagacagtctaatcg

SEQ ID NO: 11334 - DNA, 26 bp, Artificial Sequence
  Synthetic Construct
ctgagttagaaaagacagaccttcct

SEQ ID NO: 11335 - DNA, 26 bp, Artificial Sequence
  Synthetic Construct
aaactggacactgaacttcagatttc

SEQ ID NO: 11336 - DNA, 23 bp, Artificial Sequence
  Synthetic Construct
gcaaatgcaggccttagggaaag

SEQ ID NO: 11337 - DNA, 22 bp, Artificial Sequence
  Synthetic Construct
tggtgctgttgctatccatgca

SEQ ID NO: 11338 - DNA, 30 bp, Artificial Sequence
  Synthetic Construct
ccctgtatagatcatggattattcattcca

SEQ ID NO: 11339 - DNA, 21 bp, Artificial Sequence
  Synthetic Construct
agcagttggtttggcatcctt

SEQ ID NO: 11340 - DNA, 23 bp, Artificial Sequence
  Synthetic Construct
cacctttttggactgctggctta

SEQ ID NO: 11341 - DNA, 22 bp, Artificial Sequence
  Synthetic Construct
gctagctcaagccctgcatttt

SEQ ID NO: 11342 - DNA, 28 bp, Artificial Sequence
  Synthetic Construct
ggacagagattagagccactcatgtaat

SEQ ID NO: 11343 - DNA, 23 bp, Artificial Sequence
  Synthetic Construct
tctctttggagtctggggaggta

SEQ ID NO: 11344 - DNA, 27 bp, Artificial Sequence
  Synthetic Construct
ggcatctttttttcccagggataatct

SEQ ID NO: 11345 - DNA, 26 bp, Artificial Sequence
  Synthetic Construct
ggcaacaaaattcttcacacctccat

SEQ ID NO: 11346 - DNA, 25 bp, Artificial Sequence
  Synthetic Construct
cccattttggcctgacaaagtactg

SEQ ID NO: 11347 - DNA, 22 bp, Artificial Sequence
  Synthetic Construct
acctttgaaagcaggggatcag

SEQ ID NO: 11348 - DNA, 25 bp, Artificial Sequence
  Synthetic Construct
tctgaaaccggtcttttgttaacag

SEQ ID NO: 11349 - DNA, 24 bp, Artificial Sequence
  Synthetic Construct
gttcagactacggtgaaagtgttg

SEQ ID NO: 11350 - DNA, 27 bp, Artificial Sequence
  Synthetic Construct
ggattttccacacaagactgttttaga

SEQ ID NO: 11351 - DNA, 23 bp, Artificial Sequence
  Synthetic Construct
ctccaggtatcagagaggcttca

SEQ ID NO: 11352 - DNA, 22 bp, Artificial Sequence
  Synthetic Construct
accggctgttttgagagacagt

SEQ ID NO: 11353 - DNA, 27 bp, Artificial Sequence
  Synthetic Construct
ccccctagtaccctgacaatgtattca

SEQ ID NO: 11354 - DNA, 19 bp, Artificial Sequence
  Synthetic Construct
ggcagcaggtaggctttga

SEQ ID NO: 11355 - DNA, 25 bp, Artificial Sequence
  Synthetic Construct
ggcttgctaagtcagttaagaaacg

SEQ ID NO: 11356 - DNA, 22 bp, Artificial Sequence
  Synthetic Construct
tgtcaaagctggggctagatga

SEQ ID NO: 11357 - DNA, 22 bp, Artificial Sequence
  Synthetic Construct
cgcctttgcctgagttttgctt

SEQ ID NO: 11358 - DNA, 23 bp, Artificial Sequence
  Synthetic Construct
gctggccttgggtttctgttaaa

SEQ ID NO: 11359 - DNA, 20 bp, Artificial Sequence
  Synthetic Construct
tcacgtcccgatggtttcct

SEQ ID NO: 11360 - DNA, 23 bp, Artificial Sequence
  Synthetic Construct
gtgtttcactggcatgaatgtca

SEQ ID NO: 11361 - DNA, 23 bp, Artificial Sequence
  Synthetic Construct
ttgtccctgtgagaccatcaaaa

SEQ ID NO: 11362 - DNA, 22 bp, Artificial Sequence
  Synthetic Construct
aggagccatctgcctattgttg

SEQ ID NO: 11363 - DNA, 27 bp, Artificial Sequence
  Synthetic Construct
ctttttggcaagaaatgacttccaatg

SEQ ID NO: 11364 - DNA, 24 bp, Artificial Sequence
  Synthetic Construct
caccaaaactgcgagagtataggt

SEQ ID NO: 11365 - DNA, 20 bp, Artificial Sequence
  Synthetic Construct
cgggtgagggaagactcctt

SEQ ID NO: 11366 - DNA, 20 bp, Artificial Sequence
  Synthetic Construct
acgttgagcccgagttactg

SEQ ID NO: 11367 - DNA, 23 bp, Artificial Sequence
  Synthetic Construct
gagcaacatgaggatgtctgttg

SEQ ID NO: 11368 - DNA, 24 bp, Artificial Sequence
  Synthetic Construct
aggctgagagggagtagcatactt

SEQ ID NO: 11369 - DNA, 26 bp, Artificial Sequence
  Synthetic Construct
gtgaaatcatggacaaaagcttgatg

SEQ ID NO: 11370 - DNA, 25 bp, Artificial Sequence
  Synthetic Construct
tcctcctttgttcaggtaagtcaaa

SEQ ID NO: 11371 - DNA, 18 bp, Artificial Sequence
  Synthetic Construct
caccaaggccaccacaca

SEQ ID NO: 11372 - DNA, 21 bp, Artificial Sequence
  Synthetic Construct
tcagggctgcaagttcttcca

SEQ ID NO: 11373 - DNA, 21 bp, Artificial Sequence
  Synthetic Construct
ctggagttcttgggccatcag

SEQ ID NO: 11374 - DNA, 18 bp, Artificial Sequence
  Synthetic Construct
tgcagctgggaccaggaa

SEQ ID NO: 11375 - DNA, 24 bp, Artificial Sequence
  Synthetic Construct
gcaatcccttgatcctggttagga

SEQ ID NO: 11376 - DNA, 22 bp, Artificial Sequence
  Synthetic Construct
cttggttcagacccacaatgca

SEQ ID NO: 11377 - DNA, 21 bp, Artificial Sequence
  Synthetic Construct
tttggctggcatcacccatca

SEQ ID NO: 11378 - DNA, 27 bp, Artificial Sequence
  Synthetic Construct
gcacgatactgctaactgatctttttc

SEQ ID NO: 11379 - DNA, 18 bp, Artificial Sequence
  Synthetic Construct
gaggcagtggcagtgtgt

SEQ ID NO: 11380 - DNA, 20 bp, Artificial Sequence
  Synthetic Construct
gccctcggaccttagagaca

SEQ ID NO: 11381 - DNA, 25 bp, Artificial Sequence
  Synthetic Construct
ccatttgagcccatttgttctcaga

SEQ ID NO: 11382 - DNA, 22 bp, Artificial Sequence
  Synthetic Construct
tgtgcaaatcctggccttggat

SEQ ID NO: 11383 - DNA, 27 bp, Artificial Sequence
  Synthetic Construct
ggacacagatgtagcaatggagtcttc

SEQ ID NO: 11384 - DNA, 22 bp, Artificial Sequence
  Synthetic Construct
agtgacagcagagttggaatgg

SEQ ID NO: 11385 - DNA, 26 bp, Artificial Sequence
  Synthetic Construct
tgtttgcattgatctctcctttcagt

SEQ ID NO: 11386 - DNA, 21 bp, Artificial Sequence
  Synthetic Construct
gctgcaaccaggaaacaacct

SEQ ID NO: 11387 - DNA, 26 bp, Artificial Sequence
  Synthetic Construct
gctaggtgtggtgtttcttgatagtt

SEQ ID NO: 11388 - DNA, 28 bp, Artificial Sequence
  Synthetic Construct
gaaaaatttgaaagcacttttccactct

SEQ ID NO: 11389 - DNA, 26 bp, Artificial Sequence
  Synthetic Construct
cctcagtagtcatcccctttgaggat

SEQ ID NO: 11390 - DNA, 25 bp, Artificial Sequence
  Synthetic Construct
ccctcttccatattggtacccctaa

SEQ ID NO: 11391 - DNA, 22 bp, Artificial Sequence
  Synthetic Construct
agttagggctggtgagaaaggt

SEQ ID NO: 11392 - DNA, 23 bp, Artificial Sequence
  Synthetic Construct
cactggtcaaggatagtggttca

SEQ ID NO: 11393 - DNA, 20 bp, Artificial Sequence
  Synthetic Construct
aggaaggaagccagcctttg

SEQ ID NO: 11394 - DNA, 27 bp, Artificial Sequence
  Synthetic Construct
gacaatgaccatgtctgattcatcttg

SEQ ID NO: 11395 - DNA, 21 bp, Artificial Sequence
  Synthetic Construct
caggaagtgaccccagtttgg

SEQ ID NO: 11396 - DNA, 25 bp, Artificial Sequence
  Synthetic Construct
atgactactactgaagccagaactg

SEQ ID NO: 11397 - DNA, 23 bp, Artificial Sequence
  Synthetic Construct
cacaagtggctgaatgtcaagag

SEQ ID NO: 11398 - DNA, 28 bp, Artificial Sequence
  Synthetic Construct
agatttccatcctacaacacagatctac

SEQ ID NO: 11399 - DNA, 28 bp, Artificial Sequence
  Synthetic Construct
ccttcatggcttttaatgagagaacatt

SEQ ID NO: 11400 - DNA, 22 bp, Artificial Sequence
  Synthetic Construct
tcccttgatggctgtcatctga

SEQ ID NO: 11401 - DNA, 20 bp, Artificial Sequence
  Synthetic Construct
atagccagccaccagtagca

SEQ ID NO: 11402 - DNA, 20 bp, Artificial Sequence
  Synthetic Construct
agctgagctgcagggaacca

SEQ ID NO: 11403 - DNA, 21 bp, Artificial Sequence
  Synthetic Construct
gcctcatttgggtcccagtgt

SEQ ID NO: 11404 - DNA, 24 bp, Artificial Sequence
  Synthetic Construct
cacctgggatgacatagtgaaacc

SEQ ID NO: 11405 - DNA, 22 bp, Artificial Sequence
  Synthetic Construct
aactacttgtccagggctttgg

SEQ ID NO: 11406 - DNA, 24 bp, Artificial Sequence
  Synthetic Construct
cagcccagtacagacagctttatg

SEQ ID NO: 11407 - DNA, 24 bp, Artificial Sequence
  Synthetic Construct
gggccttcatcttgcaccttagat

SEQ ID NO: 11408 - DNA, 24 bp, Artificial Sequence
  Synthetic Construct
actggggaacatctgtcctttagg

SEQ ID NO: 11409 - DNA, 24 bp, Artificial Sequence
  Synthetic Construct
gccttccactctcaacttcagatg

SEQ ID NO: 11410 - DNA, 20 bp, Artificial Sequence
  Synthetic Construct
tcccctctggcccaggtaat

SEQ ID NO: 11411 - DNA, 22 bp, Artificial Sequence
  Synthetic Construct
tcaagacacccctctcacttgt

SEQ ID NO: 11412 - DNA, 22 bp, Artificial Sequence
  Synthetic Construct
ttcctagcttcctcccctttca

SEQ ID NO: 11413 - DNA, 24 bp, Artificial Sequence
  Synthetic Construct
cctccctcaccatttctgttcttc

SEQ ID NO: 11414 - DNA, 21 bp, Artificial Sequence
  Synthetic Construct
agacactggggagagggaaat

SEQ ID NO: 11415 - DNA, 23 bp, Artificial Sequence
  Synthetic Construct
gcctgctttatgctagattgcaa

SEQ ID NO: 11416 - DNA, 21 bp, Artificial Sequence
  Synthetic Construct
tgctgtgtgtgagagcaccta

SEQ ID NO: 11417 - DNA, 20 bp, Artificial Sequence
  Synthetic Construct
acgtggaggccaaggacaga

SEQ ID NO: 11418 - DNA, 21 bp, Artificial Sequence
  Synthetic Construct
tggcagaagcatggacaacct

SEQ ID NO: 11419 - DNA, 24 bp, Artificial Sequence
  Synthetic Construct
tgagacaagggaaaagggaagaag

SEQ ID NO: 11420 - DNA, 24 bp, Artificial Sequence
  Synthetic Construct
caaacaagcaaacaaatccacgtt

SEQ ID NO: 11421 - DNA, 22 bp, Artificial Sequence
  Synthetic Construct
caaggcagcactgagttcaatg

SEQ ID NO: 11422 - DNA, 27 bp, Artificial Sequence
  Synthetic Construct
ggttttcagtgtgaggttttacatacc

SEQ ID NO: 11423 - DNA, 20 bp, Artificial Sequence
  Synthetic Construct
cagctcggctgttagcaact

SEQ ID NO: 11424 - DNA, 24 bp, Artificial Sequence
  Synthetic Construct
gcgggatcaggtgtgaaggatttt

SEQ ID NO: 11425 - DNA, 24 bp, Artificial Sequence
  Synthetic Construct
gtcggttcagctggatatctatgg

SEQ ID NO: 11426 - DNA, 20 bp, Artificial Sequence
  Synthetic Construct
tctagggggagccactagga

SEQ ID NO: 11427 - DNA, 25 bp, Artificial Sequence
  Synthetic Construct
cagcatctgaaagtgaacagtatcc

SEQ ID NO: 11428 - DNA, 26 bp, Artificial Sequence
  Synthetic Construct
cctgcttcatacagggtaatgaagga

SEQ ID NO: 11429 - DNA, 28 bp, Artificial Sequence
  Synthetic Construct
gtggtctgatttactacaagcatgattt

SEQ ID NO: 11430 - DNA, 26 bp, Artificial Sequence
  Synthetic Construct
ggcaggcacctctattcatctatagg

SEQ ID NO: 11431 - DNA, 29 bp, Artificial Sequence
  Synthetic Construct
gtgttgagaaaaatacaggctatcatggt

SEQ ID NO: 11432 - DNA, 24 bp, Artificial Sequence
  Synthetic Construct
cgctgcagttgttatttctacagt

SEQ ID NO: 11433 - DNA, 23 bp, Artificial Sequence
  Synthetic Construct
aaatgattgtcctggagctgcta

SEQ ID NO: 11434 - DNA, 24 bp, Artificial Sequence
  Synthetic Construct
acagtcttccgtacactgatttca

SEQ ID NO: 11435 - DNA, 26 bp, Artificial Sequence
  Synthetic Construct
ggaacattcactgctttgaaggttag

SEQ ID NO: 11436 - DNA, 23 bp, Artificial Sequence
  Synthetic Construct
agcaaatcagtgacaccaactca

SEQ ID NO: 11437 - DNA, 24 bp, Artificial Sequence
  Synthetic Construct
ccagctcagcactatgacttgctt

SEQ ID NO: 11438 - DNA, 26 bp, Artificial Sequence
  Synthetic Construct
gtttctgtgagtgttttgtgggttta

SEQ ID NO: 11439 - DNA, 22 bp, Artificial Sequence
  Synthetic Construct
agcgcctttgcctgagtttttg

SEQ ID NO: 11440 - DNA, 23 bp, Artificial Sequence
  Synthetic Construct
gccagtcactctctgaaatgctt

SEQ ID NO: 11441 - DNA, 26 bp, Artificial Sequence
  Synthetic Construct
gggtcaagacaaatatctgctttcac

SEQ ID NO: 11442 - DNA, 24 bp, Artificial Sequence
  Synthetic Construct
tctgcaaggaccaggtaattttct

SEQ ID NO: 11443 - DNA, 22 bp, Artificial Sequence
  Synthetic Construct
caagacccagagctgagatcag

SEQ ID NO: 11444 - DNA, 23 bp, Artificial Sequence
  Synthetic Construct
tctcaacttggggaaactttgct

SEQ ID NO: 11445 - DNA, 21 bp, Artificial Sequence
  Synthetic Construct
tgagcttggatggtgcccttt

SEQ ID NO: 11446 - DNA, 24 bp, Artificial Sequence
  Synthetic Construct
agcaggtgagtaggagcaaagttg

SEQ ID NO: 11447 - DNA, 28 bp, Artificial Sequence
  Synthetic Construct
gctagcagactaatacagttacccaaat

SEQ ID NO: 11448 - DNA, 19 bp, Artificial Sequence
  Synthetic Construct
agctgggagtggggttagg

SEQ ID NO: 11449 - DNA, 22 bp, Artificial Sequence
  Synthetic Construct
agggatctgtgtgctgtgttca

SEQ ID NO: 11450 - DNA, 23 bp, Artificial Sequence
  Synthetic Construct
gggaacaaacttggtgctattgg

SEQ ID NO: 11451 - DNA, 27 bp, Artificial Sequence
  Synthetic Construct
gggattcaatgtcatgaagagagtttt

SEQ ID NO: 11452 - DNA, 26 bp, Artificial Sequence
  Synthetic Construct
gacaggcacccctttttatctatagg

SEQ ID NO: 11453 - DNA, 30 bp, Artificial Sequence
  Synthetic Construct
accgactaattgaaacatgttataggagat

SEQ ID NO: 11454 - DNA, 21 bp, Artificial Sequence
  Synthetic Construct
agggaaaggagtcagcgatga

SEQ ID NO: 11455 - DNA, 23 bp, Artificial Sequence
  Synthetic Construct
gctcacagcttagacactctcaa

SEQ ID NO: 11456 - DNA, 21 bp, Artificial Sequence
  Synthetic Construct
tgagcacgcatacaacttcct

SEQ ID NO: 11457 - DNA, 20 bp, Artificial Sequence
  Synthetic Construct
gcagcctctgcctagtgtgt

SEQ ID NO: 11458 - DNA, 23 bp, Artificial Sequence
  Synthetic Construct
gactaacaagcagccatctgaac

SEQ ID NO: 11459 - DNA, 25 bp, Artificial Sequence
  Synthetic Construct
gtctcaagcacagagatatgcagat

SEQ ID NO: 11460 - DNA, 21 bp, Artificial Sequence
  Synthetic Construct
aagaggtgcggccattaggaa

SEQ ID NO: 11461 - DNA, 28 bp, Artificial Sequence
  Synthetic Construct
tctccttcactgtcagataaaatccaaa

SEQ ID NO: 11462 - DNA, 27 bp, Artificial Sequence
  Synthetic Construct
atcgagaaaaatgatgagactgaaacc

SEQ ID NO: 11463 - DNA, 25 bp, Artificial Sequence
  Synthetic Construct
ggttgggtttacttccttggacaga

SEQ ID NO: 11464 - DNA, 21 bp, Artificial Sequence
  Synthetic Construct
accatcccctctctggttcat

SEQ ID NO: 11465 - DNA, 20 bp, Artificial Sequence
  Synthetic Construct
gaatgcacagtggccaaagc

SEQ ID NO: 11466 - DNA, 24 bp, Artificial Sequence
  Synthetic Construct
ggacggtaatctgtgtgagaacaa

SEQ ID NO: 11467 - DNA, 27 bp, Artificial Sequence
  Synthetic Construct
gatcagaatgacaatagcccagttttc

SEQ ID NO: 11468 - DNA, 27 bp, Artificial Sequence
  Synthetic Construct
gggagatttccagcactaaaattgaaa

SEQ ID NO: 11469 - DNA, 25 bp, Artificial Sequence
  Synthetic Construct
gggactcaggaatggctgtaaaagt

SEQ ID NO: 11470 - DNA, 25 bp, Artificial Sequence
  Synthetic Construct
cagtctcacttgatcctgctaagag

SEQ ID NO: 11471 - DNA, 18 bp, Artificial Sequence
  Synthetic Construct
gccagcgtatgccagtgt

SEQ ID NO: 11472 - DNA, 22 bp, Artificial Sequence
  Synthetic Construct
aagtcaggtagggctgccattt

SEQ ID NO: 11473 - DNA, 24 bp, Artificial Sequence
  Synthetic Construct
ttttactaagggctgacactgtgt

SEQ ID NO: 11474 - DNA, 26 bp, Artificial Sequence
  Synthetic Construct
ttagtcatctaggcatccttcaatcc

SEQ ID NO: 11475 - DNA, 23 bp, Artificial Sequence
  Synthetic Construct
gcccataaaaactccaggactca

SEQ ID NO: 11476 - DNA, 27 bp, Artificial Sequence
  Synthetic Construct
ggttactgaatggactatgtcctgtac

SEQ ID NO: 11477 - DNA, 23 bp, Artificial Sequence
  Synthetic Construct
gagcctgaccacattttccatct

SEQ ID NO: 11478 - DNA, 22 bp, Artificial Sequence
  Synthetic Construct
gggttgacaatgactgcatgct

SEQ ID NO: 11479 - DNA, 27 bp, Artificial Sequence
  Synthetic Construct
gtcctgagatattcacttccctctaca

SEQ ID NO: 11480 - DNA, 24 bp, Artificial Sequence
  Synthetic Construct
ccctgttggatttgacgatggaat

SEQ ID NO: 11481 - DNA, 26 bp, Artificial Sequence
  Synthetic Construct
gttcagattgaatttgcctcatctca

SEQ ID NO: 11482 - DNA, 28 bp, Artificial Sequence
  Synthetic Construct
ggaacttgggtaaattctaaacctagga

SEQ ID NO: 11483 - DNA, 22 bp, Artificial Sequence
  Synthetic Construct
caggtggtgcactctccttatg

SEQ ID NO: 11484 - DNA, 21 bp, Artificial Sequence
  Synthetic Construct
aatggagctcccagggaaagg

SEQ ID NO: 11485 - DNA, 29 bp, Artificial Sequence
  Synthetic Construct
aggacttccttttgagaagtaaccatatt

SEQ ID NO: 11486 - DNA, 23 bp, Artificial Sequence
  Synthetic Construct
actggatgtctctccaggagtca

SEQ ID NO: 11487 - DNA, 27 bp, Artificial Sequence
  Synthetic Construct
tgggaaagtacaattgggtaactacac

SEQ ID NO: 11488 - DNA, 25 bp, Artificial Sequence
  Synthetic Construct
gttttgctgtagtataaggcatgct

SEQ ID NO: 11489 - DNA, 24 bp, Artificial Sequence
  Synthetic Construct
gtgtgcaactattaatcggttcgt

SEQ ID NO: 11490 - DNA, 29 bp, Artificial Sequence
  Synthetic Construct
gacttcctgagtaccactatttggattat

SEQ ID NO: 11491 - DNA, 24 bp, Artificial Sequence
  Synthetic Construct
gacaaacccactgaccttttcaag

SEQ ID NO: 11492 - DNA, 22 bp, Artificial Sequence
  Synthetic Construct
ggtcacatgctctatggttcca

SEQ ID NO: 11493 - DNA, 22 bp, Artificial Sequence
  Synthetic Construct
ccggctcttgctgtttctaagg

SEQ ID NO: 11494 - DNA, 28 bp, Artificial Sequence
  Synthetic Construct
tctaggcactgtttagggatagtaaaag

SEQ ID NO: 11495 - DNA, 22 bp, Artificial Sequence
  Synthetic Construct
tctggctcccgaatggatcaaa

SEQ ID NO: 11496 - DNA, 25 bp, Artificial Sequence
  Synthetic Construct
cctctcccaatttcacagagtagtt

SEQ ID NO: 11497 - DNA, 22 bp, Artificial Sequence
  Synthetic Construct
acaggataaggcacccatcatg

SEQ ID NO: 11498 - DNA, 24 bp, Artificial Sequence
  Synthetic Construct
gcatgcttacccttgcaatttctg

SEQ ID NO: 11499 - DNA, 24 bp, Artificial Sequence
  Synthetic Construct
ggttggacttgggaagaattcact

SEQ ID NO: 11500 - DNA, 22 bp, Artificial Sequence
  Synthetic Construct
gaaggtggcttggctttcttca

SEQ ID NO: 11501 - DNA, 21 bp, Artificial Sequence
  Synthetic Construct
tgcagcagagagcctggaatt

SEQ ID NO: 11502 - DNA, 21 bp, Artificial Sequence
  Synthetic Construct
gccagcagcgttatgactcat

SEQ ID NO: 11503 - DNA, 28 bp, Artificial Sequence
  Synthetic Construct
cattctgttttggtctgggttttatagt

SEQ ID NO: 11504 - DNA, 30 bp, Artificial Sequence
  Synthetic Construct
ttaaagtcagccaattagcaacttttattg

SEQ ID NO: 11505 - DNA, 22 bp, Artificial Sequence
  Synthetic Construct
ggttccatgtgggttcatcctt

SEQ ID NO: 11506 - DNA, 26 bp, Artificial Sequence
  Synthetic Construct
ggggagtccatattatctgtcaactg

SEQ ID NO: 11507 - DNA, 26 bp, Artificial Sequence
  Synthetic Construct
gaataaaactaggtggtcagcaagac

SEQ ID NO: 11508 - DNA, 27 bp, Artificial Sequence
  Synthetic Construct
gcaagctattagcaaggcatattttgc

SEQ ID NO: 11509 - DNA, 21 bp, Artificial Sequence
  Synthetic Construct
ggctgcacttcaaacaggttt

SEQ ID NO: 11510 - DNA, 25 bp, Artificial Sequence
  Synthetic Construct
ttcagaaaacactccaggaatcagt

SEQ ID NO: 11511 - DNA, 24 bp, Artificial Sequence
  Synthetic Construct
gcatggctactacttcccaaggaa

SEQ ID NO: 11512 - DNA, 20 bp, Artificial Sequence
  Synthetic Construct
ccactgtggggtccaaggaa

SEQ ID NO: 11513 - DNA, 25 bp, Artificial Sequence
  Synthetic Construct
cgtcaaccaaaagttacctctgaga

SEQ ID NO: 11514 - DNA, 26 bp, Artificial Sequence
  Synthetic Construct
gtaacacctggaggactgataacaaa

SEQ ID NO: 11515 - DNA, 27 bp, Artificial Sequence
  Synthetic Construct
ccaaatctggatttgcaggttttagct

SEQ ID NO: 11516 - DNA, 22 bp, Artificial Sequence
  Synthetic Construct
tgctgaagtggctgctgttttc

SEQ ID NO: 11517 - DNA, 22 bp, Artificial Sequence
  Synthetic Construct
gtgtcatggccataagcaggaa

SEQ ID NO: 11518 - DNA, 26 bp, Artificial Sequence
  Synthetic Construct
tctctattggattgtgatgtgcaatg

SEQ ID NO: 11519 - DNA, 21 bp, Artificial Sequence
  Synthetic Construct
agaagagtcctggctcacaga

SEQ ID NO: 11520 - DNA, 24 bp, Artificial Sequence
  Synthetic Construct
tcatgctgagaaggtgagaattga

SEQ ID NO: 11521 - DNA, 20 bp, Artificial Sequence
  Synthetic Construct
agctagctcggcctttcaca

SEQ ID NO: 11522 - DNA, 29 bp, Artificial Sequence
  Synthetic Construct
gcctattttacaaggccttgataaaaatc

SEQ ID NO: 11523 - DNA, 29 bp, Artificial Sequence
  Synthetic Construct
agttgggttaaaccatctaaaacatcaaa

SEQ ID NO: 11524 - DNA, 24 bp, Artificial Sequence
  Synthetic Construct
ttgtaacatgccattgcttttgga

SEQ ID NO: 11525 - DNA, 24 bp, Artificial Sequence
  Synthetic Construct
gctcttgtattccggacatactct

SEQ ID NO: 11526 - DNA, 26 bp, Artificial Sequence
  Synthetic Construct
tgtaatgtagattacagtcgctgtgt

SEQ ID NO: 11527 - DNA, 27 bp, Artificial Sequence
  Synthetic Construct
aacattaaattcttgccacaccctaaa

SEQ ID NO: 11528 - DNA, 24 bp, Artificial Sequence
  Synthetic Construct
acacacaagcaggttaggtatctg

SEQ ID NO: 11529 - DNA, 27 bp, Artificial Sequence
  Synthetic Construct
cctatggttatctgagtctgtgttcag

SEQ ID NO: 11530 - DNA, 21 bp, Artificial Sequence
  Synthetic Construct
atgagtcccagccacttccaa

SEQ ID NO: 11531 - DNA, 25 bp, Artificial Sequence
  Synthetic Construct
gaactctatcaccaagcagatagca

SEQ ID NO: 11532 - DNA, 22 bp, Artificial Sequence
  Synthetic Construct
aggatggagctcccagagacaa

SEQ ID NO: 11533 - DNA, 28 bp, Artificial Sequence
  Synthetic Construct
gcaactttttgtcttccaactacctgaa

SEQ ID NO: 11534 - DNA, 22 bp, Artificial Sequence
  Synthetic Construct
accctagtccactgtcctatgc

SEQ ID NO: 11535 - DNA, 25 bp, Artificial Sequence
  Synthetic Construct
aagcacccgaaaaagacatttagtc

SEQ ID NO: 11536 - DNA, 22 bp, Artificial Sequence
  Synthetic Construct
tcagaagctggagaaagcaaca

SEQ ID NO: 11537 - DNA, 25 bp, Artificial Sequence
  Synthetic Construct
tggccatagtttcagagaaaacact

SEQ ID NO: 11538 - DNA, 29 bp, Artificial Sequence
  Synthetic Construct
aggattatacaccatcaaaaatgtggttt

SEQ ID NO: 11539 - DNA, 29 bp, Artificial Sequence
  Synthetic Construct
tgaaaagcctatactaaagcatcagtttt

SEQ ID NO: 11540 - DNA, 30 bp, Artificial Sequence
  Synthetic Construct
gaaggcaaaactgatctctagaaattaagg

SEQ ID NO: 11541 - DNA, 24 bp, Artificial Sequence
  Synthetic Construct
gaggttagctctggggaataaggt

SEQ ID NO: 11542 - DNA, 29 bp, Artificial Sequence
  Synthetic Construct
gggcagtaaccatacaatttatcattgtc

SEQ ID NO: 11543 - DNA, 22 bp, Artificial Sequence
  Synthetic Construct
gaagacagaagcccctggtaaa

SEQ ID NO: 11544 - DNA, 25 bp, Artificial Sequence
  Synthetic Construct
ggacttaccagttctaccagagaag

SEQ ID NO: 11545 - DNA, 22 bp, Artificial Sequence
  Synthetic Construct
tgtctgtgcaggcatgaattca

SEQ ID NO: 11546 - DNA, 25 bp, Artificial Sequence
  Synthetic Construct
gagccaggacaagacttcttttcag

SEQ ID NO: 11547 - DNA, 25 bp, Artificial Sequence
  Synthetic Construct
ggttgtgtgggtaaatgaggttttg

SEQ ID NO: 11548 - DNA, 24 bp, Artificial Sequence
  Synthetic Construct
tgagctacagcaaagcaaagtagt

SEQ ID NO: 11549 - DNA, 28 bp, Artificial Sequence
  Synthetic Construct
ctattattaggaagaagtgctggtctgt

SEQ ID NO: 11550 - DNA, 27 bp, Artificial Sequence
  Synthetic Construct
gctactttccaggttacaagagaagac

SEQ ID NO: 11551 - DNA, 27 bp, Artificial Sequence
  Synthetic Construct
gtttaattttgacagggggaaactttg

SEQ ID NO: 11552 - DNA, 22 bp, Artificial Sequence
  Synthetic Construct
ccgtgcaacaaagctgattaca

SEQ ID NO: 11553 - DNA, 25 bp, Artificial Sequence
  Synthetic Construct
tgtcagattctggcattcaaaatcc

SEQ ID NO: 11554 - DNA, 22 bp, Artificial Sequence
  Synthetic Construct
agtggtcacattgggctacaaa

SEQ ID NO: 11555 - DNA, 27 bp, Artificial Sequence
  Synthetic Construct
gctcttatgtttagtgccttaaacctt

SEQ ID NO: 11556 - DNA, 22 bp, Artificial Sequence
  Synthetic Construct
tcaaaagcctgtgggattccat

SEQ ID NO: 11557 - DNA, 23 bp, Artificial Sequence
  Synthetic Construct
gctgcacaaacttccagtttctg

SEQ ID NO: 11558 - DNA, 22 bp, Artificial Sequence
  Synthetic Construct
tgaaagcagcccaggaagtcaa

SEQ ID NO: 11559 - DNA, 27 bp, Artificial Sequence
  Synthetic Construct
gaacattcctcctagacaagttttgag

SEQ ID NO: 11560 - DNA, 22 bp, Artificial Sequence
  Synthetic Construct
agcttctaggggtcatgaagca

SEQ ID NO: 11561 - DNA, 25 bp, Artificial Sequence
  Synthetic Construct
cagctatgctgtgtcacaaaaaacc

SEQ ID NO: 11562 - DNA, 24 bp, Artificial Sequence
  Synthetic Construct
gctagggagtctccatttcaaacc

SEQ ID NO: 11563 - DNA, 23 bp, Artificial Sequence
  Synthetic Construct
ctggccacctcaatgaaaatgag

SEQ ID NO: 11564 - DNA, 29 bp, Artificial Sequence
  Synthetic Construct
agaggtttttcttattttgaggaccattt

SEQ ID NO: 11565 - DNA, 25 bp, Artificial Sequence
  Synthetic Construct
ccctcttctttaccagttgtcaagt

SEQ ID NO: 11566 - DNA, 24 bp, Artificial Sequence
  Synthetic Construct
caagaggtcctgaggaaatgctat

SEQ ID NO: 11567 - DNA, 26 bp, Artificial Sequence
  Synthetic Construct
cccccttccctttatcttcacacttg

SEQ ID NO: 11568 - DNA, 29 bp, Artificial Sequence
  Synthetic Construct
ccttttaacaccaccttgtatcccaaatt

SEQ ID NO: 11569 - DNA, 26 bp, Artificial Sequence
  Synthetic Construct
tgagagaaacacgtctatggaattcg

SEQ ID NO: 11570 - DNA, 19 bp, Artificial Sequence
  Synthetic Construct
tctcccagcggctgttgat

SEQ ID NO: 11571 - DNA, 25 bp, Artificial Sequence
  Synthetic Construct
attcttgggaatcatggggatcatg

SEQ ID NO: 11572 - DNA, 25 bp, Artificial Sequence
  Synthetic Construct
caagctctactcgctctaaattgga

SEQ ID NO: 11573 - DNA, 21 bp, Artificial Sequence
  Synthetic Construct
acctcccaaccagagccttga

SEQ ID NO: 11574 - DNA, 27 bp, Artificial Sequence
  Synthetic Construct
cagtgtttaggcattgaagagttaggt

SEQ ID NO: 11575 - DNA, 24 bp, Artificial Sequence
  Synthetic Construct
ctttctgtgggtctcatctttgca

SEQ ID NO: 11576 - DNA, 29 bp, Artificial Sequence
  Synthetic Construct
cttttttatccctcaaagataaccaaggt

SEQ ID NO: 11577 - DNA, 20 bp, Artificial Sequence
  Synthetic Construct
accatcaccctggccttcct

SEQ ID NO: 11578 - DNA, 28 bp, Artificial Sequence
  Synthetic Construct
gtgtttgggtcataagaggattcttcat

SEQ ID NO: 11579 - DNA, 26 bp, Artificial Sequence
  Synthetic Construct
cagatcagggatgaactgtgatgttg

SEQ ID NO: 11580 - DNA, 27 bp, Artificial Sequence
  Synthetic Construct
tgtgttttcctactccatcactgttac

SEQ ID NO: 11581 - DNA, 21 bp, Artificial Sequence
  Synthetic Construct
gacaaggcagcactgagttca

SEQ ID NO: 11582 - DNA, 28 bp, Artificial Sequence
  Synthetic Construct
gctttgtaccttcagatgattacttgct

SEQ ID NO: 11583 - DNA, 30 bp, Artificial Sequence
  Synthetic Construct
gctcctttttaaattgactttgatggatct

SEQ ID NO: 11584 - DNA, 23 bp, Artificial Sequence
  Synthetic Construct
gtaggtcagtgggtctctgaaac

SEQ ID NO: 11585 - DNA, 29 bp, Artificial Sequence
  Synthetic Construct
agaaaataccactactgactgaaaattgg

SEQ ID NO: 11586 - DNA, 24 bp, Artificial Sequence
  Synthetic Construct
gcactgtttctggttttagcttct

SEQ ID NO: 11587 - DNA, 25 bp, Artificial Sequence
  Synthetic Construct
agctacacctgtattaaccccctta

SEQ ID NO: 11588 - DNA, 29 bp, Artificial Sequence
  Synthetic Construct
tggtccctgatgacttatttagttcattt

SEQ ID NO: 11589 - DNA, 24 bp, Artificial Sequence
  Synthetic Construct
ggagtttagccctcacttcaatga

SEQ ID NO: 11590 - DNA, 24 bp, Artificial Sequence
  Synthetic Construct
tgctccaccttcctcagaaatgtg

SEQ ID NO: 11591 - DNA, 27 bp, Artificial Sequence
  Synthetic Construct
gtgagcaggaatgttacagctatttca

SEQ ID NO: 11592 - DNA, 23 bp, Artificial Sequence
  Synthetic Construct
ttggggtagacagtctggaagtc

SEQ ID NO: 11593 - DNA, 25 bp, Artificial Sequence
  Synthetic Construct
ccattgtcctctttttctcaaagct

SEQ ID NO: 11594 - DNA, 21 bp, Artificial Sequence
  Synthetic Construct
aaccccaaggctcttgtgagt

SEQ ID NO: 11595 - DNA, 23 bp, Artificial Sequence
  Synthetic Construct
tgtgtcttagtgtccaactgctt

SEQ ID NO: 11596 - DNA, 20 bp, Artificial Sequence
  Synthetic Construct
atgttgcctgcttgcttggt

SEQ ID NO: 11597 - DNA, 29 bp, Artificial Sequence
  Synthetic Construct
gtcagagactttctatttcccatttatgc

SEQ ID NO: 11598 - DNA, 20 bp, Artificial Sequence
  Synthetic Construct
tcagaagaggggcgattcca

SEQ ID NO: 11599 - DNA, 24 bp, Artificial Sequence
  Synthetic Construct
ggtcttgcaacagttgtgacattc

SEQ ID NO: 11600 - DNA, 21 bp, Artificial Sequence
  Synthetic Construct
aggtgtgtggcttgacttctg

SEQ ID NO: 11601 - DNA, 21 bp, Artificial Sequence
  Synthetic Construct
tcgcaccatcttctcctctgt

SEQ ID NO: 11602 - DNA, 27 bp, Artificial Sequence
  Synthetic Construct
gggaaaacttgccaaggttaaatgact

SEQ ID NO: 11603 - DNA, 24 bp, Artificial Sequence
  Synthetic Construct
tctttttcctgcctctatggttgt

SEQ ID NO: 11604 - DNA, 27 bp, Artificial Sequence
  Synthetic Construct
ggagtaataagtgagggagggtaagtt

SEQ ID NO: 11605 - DNA, 28 bp, Artificial Sequence
  Synthetic Construct
ccctcatcccaaaatttctttgttacca

SEQ ID NO: 11606 - DNA, 26 bp, Artificial Sequence
  Synthetic Construct
ttattccactcctgattcctatgcaa

SEQ ID NO: 11607 - DNA, 22 bp, Artificial Sequence
  Synthetic Construct
tcctgtctgtcagtcccattct

SEQ ID NO: 11608 - DNA, 22 bp, Artificial Sequence
  Synthetic Construct
ggaggaagtgttgggcaatact

SEQ ID NO: 11609 - DNA, 21 bp, Artificial Sequence
  Synthetic Construct
ccacaaaccttgccactgtga

SEQ ID NO: 11610 - DNA, 29 bp, Artificial Sequence
  Synthetic Construct
cacctacagattaactgaaagctttttga

SEQ ID NO: 11611 - DNA, 27 bp, Artificial Sequence
  Synthetic Construct
aataaaaaatccggatggagacaagtg

SEQ ID NO: 11612 - DNA, 24 bp, Artificial Sequence
  Synthetic Construct
gctcccttacctactcagagatga

SEQ ID NO: 11613 - DNA, 24 bp, Artificial Sequence
  Synthetic Construct
cataaatcctgtcgccgaagtact

SEQ ID NO: 11614 - DNA, 25 bp, Artificial Sequence
  Synthetic Construct
agagctttaagtgcacaatggaaag

SEQ ID NO: 11615 - DNA, 27 bp, Artificial Sequence
  Synthetic Construct
gagcattttacaattcacaaagcacat

SEQ ID NO: 11616 - DNA, 24 bp, Artificial Sequence
  Synthetic Construct
tgattgtgtggcattgctaagagt

SEQ ID NO: 11617 - DNA, 20 bp, Artificial Sequence
  Synthetic Construct
atccctgctctgcgtgcttt

SEQ ID NO: 11618 - DNA, 25 bp, Artificial Sequence
  Synthetic Construct
tgtctgtgacagagttgttctttct

SEQ ID NO: 11619 - DNA, 28 bp, Artificial Sequence
  Synthetic Construct
cgactttttcctgaaaatacacctatgg

SEQ ID NO: 11620 - DNA, 21 bp, Artificial Sequence
  Synthetic Construct
tgctcagggtcaacactcaga

SEQ ID NO: 11621 - DNA, 30 bp, Artificial Sequence
  Synthetic Construct
ctgcttcttaagtgatagataaccctcttc

SEQ ID NO: 11622 - DNA, 28 bp, Artificial Sequence
  Synthetic Construct
ccagtgaggttttctactgtagtgttga

SEQ ID NO: 11623 - DNA, 26 bp, Artificial Sequence
  Synthetic Construct
gtaatatgggtggtctttctctcaca

SEQ ID NO: 11624 - DNA, 30 bp, Artificial Sequence
  Synthetic Construct
cacaccaaggttaaattaagaaacccaata

SEQ ID NO: 11625 - DNA, 20 bp, Artificial Sequence
  Synthetic Construct
tgggtgtggcctttaaagca

SEQ ID NO: 11626 - DNA, 24 bp, Artificial Sequence
  Synthetic Construct
ggacctgtagatagaccctaacca

SEQ ID NO: 11627 - DNA, 24 bp, Artificial Sequence
  Synthetic Construct
tgaaagagcagcctaagcgataag

SEQ ID NO: 11628 - DNA, 22 bp, Artificial Sequence
  Synthetic Construct
tcctttgcgatgtgcttttcag

SEQ ID NO: 11629 - DNA, 25 bp, Artificial Sequence
  Synthetic Construct
gtgaggtcttccatggaactaagac

SEQ ID NO: 11630 - DNA, 24 bp, Artificial Sequence
  Synthetic Construct
cacaggtgttgatgtccctaacct

SEQ ID NO: 11631 - DNA, 27 bp, Artificial Sequence
  Synthetic Construct
acctgcacacttgttctttaaatgttc

SEQ ID NO: 11632 - DNA, 24 bp, Artificial Sequence
  Synthetic Construct
gtcaccctgaagtgatccagaaag

SEQ ID NO: 11633 - DNA, 27 bp, Artificial Sequence
  Synthetic Construct
gcaacatctttaggctttgagttaacc

SEQ ID NO: 11634 - DNA, 26 bp, Artificial Sequence
  Synthetic Construct
gtgctaagaggaaagtttgaccacaa

SEQ ID NO: 11635 - DNA, 27 bp, Artificial Sequence
  Synthetic Construct
tgatggaagtggtcaaatgtaatcaac

SEQ ID NO: 11636 - DNA, 27 bp, Artificial Sequence
  Synthetic Construct
tctgcagattcaacactattcctatca

SEQ ID NO: 11637 - DNA, 29 bp, Artificial Sequence
  Synthetic Construct
tcacatgctatagttcattcacacaaatc

SEQ ID NO: 11638 - DNA, 22 bp, Artificial Sequence
  Synthetic Construct
agcttgaaggtaggaggcagaa

SEQ ID NO: 11639 - DNA, 27 bp, Artificial Sequence
  Synthetic Construct
gccatattctctcagttcacacaaagg

SEQ ID NO: 11640 - DNA, 29 bp, Artificial Sequence
  Synthetic Construct
cctttcaggaataaaagttgtgattacca

SEQ ID NO: 11641 - DNA, 27 bp, Artificial Sequence
  Synthetic Construct
acaggacagggagattatttcactaac

SEQ ID NO: 11642 - DNA, 25 bp, Artificial Sequence
  Synthetic Construct
cctgaaaaggaaaatctggcctgat

SEQ ID NO: 11643 - DNA, 26 bp, Artificial Sequence
  Synthetic Construct
gggatgctaactgctcttctctttgg

SEQ ID NO: 11644 - DNA, 18 bp, Artificial Sequence
  Synthetic Construct
tgcacggaggccctccat

SEQ ID NO: 11645 - DNA, 30 bp, Artificial Sequence
  Synthetic Construct
gctgaactcacaataatagcttcttacttg

SEQ ID NO: 11646 - DNA, 21 bp, Artificial Sequence
  Synthetic Construct
aagctctgcagccttccagat

SEQ ID NO: 11647 - DNA, 26 bp, Artificial Sequence
  Synthetic Construct
atctttctcttcctccagttgactac

SEQ ID NO: 11648 - DNA, 29 bp, Artificial Sequence
  Synthetic Construct
ccagttataagcagatgaggtgtattcat

SEQ ID NO: 11649 - DNA, 27 bp, Artificial Sequence
  Synthetic Construct
cccaggaagccactagaatacaaatcc

SEQ ID NO: 11650 - DNA, 22 bp, Artificial Sequence
  Synthetic Construct
accataatggcagggtgacatg

SEQ ID NO: 11651 - DNA, 25 bp, Artificial Sequence
  Synthetic Construct
ctccaaagcttgttcacttcctact

SEQ ID NO: 11652 - DNA, 23 bp, Artificial Sequence
  Synthetic Construct
gcttgccctttttcgttcattgt

SEQ ID NO: 11653 - DNA, 30 bp, Artificial Sequence
  Synthetic Construct
tggtgaaaattaacacggaaattctaaagt

SEQ ID NO: 11654 - DNA, 28 bp, Artificial Sequence
  Synthetic Construct
tctgtctaccctcattctatggtattga

SEQ ID NO: 11655 - DNA, 23 bp, Artificial Sequence
  Synthetic Construct
acctactggggatcacaaaactg

SEQ ID NO: 11656 - DNA, 22 bp, Artificial Sequence
  Synthetic Construct
tccaggacctgatgacttcact

SEQ ID NO: 11657 - DNA, 27 bp, Artificial Sequence
  Synthetic Construct
gcataatgttgtaggcactttgaaaga

SEQ ID NO: 11658 - DNA, 26 bp, Artificial Sequence
  Synthetic Construct
aacacccattaatcctcatgttttcc

SEQ ID NO: 11659 - DNA, 22 bp, Artificial Sequence
  Synthetic Construct
ggcacaacatttgggagacaaa

SEQ ID NO: 11660 - DNA, 26 bp, Artificial Sequence
  Synthetic Construct
cctggaacctgaaagcttgcaaaaag

SEQ ID NO: 11661 - DNA, 20 bp, Artificial Sequence
  Synthetic Construct
acagggtgctctcctcttga

SEQ ID NO: 11662 - DNA, 25 bp, Artificial Sequence
  Synthetic Construct
ggaagcaaacaggtagagcctggta

SEQ ID NO: 11663 - DNA, 23 bp, Artificial Sequence
  Synthetic Construct
ctacaacaacagagctccaggat

SEQ ID NO: 11664 - DNA, 23 bp, Artificial Sequence
  Synthetic Construct
tgtccttggtcgtatgtgagaga

SEQ ID NO: 11665 - DNA, 20 bp, Artificial Sequence
  Synthetic Construct
gcaggaactggcttgccttt

SEQ ID NO: 11666 - DNA, 23 bp, Artificial Sequence
  Synthetic Construct
aggtttcggctttagttgtgtga

SEQ ID NO: 11667 - DNA, 21 bp, Artificial Sequence
  Synthetic Construct
tgtctgcttctgccggcattc

SEQ ID NO: 11668 - DNA, 25 bp, Artificial Sequence
  Synthetic Construct
gtccctcacacctttctaccagaag

SEQ ID NO: 11669 - DNA, 25 bp, Artificial Sequence
  Synthetic Construct
ggctgcaggagtagaggtctaaatg

SEQ ID NO: 11670 - DNA, 25 bp, Artificial Sequence
  Synthetic Construct
ggcaagaagaaaactggagccaaga

SEQ ID NO: 11671 - DNA, 24 bp, Artificial Sequence
  Synthetic Construct
gagcctgagttcttgatcactaca

SEQ ID NO: 11672 - DNA, 21 bp, Artificial Sequence
  Synthetic Construct
cctggaaaaagccccggtaga

SEQ ID NO: 11673 - DNA, 21 bp, Artificial Sequence
  Synthetic Construct
gcaatggtcccagtgagagtt

SEQ ID NO: 11674 - DNA, 20 bp, Artificial Sequence
  Synthetic Construct
gccctttggaacctgaccaa

SEQ ID NO: 11675 - DNA, 24 bp, Artificial Sequence
  Synthetic Construct
ggccttgatttgacccttcttttc

SEQ ID NO: 11676 - DNA, 22 bp, Artificial Sequence
  Synthetic Construct
ccacccgcttctgaaacacatc

SEQ ID NO: 11677 - DNA, 18 bp, Artificial Sequence
  Synthetic Construct
tggcgctaaagcccaaca

SEQ ID NO: 11678 - DNA, 24 bp, Artificial Sequence
  Synthetic Construct
ccttccccgcttctggatatgaaa

SEQ ID NO: 11679 - DNA, 23 bp, Artificial Sequence
  Synthetic Construct
gtcagcgtttacggctattgagt

SEQ ID NO: 11680 - DNA, 20 bp, Artificial Sequence
  Synthetic Construct
gcatctccagtgccctctgt

SEQ ID NO: 11681 - DNA, 24 bp, Artificial Sequence
  Synthetic Construct
catcttcctagacatgcacacaac

SEQ ID NO: 11682 - DNA, 21 bp, Artificial Sequence
  Synthetic Construct
gtcccaagtcaactgccatct

SEQ ID NO: 11683 - DNA, 20 bp, Artificial Sequence
  Synthetic Construct
gcgtcagcacagctaacaca

SEQ ID NO: 11684 - DNA, 23 bp, Artificial Sequence
  Synthetic Construct
tcacaatgggagggaacattcaa

SEQ ID NO: 11685 - DNA, 27 bp, Artificial Sequence
  Synthetic Construct
ggtaaaggctggttgtaaagtccacat

SEQ ID NO: 11686 - DNA, 24 bp, Artificial Sequence
  Synthetic Construct
ccgactcaatggggaactcctact

SEQ ID NO: 11687 - DNA, 22 bp, Artificial Sequence
  Synthetic Construct
tccttacaccttggggcgtcta

SEQ ID NO: 11688 - DNA, 26 bp, Artificial Sequence
  Synthetic Construct
gggcatttctaagacacttggacagt

SEQ ID NO: 11689 - DNA, 25 bp, Artificial Sequence
  Synthetic Construct
cactgtatctcaaagggcaaaacaa

SEQ ID NO: 11690 - DNA, 23 bp, Artificial Sequence
  Synthetic Construct
acttgtctctgcagacagtttca

SEQ ID NO: 11691 - DNA, 20 bp, Artificial Sequence
  Synthetic Construct
ggcctcttggtgcctctgtt

SEQ ID NO: 11692 - DNA, 29 bp, Artificial Sequence
  Synthetic Construct
gctagagaaacaagacaacatccaagttc

SEQ ID NO: 11693 - DNA, 22 bp, Artificial Sequence
  Synthetic Construct
gcgggcatagagagaaggaaat

SEQ ID NO: 11694 - DNA, 23 bp, Artificial Sequence
  Synthetic Construct
ggcttcagtccttcacctctttc

SEQ ID NO: 11695 - DNA, 20 bp, Artificial Sequence
  Synthetic Construct
tcagagtcctaggccagcat

SEQ ID NO: 11696 - DNA, 24 bp, Artificial Sequence
  Synthetic Construct
ggttcctcatggaagactggtttg

SEQ ID NO: 11697 - DNA, 26 bp, Artificial Sequence
  Synthetic Construct
gttgagaagggagtaagatcagacaa

SEQ ID NO: 11698 - DNA, 23 bp, Artificial Sequence
  Synthetic Construct
ctcccgcctctaaatgaatggat

SEQ ID NO: 11699 - DNA, 23 bp, Artificial Sequence
  Synthetic Construct
cattccctcccctaccctggaaa

SEQ ID NO: 11700 - DNA, 22 bp, Artificial Sequence
  Synthetic Construct
gagactcaatcctggcacttgt

SEQ ID NO: 11701 - DNA, 22 bp, Artificial Sequence
  Synthetic Construct
cccggctgccatttaagaccat

SEQ ID NO: 11702 - DNA, 23 bp, Artificial Sequence
  Synthetic Construct
gatgagggctgagtatggtcaag

SEQ ID NO: 11703 - DNA, 22 bp, Artificial Sequence
  Synthetic Construct
ccctttcctgaaccccttcatt

SEQ ID NO: 11704 - DNA, 22 bp, Artificial Sequence
  Synthetic Construct
ggggcaccaaagaaaagacaag

SEQ ID NO: 11705 - DNA, 26 bp, Artificial Sequence
  Synthetic Construct
catcagtaccccacataggtttaact

SEQ ID NO: 11706 - DNA, 26 bp, Artificial Sequence
  Synthetic Construct
ggagctcagtatgagtagaggggaaa

SEQ ID NO: 11707 - DNA, 20 bp, Artificial Sequence
  Synthetic Construct
ttgtgcacgacgctggaatg

SEQ ID NO: 11708 - DNA, 22 bp, Artificial Sequence
  Synthetic Construct
tcgctaggccattcctcctgtt

SEQ ID NO: 11709 - DNA, 26 bp, Artificial Sequence
  Synthetic Construct
cacgacacccttagataatgttggat

SEQ ID NO: 11710 - DNA, 19 bp, Artificial Sequence
  Synthetic Construct
tggcacaagcccaggtcat

SEQ ID NO: 11711 - DNA, 24 bp, Artificial Sequence
  Synthetic Construct
gcctcctctgcatctctgaaccaa

SEQ ID NO: 11712 - DNA, 20 bp, Artificial Sequence
  Synthetic Construct
tgcagcgatcccttcacctt

SEQ ID NO: 11713 - DNA, 22 bp, Artificial Sequence
  Synthetic Construct
tggtagtcaggcctagtgactt

SEQ ID NO: 11714 - DNA, 24 bp, Artificial Sequence
  Synthetic Construct
gaggtcttccaaaggctattcaga

SEQ ID NO: 11715 - DNA, 23 bp, Artificial Sequence
  Synthetic Construct
cctgagcctgtcacactatttct

SEQ ID NO: 11716 - DNA, 20 bp, Artificial Sequence
  Synthetic Construct
gagagcaacaggcgttgaga

SEQ ID NO: 11717 - DNA, 23 bp, Artificial Sequence
  Synthetic Construct
agccctacaaggtcaagttttca

SEQ ID NO: 11718 - DNA, 21 bp, Artificial Sequence
  Synthetic Construct
ggaggcacttcactcctccta

SEQ ID NO: 11719 - DNA, 23 bp, Artificial Sequence
  Synthetic Construct
gttggggtcaactttccctgaag

SEQ ID NO: 11720 - DNA, 22 bp, Artificial Sequence
  Synthetic Construct
gaggtttggctccatcatcaga

SEQ ID NO: 11721 - DNA, 25 bp, Artificial Sequence
  Synthetic Construct
gaggctcatgtctcttcagccttag

SEQ ID NO: 11722 - DNA, 22 bp, Artificial Sequence
  Synthetic Construct
gttgcttcccgttatcctcact

SEQ ID NO: 11723 - DNA, 24 bp, Artificial Sequence
  Synthetic Construct
gggcctgttcttgttgatagtgtt

SEQ ID NO: 11724 - DNA, 26 bp, Artificial Sequence
  Synthetic Construct
gtttgctgttactgaatcccgaatct

SEQ ID NO: 11725 - DNA, 26 bp, Artificial Sequence
  Synthetic Construct
gcacatgtaaaaatcctccctactgt

SEQ ID NO: 11726 - DNA, 25 bp, Artificial Sequence
  Synthetic Construct
cctctggtaatagcacccaggatac

SEQ ID NO: 11727 - DNA, 25 bp, Artificial Sequence
  Synthetic Construct
ctgaggtccagaatccagatgttct

SEQ ID NO: 11728 - DNA, 21 bp, Artificial Sequence
  Synthetic Construct
ggacaacaggatcggggatga

SEQ ID NO: 11729 - DNA, 22 bp, Artificial Sequence
  Synthetic Construct
ccatgtgtaggaagccctgtga

SEQ ID NO: 11730 - DNA, 22 bp, Artificial Sequence
  Synthetic Construct
gcgacctcacttttccagtcat

SEQ ID NO: 11731 - DNA, 25 bp, Artificial Sequence
  Synthetic Construct
gtgctattgtggctctgtaggttga

SEQ ID NO: 11732 - DNA, 21 bp, Artificial Sequence
  Synthetic Construct
gtttcagcctgagaggcaaga

SEQ ID NO: 11733 - DNA, 23 bp, Artificial Sequence
  Synthetic Construct
gagatgaagcgtgtgacccaagt

SEQ ID NO: 11734 - DNA, 22 bp, Artificial Sequence
  Synthetic Construct
tgcctcatctctgcccctcttt

SEQ ID NO: 11735 - DNA, 22 bp, Artificial Sequence
  Synthetic Construct
tctcagtgcgtttggaaggaaa

SEQ ID NO: 11736 - DNA, 22 bp, Artificial Sequence
  Synthetic Construct
aggtttccctggacacacattc

SEQ ID NO: 11737 - DNA, 23 bp, Artificial Sequence
  Synthetic Construct
aggagacagggacagtttcaatg

SEQ ID NO: 11738 - DNA, 22 bp, Artificial Sequence
  Synthetic Construct
tgggttggaaacacgtccttta

SEQ ID NO: 11739 - DNA, 20 bp, Artificial Sequence
  Synthetic Construct
gcccttagcaacagctgcat

SEQ ID NO: 11740 - DNA, 21 bp, Artificial Sequence
  Synthetic Construct
gcagacacgcctctggcaaat

SEQ ID NO: 11741 - DNA, 21 bp, Artificial Sequence
  Synthetic Construct
gccaaaagtgacagcaacaca

SEQ ID NO: 11742 - DNA, 26 bp, Artificial Sequence
  Synthetic Construct
gcacacatccaatccttcagtaaatc

SEQ ID NO: 11743 - DNA, 22 bp, Artificial Sequence
  Synthetic Construct
tcctcatccaagctccttctct

SEQ ID NO: 11744 - DNA, 24 bp, Artificial Sequence
  Synthetic Construct
ggcactttccacccagaacttaac

SEQ ID NO: 11745 - DNA, 20 bp, Artificial Sequence
  Synthetic Construct
aagcccacgttgtgctcttg

SEQ ID NO: 11746 - DNA, 26 bp, Artificial Sequence
  Synthetic Construct
ctcagtagggtgaaaaggatggaagt

SEQ ID NO: 11747 - DNA, 24 bp, Artificial Sequence
  Synthetic Construct
gctggatctacagaaaccagcaaa

SEQ ID NO: 11748 - DNA, 19 bp, Artificial Sequence
  Synthetic Construct
tggctgcagatgcttgtca

SEQ ID NO: 11749 - DNA, 22 bp, Artificial Sequence
  Synthetic Construct
gcctctcagcctcacgttctta

SEQ ID NO: 11750 - DNA, 20 bp, Artificial Sequence
  Synthetic Construct
tccttgactcacgcctctga

SEQ ID NO: 11751 - DNA, 22 bp, Artificial Sequence
  Synthetic Construct
ggaggacatggtgtttgaggat

SEQ ID NO: 11752 - DNA, 24 bp, Artificial Sequence
  Synthetic Construct
ctacagttagagtcacacgtcaca

SEQ ID NO: 11753 - DNA, 20 bp, Artificial Sequence
  Synthetic Construct
catgcggagggacttagcaa

SEQ ID NO: 11754 - DNA, 23 bp, Artificial Sequence
  Synthetic Construct
gctttccagagtagaggcgtttc

SEQ ID NO: 11755 - DNA, 24 bp, Artificial Sequence
  Synthetic Construct
tgatggtgcagaattgctacgata

SEQ ID NO: 11756 - DNA, 21 bp, Artificial Sequence
  Synthetic Construct
gctgaaatggacccacagaga

SEQ ID NO: 11757 - DNA, 20 bp, Artificial Sequence
  Synthetic Construct
tgctccaacgatggctcttc

SEQ ID NO: 11758 - DNA, 23 bp, Artificial Sequence
  Synthetic Construct
aggtgaaagcgatgtctgcttag

SEQ ID NO: 11759 - DNA, 21 bp, Artificial Sequence
  Synthetic Construct
gccctgacctcaccattggaa

SEQ ID NO: 11760 - DNA, 19 bp, Artificial Sequence
  Synthetic Construct
tggggcaattgcgggtatt

SEQ ID NO: 11761 - DNA, 25 bp, Artificial Sequence
  Synthetic Construct
gcattacaggagagtgaagatggat

SEQ ID NO: 11762 - DNA, 23 bp, Artificial Sequence
  Synthetic Construct
ggaggagaaaggtggtacacttg

SEQ ID NO: 11763 - DNA, 24 bp, Artificial Sequence
  Synthetic Construct
ggagacaatacaggttgggtggtt

SEQ ID NO: 11764 - DNA, 24 bp, Artificial Sequence
  Synthetic Construct
gcggatcttccttacctagtctga

SEQ ID NO: 11765 - DNA, 25 bp, Artificial Sequence
  Synthetic Construct
ggatactgtgtaggaaggcaataca

SEQ ID NO: 11766 - DNA, 22 bp, Artificial Sequence
  Synthetic Construct
caactccaaccccagccttttg

SEQ ID NO: 11767 - DNA, 24 bp, Artificial Sequence
  Synthetic Construct
caggccaagaatgacatacgactt

SEQ ID NO: 11768 - DNA, 22 bp, Artificial Sequence
  Synthetic Construct
ggcgaaaatgagcactgtggaa

SEQ ID NO: 11769 - DNA, 23 bp, Artificial Sequence
  Synthetic Construct
ggaaggcagtacaagagcttact

SEQ ID NO: 11770 - DNA, 25 bp, Artificial Sequence
  Synthetic Construct
ggcgattcctgacatttgattgcat

SEQ ID NO: 11771 - DNA, 21 bp, Artificial Sequence
  Synthetic Construct
ggggtttgtttgggtcagaga

SEQ ID NO: 11772 - DNA, 25 bp, Artificial Sequence
  Synthetic Construct
ctgcaatattggccatttctcttca

SEQ ID NO: 11773 - DNA, 20 bp, Artificial Sequence
  Synthetic Construct
agtgtgcacgcctggttgaa

SEQ ID NO: 11774 - DNA, 22 bp, Artificial Sequence
  Synthetic Construct
ccccagctccttcacaaagact

SEQ ID NO: 11775 - DNA, 22 bp, Artificial Sequence
  Synthetic Construct
tggagctgaggaggaaagaaca

SEQ ID NO: 11776 - DNA, 27 bp, Artificial Sequence
  Synthetic Construct
tgggtcataaagtgactctgtaacatc

SEQ ID NO: 11777 - DNA, 24 bp, Artificial Sequence
  Synthetic Construct
gctgtgaatgttacatggcaggat

SEQ ID NO: 11778 - DNA, 22 bp, Artificial Sequence
  Synthetic Construct
cgtcccttaccggagcaacttt

SEQ ID NO: 11779 - DNA, 24 bp, Artificial Sequence
  Synthetic Construct
agtgagctagaggctaggacttac

SEQ ID NO: 11780 - DNA, 22 bp, Artificial Sequence
  Synthetic Construct
tcctttcctctcatcgcctttg

SEQ ID NO: 11781 - DNA, 22 bp, Artificial Sequence
  Synthetic Construct
gggcacagaagggtgttccaaa

SEQ ID NO: 11782 - DNA, 21 bp, Artificial Sequence
  Synthetic Construct
ggccctcattgcagtcagcat

SEQ ID NO: 11783 - DNA, 24 bp, Artificial Sequence
  Synthetic Construct
tcctgagatgggaaagagtgaaga

SEQ ID NO: 11784 - DNA, 25 bp, Artificial Sequence
  Synthetic Construct
gaaactgcacaaacttcctctccta

SEQ ID NO: 11785 - DNA, 22 bp, Artificial Sequence
  Synthetic Construct
cgcctgtggttgttgatgaaag

SEQ ID NO: 11786 - DNA, 22 bp, Artificial Sequence
  Synthetic Construct
tccccaagagcacagactcaac

SEQ ID NO: 11787 - DNA, 22 bp, Artificial Sequence
  Synthetic Construct
cctcttcgcagaccttgaggat

SEQ ID NO: 11788 - DNA, 24 bp, Artificial Sequence
  Synthetic Construct
tccacactctaccatttgctgaat

SEQ ID NO: 11789 - DNA, 25 bp, Artificial Sequence
  Synthetic Construct
tgaattgtgcagtgaggctatatct

SEQ ID NO: 11790 - DNA, 26 bp, Artificial Sequence
  Synthetic Construct
tgtgagtaggatctaggcatgttagt

SEQ ID NO: 11791 - DNA, 24 bp, Artificial Sequence
  Synthetic Construct
ggtcacacagagttaatggagaca

SEQ ID NO: 11792 - DNA, 21 bp, Artificial Sequence
  Synthetic Construct
ggacccaagaggctgagaaag

SEQ ID NO: 11793 - DNA, 22 bp, Artificial Sequence
  Synthetic Construct
ctcgtgggtgtgatggaacaga

SEQ ID NO: 11794 - DNA, 20 bp, Artificial Sequence
  Synthetic Construct
tgttgagcgtggaccagtga

SEQ ID NO: 11795 - DNA, 21 bp, Artificial Sequence
  Synthetic Construct
ggctgaggctgtagccttgat

SEQ ID NO: 11796 - DNA, 24 bp, Artificial Sequence
  Synthetic Construct
gatgggctcaagtcagaggttaag

SEQ ID NO: 11797 - DNA, 22 bp, Artificial Sequence
  Synthetic Construct
gacagctgcttctcggctacaa

SEQ ID NO: 11798 - DNA, 19 bp, Artificial Sequence
  Synthetic Construct
atcgcacgtactgccatgt

SEQ ID NO: 11799 - DNA, 23 bp, Artificial Sequence
  Synthetic Construct
ccagaccatgcatccatccacat

SEQ ID NO: 11800 - DNA, 25 bp, Artificial Sequence
  Synthetic Construct
gcaaagaaccatcagggtagacatc

SEQ ID NO: 11801 - DNA, 22 bp, Artificial Sequence
  Synthetic Construct
aagggaggccttccactgtcat

SEQ ID NO: 11802 - DNA, 22 bp, Artificial Sequence
  Synthetic Construct
aagaggccattgccatagttca

SEQ ID NO: 11803 - DNA, 19 bp, Artificial Sequence
  Synthetic Construct
tggggttcaaccggacagt

SEQ ID NO: 11804 - DNA, 21 bp, Artificial Sequence
  Synthetic Construct
cgtgccttaagcccaggtatt

SEQ ID NO: 11805 - DNA, 22 bp, Artificial Sequence
  Synthetic Construct
ggtctcaggaatccacctccaa

SEQ ID NO: 11806 - DNA, 23 bp, Artificial Sequence
  Synthetic Construct
acacagggaacgctctgtaaatg

SEQ ID NO: 11807 - DNA, 24 bp, Artificial Sequence
  Synthetic Construct
cctgtccctctttggttgaaggtt

SEQ ID NO: 11808 - DNA, 28 bp, Artificial Sequence
  Synthetic Construct
caggcattatctacatgtctgcttgtct

SEQ ID NO: 11809 - DNA, 22 bp, Artificial Sequence
  Synthetic Construct
cgtccaagcctcagctgtgtaa

SEQ ID NO: 11810 - DNA, 24 bp, Artificial Sequence
  Synthetic Construct
ctagccaaaagccattctggtagt

SEQ ID NO: 11811 - DNA, 24 bp, Artificial Sequence
  Synthetic Construct
tgttatctgccttctcccaacaaa

SEQ ID NO: 11812 - DNA, 26 bp, Artificial Sequence
  Synthetic Construct
cctcactgccaaatctgatacagaca

SEQ ID NO: 11813 - DNA, 29 bp, Artificial Sequence
  Synthetic Construct
cgagaattacacccatctgatcctctttc

SEQ ID NO: 11814 - DNA, 22 bp, Artificial Sequence
  Synthetic Construct
ggcaagggctaagacgtttgaa

SEQ ID NO: 11815 - DNA, 26 bp, Artificial Sequence
  Synthetic Construct
tcctaactcctacctcatacctcaac

SEQ ID NO: 11816 - DNA, 21 bp, Artificial Sequence
  Synthetic Construct
ccgggactagggtggaagtca

SEQ ID NO: 11817 - DNA, 22 bp, Artificial Sequence
  Synthetic Construct
tgctacacactagctcctcaca

SEQ ID NO: 11818 - DNA, 22 bp, Artificial Sequence
  Synthetic Construct
gcacagacatccagaactgctt

SEQ ID NO: 11819 - DNA, 22 bp, Artificial Sequence
  Synthetic Construct
gtgtgcccacagagacttggaa

SEQ ID NO: 11820 - DNA, 24 bp, Artificial Sequence
  Synthetic Construct
aagccgcctaataatggaaaccta

SEQ ID NO: 11821 - DNA, 24 bp, Artificial Sequence
  Synthetic Construct
atgttctgtagtcgttaggcttgt

SEQ ID NO: 11822 - DNA, 23 bp, Artificial Sequence
  Synthetic Construct
tgaaagaggcaggaaaaggttgt

SEQ ID NO: 11823 - DNA, 22 bp, Artificial Sequence
  Synthetic Construct
agccagataccgtgagccaaga

SEQ ID NO: 11824 - DNA, 27 bp, Artificial Sequence
  Synthetic Construct
cagaagtgggattcaaatccacagaga

SEQ ID NO: 11825 - DNA, 22 bp, Artificial Sequence
  Synthetic Construct
ggcccaaagtgctttgagaaca

SEQ ID NO: 11826 - DNA, 23 bp, Artificial Sequence
  Synthetic Construct
gtcacggaagaactggtggatca

SEQ ID NO: 11827 - DNA, 22 bp, Artificial Sequence
  Synthetic Construct
gcttaataggcgccaaccattt

SEQ ID NO: 11828 - DNA, 24 bp, Artificial Sequence
  Synthetic Construct
cagcttccctgtggaattgtcttc

SEQ ID NO: 11829 - DNA, 21 bp, Artificial Sequence
  Synthetic Construct
tgaaggctcaccagccagaga

SEQ ID NO: 11830 - DNA, 22 bp, Artificial Sequence
  Synthetic Construct
gctgcctcctagagccactaca

SEQ ID NO: 11831 - DNA, 20 bp, Artificial Sequence
  Synthetic Construct
tttacgggcctcccaagtca

SEQ ID NO: 11832 - DNA, 25 bp, Artificial Sequence
  Synthetic Construct
cgtcagccgataatagctgttgctt

SEQ ID NO: 11833 - DNA, 23 bp, Artificial Sequence
  Synthetic Construct
tcttccctaccctgagcctgatg

SEQ ID NO: 11834 - DNA, 23 bp, Artificial Sequence
  Synthetic Construct
gccatgtttcacctgctgcttac

SEQ ID NO: 11835 - DNA, 23 bp, Artificial Sequence
  Synthetic Construct
cagggctttgtgacctagacaga

SEQ ID NO: 11836 - DNA, 19 bp, Artificial Sequence
  Synthetic Construct
tcttgcgcgacaggagaga

SEQ ID NO: 11837 - DNA, 22 bp, Artificial Sequence
  Synthetic Construct
ccttccctccttcgtgtcttct

SEQ ID NO: 11838 - DNA, 24 bp, Artificial Sequence
  Synthetic Construct
gcacttgaggtaggattggaggaa

SEQ ID NO: 11839 - DNA, 21 bp, Artificial Sequence
  Synthetic Construct
gttgtcttggttgccgtgttc

SEQ ID NO: 11840 - DNA, 21 bp, Artificial Sequence
  Synthetic Construct
tgcttctgtctggctgagaag

SEQ ID NO: 11841 - DNA, 24 bp, Artificial Sequence
  Synthetic Construct
ctccttcgtgtatatgagcagctt

SEQ ID NO: 11842 - DNA, 25 bp, Artificial Sequence
  Synthetic Construct
gcccttttccttaaaagcaggaaga

SEQ ID NO: 11843 - DNA, 22 bp, Artificial Sequence
  Synthetic Construct
gcgcaggaagagcagtttgatg

SEQ ID NO: 11844 - DNA, 23 bp, Artificial Sequence
  Synthetic Construct
ggttccccagattggctcaaaag

SEQ ID NO: 11845 - DNA, 19 bp, Artificial Sequence
  Synthetic Construct
atccgccagccgcccaata

SEQ ID NO: 11846 - DNA, 25 bp, Artificial Sequence
  Synthetic Construct
ccaagtctcaggtgtgaggagttac

SEQ ID NO: 11847 - DNA, 24 bp, Artificial Sequence
  Synthetic Construct
cacactgggttttctggtttcagt

SEQ ID NO: 11848 - DNA, 22 bp, Artificial Sequence
  Synthetic Construct
cagggcaactcaacggcaaaag

SEQ ID NO: 11849 - DNA, 22 bp, Artificial Sequence
  Synthetic Construct
agctggtcactgtgggagaaga

SEQ ID NO: 11850 - DNA, 20 bp, Artificial Sequence
  Synthetic Construct
aggctcagctctggggattg

SEQ ID NO: 11851 - DNA, 22 bp, Artificial Sequence
  Synthetic Construct
ggctggctccatcgtttgagat

SEQ ID NO: 11852 - DNA, 25 bp, Artificial Sequence
  Synthetic Construct
cagggaagctttgacagaagagata

SEQ ID NO: 11853 - DNA, 25 bp, Artificial Sequence
  Synthetic Construct
aggatacaggttggaaagcaagatt

SEQ ID NO: 11854 - DNA, 24 bp, Artificial Sequence
  Synthetic Construct
gtgcggctgtcatcaacattcaac

SEQ ID NO: 11855 - DNA, 22 bp, Artificial Sequence
  Synthetic Construct
ggaacgggagtcaggtcaaaca

SEQ ID NO: 11856 - DNA, 22 bp, Artificial Sequence
  Synthetic Construct
tccctctgtcagtctgggtcta

SEQ ID NO: 11857 - DNA, 18 bp, Artificial Sequence
  Synthetic Construct
acgcgcagtccacaaaca

SEQ ID NO: 11858 - DNA, 22 bp, Artificial Sequence
  Synthetic Construct
tgcatattgtccaaggctgctt

SEQ ID NO: 11859 - DNA, 20 bp, Artificial Sequence
  Synthetic Construct
gccctctgcatctagccaat

SEQ ID NO: 11860 - DNA, 22 bp, Artificial Sequence
  Synthetic Construct
tggtccatccaaatcaggcaat

SEQ ID NO: 11861 - DNA, 27 bp, Artificial Sequence
  Synthetic Construct
gccgctcctctttctgttccttaaaaa

SEQ ID NO: 11862 - DNA, 23 bp, Artificial Sequence
  Synthetic Construct
gcaaaccaggcttttcttgcata

SEQ ID NO: 11863 - DNA, 23 bp, Artificial Sequence
  Synthetic Construct
ccatctggctatgtgacggatgt

SEQ ID NO: 11864 - DNA, 26 bp, Artificial Sequence
  Synthetic Construct
cagtaaaggaagctttgcaggtttgt

SEQ ID NO: 11865 - DNA, 23 bp, Artificial Sequence
  Synthetic Construct
ttaaatactcccatgcccggaaa

SEQ ID NO: 11866 - DNA, 23 bp, Artificial Sequence
  Synthetic Construct
ggttgtggagacaaggcttccta

SEQ ID NO: 11867 - DNA, 23 bp, Artificial Sequence
  Synthetic Construct
gctgtctctccctaggtcaggtt

SEQ ID NO: 11868 - DNA, 24 bp, Artificial Sequence
  Synthetic Construct
atgtgttcctgagagtccctttac

SEQ ID NO: 11869 - DNA, 22 bp, Artificial Sequence
  Synthetic Construct
gggacatagcacaggactggat

SEQ ID NO: 11870 - DNA, 26 bp, Artificial Sequence
  Synthetic Construct
cagctctacaaattgttgccatcttc

SEQ ID NO: 11871 - DNA, 21 bp, Artificial Sequence
  Synthetic Construct
ggctctggaagttgccagtca

SEQ ID NO: 11872 - DNA, 24 bp, Artificial Sequence
  Synthetic Construct
ccaagatttggaagagctgaggat

SEQ ID NO: 11873 - DNA, 22 bp, Artificial Sequence
  Synthetic Construct
ggctgaagctgtaatccacaca

SEQ ID NO: 11874 - DNA, 22 bp, Artificial Sequence
  Synthetic Construct
caaccaggatcgccctagaaaa

SEQ ID NO: 11875 - DNA, 22 bp, Artificial Sequence
  Synthetic Construct
aacccagctacggagaggatga

SEQ ID NO: 11876 - DNA, 25 bp, Artificial Sequence
  Synthetic Construct
acccagcttaatggttccaaatagt

SEQ ID NO: 11877 - DNA, 23 bp, Artificial Sequence
  Synthetic Construct
tgctctgctttcttccagtttca

SEQ ID NO: 11878 - DNA, 25 bp, Artificial Sequence
  Synthetic Construct
ccttccaaaagggagggatgttttc

SEQ ID NO: 11879 - DNA, 25 bp, Artificial Sequence
  Synthetic Construct
gcattgaaacacctggtttacttca

SEQ ID NO: 11880 - DNA, 23 bp, Artificial Sequence
  Synthetic Construct
tgcttgacagctctgttgattgt

SEQ ID NO: 11881 - DNA, 25 bp, Artificial Sequence
  Synthetic Construct
gccagctagaaccctatacccagaa

SEQ ID NO: 11882 - DNA, 24 bp, Artificial Sequence
  Synthetic Construct
gtgaaatgtcttgcccttgtcatc

SEQ ID NO: 11883 - DNA, 20 bp, Artificial Sequence
  Synthetic Construct
caccagctacccaagctcaa

SEQ ID NO: 11884 - DNA, 22 bp, Artificial Sequence
  Synthetic Construct
gatgactggaccgcatgtctct

SEQ ID NO: 11885 - DNA, 22 bp, Artificial Sequence
  Synthetic Construct
ctcgttcctgctgtgcttgtag

SEQ ID NO: 11886 - DNA, 22 bp, Artificial Sequence
  Synthetic Construct
tgcctttggtccctcacacaag

SEQ ID NO: 11887 - DNA, 22 bp, Artificial Sequence
  Synthetic Construct
gagaaccacggagagaggaagt

SEQ ID NO: 11888 - DNA, 26 bp, Artificial Sequence
  Synthetic Construct
cccacagttagtacatggcagagttt

SEQ ID NO: 11889 - DNA, 22 bp, Artificial Sequence
  Synthetic Construct
cctgggagccatgtctgaaact

SEQ ID NO: 11890 - DNA, 22 bp, Artificial Sequence
  Synthetic Construct
gggcaccttcacattgctgaga

SEQ ID NO: 11891 - DNA, 24 bp, Artificial Sequence
  Synthetic Construct
ggaccctggtctttagttccgatt

SEQ ID NO: 11892 - DNA, 22 bp, Artificial Sequence
  Synthetic Construct
agcaccaagggctgaaggaaag

SEQ ID NO: 11893 - DNA, 23 bp, Artificial Sequence
  Synthetic Construct
gcaacacagatccactgaagaca

SEQ ID NO: 11894 - DNA, 24 bp, Artificial Sequence
  Synthetic Construct
ggctctccataaccagatgctgta

SEQ ID NO: 11895 - DNA, 20 bp, Artificial Sequence
  Synthetic Construct
ttccactggcccactgtact

SEQ ID NO: 11896 - DNA, 21 bp, Artificial Sequence
  Synthetic Construct
gcccatcagtctcccctgcta

SEQ ID NO: 11897 - DNA, 19 bp, Artificial Sequence
  Synthetic Construct
ccagtcatccggggcactt

SEQ ID NO: 11898 - DNA, 25 bp, Artificial Sequence
  Synthetic Construct
gtggaatccaatcactcagccttca

SEQ ID NO: 11899 - DNA, 24 bp, Artificial Sequence
  Synthetic Construct
cgcccactgctatctctaccattc

SEQ ID NO: 11900 - DNA, 21 bp, Artificial Sequence
  Synthetic Construct
agtgcctggccatctgctgta

SEQ ID NO: 11901 - DNA, 23 bp, Artificial Sequence
  Synthetic Construct
gtgttcatccatcagggccaatg

SEQ ID NO: 11902 - DNA, 21 bp, Artificial Sequence
  Synthetic Construct
gctaaccttggcactgtggat

SEQ ID NO: 11903 - DNA, 22 bp, Artificial Sequence
  Synthetic Construct
gctgtcatccatggtccagaca

SEQ ID NO: 11904 - DNA, 23 bp, Artificial Sequence
  Synthetic Construct
ccatggaagagggagatggaagt

SEQ ID NO: 11905 - DNA, 19 bp, Artificial Sequence
  Synthetic Construct
ccacctcttgggccctttg

SEQ ID NO: 11906 - DNA, 27 bp, Artificial Sequence
  Synthetic Construct
cacagaatatgggctgagaatccaaga

SEQ ID NO: 11907 - DNA, 20 bp, Artificial Sequence
  Synthetic Construct
gagtccccaccagcaagaag

SEQ ID NO: 11908 - DNA, 22 bp, Artificial Sequence
  Synthetic Construct
gtgatgtggctactgcttcact

SEQ ID NO: 11909 - DNA, 20 bp, Artificial Sequence
  Synthetic Construct
gcttccctcttccagtgctt

SEQ ID NO: 11910 - DNA, 23 bp, Artificial Sequence
  Synthetic Construct
ctgcactgtgattctggcatagt

SEQ ID NO: 11911 - DNA, 22 bp, Artificial Sequence
  Synthetic Construct
cccctccactaacggtgcatta

SEQ ID NO: 11912 - DNA, 26 bp, Artificial Sequence
  Synthetic Construct
cagggatgaaagacagagagcatttg

SEQ ID NO: 11913 - DNA, 22 bp, Artificial Sequence
  Synthetic Construct
cccctcgaggctgttttagtga

SEQ ID NO: 11914 - DNA, 20 bp, Artificial Sequence
  Synthetic Construct
ccagtgtcagggccgagtag

SEQ ID NO: 11915 - DNA, 20 bp, Artificial Sequence
  Synthetic Construct
tgctgctttacgcccagtga

SEQ ID NO: 11916 - DNA, 20 bp, Artificial Sequence
  Synthetic Construct
gaccaatggggtgtcagctt

SEQ ID NO: 11917 - DNA, 21 bp, Artificial Sequence
  Synthetic Construct
aggctatgggaggtgggaaca

SEQ ID NO: 11918 - DNA, 25 bp, Artificial Sequence
  Synthetic Construct
ctgtgtatgtgggtctgaagctcaa

SEQ ID NO: 11919 - DNA, 20 bp, Artificial Sequence
  Synthetic Construct
ggggctcagatcccttggtt

SEQ ID NO: 11920 - DNA, 22 bp, Artificial Sequence
  Synthetic Construct
agcatccgtggaggcttttaat

SEQ ID NO: 11921 - DNA, 24 bp, Artificial Sequence
  Synthetic Construct
acgatttctgaagcagtcttggta

SEQ ID NO: 11922 - DNA, 21 bp, Artificial Sequence
  Synthetic Construct
gggcattagctggccttcaca

SEQ ID NO: 11923 - DNA, 21 bp, Artificial Sequence
  Synthetic Construct
tcccacttacaggcccgttct

SEQ ID NO: 11924 - DNA, 23 bp, Artificial Sequence
  Synthetic Construct
tttcagaagtgctggaaccaaga

SEQ ID NO: 11925 - DNA, 22 bp, Artificial Sequence
  Synthetic Construct
catgaaagcactggggttctct

SEQ ID NO: 11926 - DNA, 25 bp, Artificial Sequence
  Synthetic Construct
cgagagaggaagacactggagtgaa

SEQ ID NO: 11927 - DNA, 27 bp, Artificial Sequence
  Synthetic Construct
ccttcctccacactaagtgactggaaa

SEQ ID NO: 11928 - DNA, 19 bp, Artificial Sequence
  Synthetic Construct
cagcccatcctgggcatct

SEQ ID NO: 11929 - DNA, 20 bp, Artificial Sequence
  Synthetic Construct
aggctggcaaatgggctcaa

SEQ ID NO: 11930 - DNA, 18 bp, Artificial Sequence
  Synthetic Construct
gctgagcccagcagtgtt

SEQ ID NO: 11931 - DNA, 24 bp, Artificial Sequence
  Synthetic Construct
cctggctgggctacatcttacctt

SEQ ID NO: 11932 - DNA, 22 bp, Artificial Sequence
  Synthetic Construct
gcatggggacctgagactttct

SEQ ID NO: 11933 - DNA, 21 bp, Artificial Sequence
  Synthetic Construct
gggccgatgagcaagtcagtt

SEQ ID NO: 11934 - DNA, 24 bp, Artificial Sequence
  Synthetic Construct
cctccccgaaaggaaacagagcat

SEQ ID NO: 11935 - DNA, 22 bp, Artificial Sequence
  Synthetic Construct
tggatggtgagaagagccaatg

SEQ ID NO: 11936 - DNA, 20 bp, Artificial Sequence
  Synthetic Construct
gcctggtcaccatccgcttt

SEQ ID NO: 11937 - DNA, 22 bp, Artificial Sequence
  Synthetic Construct
gacactcacaggctcagagaac

SEQ ID NO: 11938 - DNA, 20 bp, Artificial Sequence
  Synthetic Construct
tgagcactcctgggtcaaga

SEQ ID NO: 11939 - DNA, 21 bp, Artificial Sequence
  Synthetic Construct
cttggctcgattggtccaaca

SEQ ID NO: 11940 - DNA, 20 bp, Artificial Sequence
  Synthetic Construct
ccagagcagccaggtcttca

SEQ ID NO: 11941 - DNA, 20 bp, Artificial Sequence
  Synthetic Construct
tctcctcgcccaagatcaga

SEQ ID NO: 11942 - DNA, 24 bp, Artificial Sequence
  Synthetic Construct
cctcagcccaggactcacttttag

SEQ ID NO: 11943 - DNA, 19 bp, Artificial Sequence
  Synthetic Construct
tccatgacgggcagctgta

SEQ ID NO: 11944 - DNA, 22 bp, Artificial Sequence
  Synthetic Construct
caccctgggatcaagtccaagt

SEQ ID NO: 11945 - DNA, 20 bp, Artificial Sequence
  Synthetic Construct
tgcatgctgggacacagaga

SEQ ID NO: 11946 - DNA, 20 bp, Artificial Sequence
  Synthetic Construct
aggggctgctggggcttgta

SEQ ID NO: 11947 - DNA, 22 bp, Artificial Sequence
  Synthetic Construct
gcgctgcctagtgacattggtt

SEQ ID NO: 11948 - DNA, 22 bp, Artificial Sequence
  Synthetic Construct
tggtggtggtccccagtaatgt

SEQ ID NO: 11949 - DNA, 21 bp, Artificial Sequence
  Synthetic Construct
ccctggtgggttttgagtgaa

SEQ ID NO: 11950 - DNA, 21 bp, Artificial Sequence
  Synthetic Construct
cccacttagagccccaggaaa

SEQ ID NO: 11951 - DNA, 20 bp, Artificial Sequence
  Synthetic Construct
cgatcggctttgcaggcttt

SEQ ID NO: 11952 - DNA, 22 bp, Artificial Sequence
  Synthetic Construct
aaccagatcgtgtctccctagt

SEQ ID NO: 11953 - DNA, 21 bp, Artificial Sequence
  Synthetic Construct
ccaacagcgtgaggcttctga

SEQ ID NO: 11954 - DNA, 23 bp, Artificial Sequence
  Synthetic Construct
gcctggaacacactgtactctga

SEQ ID NO: 11955 - DNA, 18 bp, Artificial Sequence
  Synthetic Construct
tcctgcccgtctgctcaa

SEQ ID NO: 11956 - DNA, 24 bp, Artificial Sequence
  Synthetic Construct
tgaaaccagaagctttcacctcat

SEQ ID NO: 11957 - DNA, 22 bp, Artificial Sequence
  Synthetic Construct
agtcagggtgtctcttccatga

SEQ ID NO: 11958 - DNA, 24 bp, Artificial Sequence
  Synthetic Construct
gagcaaaagagctgttccagagaa

SEQ ID NO: 11959 - DNA, 24 bp, Artificial Sequence
  Synthetic Construct
ccttctacacaggatgggatgagt

SEQ ID NO: 11960 - DNA, 21 bp, Artificial Sequence
  Synthetic Construct
tgaagggttcccctccaaagt

SEQ ID NO: 11961 - DNA, 23 bp, Artificial Sequence
  Synthetic Construct
gcctacatgtctatcccctgaag

SEQ ID NO: 11962 - DNA, 21 bp, Artificial Sequence
  Synthetic Construct
gctggaaaccatggcggagtt

SEQ ID NO: 11963 - DNA, 20 bp, Artificial Sequence
  Synthetic Construct
gggccagtacccaggaggaa

SEQ ID NO: 11964 - DNA, 21 bp, Artificial Sequence
  Synthetic Construct
cacagggatgagcaccaccat

SEQ ID NO: 11965 - DNA, 23 bp, Artificial Sequence
  Synthetic Construct
tggcagagttgtcaggatttcaa

SEQ ID NO: 11966 - DNA, 20 bp, Artificial Sequence
  Synthetic Construct
aggcgagtgtcccaagacaa

SEQ ID NO: 11967 - DNA, 24 bp, Artificial Sequence
  Synthetic Construct
gtgaaccagggacatctggacaag

SEQ ID NO: 11968 - DNA, 21 bp, Artificial Sequence
  Synthetic Construct
tcaggcacaggccaggtatag

SEQ ID NO: 11969 - DNA, 21 bp, Artificial Sequence
  Synthetic Construct
ccggacgcagacggaattact

SEQ ID NO: 11970 - DNA, 20 bp, Artificial Sequence
  Synthetic Construct
ggcagtttggggagctgtgt

SEQ ID NO: 11971 - DNA, 20 bp, Artificial Sequence
  Synthetic Construct
ctgacatttgcgggctgttg

SEQ ID NO: 11972 - DNA, 22 bp, Artificial Sequence
  Synthetic Construct
cttcatgggacccaagcctatg

SEQ ID NO: 11973 - DNA, 20 bp, Artificial Sequence
  Synthetic Construct
ctggctggacccttcctgat

SEQ ID NO: 11974 - DNA, 18 bp, Artificial Sequence
  Synthetic Construct
ggcccttggctgtgtgaa

SEQ ID NO: 11975 - DNA, 22 bp, Artificial Sequence
  Synthetic Construct
ttcctcgtggaccctactgtgt

SEQ ID NO: 11976 - DNA, 22 bp, Artificial Sequence
  Synthetic Construct
cgttggctcctaaagtcagcta

SEQ ID NO: 11977 - DNA, 22 bp, Artificial Sequence
  Synthetic Construct
gtgtaagggcggctctaactga

SEQ ID NO: 11978 - DNA, 20 bp, Artificial Sequence
  Synthetic Construct
atcagaggagggcggaccaa

SEQ ID NO: 11979 - DNA, 23 bp, Artificial Sequence
  Synthetic Construct
ggagaccatgggaacccttcaac

SEQ ID NO: 11980 - DNA, 22 bp, Artificial Sequence
  Synthetic Construct
ggtcctgtcgttgaggtagtca

SEQ ID NO: 11981 - DNA, 20 bp, Artificial Sequence
  Synthetic Construct
gggctagcaaacacccaagt

SEQ ID NO: 11982 - DNA, 22 bp, Artificial Sequence
  Synthetic Construct
gccaaatgaacctggccctgta

SEQ ID NO: 11983 - DNA, 21 bp, Artificial Sequence
  Synthetic Construct
gccacaaaggcccactacaga

SEQ ID NO: 11984 - DNA, 22 bp, Artificial Sequence
  Synthetic Construct
gtcttccaggtcagcaatccaa

SEQ ID NO: 11985 - DNA, 23 bp, Artificial Sequence
  Synthetic Construct
catgcccagcaattgtcccttag

SEQ ID NO: 11986 - DNA, 22 bp, Artificial Sequence
  Synthetic Construct
gcagtcttggcagagctttact

SEQ ID NO: 11987 - DNA, 22 bp, Artificial Sequence
  Synthetic Construct
gaagagtcagtggccttgaaga

SEQ ID NO: 11988 - DNA, 25 bp, Artificial Sequence
  Synthetic Construct
gtggtgtatgttgtagtcccagcta

SEQ ID NO: 11989 - DNA, 24 bp, Artificial Sequence
  Synthetic Construct
gtggggtagtggtaaagtaagcat

SEQ ID NO: 11990 - DNA, 22 bp, Artificial Sequence
  Synthetic Construct
gggtccctgctccatctcattt

SEQ ID NO: 11991 - DNA, 20 bp, Artificial Sequence
  Synthetic Construct
agggccctcccgcaattaga

SEQ ID NO: 11992 - DNA, 22 bp, Artificial Sequence
  Synthetic Construct
cctgaggtcttggcccacaata

SEQ ID NO: 11993 - DNA, 20 bp, Artificial Sequence
  Synthetic Construct
ttcagcgggaaccaccatgt

SEQ ID NO: 11994 - DNA, 29 bp, Artificial Sequence
  Synthetic Construct
ctgacttcctagtcttcccttctatgaaa

SEQ ID NO: 11995 - DNA, 23 bp, Artificial Sequence
  Synthetic Construct
ggtttacaggttagggcatggat

SEQ ID NO: 11996 - DNA, 22 bp, Artificial Sequence
  Synthetic Construct
aggaccggaggactgctctatt

SEQ ID NO: 11997 - DNA, 22 bp, Artificial Sequence
  Synthetic Construct
aagggcagcgtatccctctaca

SEQ ID NO: 11998 - DNA, 23 bp, Artificial Sequence
  Synthetic Construct
gtggcccagtttttgctcagaga

SEQ ID NO: 11999 - DNA, 26 bp, Artificial Sequence
  Synthetic Construct
ggtgcaggatttttctcgacctcttt

SEQ ID NO: 12000 - DNA, 22 bp, Artificial Sequence
  Synthetic Construct
tctctgtgtctcctcaccagtt

SEQ ID NO: 12001 - DNA, 22 bp, Artificial Sequence
  Synthetic Construct
ccaactggtccctgcattcttg

SEQ ID NO: 12002 - DNA, 23 bp, Artificial Sequence
  Synthetic Construct
gtgtgaggatcctgcagcattta

SEQ ID NO: 12003 - DNA, 21 bp, Artificial Sequence
  Synthetic Construct
agtccctcagctcagcccata

SEQ ID NO: 12004 - DNA, 23 bp, Artificial Sequence
  Synthetic Construct
gccaaggggtaaccctaaaggta

SEQ ID NO: 12005 - DNA, 20 bp, Artificial Sequence
  Synthetic Construct
ggttggaaggtgacgctaca

SEQ ID NO: 12006 - DNA, 19 bp, Artificial Sequence
  Synthetic Construct
cctgcacttgcccggttct

SEQ ID NO: 12007 - DNA, 23 bp, Artificial Sequence
  Synthetic Construct
gctccaagaagtgcatccaggtt

SEQ ID NO: 12008 - DNA, 21 bp, Artificial Sequence
  Synthetic Construct
gtgctgggtcacactcaaact

SEQ ID NO: 12009 - DNA, 21 bp, Artificial Sequence
  Synthetic Construct
tgtcgtccccactgtggaact

SEQ ID NO: 12010 - DNA, 21 bp, Artificial Sequence
  Synthetic Construct
ccccaggcaactcacttcaca

SEQ ID NO: 12011 - DNA, 20 bp, Artificial Sequence
  Synthetic Construct
agagtagacgcgccctggaa

SEQ ID NO: 12012 - DNA, 21 bp, Artificial Sequence
  Synthetic Construct
gctagcaggacttgggcaaca

SEQ ID NO: 12013 - DNA, 23 bp, Artificial Sequence
  Synthetic Construct
ctgaaccagctcggacagagaag

SEQ ID NO: 12014 - DNA, 22 bp, Artificial Sequence
  Synthetic Construct
caccacgttgatgcagagtttc

SEQ ID NO: 12015 - DNA, 23 bp, Artificial Sequence
  Synthetic Construct
ccaagtgcagaagctggaaaaca

SEQ ID NO: 12016 - DNA, 24 bp, Artificial Sequence
  Synthetic Construct
gaccaggccctttgattgttctgt

SEQ ID NO: 12017 - DNA, 22 bp, Artificial Sequence
  Synthetic Construct
taagtccccgtgctcacagcat

SEQ ID NO: 12018 - DNA, 25 bp, Artificial Sequence
  Synthetic Construct
gctccatcctgtgaatgaagtaagt

SEQ ID NO: 12019 - DNA, 24 bp, Artificial Sequence
  Synthetic Construct
gggatccatcaccgttccaaacat

SEQ ID NO: 12020 - DNA, 19 bp, Artificial Sequence
  Synthetic Construct
ggagagtccagggcgtctt

SEQ ID NO: 12021 - DNA, 22 bp, Artificial Sequence
  Synthetic Construct
cttcacagtgcctgggacattt

SEQ ID NO: 12022 - DNA, 23 bp, Artificial Sequence
  Synthetic Construct
tccaggatggggaaggacctaag

SEQ ID NO: 12023 - DNA, 24 bp, Artificial Sequence
  Synthetic Construct
ctaagctcaaagtcaagggacaga

SEQ ID NO: 12024 - DNA, 25 bp, Artificial Sequence
  Synthetic Construct
gagaagaaagtcgccctgaaaatac

SEQ ID NO: 12025 - DNA, 20 bp, Artificial Sequence
  Synthetic Construct
gtgctttcccacagcgaatc

SEQ ID NO: 12026 - DNA, 20 bp, Artificial Sequence
  Synthetic Construct
ggtgctgcagagggtggaaa

SEQ ID NO: 12027 - DNA, 20 bp, Artificial Sequence
  Synthetic Construct
aactaccctcccacccaaca

SEQ ID NO: 12028 - DNA, 28 bp, Artificial Sequence
  Synthetic Construct
gttgggtggacagtctttttcatctttg

SEQ ID NO: 12029 - DNA, 23 bp, Artificial Sequence
  Synthetic Construct
gtgctctcccttgaaatgaggat

SEQ ID NO: 12030 - DNA, 21 bp, Artificial Sequence
  Synthetic Construct
gatggtggaaaccgaccaact

SEQ ID NO: 12031 - DNA, 18 bp, Artificial Sequence
  Synthetic Construct
tgcagggtggcagcatga

SEQ ID NO: 12032 - DNA, 24 bp, Artificial Sequence
  Synthetic Construct
gccctctgacttcactgacctact

SEQ ID NO: 12033 - DNA, 21 bp, Artificial Sequence
  Synthetic Construct
tggggttgaggtccccttatg

SEQ ID NO: 12034 - DNA, 22 bp, Artificial Sequence
  Synthetic Construct
ccccttcatctgccctggtagt

SEQ ID NO: 12035 - DNA, 22 bp, Artificial Sequence
  Synthetic Construct
cctctgcaccttggcctacatt

SEQ ID NO: 12036 - DNA, 21 bp, Artificial Sequence
  Synthetic Construct
ggcggaaaccaaaccctcaga

SEQ ID NO: 12037 - DNA, 20 bp, Artificial Sequence
  Synthetic Construct
gggcccctcccacatacaca

SEQ ID NO: 12038 - DNA, 22 bp, Artificial Sequence
  Synthetic Construct
gcccatgctgaggactaacctt

SEQ ID NO: 12039 - DNA, 21 bp, Artificial Sequence
  Synthetic Construct
ccctaaggttgggtcgagttg

SEQ ID NO: 12040 - DNA, 21 bp, Artificial Sequence
  Synthetic Construct
cagggtcccaacgggtttcta

SEQ ID NO: 12041 - DNA, 21 bp, Artificial Sequence
  Synthetic Construct
gccccagcattcacactgcat

SEQ ID NO: 12042 - DNA, 21 bp, Artificial Sequence
  Synthetic Construct
gcaagtagctgggccttgtca

SEQ ID NO: 12043 - DNA, 22 bp, Artificial Sequence
  Synthetic Construct
gcaccatcaggagatgcagact

SEQ ID NO: 12044 - DNA, 25 bp, Artificial Sequence
  Synthetic Construct
ctctgtcagtttctgagtgggatga

SEQ ID NO: 12045 - DNA, 21 bp, Artificial Sequence
  Synthetic Construct
gaggcctcactctccccttat

SEQ ID NO: 12046 - DNA, 23 bp, Artificial Sequence
  Synthetic Construct
tcatgctgcttgggtaatgttct

SEQ ID NO: 12047 - DNA, 19 bp, Artificial Sequence
  Synthetic Construct
ctgggccatcctcctgtct

SEQ ID NO: 12048 - DNA, 20 bp, Artificial Sequence
  Synthetic Construct
tggagagtggggaggagctt

SEQ ID NO: 12049 - DNA, 21 bp, Artificial Sequence
  Synthetic Construct
ggagcatgccgccttgttact

SEQ ID NO: 12050 - DNA, 24 bp, Artificial Sequence
  Synthetic Construct
gtctcttccctgaagtagggttgt

SEQ ID NO: 12051 - DNA, 24 bp, Artificial Sequence
  Synthetic Construct
tcactcacatcatcatggttggat

SEQ ID NO: 12052 - DNA, 20 bp, Artificial Sequence
  Synthetic Construct
ggagcagcattgccttcgtt

SEQ ID NO: 12053 - DNA, 20 bp, Artificial Sequence
  Synthetic Construct
gcctcgcatcacgcagtttt

SEQ ID NO: 12054 - DNA, 26 bp, Artificial Sequence
  Synthetic Construct
cccgtttgaagaaatgatagctcgaa

SEQ ID NO: 12055 - DNA, 20 bp, Artificial Sequence
  Synthetic Construct
gggtgctgttctggctttga

SEQ ID NO: 12056 - DNA, 21 bp, Artificial Sequence
  Synthetic Construct
ggctgtggttgttgacagagt

SEQ ID NO: 12057 - DNA, 23 bp, Artificial Sequence
  Synthetic Construct
ccctgtggaacaaagtgggaact

SEQ ID NO: 12058 - DNA, 22 bp, Artificial Sequence
  Synthetic Construct
gcaaaggcttgtctgacagtga

SEQ ID NO: 12059 - DNA, 24 bp, Artificial Sequence
  Synthetic Construct
caagaggaccttcggaaactttga

SEQ ID NO: 12060 - DNA, 20 bp, Artificial Sequence
  Synthetic Construct
aggcacacgcaggtctcatc

SEQ ID NO: 12061 - DNA, 25 bp, Artificial Sequence
  Synthetic Construct
gtgtagaggggcaactcctatcttg

SEQ ID NO: 12062 - DNA, 27 bp, Artificial Sequence
  Synthetic Construct
cagactacaaaggtgtttgctgtttgt

SEQ ID NO: 12063 - DNA, 20 bp, Artificial Sequence
  Synthetic Construct
ctgcgttgtgcctactctgt

SEQ ID NO: 12064 - DNA, 20 bp, Artificial Sequence
  Synthetic Construct
ggtgtccccgcacttagcat

SEQ ID NO: 12065 - DNA, 23 bp, Artificial Sequence
  Synthetic Construct
gtgaagccagacagcagtaatca

SEQ ID NO: 12066 - DNA, 23 bp, Artificial Sequence
  Synthetic Construct
ggagggtgaacaaggcaaagatg

SEQ ID NO: 12067 - DNA, 22 bp, Artificial Sequence
  Synthetic Construct
acctgcaggagctagttagaga

SEQ ID NO: 12068 - DNA, 21 bp, Artificial Sequence
  Synthetic Construct
gctttcagtccccacttgtga

SEQ ID NO: 12069 - DNA, 22 bp, Artificial Sequence
  Synthetic Construct
gtgaggcaggaaggatgagttt

SEQ ID NO: 12070 - DNA, 24 bp, Artificial Sequence
  Synthetic Construct
gagctttggagacagtggggtaac

SEQ ID NO: 12071 - DNA, 22 bp, Artificial Sequence
  Synthetic Construct
ccagcatcaggtcacaatgaac

SEQ ID NO: 12072 - DNA, 20 bp, Artificial Sequence
  Synthetic Construct
actgagggcggcattgctta

SEQ ID NO: 12073 - DNA, 20 bp, Artificial Sequence
  Synthetic Construct
gcggcaaggagggtttctaa

SEQ ID NO: 12074 - DNA, 25 bp, Artificial Sequence
  Synthetic Construct
tcagagttctgtcctaatggaggaa

SEQ ID NO: 12075 - DNA, 26 bp, Artificial Sequence
  Synthetic Construct
cactagtctggaaaaaccagcaccaa

SEQ ID NO: 12076 - DNA, 24 bp, Artificial Sequence
  Synthetic Construct
aatcctggaacactcttgcctaaa

SEQ ID NO: 12077 - DNA, 26 bp, Artificial Sequence
  Synthetic Construct
gtgtgagctagttccttctgctcttc

SEQ ID NO: 12078 - DNA, 22 bp, Artificial Sequence
  Synthetic Construct
caactgcagcgtgctgatttta

SEQ ID NO: 12079 - DNA, 21 bp, Artificial Sequence
  Synthetic Construct
aatcggccacagccccagaga

SEQ ID NO: 12080 - DNA, 24 bp, Artificial Sequence
  Synthetic Construct
ggatcttctgaacaccacatcctt

SEQ ID NO: 12081 - DNA, 22 bp, Artificial Sequence
  Synthetic Construct
atccagttccctgggtgactct

SEQ ID NO: 12082 - DNA, 25 bp, Artificial Sequence
  Synthetic Construct
gttttctccaccaacacacctttct

SEQ ID NO: 12083 - DNA, 21 bp, Artificial Sequence
  Synthetic Construct
aaggggactcggaggacaaga

SEQ ID NO: 12084 - DNA, 22 bp, Artificial Sequence
  Synthetic Construct
gggccaatgtgtcctggtttgt

SEQ ID NO: 12085 - DNA, 21 bp, Artificial Sequence
  Synthetic Construct
tgccatggcctttgcctatac

SEQ ID NO: 12086 - DNA, 24 bp, Artificial Sequence
  Synthetic Construct
gctctcagggaaatcatccatttg

SEQ ID NO: 12087 - DNA, 24 bp, Artificial Sequence
  Synthetic Construct
cctgggatttaccatgtcccataa

SEQ ID NO: 12088 - DNA, 21 bp, Artificial Sequence
  Synthetic Construct
cgtgctccactttcctgacaa

SEQ ID NO: 12089 - DNA, 22 bp, Artificial Sequence
  Synthetic Construct
cagggatgagccgctgtttcta

SEQ ID NO: 12090 - DNA, 21 bp, Artificial Sequence
  Synthetic Construct
agatcttcggggctccagaca

SEQ ID NO: 12091 - DNA, 27 bp, Artificial Sequence
  Synthetic Construct
gcatagtccacagtaggaaaaatgcaa

SEQ ID NO: 12092 - DNA, 21 bp, Artificial Sequence
  Synthetic Construct
ggcagctgcaacagtatgtct

SEQ ID NO: 12093 - DNA, 24 bp, Artificial Sequence
  Synthetic Construct
ggtctgtctgattccagctgatac

SEQ ID NO: 12094 - DNA, 27 bp, Artificial Sequence
  Synthetic Construct
ctcagtgggcttagaataaacctgaat

SEQ ID NO: 12095 - DNA, 20 bp, Artificial Sequence
  Synthetic Construct
ggaggtttggctgggtcttt

SEQ ID NO: 12096 - DNA, 20 bp, Artificial Sequence
  Synthetic Construct
aggcgggtccccaggaaaca

SEQ ID NO: 12097 - DNA, 21 bp, Artificial Sequence
  Synthetic Construct
acaaggggcctgactcagctt

SEQ ID NO: 12098 - DNA, 21 bp, Artificial Sequence
  Synthetic Construct
cctggtgtgctctgccttgaa

SEQ ID NO: 12099 - DNA, 22 bp, Artificial Sequence
  Synthetic Construct
cctcggtggacacttggtcttg

SEQ ID NO: 12100 - DNA, 27 bp, Artificial Sequence
  Synthetic Construct
ggagataggaaaagtcatggagggtaa

SEQ ID NO: 12101 - DNA, 20 bp, Artificial Sequence
  Synthetic Construct
agtctcatggcaggctgctt

SEQ ID NO: 12102 - DNA, 22 bp, Artificial Sequence
  Synthetic Construct
agaacccctgcaccctctttct

SEQ ID NO: 12103 - DNA, 26 bp, Artificial Sequence
  Synthetic Construct
ggccttaattgacaccgctaatcttg

SEQ ID NO: 12104 - DNA, 22 bp, Artificial Sequence
  Synthetic Construct
ggagaggctaaggggaaacaga

SEQ ID NO: 12105 - DNA, 20 bp, Artificial Sequence
  Synthetic Construct
atggtggtggctgtgcgatt

SEQ ID NO: 12106 - DNA, 22 bp, Artificial Sequence
  Synthetic Construct
ttgggtcatagggccgagaatg

SEQ ID NO: 12107 - DNA, 20 bp, Artificial Sequence
  Synthetic Construct
acacgaaagcggcgtcagaa

SEQ ID NO: 12108 - DNA, 22 bp, Artificial Sequence
  Synthetic Construct
tgggcttctgggttctagatgt

SEQ ID NO: 12109 - DNA, 25 bp, Artificial Sequence
  Synthetic Construct
ggaaaccatcccatgtctactgtgt

SEQ ID NO: 12110 - DNA, 22 bp, Artificial Sequence
  Synthetic Construct
tcccacttactacgctccaaga

SEQ ID NO: 12111 - DNA, 21 bp, Artificial Sequence
  Synthetic Construct
tcctgccctagctgtggcttt

SEQ ID NO: 12112 - DNA, 20 bp, Artificial Sequence
  Synthetic Construct
ccgcaaatagccccagaact

SEQ ID NO: 12113 - DNA, 20 bp, Artificial Sequence
  Synthetic Construct
tttggttagcggggctctct

SEQ ID NO: 12114 - DNA, 25 bp, Artificial Sequence
  Synthetic Construct
ccaggataagaatgttggcctcctt

SEQ ID NO: 12115 - DNA, 23 bp, Artificial Sequence
  Synthetic Construct
ctgttgcccgtgggattaaaatg

SEQ ID NO: 12116 - DNA, 22 bp, Artificial Sequence
  Synthetic Construct
tgtgctacctggagagggtttc

SEQ ID NO: 12117 - DNA, 22 bp, Artificial Sequence
  Synthetic Construct
cccttctgcagcatgtgcattt

SEQ ID NO: 12118 - DNA, 25 bp, Artificial Sequence
  Synthetic Construct
gctaggaatgggaacattggcatct

SEQ ID NO: 12119 - DNA, 24 bp, Artificial Sequence
  Synthetic Construct
gtctttacaagcaggccccatttg

SEQ ID NO: 12120 - DNA, 21 bp, Artificial Sequence
  Synthetic Construct
agaccacctgcctaagaccaa

SEQ ID NO: 12121 - DNA, 19 bp, Artificial Sequence
  Synthetic Construct
accccatccccaccagctt

SEQ ID NO: 12122 - DNA, 22 bp, Artificial Sequence
  Synthetic Construct
gattggctcctgtgctctgagt

SEQ ID NO: 12123 - DNA, 22 bp, Artificial Sequence
  Synthetic Construct
cctgcagggaaaacctgcaact

SEQ ID NO: 12124 - DNA, 23 bp, Artificial Sequence
  Synthetic Construct
ctttacagcattgcctcctccta

SEQ ID NO: 12125 - DNA, 21 bp, Artificial Sequence
  Synthetic Construct
ggccactagtctgggacaaag

SEQ ID NO: 12126 - DNA, 26 bp, Artificial Sequence
  Synthetic Construct
gtaatgtcagtgcgtctaggtaaaga

SEQ ID NO: 12127 - DNA, 20 bp, Artificial Sequence
  Synthetic Construct
ggagagggaatgctgcgaat

SEQ ID NO: 12128 - DNA, 19 bp, Artificial Sequence
  Synthetic Construct
ggaggcacagcaggtctga

SEQ ID NO: 12129 - DNA, 23 bp, Artificial Sequence
  Synthetic Construct
ggacaccaacgatgacacaaaat

SEQ ID NO: 12130 - DNA, 19 bp, Artificial Sequence
  Synthetic Construct
agggagccggcatcctttg

SEQ ID NO: 12131 - DNA, 21 bp, Artificial Sequence
  Synthetic Construct
tgccaagaggcttctcagttc

SEQ ID NO: 12132 - DNA, 22 bp, Artificial Sequence
  Synthetic Construct
cctgggcagtaagctagcaatg

SEQ ID NO: 12133 - DNA, 20 bp, Artificial Sequence
  Synthetic Construct
tcacccctcacctgcactct

SEQ ID NO: 12134 - DNA, 23 bp, Artificial Sequence
  Synthetic Construct
gctgagaatccagagactgtgtt

SEQ ID NO: 12135 - DNA, 23 bp, Artificial Sequence
  Synthetic Construct
ccacaccatacaagggatctcaa

SEQ ID NO: 12136 - DNA, 25 bp, Artificial Sequence
  Synthetic Construct
agtggatgagaactatcatggcaaa

SEQ ID NO: 12137 - DNA, 21 bp, Artificial Sequence
  Synthetic Construct
cttgaggcagttccgacttca

SEQ ID NO: 12138 - DNA, 22 bp, Artificial Sequence
  Synthetic Construct
gccaagaacacgtcaggtctca

SEQ ID NO: 12139 - DNA, 25 bp, Artificial Sequence
  Synthetic Construct
tttccactctcccttatttctgcaa

SEQ ID NO: 12140 - DNA, 24 bp, Artificial Sequence
  Synthetic Construct
ccacagatgcaaagagagcacttc

SEQ ID NO: 12141 - DNA, 22 bp, Artificial Sequence
  Synthetic Construct
gggagtgtctgtggtccagaat

SEQ ID NO: 12142 - DNA, 21 bp, Artificial Sequence
  Synthetic Construct
ccaaagctgtttgcggctaga

SEQ ID NO: 12143 - DNA, 19 bp, Artificial Sequence
  Synthetic Construct
gctgcggaggccagaaagt

SEQ ID NO: 12144 - DNA, 23 bp, Artificial Sequence
  Synthetic Construct
ttgtagacaatggggccactaag

SEQ ID NO: 12145 - DNA, 23 bp, Artificial Sequence
  Synthetic Construct
tgtgccagtgtgtaccttcattt

SEQ ID NO: 12146 - DNA, 26 bp, Artificial Sequence
  Synthetic Construct
gggttcaggccagtagaatgacctat

SEQ ID NO: 12147 - DNA, 26 bp, Artificial Sequence
  Synthetic Construct
ttgaggacaatagagaaggtctgttc

SEQ ID NO: 12148 - DNA, 25 bp, Artificial Sequence
  Synthetic Construct
gctggatcctaagacaacactgtat

SEQ ID NO: 12149 - DNA, 20 bp, Artificial Sequence
  Synthetic Construct
aggctggcatgttggagtca

SEQ ID NO: 12150 - DNA, 21 bp, Artificial Sequence
  Synthetic Construct
tgtgagctgttcttgccatgt

SEQ ID NO: 12151 - DNA, 22 bp, Artificial Sequence
  Synthetic Construct
gtgttacctggcgcctgaatgt

SEQ ID NO: 12152 - DNA, 22 bp, Artificial Sequence
  Synthetic Construct
agctaagttttccaggcgatgt

SEQ ID NO: 12153 - DNA, 24 bp, Artificial Sequence
  Synthetic Construct
gtgaaagagccatgataggtctga

SEQ ID NO: 12154 - DNA, 19 bp, Artificial Sequence
  Synthetic Construct
gatgcccgcacctgctaga

SEQ ID NO: 12155 - DNA, 20 bp, Artificial Sequence
  Synthetic Construct
tcgcccttgtggatccaagt

SEQ ID NO: 12156 - DNA, 19 bp, Artificial Sequence
  Synthetic Construct
aggggacgtctcccaggtt

SEQ ID NO: 12157 - DNA, 18 bp, Artificial Sequence
  Synthetic Construct
accctgcatcgggtctca

SEQ ID NO: 12158 - DNA, 21 bp, Artificial Sequence
  Synthetic Construct
gtcctgttcccgcaaggttga

SEQ ID NO: 12159 - DNA, 24 bp, Artificial Sequence
  Synthetic Construct
gtgttgttcctcttcccaaggaat

SEQ ID NO: 12160 - DNA, 24 bp, Artificial Sequence
  Synthetic Construct
gtctcagagattccacagcctaca

SEQ ID NO: 12161 - DNA, 23 bp, Artificial Sequence
  Synthetic Construct
acagatgccagatgcagaagaaa

SEQ ID NO: 12162 - DNA, 24 bp, Artificial Sequence
  Synthetic Construct
ggctctgaggtcatctctgtatca

SEQ ID NO: 12163 - DNA, 20 bp, Artificial Sequence
  Synthetic Construct
caagtccctcccagcaacaa

SEQ ID NO: 12164 - DNA, 22 bp, Artificial Sequence
  Synthetic Construct
cgcctctgtcctctgtcacttt

SEQ ID NO: 12165 - DNA, 20 bp, Artificial Sequence
  Synthetic Construct
ggataccaaccccgccagaa

SEQ ID NO: 12166 - DNA, 25 bp, Artificial Sequence
  Synthetic Construct
ccatcatctggttatgctacagtct

SEQ ID NO: 12167 - DNA, 24 bp, Artificial Sequence
  Synthetic Construct
cttgatgactccacttctccatca

SEQ ID NO: 12168 - DNA, 22 bp, Artificial Sequence
  Synthetic Construct
gccaaggagtgaaccaggtttg

SEQ ID NO: 12169 - DNA, 22 bp, Artificial Sequence
  Synthetic Construct
cgacctgtgttaggggttcagt

SEQ ID NO: 12170 - DNA, 19 bp, Artificial Sequence
  Synthetic Construct
gtggcccagaaggctgctt

SEQ ID NO: 12171 - DNA, 25 bp, Artificial Sequence
  Synthetic Construct
cacaggaggtcattaaggttcaaca

SEQ ID NO: 12172 - DNA, 24 bp, Artificial Sequence
  Synthetic Construct
gcagacattgtatgtcggtgaaca

SEQ ID NO: 12173 - DNA, 18 bp, Artificial Sequence
  Synthetic Construct
tgggttcgcacggctgtt

SEQ ID NO: 12174 - DNA, 22 bp, Artificial Sequence
  Synthetic Construct
accaccacacctagctgcaaag

SEQ ID NO: 12175 - DNA, 19 bp, Artificial Sequence
  Synthetic Construct
tgtccctggggccactgaa

SEQ ID NO: 12176 - DNA, 22 bp, Artificial Sequence
  Synthetic Construct
gtggggtaacagccacaggtat

SEQ ID NO: 12177 - DNA, 22 bp, Artificial Sequence
  Synthetic Construct
ctgccggagactatgctcagta

SEQ ID NO: 12178 - DNA, 22 bp, Artificial Sequence
  Synthetic Construct
gtcacccaggccatgtgaactt

SEQ ID NO: 12179 - DNA, 22 bp, Artificial Sequence
  Synthetic Construct
gggccatgtcattgctctgtag

SEQ ID NO: 12180 - DNA, 23 bp, Artificial Sequence
  Synthetic Construct
ccccaagatgtctgccatagttc

SEQ ID NO: 12181 - DNA, 29 bp, Artificial Sequence
  Synthetic Construct
gcagttggtaaaggcaaagcttaacgaaa

SEQ ID NO: 12182 - DNA, 21 bp, Artificial Sequence
  Synthetic Construct
agactaggcagggtacacaca

SEQ ID NO: 12183 - DNA, 27 bp, Artificial Sequence
  Synthetic Construct
gtgagcacaaatttggatcgagtgaga

SEQ ID NO: 12184 - DNA, 23 bp, Artificial Sequence
  Synthetic Construct
gagtggctagctctcaagacaca

SEQ ID NO: 12185 - DNA, 23 bp, Artificial Sequence
  Synthetic Construct
gtgtgggaaggaggattccatgt

SEQ ID NO: 12186 - DNA, 22 bp, Artificial Sequence
  Synthetic Construct
atggtaggtcagacccagaagt

SEQ ID NO: 12187 - DNA, 25 bp, Artificial Sequence
  Synthetic Construct
cgtccaggagacagttaacctcttg

SEQ ID NO: 12188 - DNA, 23 bp, Artificial Sequence
  Synthetic Construct
ttccaagagcattcaggtgtctt

SEQ ID NO: 12189 - DNA, 23 bp, Artificial Sequence
  Synthetic Construct
agcagctcaaactatgccaaaga

SEQ ID NO: 12190 - DNA, 21 bp, Artificial Sequence
  Synthetic Construct
agtgccagagcccgctagaaa

SEQ ID NO: 12191 - DNA, 22 bp, Artificial Sequence
  Synthetic Construct
acccctgtgcctaagctgaagt

SEQ ID NO: 12192 - DNA, 20 bp, Artificial Sequence
  Synthetic Construct
ctgtgctggctgctgtttca

SEQ ID NO: 12193 - DNA, 21 bp, Artificial Sequence
  Synthetic Construct
gatgggtgttgcaaggcaaag

SEQ ID NO: 12194 - DNA, 25 bp, Artificial Sequence
  Synthetic Construct
ggcccatttaccctttctatcatgt

SEQ ID NO: 12195 - DNA, 23 bp, Artificial Sequence
  Synthetic Construct
caagtggattgtgggtggacact

SEQ ID NO: 12196 - DNA, 23 bp, Artificial Sequence
  Synthetic Construct
tgtgtgacattcctggtgctaaa

SEQ ID NO: 12197 - DNA, 20 bp, Artificial Sequence
  Synthetic Construct
aggcaggcgatgagccaaat

SEQ ID NO: 12198 - DNA, 24 bp, Artificial Sequence
  Synthetic Construct
gttccaatcacaggacaggggtat

SEQ ID NO: 12199 - DNA, 21 bp, Artificial Sequence
  Synthetic Construct
ggagatgcaatcggcccataa

SEQ ID NO: 12200 - DNA, 20 bp, Artificial Sequence
  Synthetic Construct
tgttggccaggggttaggtt

SEQ ID NO: 12201 - DNA, 22 bp, Artificial Sequence
  Synthetic Construct
gtcatggggacctggattgcta

SEQ ID NO: 12202 - DNA, 22 bp, Artificial Sequence
  Synthetic Construct
gccacatggacacctcacactt

SEQ ID NO: 12203 - DNA, 28 bp, Artificial Sequence
  Synthetic Construct
ggttttcctatcggtgtttgaggtctac

SEQ ID NO: 12204 - DNA, 24 bp, Artificial Sequence
  Synthetic Construct
cagggtgataagtccacagcattc

SEQ ID NO: 12205 - DNA, 20 bp, Artificial Sequence
  Synthetic Construct
cagcacccagagagcagctt

SEQ ID NO: 12206 - DNA, 19 bp, Artificial Sequence
  Synthetic Construct
gcgcaggcgcagcattatt

SEQ ID NO: 12207 - DNA, 20 bp, Artificial Sequence
  Synthetic Construct
cacgacaccacacgcattca

SEQ ID NO: 12208 - DNA, 22 bp, Artificial Sequence
  Synthetic Construct
tcccatcagcaccagtggaaac

SEQ ID NO: 12209 - DNA, 26 bp, Artificial Sequence
  Synthetic Construct
gggagatcatacacagagaggaggtt

SEQ ID NO: 12210 - DNA, 25 bp, Artificial Sequence
  Synthetic Construct
tcaggctaaagacattgctgtagaa

SEQ ID NO: 12211 - DNA, 22 bp, Artificial Sequence
  Synthetic Construct
ccctgctcttccatgctgctaa

SEQ ID NO: 12212 - DNA, 23 bp, Artificial Sequence
  Synthetic Construct
cctaggagggtaaaggcggagtt

SEQ ID NO: 12213 - DNA, 20 bp, Artificial Sequence
  Synthetic Construct
ttgccagctctgccctgcta

SEQ ID NO: 12214 - DNA, 22 bp, Artificial Sequence
  Synthetic Construct
gcaccaggagtgtgctgaagtt

SEQ ID NO: 12215 - DNA, 26 bp, Artificial Sequence
  Synthetic Construct
gtctctgacaatacattcagccacta

SEQ ID NO: 12216 - DNA, 20 bp, Artificial Sequence
  Synthetic Construct
aaggctcgcctgagggtgaa

SEQ ID NO: 12217 - DNA, 24 bp, Artificial Sequence
  Synthetic Construct
cgtgattaagtacggctgcctgtt

SEQ ID NO: 12218 - DNA, 24 bp, Artificial Sequence
  Synthetic Construct
gaccacagaaattggaaggagcta

SEQ ID NO: 12219 - DNA, 20 bp, Artificial Sequence
  Synthetic Construct
ggcagcttcccttcgctctt

SEQ ID NO: 12220 - DNA, 24 bp, Artificial Sequence
  Synthetic Construct
gcctgctgttgggtgaattactgt

SEQ ID NO: 12221 - DNA, 20 bp, Artificial Sequence
  Synthetic Construct
gtgatgctgctacggaggaa

SEQ ID NO: 12222 - DNA, 19 bp, Artificial Sequence
  Synthetic Construct
cccgcaatgcccagtgaca

SEQ ID NO: 12223 - DNA, 22 bp, Artificial Sequence
  Synthetic Construct
aggggctgagtgctttttcttc

SEQ ID NO: 12224 - DNA, 22 bp, Artificial Sequence
  Synthetic Construct
gcatcagagcagtgggcttaca

SEQ ID NO: 12225 - DNA, 19 bp, Artificial Sequence
  Synthetic Construct
tggagggagggagctgttc

SEQ ID NO: 12226 - DNA, 21 bp, Artificial Sequence
  Synthetic Construct
tgggagggccagagactcatt

SEQ ID NO: 12227 - DNA, 23 bp, Artificial Sequence
  Synthetic Construct
gaagaaagccaggcctccaaaac

SEQ ID NO: 12228 - DNA, 19 bp, Artificial Sequence
  Synthetic Construct
acagttggggcaagcacat

SEQ ID NO: 12229 - DNA, 19 bp, Artificial Sequence
  Synthetic Construct
tgcaacgcgagggtgagtt

SEQ ID NO: 12230 - DNA, 22 bp, Artificial Sequence
  Synthetic Construct
ggagagatgcgtccatcacaga

SEQ ID NO: 12231 - DNA, 20 bp, Artificial Sequence
  Synthetic Construct
ggatggcttcaggcagttga

SEQ ID NO: 12232 - DNA, 20 bp, Artificial Sequence
  Synthetic Construct
cacttctggggcacttgtgt

SEQ ID NO: 12233 - DNA, 25 bp, Artificial Sequence
  Synthetic Construct
ctcttgcaaatcgaggaacgagaga

SEQ ID NO: 12234 - DNA, 21 bp, Artificial Sequence
  Synthetic Construct
accttcagggccaccagtgtt

SEQ ID NO: 12235 - DNA, 22 bp, Artificial Sequence
  Synthetic Construct
tgcactcactcagggcagaagt

SEQ ID NO: 12236 - DNA, 21 bp, Artificial Sequence
  Synthetic Construct
gcagtgcgtgttcttgcatca

SEQ ID NO: 12237 - DNA, 21 bp, Artificial Sequence
  Synthetic Construct
tcaggcagggctcagaactgt

SEQ ID NO: 12238 - DNA, 20 bp, Artificial Sequence
  Synthetic Construct
tcctctgccttcagcactgt

SEQ ID NO: 12239 - DNA, 22 bp, Artificial Sequence
  Synthetic Construct
ggagaagactgcggaacacaca

SEQ ID NO: 12240 - DNA, 28 bp, Artificial Sequence
  Synthetic Construct
cacccctaagtttgagatctgttgattc

SEQ ID NO: 12241 - DNA, 22 bp, Artificial Sequence
  Synthetic Construct
tgccccttccaatcctgtgtga

SEQ ID NO: 12242 - DNA, 27 bp, Artificial Sequence
  Synthetic Construct
gccacaggggatgaataaaaagcagta

SEQ ID NO: 12243 - DNA, 24 bp, Artificial Sequence
  Synthetic Construct
caaagatgggtcaagttcctctca

SEQ ID NO: 12244 - DNA, 19 bp, Artificial Sequence
  Synthetic Construct
ggtgggcccagaacaaact

SEQ ID NO: 12245 - DNA, 20 bp, Artificial Sequence
  Synthetic Construct
aaggctgccctggtcaaaca

SEQ ID NO: 12246 - DNA, 23 bp, Artificial Sequence
  Synthetic Construct
gttttaggacagccagtcgagaa

SEQ ID NO: 12247 - DNA, 25 bp, Artificial Sequence
  Synthetic Construct
acagttgaagtccaggcttatttga

SEQ ID NO: 12248 - DNA, 23 bp, Artificial Sequence
  Synthetic Construct
cagtggacccagatggtgacttc

SEQ ID NO: 12249 - DNA, 23 bp, Artificial Sequence
  Synthetic Construct
tgctttagggagcatggagtaca

SEQ ID NO: 12250 - DNA, 23 bp, Artificial Sequence
  Synthetic Construct
cctcagtcttagcctgggctctt

SEQ ID NO: 12251 - DNA, 20 bp, Artificial Sequence
  Synthetic Construct
acagacccaggacgctgaag

SEQ ID NO: 12252 - DNA, 22 bp, Artificial Sequence
  Synthetic Construct
cgaggggctttgtaccagtgtt

SEQ ID NO: 12253 - DNA, 21 bp, Artificial Sequence
  Synthetic Construct
ccatctggagcaggggagaag

SEQ ID NO: 12254 - DNA, 26 bp, Artificial Sequence
  Synthetic Construct
ggttaccccattccatcttctctgta

SEQ ID NO: 12255 - DNA, 19 bp, Artificial Sequence
  Synthetic Construct
gggagagagctggcgttca

SEQ ID NO: 12256 - DNA, 22 bp, Artificial Sequence
  Synthetic Construct
cctgcatgtctctggtctcttg

SEQ ID NO: 12257 - DNA, 24 bp, Artificial Sequence
  Synthetic Construct
ccgcacaacttactattgctgttg

SEQ ID NO: 12258 - DNA, 26 bp, Artificial Sequence
  Synthetic Construct
aggagtgaatcaaaggatggaagtag

SEQ ID NO: 12259 - DNA, 24 bp, Artificial Sequence
  Synthetic Construct
gtcttctgcaggggtgaaaacagt

SEQ ID NO: 12260 - DNA, 20 bp, Artificial Sequence
  Synthetic Construct
aggccctgaagttgctggaa

SEQ ID NO: 12261 - DNA, 26 bp, Artificial Sequence
  Synthetic Construct
gtgagtaagtcaacagtgatgaggaa

SEQ ID NO: 12262 - DNA, 21 bp, Artificial Sequence
  Synthetic Construct
ccagcacagaaccgacacgtt

SEQ ID NO: 12263 - DNA, 20 bp, Artificial Sequence
  Synthetic Construct
agctgccgcatcttgctttc

SEQ ID NO: 12264 - DNA, 22 bp, Artificial Sequence
  Synthetic Construct
gatggtcccaaggagccaatgt

SEQ ID NO: 12265 - DNA, 24 bp, Artificial Sequence
  Synthetic Construct
cgtgcagacctcacattactcttg

SEQ ID NO: 12266 - DNA, 22 bp, Artificial Sequence
  Synthetic Construct
gcctgagtgtccatgaacttgt

SEQ ID NO: 12267 - DNA, 24 bp, Artificial Sequence
  Synthetic Construct
tggatagctacatgcttgcttctt

SEQ ID NO: 12268 - DNA, 22 bp, Artificial Sequence
  Synthetic Construct
cggagccactttactcccacaa

SEQ ID NO: 12269 - DNA, 24 bp, Artificial Sequence
  Synthetic Construct
cttagcaaagagccttctgactgt

SEQ ID NO: 12270 - DNA, 22 bp, Artificial Sequence
  Synthetic Construct
acaagggaaagctgagggttct

SEQ ID NO: 12271 - DNA, 23 bp, Artificial Sequence
  Synthetic Construct
caaagcaccaatcctctgtgtga

SEQ ID NO: 12272 - DNA, 24 bp, Artificial Sequence
  Synthetic Construct
gggcaaaagaatactctggtcagt

SEQ ID NO: 12273 - DNA, 20 bp, Artificial Sequence
  Synthetic Construct
cacttcccaccctccctaca

SEQ ID NO: 12274 - DNA, 21 bp, Artificial Sequence
  Synthetic Construct
gcactttgcgtggactgtttc

SEQ ID NO: 12275 - DNA, 23 bp, Artificial Sequence
  Synthetic Construct
ctccgccacaaactgaaatctct

SEQ ID NO: 12276 - DNA, 20 bp, Artificial Sequence
  Synthetic Construct
tgggcaagagtgtggagtca

SEQ ID NO: 12277 - DNA, 26 bp, Artificial Sequence
  Synthetic Construct
ccgaaatcattgaacgagcaggctat

SEQ ID NO: 12278 - DNA, 23 bp, Artificial Sequence
  Synthetic Construct
ccacctaagccctaggatcatct

SEQ ID NO: 12279 - DNA, 20 bp, Artificial Sequence
  Synthetic Construct
cagcaggaaggggtgagttc

SEQ ID NO: 12280 - DNA, 22 bp, Artificial Sequence
  Synthetic Construct
cgcctggagcctcaaattggtt

SEQ ID NO: 12281 - DNA, 25 bp, Artificial Sequence
  Synthetic Construct
gtctggaaccaacagaattgtcact

SEQ ID NO: 12282 - DNA, 22 bp, Artificial Sequence
  Synthetic Construct
caagaccctggacgctcaagaa

SEQ ID NO: 12283 - DNA, 23 bp, Artificial Sequence
  Synthetic Construct
gtcagcaaaggaaggagtaccat

SEQ ID NO: 12284 - DNA, 23 bp, Artificial Sequence
  Synthetic Construct
cagaagtcattgctgaggaggaa

SEQ ID NO: 12285 - DNA, 24 bp, Artificial Sequence
  Synthetic Construct
ctggagaaagatgcagtcgaccat

SEQ ID NO: 12286 - DNA, 25 bp, Artificial Sequence
  Synthetic Construct
agctctacttcacagaaaggagttg

SEQ ID NO: 12287 - DNA, 19 bp, Artificial Sequence
  Synthetic Construct
cctgctcctgtggccctta

SEQ ID NO: 12288 - DNA, 22 bp, Artificial Sequence
  Synthetic Construct
ccagccttgcttccccttcaat

SEQ ID NO: 12289 - DNA, 22 bp, Artificial Sequence
  Synthetic Construct
ggggcagggaatacaggaattt

SEQ ID NO: 12290 - DNA, 25 bp, Artificial Sequence
  Synthetic Construct
gaaatactcacaatgccctcagcat

SEQ ID NO: 12291 - DNA, 24 bp, Artificial Sequence
  Synthetic Construct
gtgaggtgtggaaacgaaggtttg

SEQ ID NO: 12292 - DNA, 21 bp, Artificial Sequence
  Synthetic Construct
ttgattgagcgggagcaaaga

SEQ ID NO: 12293 - DNA, 27 bp, Artificial Sequence
  Synthetic Construct
caacccgaagaatctttgttcctcaag

SEQ ID NO: 12294 - DNA, 25 bp, Artificial Sequence
  Synthetic Construct
ggcatgggaataaatgccaggtgaa

SEQ ID NO: 12295 - DNA, 25 bp, Artificial Sequence
  Synthetic Construct
ggagacttggagggtaaaggcaact

SEQ ID NO: 12296 - DNA, 26 bp, Artificial Sequence
  Synthetic Construct
gcagttttgaaggcctagttatgttc

SEQ ID NO: 12297 - DNA, 22 bp, Artificial Sequence
  Synthetic Construct
gcaaggtctgagtggagaggat

SEQ ID NO: 12298 - DNA, 23 bp, Artificial Sequence
  Synthetic Construct
attgcagctccaggctccgagat

SEQ ID NO: 12299 - DNA, 22 bp, Artificial Sequence
  Synthetic Construct
cagccctctcctgttcagtgtt

SEQ ID NO: 12300 - DNA, 22 bp, Artificial Sequence
  Synthetic Construct
cgagggtcgttggcacttcaat

SEQ ID NO: 12301 - DNA, 22 bp, Artificial Sequence
  Synthetic Construct
tgggaaagagcgagatccaaaa

SEQ ID NO: 12302 - DNA, 20 bp, Artificial Sequence
  Synthetic Construct
tctgcccagccgatggagta

SEQ ID NO: 12303 - DNA, 23 bp, Artificial Sequence
  Synthetic Construct
gtcagtccctctgttctctgtca

SEQ ID NO: 12304 - DNA, 24 bp, Artificial Sequence
  Synthetic Construct
tgacacaagaatcaggttggttga

SEQ ID NO: 12305 - DNA, 23 bp, Artificial Sequence
  Synthetic Construct
tttattggctaccccaggtccta

SEQ ID NO: 12306 - DNA, 24 bp, Artificial Sequence
  Synthetic Construct
gatgtcttccctgaacagtcagaa

SEQ ID NO: 12307 - DNA, 21 bp, Artificial Sequence
  Synthetic Construct
gctgggctggttagggaaaca

SEQ ID NO: 12308 - DNA, 24 bp, Artificial Sequence
  Synthetic Construct
caacactgtgctgtatgggaaaat

SEQ ID NO: 12309 - DNA, 21 bp, Artificial Sequence
  Synthetic Construct
caacccaggaagacacaccaa

SEQ ID NO: 12310 - DNA, 24 bp, Artificial Sequence
  Synthetic Construct
agaaggtagttcacctgaccgtta

SEQ ID NO: 12311 - DNA, 24 bp, Artificial Sequence
  Synthetic Construct
gggctggcacatatgtagtagaag

SEQ ID NO: 12312 - DNA, 22 bp, Artificial Sequence
  Synthetic Construct
ggcgacaacattgccaggatct

SEQ ID NO: 12313 - DNA, 25 bp, Artificial Sequence
  Synthetic Construct
ctcagctcaggtatttgtgctgtta

SEQ ID NO: 12314 - DNA, 24 bp, Artificial Sequence
  Synthetic Construct
gctgcactgcatacatacatggaa

SEQ ID NO: 12315 - DNA, 22 bp, Artificial Sequence
  Synthetic Construct
ggcaaagtgatggtggcagctt

SEQ ID NO: 12316 - DNA, 23 bp, Artificial Sequence
  Synthetic Construct
ggaaatctgagcatgtggagtga

SEQ ID NO: 12317 - DNA, 24 bp, Artificial Sequence
  Synthetic Construct
cgatacccaggtaccatgttgaga

SEQ ID NO: 12318 - DNA, 22 bp, Artificial Sequence
  Synthetic Construct
ggaaggccatttggcaagaatc

SEQ ID NO: 12319 - DNA, 24 bp, Artificial Sequence
  Synthetic Construct
cttggtctgtccccaggttgttag

SEQ ID NO: 12320 - DNA, 25 bp, Artificial Sequence
  Synthetic Construct
tcgagagaaagatggggtagaaagt

SEQ ID NO: 12321 - DNA, 24 bp, Artificial Sequence
  Synthetic Construct
ccctgcctaacccaacatctgtgt

SEQ ID NO: 12322 - DNA, 21 bp, Artificial Sequence
  Synthetic Construct
gtggaaaaggcgtcagactgt

SEQ ID NO: 12323 - DNA, 21 bp, Artificial Sequence
  Synthetic Construct
cctgcgagttcctggagcaat

SEQ ID NO: 12324 - DNA, 20 bp, Artificial Sequence
  Synthetic Construct
ggactaggtggttggtgcaa

SEQ ID NO: 12325 - DNA, 23 bp, Artificial Sequence
  Synthetic Construct
agggcttttcatgtgagtgttgt

SEQ ID NO: 12326 - DNA, 22 bp, Artificial Sequence
  Synthetic Construct
agcatctggctcccaagtgcta

SEQ ID NO: 12327 - DNA, 24 bp, Artificial Sequence
  Synthetic Construct
ggcaagagacgaagtggaagcatt

SEQ ID NO: 12328 - DNA, 27 bp, Artificial Sequence
  Synthetic Construct
gcaagctgggtgaagttatcttgtttc

SEQ ID NO: 12329 - DNA, 21 bp, Artificial Sequence
  Synthetic Construct
gccagttgagggaagccatct

SEQ ID NO: 12330 - DNA, 20 bp, Artificial Sequence
  Synthetic Construct
gcctccttagtgggcaggtt

SEQ ID NO: 12331 - DNA, 26 bp, Artificial Sequence
  Synthetic Construct
cggaaacaaaacaactcttcccagat

SEQ ID NO: 12332 - DNA, 19 bp, Artificial Sequence
  Synthetic Construct
tgagccttgctggctgtca

SEQ ID NO: 12333 - DNA, 22 bp, Artificial Sequence
  Synthetic Construct
tgggaggcatagtccctgtgat

SEQ ID NO: 12334 - DNA, 22 bp, Artificial Sequence
  Synthetic Construct
ttctgtggggcacttgtacttt

SEQ ID NO: 12335 - DNA, 26 bp, Artificial Sequence
  Synthetic Construct
caaaggaggttcaaagaccagtttgt

SEQ ID NO: 12336 - DNA, 26 bp, Artificial Sequence
  Synthetic Construct
ccttagtcctactttttcccttgcat

SEQ ID NO: 12337 - DNA, 21 bp, Artificial Sequence
  Synthetic Construct
gaccttgcaagaacggagtca

SEQ ID NO: 12338 - DNA, 23 bp, Artificial Sequence
  Synthetic Construct
gactgccatctggcattgagaac

SEQ ID NO: 12339 - DNA, 19 bp, Artificial Sequence
  Synthetic Construct
agccgctcctgctttttga

SEQ ID NO: 12340 - DNA, 25 bp, Artificial Sequence
  Synthetic Construct
gccaaaagtgcagagttatttcagt

SEQ ID NO: 12341 - DNA, 19 bp, Artificial Sequence
  Synthetic Construct
tattggccgccagcactgt

SEQ ID NO: 12342 - DNA, 22 bp, Artificial Sequence
  Synthetic Construct
gagcgcctagtcagtactttgt

SEQ ID NO: 12343 - DNA, 21 bp, Artificial Sequence
  Synthetic Construct
gaagccaagttggtggaggat

SEQ ID NO: 12344 - DNA, 24 bp, Artificial Sequence
  Synthetic Construct
gagaagggagagatgcatgggttt

SEQ ID NO: 12345 - DNA, 21 bp, Artificial Sequence
  Synthetic Construct
ggccacccctgtgcatcttta

SEQ ID NO: 12346 - DNA, 21 bp, Artificial Sequence
  Synthetic Construct
tgaatggtggccgaattgtgt

SEQ ID NO: 12347 - DNA, 27 bp, Artificial Sequence
  Synthetic Construct
gccctttctggaggtacttgagcttat

SEQ ID NO: 12348 - DNA, 22 bp, Artificial Sequence
  Synthetic Construct
gcagtctccagtgctgttcttc

SEQ ID NO: 12349 - DNA, 22 bp, Artificial Sequence
  Synthetic Construct
cttcacccacagccagaaatgt

SEQ ID NO: 12350 - DNA, 25 bp, Artificial Sequence
  Synthetic Construct
ctggcttggaacagaaaccatgact

SEQ ID NO: 12351 - DNA, 20 bp, Artificial Sequence
  Synthetic Construct
aaggcttgagacgtgcttgt

SEQ ID NO: 12352 - DNA, 18 bp, Artificial Sequence
  Synthetic Construct
gctgcagtgagccacgat

SEQ ID NO: 12353 - DNA, 20 bp, Artificial Sequence
  Synthetic Construct
tggctggagcagagtgaaca

SEQ ID NO: 12354 - DNA, 22 bp, Artificial Sequence
  Synthetic Construct
ccgccatcaggggttgatgtaa

SEQ ID NO: 12355 - DNA, 20 bp, Artificial Sequence
  Synthetic Construct
agggatcagggccatcttca

SEQ ID NO: 12356 - DNA, 21 bp, Artificial Sequence
  Synthetic Construct
agtcagcaggctggaaaaact

SEQ ID NO: 12357 - DNA, 22 bp, Artificial Sequence
  Synthetic Construct
ctgtgcaggaagcaaggtagat

SEQ ID NO: 12358 - DNA, 25 bp, Artificial Sequence
  Synthetic Construct
tgagtcaaggtgatacttgcttctt

SEQ ID NO: 12359 - DNA, 26 bp, Artificial Sequence
  Synthetic Construct
acctataacaaaggggaagtcaggat

SEQ ID NO: 12360 - DNA, 22 bp, Artificial Sequence
  Synthetic Construct
accttccccaccatgttctaca

SEQ ID NO: 12361 - DNA, 24 bp, Artificial Sequence
  Synthetic Construct
cacatgcccagtaaatggaacaaa

SEQ ID NO: 12362 - DNA, 22 bp, Artificial Sequence
  Synthetic Construct
cacctggaagctgaagccaaag

SEQ ID NO: 12363 - DNA, 20 bp, Artificial Sequence
  Synthetic Construct
agtgggcgagcgccccttat

SEQ ID NO: 12364 - DNA, 19 bp, Artificial Sequence
  Synthetic Construct
agccctgctgcgtggacaa

SEQ ID NO: 12365 - DNA, 25 bp, Artificial Sequence
  Synthetic Construct
cttgggaaactaagtgagggcaaag

SEQ ID NO: 12366 - DNA, 22 bp, Artificial Sequence
  Synthetic Construct
gcagcttttcctggtgtctttc

SEQ ID NO: 12367 - DNA, 25 bp, Artificial Sequence
  Synthetic Construct
ggggtggttaagtatgggctagcaa

SEQ ID NO: 12368 - DNA, 25 bp, Artificial Sequence
  Synthetic Construct
agtgagcatacagcttctcagaaat

SEQ ID NO: 12369 - DNA, 25 bp, Artificial Sequence
  Synthetic Construct
ggatctaagcagtgcatctctgtgt

SEQ ID NO: 12370 - DNA, 21 bp, Artificial Sequence
  Synthetic Construct
ggtgactgtgcacgcgttaat

SEQ ID NO: 12371 - DNA, 22 bp, Artificial Sequence
  Synthetic Construct
gctcaagtactccctggcttct

SEQ ID NO: 12372 - DNA, 27 bp, Artificial Sequence
  Synthetic Construct
caggatcttctttgtttgaaggagctt

SEQ ID NO: 12373 - DNA, 21 bp, Artificial Sequence
  Synthetic Construct
ggcagacaaatcagcccagtt

SEQ ID NO: 12374 - DNA, 21 bp, Artificial Sequence
  Synthetic Construct
gtcattgaactgcgcttgcat

SEQ ID NO: 12375 - DNA, 24 bp, Artificial Sequence
  Synthetic Construct
gggactacagataagcaccactgt

SEQ ID NO: 12376 - DNA, 22 bp, Artificial Sequence
  Synthetic Construct
caaagaggccctcatgctcagt

SEQ ID NO: 12377 - DNA, 22 bp, Artificial Sequence
  Synthetic Construct
ttggtcctacaaccaagcaagt

SEQ ID NO: 12378 - DNA, 25 bp, Artificial Sequence
  Synthetic Construct
gccagagatgaatggtttgcgaatg

SEQ ID NO: 12379 - DNA, 24 bp, Artificial Sequence
  Synthetic Construct
cctgtgctatagaatcagcactct

SEQ ID NO: 12380 - DNA, 22 bp, Artificial Sequence
  Synthetic Construct
tgtgtgttgtggagagggagat

SEQ ID NO: 12381 - DNA, 26 bp, Artificial Sequence
  Synthetic Construct
gaagctccttacattagtgccaggtt

SEQ ID NO: 12382 - DNA, 25 bp, Artificial Sequence
  Synthetic Construct
tgcactcagaggagaagttaaaaca

SEQ ID NO: 12383 - DNA, 27 bp, Artificial Sequence
  Synthetic Construct
ggatcaaagttcaaggagttagtgtga

SEQ ID NO: 12384 - DNA, 22 bp, Artificial Sequence
  Synthetic Construct
cgccaccagcatttgagtcttg

SEQ ID NO: 12385 - DNA, 19 bp, Artificial Sequence
  Synthetic Construct
ccggccaagaaggtagcaa

SEQ ID NO: 12386 - DNA, 21 bp, Artificial Sequence
  Synthetic Construct
gggctttctggccgagatgaa

SEQ ID NO: 12387 - DNA, 20 bp, Artificial Sequence
  Synthetic Construct
gccacaggttggaggcaaga

SEQ ID NO: 12388 - DNA, 21 bp, Artificial Sequence
  Synthetic Construct
agtgccctgctcaaccaatac

SEQ ID NO: 12389 - DNA, 24 bp, Artificial Sequence
  Synthetic Construct
tccctcttgtttccaggtttttgt

SEQ ID NO: 12390 - DNA, 20 bp, Artificial Sequence
  Synthetic Construct
ggaggctccatccacagtca

SEQ ID NO: 12391 - DNA, 24 bp, Artificial Sequence
  Synthetic Construct
gggcaaatctgtgtcctccagata

SEQ ID NO: 12392 - DNA, 24 bp, Artificial Sequence
  Synthetic Construct
gggttacaggttgactctgggatt

SEQ ID NO: 12393 - DNA, 21 bp, Artificial Sequence
  Synthetic Construct
cctagcctacaagcgcactct

SEQ ID NO: 12394 - DNA, 23 bp, Artificial Sequence
  Synthetic Construct
gagtactgaggcagggaaggttt

SEQ ID NO: 12395 - DNA, 26 bp, Artificial Sequence
  Synthetic Construct
ccaatgagttgtagagctcagattgt

SEQ ID NO: 12396 - DNA, 22 bp, Artificial Sequence
  Synthetic Construct
gaggggtgctagtcaactgtgt

SEQ ID NO: 12397 - DNA, 20 bp, Artificial Sequence
  Synthetic Construct
aatgccaagccaccctggaa

SEQ ID NO: 12398 - DNA, 22 bp, Artificial Sequence
  Synthetic Construct
aggaacccacagcggtaactga

SEQ ID NO: 12399 - DNA, 19 bp, Artificial Sequence
  Synthetic Construct
tgcgagctgagtgcagcat

SEQ ID NO: 12400 - DNA, 26 bp, Artificial Sequence
  Synthetic Construct
ctccaagtccaggatatatgaagcaa

SEQ ID NO: 12401 - DNA, 24 bp, Artificial Sequence
  Synthetic Construct
gcacagaaataatcgtgcaggaaa

SEQ ID NO: 12402 - DNA, 24 bp, Artificial Sequence
  Synthetic Construct
gggagcaaacctcttaggaagaca

SEQ ID NO: 12403 - DNA, 24 bp, Artificial Sequence
  Synthetic Construct
tttggggttttgggatgaggataa

SEQ ID NO: 12404 - DNA, 21 bp, Artificial Sequence
  Synthetic Construct
ttcctccgcccaaccgtcttt

SEQ ID NO: 12405 - DNA, 23 bp, Artificial Sequence
  Synthetic Construct
gctaccctgaagtgctgatggat

SEQ ID NO: 12406 - DNA, 26 bp, Artificial Sequence
  Synthetic Construct
cttgatctgtcaagggagaagagaga

SEQ ID NO: 12407 - DNA, 23 bp, Artificial Sequence
  Synthetic Construct
gcaaagggagtgatgggagatga

SEQ ID NO: 12408 - DNA, 20 bp, Artificial Sequence
  Synthetic Construct
ccgactcttggtgggttgaa

SEQ ID NO: 12409 - DNA, 24 bp, Artificial Sequence
  Synthetic Construct
tgtgttcctagagactctggcttt

SEQ ID NO: 12410 - DNA, 22 bp, Artificial Sequence
  Synthetic Construct
accagctgtgtgagctaagttg

SEQ ID NO: 12411 - DNA, 22 bp, Artificial Sequence
  Synthetic Construct
ttgcctttccctgtctttggaa

SEQ ID NO: 12412 - DNA, 22 bp, Artificial Sequence
  Synthetic Construct
gcaggactaacaatggctcaga

SEQ ID NO: 12413 - DNA, 19 bp, Artificial Sequence
  Synthetic Construct
caggagccacctgggaact

SEQ ID NO: 12414 - DNA, 24 bp, Artificial Sequence
  Synthetic Construct
tggagaagagcaaatccatgttgt

SEQ ID NO: 12415 - DNA, 24 bp, Artificial Sequence
  Synthetic Construct
ccaggacccagaagtactccctat

SEQ ID NO: 12416 - DNA, 22 bp, Artificial Sequence
  Synthetic Construct
cctaccatatgcaaggcaccat

SEQ ID NO: 12417 - DNA, 22 bp, Artificial Sequence
  Synthetic Construct
agaagtccaggcttcccacttg

SEQ ID NO: 12418 - DNA, 26 bp, Artificial Sequence
  Synthetic Construct
gggcttgttaaatgaacccgagaagt

SEQ ID NO: 12419 - DNA, 25 bp, Artificial Sequence
  Synthetic Construct
gccacagtaaaacaaagtacacagt

SEQ ID NO: 12420 - DNA, 23 bp, Artificial Sequence
  Synthetic Construct
tgtgcagtgaatgcagagactat

SEQ ID NO: 12421 - DNA, 24 bp, Artificial Sequence
  Synthetic Construct
ctcacaagcctagaagggtatgtt

SEQ ID NO: 12422 - DNA, 22 bp, Artificial Sequence
  Synthetic Construct
atgggacacctccctgctgagt

SEQ ID NO: 12423 - DNA, 25 bp, Artificial Sequence
  Synthetic Construct
ggtgtagcagggagagagattggtt

SEQ ID NO: 12424 - DNA, 22 bp, Artificial Sequence
  Synthetic Construct
ggccttgttgcctctccactta

SEQ ID NO: 12425 - DNA, 25 bp, Artificial Sequence
  Synthetic Construct
cacttcatagtgtcaccctggttgt

SEQ ID NO: 12426 - DNA, 22 bp, Artificial Sequence
  Synthetic Construct
agaagctgctttctgcttgtca

SEQ ID NO: 12427 - DNA, 25 bp, Artificial Sequence
  Synthetic Construct
gattgtttgtgctccagaaagaaga

SEQ ID NO: 12428 - DNA, 22 bp, Artificial Sequence
  Synthetic Construct
gaacagttggcgataggctgaa

SEQ ID NO: 12429 - DNA, 22 bp, Artificial Sequence
  Synthetic Construct
ggccctatactgccttcagaga

SEQ ID NO: 12430 - DNA, 26 bp, Artificial Sequence
  Synthetic Construct
cacaggtgatagcaacaacctaccat

SEQ ID NO: 12431 - DNA, 24 bp, Artificial Sequence
  Synthetic Construct
ccttgggtggaacctgtgattcaa

SEQ ID NO: 12432 - DNA, 21 bp, Artificial Sequence
  Synthetic Construct
aggcaccatgctcagctccta

SEQ ID NO: 12433 - DNA, 22 bp, Artificial Sequence
  Synthetic Construct
gctcaaagccttggggttctac

SEQ ID NO: 12434 - DNA, 21 bp, Artificial Sequence
  Synthetic Construct
gctccaatgtcagtcccttca

SEQ ID NO: 12435 - DNA, 22 bp, Artificial Sequence
  Synthetic Construct
gctggagttccaggttggactt

SEQ ID NO: 12436 - DNA, 19 bp, Artificial Sequence
  Synthetic Construct
gggcaccccaccattggaa

SEQ ID NO: 12437 - DNA, 22 bp, Artificial Sequence
  Synthetic Construct
gccagtctgtggtgttcattgt

SEQ ID NO: 12438 - DNA, 21 bp, Artificial Sequence
  Synthetic Construct
caccctgggaagctgactgta

SEQ ID NO: 12439 - DNA, 22 bp, Artificial Sequence
  Synthetic Construct
gtggcatctgaggtgagctttg

SEQ ID NO: 12440 - DNA, 24 bp, Artificial Sequence
  Synthetic Construct
gccggtagttgtgacaataggaaa

SEQ ID NO: 12441 - DNA, 25 bp, Artificial Sequence
  Synthetic Construct
gggcgtacttcctttttcattctac

SEQ ID NO: 12442 - DNA, 22 bp, Artificial Sequence
  Synthetic Construct
tctaggctggactggacaccaa

SEQ ID NO: 12443 - DNA, 26 bp, Artificial Sequence
  Synthetic Construct
gagtttcctgttctgggtatgggttt

SEQ ID NO: 12444 - DNA, 22 bp, Artificial Sequence
  Synthetic Construct
gagacacctggaaggacgaaca

SEQ ID NO: 12445 - DNA, 23 bp, Artificial Sequence
  Synthetic Construct
gcttgcctgagaaatgcctgtga

SEQ ID NO: 12446 - DNA, 20 bp, Artificial Sequence
  Synthetic Construct
cccacacacaactgctcaca

SEQ ID NO: 12447 - DNA, 19 bp, Artificial Sequence
  Synthetic Construct
tggcaggacaaggggtttg

SEQ ID NO: 12448 - DNA, 24 bp, Artificial Sequence
  Synthetic Construct
cctattcccatggagccattgttg

SEQ ID NO: 12449 - DNA, 20 bp, Artificial Sequence
  Synthetic Construct
accttgctgagggagcagta

SEQ ID NO: 12450 - DNA, 23 bp, Artificial Sequence
  Synthetic Construct
caaggcagatgggagaagagcaa

SEQ ID NO: 12451 - DNA, 19 bp, Artificial Sequence
  Synthetic Construct
ccaccttccagccccttga

SEQ ID NO: 12452 - DNA, 20 bp, Artificial Sequence
  Synthetic Construct
gcaacatcctggggcacaga

SEQ ID NO: 12453 - DNA, 20 bp, Artificial Sequence
  Synthetic Construct
tcccaacacaggtggctaga

SEQ ID NO: 12454 - DNA, 26 bp, Artificial Sequence
  Synthetic Construct
ggagtggatgcagaagtgtttctttc

SEQ ID NO: 12455 - DNA, 24 bp, Artificial Sequence
  Synthetic Construct
gtacactagcaagtaccggtgaga

SEQ ID NO: 12456 - DNA, 20 bp, Artificial Sequence
  Synthetic Construct
tgaggcttgtttccgcatgt

SEQ ID NO: 12457 - DNA, 26 bp, Artificial Sequence
  Synthetic Construct
actggactacactggactactttgat

SEQ ID NO: 12458 - DNA, 22 bp, Artificial Sequence
  Synthetic Construct
ccaagagcccacctgattctct

SEQ ID NO: 12459 - DNA, 22 bp, Artificial Sequence
  Synthetic Construct
tgataggcaaacagcagacagt

SEQ ID NO: 12460 - DNA, 20 bp, Artificial Sequence
  Synthetic Construct
cccgcgttacaatgcaactt

SEQ ID NO: 12461 - DNA, 24 bp, Artificial Sequence
  Synthetic Construct
cacttccaaaaggcagctacaatc

SEQ ID NO: 12462 - DNA, 20 bp, Artificial Sequence
  Synthetic Construct
tgcctggtgatcctccatca

SEQ ID NO: 12463 - DNA, 23 bp, Artificial Sequence
  Synthetic Construct
gctgcaaacgagaagtaaagcat

SEQ ID NO: 12464 - DNA, 21 bp, Artificial Sequence
  Synthetic Construct
gccctatgcacattggcttgt

SEQ ID NO: 12465 - DNA, 21 bp, Artificial Sequence
  Synthetic Construct
aaggactgagcaatggctgtt

SEQ ID NO: 12466 - DNA, 20 bp, Artificial Sequence
  Synthetic Construct
ggccgcagagcctcaacttt

SEQ ID NO: 12467 - DNA, 26 bp, Artificial Sequence
  Synthetic Construct
ggagtctgcagtttgaggtttatatg

SEQ ID NO: 12468 - DNA, 24 bp, Artificial Sequence
  Synthetic Construct
cctgtttcaggattaagggcttct

SEQ ID NO: 12469 - DNA, 21 bp, Artificial Sequence
  Synthetic Construct
agctttggggtccctcagtat

SEQ ID NO: 12470 - DNA, 23 bp, Artificial Sequence
  Synthetic Construct
agatcaaatcaccccagctttgt

SEQ ID NO: 12471 - DNA, 21 bp, Artificial Sequence
  Synthetic Construct
cacacatgtccctgcagtttg

SEQ ID NO: 12472 - DNA, 21 bp, Artificial Sequence
  Synthetic Construct
gcgtctgactcatgtcctgtt

SEQ ID NO: 12473 - DNA, 22 bp, Artificial Sequence
  Synthetic Construct
ccggcttctttaccccacttag

SEQ ID NO: 12474 - DNA, 19 bp, Artificial Sequence
  Synthetic Construct
caccccagaccccaagttc

SEQ ID NO: 12475 - DNA, 20 bp, Artificial Sequence
  Synthetic Construct
agcctgtctgccacctgaaa

SEQ ID NO: 12476 - DNA, 19 bp, Artificial Sequence
  Synthetic Construct
ggagcagagcgaccgtcat

SEQ ID NO: 12477 - DNA, 24 bp, Artificial Sequence
  Synthetic Construct
gcactggactagtattcgggagat

SEQ ID NO: 12478 - DNA, 23 bp, Artificial Sequence
  Synthetic Construct
ctcttctggcacaaggtgtgtct

SEQ ID NO: 12479 - DNA, 23 bp, Artificial Sequence
  Synthetic Construct
caccagcaaagagggaagttaga

SEQ ID NO: 12480 - DNA, 24 bp, Artificial Sequence
  Synthetic Construct
gatgtcaacgtactgactccaaca

SEQ ID NO: 12481 - DNA, 21 bp, Artificial Sequence
  Synthetic Construct
ccaccagcttcattggtctct

SEQ ID NO: 12482 - DNA, 24 bp, Artificial Sequence
  Synthetic Construct
gggatggttatcatgcccctcttc

SEQ ID NO: 12483 - DNA, 23 bp, Artificial Sequence
  Synthetic Construct
ggttctagatcccgctctcttct

SEQ ID NO: 12484 - DNA, 24 bp, Artificial Sequence
  Synthetic Construct
ctctggtacctgaaccttcccatt

SEQ ID NO: 12485 - DNA, 21 bp, Artificial Sequence
  Synthetic Construct
tgcttcgaggagaggtagtga

SEQ ID NO: 12486 - DNA, 21 bp, Artificial Sequence
  Synthetic Construct
gcacttgactcacagggagaa

SEQ ID NO: 12487 - DNA, 22 bp, Artificial Sequence
  Synthetic Construct
gttatggcagctgacaccagta

SEQ ID NO: 12488 - DNA, 23 bp, Artificial Sequence
  Synthetic Construct
gtcacagattcagggagaagcaa

SEQ ID NO: 12489 - DNA, 22 bp, Artificial Sequence
  Synthetic Construct
cagccttttccctaggcaatgt

SEQ ID NO: 12490 - DNA, 25 bp, Artificial Sequence
  Synthetic Construct
gctctggctactgctattggtgtga

SEQ ID NO: 12491 - DNA, 23 bp, Artificial Sequence
  Synthetic Construct
acacaaagagttcgatggccttt

SEQ ID NO: 12492 - DNA, 23 bp, Artificial Sequence
  Synthetic Construct
tgtttccagacaagccaacaagt

SEQ ID NO: 12493 - DNA, 23 bp, Artificial Sequence
  Synthetic Construct
ggcagagcagcttctttccatct

SEQ ID NO: 12494 - DNA, 19 bp, Artificial Sequence
  Synthetic Construct
gtccagcctcggagcaaaa

SEQ ID NO: 12495 - DNA, 24 bp, Artificial Sequence
  Synthetic Construct
tcactatgaaccctaccaccacta

SEQ ID NO: 12496 - DNA, 21 bp, Artificial Sequence
  Synthetic Construct
cccctgccttcctggtagtaa

SEQ ID NO: 12497 - DNA, 19 bp, Artificial Sequence
  Synthetic Construct
aaggcgaccctccggaaca

SEQ ID NO: 12498 - DNA, 20 bp, Artificial Sequence
  Synthetic Construct
aggcggagctctaagcacta

SEQ ID NO: 12499 - DNA, 24 bp, Artificial Sequence
  Synthetic Construct
atgagctctgcagtcattgaattg

SEQ ID NO: 12500 - DNA, 20 bp, Artificial Sequence
  Synthetic Construct
ctggctgctatgcactcaga

SEQ ID NO: 12501 - DNA, 23 bp, Artificial Sequence
  Synthetic Construct
gcttcgtgcttttacctgactgt

SEQ ID NO: 12502 - DNA, 22 bp, Artificial Sequence
  Synthetic Construct
ccaaggacagacctcccagaga

SEQ ID NO: 12503 - DNA, 27 bp, Artificial Sequence
  Synthetic Construct
ggggttacttaccggtcagacaaattc

SEQ ID NO: 12504 - DNA, 24 bp, Artificial Sequence
  Synthetic Construct
gcagaagcatcactgcgtaatatc

SEQ ID NO: 12505 - DNA, 23 bp, Artificial Sequence
  Synthetic Construct
accatcctccccatctcagtaaa

SEQ ID NO: 12506 - DNA, 26 bp, Artificial Sequence
  Synthetic Construct
cgtctccatttctgtatccctctcaa

SEQ ID NO: 12507 - DNA, 23 bp, Artificial Sequence
  Synthetic Construct
gtggggtaacggtttaggagttg

SEQ ID NO: 12508 - DNA, 25 bp, Artificial Sequence
  Synthetic Construct
ccttaattactgccgattgcctgtt

SEQ ID NO: 12509 - DNA, 23 bp, Artificial Sequence
  Synthetic Construct
agcctggagaacaaaaggtgaaa

SEQ ID NO: 12510 - DNA, 20 bp, Artificial Sequence
  Synthetic Construct
cgaggcaatttcccctgcaa

SEQ ID NO: 12511 - DNA, 22 bp, Artificial Sequence
  Synthetic Construct
gaggtgacatgcctgttgtcat

SEQ ID NO: 12512 - DNA, 26 bp, Artificial Sequence
  Synthetic Construct
gcccttctagtgaatgtttgggttca

SEQ ID NO: 12513 - DNA, 23 bp, Artificial Sequence
  Synthetic Construct
ccaacaatctctgtgcctctact

SEQ ID NO: 12514 - DNA, 23 bp, Artificial Sequence
  Synthetic Construct
ccctgcctaaaggtctccaaaac

SEQ ID NO: 12515 - DNA, 21 bp, Artificial Sequence
  Synthetic Construct
tgagggctatcctcgaccttt

SEQ ID NO: 12516 - DNA, 25 bp, Artificial Sequence
  Synthetic Construct
gtggtagctactgaatcagccctat

SEQ ID NO: 12517 - DNA, 21 bp, Artificial Sequence
  Synthetic Construct
tccaggtgaaagcaggtcaag

SEQ ID NO: 12518 - DNA, 24 bp, Artificial Sequence
  Synthetic Construct
gcagataaagcaaaagggtgactt

SEQ ID NO: 12519 - DNA, 22 bp, Artificial Sequence
  Synthetic Construct
tccaggtcactgcctcatagat

SEQ ID NO: 12520 - DNA, 21 bp, Artificial Sequence
  Synthetic Construct
tgtgggaggagaggtcaccat

SEQ ID NO: 12521 - DNA, 20 bp, Artificial Sequence
  Synthetic Construct
agggcctagcggtcaacatt

SEQ ID NO: 12522 - DNA, 25 bp, Artificial Sequence
  Synthetic Construct
gggcaacagaagtaacatccattag

SEQ ID NO: 12523 - DNA, 22 bp, Artificial Sequence
  Synthetic Construct
tctgctacagtctttgcgttca

SEQ ID NO: 12524 - DNA, 22 bp, Artificial Sequence
  Synthetic Construct
tgaccttttcagcttccgttgt

SEQ ID NO: 12525 - DNA, 20 bp, Artificial Sequence
  Synthetic Construct
tggaggaccaaagccctcat

SEQ ID NO: 12526 - DNA, 23 bp, Artificial Sequence
  Synthetic Construct
gtgacacctctgcctttgcatgt

SEQ ID NO: 12527 - DNA, 23 bp, Artificial Sequence
  Synthetic Construct
tctgggatttgagcatggaactt

SEQ ID NO: 12528 - DNA, 24 bp, Artificial Sequence
  Synthetic Construct
gaccgtctactaacagcaccaagt

SEQ ID NO: 12529 - DNA, 23 bp, Artificial Sequence
  Synthetic Construct
ggtgtaagactaggctccctcta

SEQ ID NO: 12530 - DNA, 22 bp, Artificial Sequence
  Synthetic Construct
ggggcgtagtgaatctccaatg

SEQ ID NO: 12531 - DNA, 21 bp, Artificial Sequence
  Synthetic Construct
accaccacactccccttctct

SEQ ID NO: 12532 - DNA, 27 bp, Artificial Sequence
  Synthetic Construct
gagaggtcaaagacaggagactgaatc

SEQ ID NO: 12533 - DNA, 23 bp, Artificial Sequence
  Synthetic Construct
ggcataggtgacatgccatcaga

SEQ ID NO: 12534 - DNA, 24 bp, Artificial Sequence
  Synthetic Construct
cagacaatggaactacgcctgcat

SEQ ID NO: 12535 - DNA, 25 bp, Artificial Sequence
  Synthetic Construct
cgcctgagcttagacttcacctaca

SEQ ID NO: 12536 - DNA, 21 bp, Artificial Sequence
  Synthetic Construct
tccccacctggagcccaaaat

SEQ ID NO: 12537 - DNA, 22 bp, Artificial Sequence
  Synthetic Construct
ctgtccagacttgtccccaaga

SEQ ID NO: 12538 - DNA, 22 bp, Artificial Sequence
  Synthetic Construct
aggagacagtgcaagcttttgt

SEQ ID NO: 12539 - DNA, 23 bp, Artificial Sequence
  Synthetic Construct
tggactcactgttctccaagtga

SEQ ID NO: 12540 - DNA, 22 bp, Artificial Sequence
  Synthetic Construct
gccctggtgaatgcacattttg

SEQ ID NO: 12541 - DNA, 20 bp, Artificial Sequence
  Synthetic Construct
tggcatcgaggatggcatga

SEQ ID NO: 12542 - DNA, 24 bp, Artificial Sequence
  Synthetic Construct
tcctgtttgttatgggaaccaagt

SEQ ID NO: 12543 - DNA, 22 bp, Artificial Sequence
  Synthetic Construct
gcatccagcccaaatcctcact

SEQ ID NO: 12544 - DNA, 21 bp, Artificial Sequence
  Synthetic Construct
tcctccctgagaccacagctt

SEQ ID NO: 12545 - DNA, 24 bp, Artificial Sequence
  Synthetic Construct
ccatcacccatttacccctacttg

SEQ ID NO: 12546 - DNA, 20 bp, Artificial Sequence
  Synthetic Construct
actggctgtcaggcttgctt

SEQ ID NO: 12547 - DNA, 25 bp, Artificial Sequence
  Synthetic Construct
gcacgagatgaactaagacaccatt

SEQ ID NO: 12548 - DNA, 25 bp, Artificial Sequence
  Synthetic Construct
gagggaatggtacctggattagcaa

SEQ ID NO: 12549 - DNA, 24 bp, Artificial Sequence
  Synthetic Construct
tgccacttcacccatactgaattt

SEQ ID NO: 12550 - DNA, 22 bp, Artificial Sequence
  Synthetic Construct
cacactgccacctgcttgagta

SEQ ID NO: 12551 - DNA, 22 bp, Artificial Sequence
  Synthetic Construct
tgatgagtggaagcccatgttg

SEQ ID NO: 12552 - DNA, 23 bp, Artificial Sequence
  Synthetic Construct
tgctcatcatggctatgctttct

SEQ ID NO: 12553 - DNA, 22 bp, Artificial Sequence
  Synthetic Construct
gctgatccagagatggacacaa

SEQ ID NO: 12554 - DNA, 21 bp, Artificial Sequence
  Synthetic Construct
gcagtgctgtctatgccaatg

SEQ ID NO: 12555 - DNA, 24 bp, Artificial Sequence
  Synthetic Construct
gccagatgtggagttaacaagtca

SEQ ID NO: 12556 - DNA, 25 bp, Artificial Sequence
  Synthetic Construct
tgacttaacaggtgacctagacaca

SEQ ID NO: 12557 - DNA, 19 bp, Artificial Sequence
  Synthetic Construct
ccttggaggccagcaacaa

SEQ ID NO: 12558 - DNA, 26 bp, Artificial Sequence
  Synthetic Construct
gaggcactgattcattcaacaggatt

SEQ ID NO: 12559 - DNA, 24 bp, Artificial Sequence
  Synthetic Construct
cccatgggtaaactgctgtaagta

SEQ ID NO: 12560 - DNA, 22 bp, Artificial Sequence
  Synthetic Construct
caggcctcaaaacacgaagaag

SEQ ID NO: 12561 - DNA, 23 bp, Artificial Sequence
  Synthetic Construct
ggggagaagtgtcaccagattca

SEQ ID NO: 12562 - DNA, 24 bp, Artificial Sequence
  Synthetic Construct
gcgggttaggaagattccctgaag

SEQ ID NO: 12563 - DNA, 24 bp, Artificial Sequence
  Synthetic Construct
cttcctcacccgtccttaataaca

SEQ ID NO: 12564 - DNA, 23 bp, Artificial Sequence
  Synthetic Construct
ggtgctttcctttccaccgaagt

SEQ ID NO: 12565 - DNA, 23 bp, Artificial Sequence
  Synthetic Construct
gggaggaacagtgatctgagcat

SEQ ID NO: 12566 - DNA, 27 bp, Artificial Sequence
  Synthetic Construct
gagaattaaacagggctttgagggatt

SEQ ID NO: 12567 - DNA, 22 bp, Artificial Sequence
  Synthetic Construct
caccgagcactcgggtgaataa

SEQ ID NO: 12568 - DNA, 24 bp, Artificial Sequence
  Synthetic Construct
ttgatggctcccatgtaagtttga

SEQ ID NO: 12569 - DNA, 23 bp, Artificial Sequence
  Synthetic Construct
cgaagaagcaagaccgcagtaac

SEQ ID NO: 12570 - DNA, 23 bp, Artificial Sequence
  Synthetic Construct
ctctggggaatgcctaacaatga

SEQ ID NO: 12571 - DNA, 22 bp, Artificial Sequence
  Synthetic Construct
cagcaatgaggccagcgtagtt

SEQ ID NO: 12572 - DNA, 28 bp, Artificial Sequence
  Synthetic Construct
ccctatccagaaagaaaaagccaagtga

SEQ ID NO: 12573 - DNA, 23 bp, Artificial Sequence
  Synthetic Construct
ccttcctgcaagtcaaggactca

SEQ ID NO: 12574 - DNA, 22 bp, Artificial Sequence
  Synthetic Construct
gccgtaggtagttccatgctaa

SEQ ID NO: 12575 - DNA, 22 bp, Artificial Sequence
  Synthetic Construct
catcctcttgccgtgtgtgact

SEQ ID NO: 12576 - DNA, 22 bp, Artificial Sequence
  Synthetic Construct
caagtagcgttcatcccaggaa

SEQ ID NO: 12577 - DNA, 22 bp, Artificial Sequence
  Synthetic Construct
gcccctgaaattggaagcaaat

SEQ ID NO: 12578 - DNA, 21 bp, Artificial Sequence
  Synthetic Construct
gccacaggtcgccttctgaac

SEQ ID NO: 12579 - DNA, 26 bp, Artificial Sequence
  Synthetic Construct
ggcaacactctgtacaactccttact

SEQ ID NO: 12580 - DNA, 23 bp, Artificial Sequence
  Synthetic Construct
aggcccttcaagaagttgaaaca

SEQ ID NO: 12581 - DNA, 23 bp, Artificial Sequence
  Synthetic Construct
cccgtgtagccaagagactgaag

SEQ ID NO: 12582 - DNA, 21 bp, Artificial Sequence
  Synthetic Construct
tgtgtggtacaggcccgatct

SEQ ID NO: 12583 - DNA, 22 bp, Artificial Sequence
  Synthetic Construct
gctctcaaggactttgcagtct

SEQ ID NO: 12584 - DNA, 22 bp, Artificial Sequence
  Synthetic Construct
gagggaggtgctttgctgtcaa

SEQ ID NO: 12585 - DNA, 23 bp, Artificial Sequence
  Synthetic Construct
ggctctgtgaggatggagagagt

SEQ ID NO: 12586 - DNA, 22 bp, Artificial Sequence
  Synthetic Construct
gccaggggaagtggtgtttaag

SEQ ID NO: 12587 - DNA, 24 bp, Artificial Sequence
  Synthetic Construct
gtagactccacaccttcctacctt

SEQ ID NO: 12588 - DNA, 25 bp, Artificial Sequence
  Synthetic Construct
tctcctggaaatgtgaacaggattg

SEQ ID NO: 12589 - DNA, 20 bp, Artificial Sequence
  Synthetic Construct
ctcgctgcatctgagtgagt

SEQ ID NO: 12590 - DNA, 21 bp, Artificial Sequence
  Synthetic Construct
tcggatgcttcctgggcaaag

SEQ ID NO: 12591 - DNA, 19 bp, Artificial Sequence
  Synthetic Construct
caaccgctcaggctgtgaa

SEQ ID NO: 12592 - DNA, 24 bp, Artificial Sequence
  Synthetic Construct
gatgataagcctgtccctgagatg

SEQ ID NO: 12593 - DNA, 24 bp, Artificial Sequence
  Synthetic Construct
caggagggagaaagctttggaaga

SEQ ID NO: 12594 - DNA, 27 bp, Artificial Sequence
  Synthetic Construct
catccgtctcttcactagctgttaaat

SEQ ID NO: 12595 - DNA, 21 bp, Artificial Sequence
  Synthetic Construct
gtccctctgcttcctgccata

SEQ ID NO: 12596 - DNA, 22 bp, Artificial Sequence
  Synthetic Construct
gctgtactcctgggtgacattc

SEQ ID NO: 12597 - DNA, 22 bp, Artificial Sequence
  Synthetic Construct
agccctctgattccaggtaaga

SEQ ID NO: 12598 - DNA, 22 bp, Artificial Sequence
  Synthetic Construct
tcgatggcagagacaaatgaca

SEQ ID NO: 12599 - DNA, 22 bp, Artificial Sequence
  Synthetic Construct
cagggtcacacactcgggtatt

SEQ ID NO: 12600 - DNA, 22 bp, Artificial Sequence
  Synthetic Construct
ctccagcagacagcatgcaaac

SEQ ID NO: 12601 - DNA, 24 bp, Artificial Sequence
  Synthetic Construct
gcacacctgaaggtcaaacgaaca

SEQ ID NO: 12602 - DNA, 24 bp, Artificial Sequence
  Synthetic Construct
gttgatggtcgcattccagatgta

SEQ ID NO: 12603 - DNA, 20 bp, Artificial Sequence
  Synthetic Construct
tgtggcctggctcagacata

SEQ ID NO: 12604 - DNA, 20 bp, Artificial Sequence
  Synthetic Construct
ttgcggccactgtcactact

SEQ ID NO: 12605 - DNA, 25 bp, Artificial Sequence
  Synthetic Construct
caaatcctttgtgggtgttaagtgt

SEQ ID NO: 12606 - DNA, 21 bp, Artificial Sequence
  Synthetic Construct
tgccctgatggataggtggat

SEQ ID NO: 12607 - DNA, 22 bp, Artificial Sequence
  Synthetic Construct
agagctccaggctcatccctat

SEQ ID NO: 12608 - DNA, 24 bp, Artificial Sequence
  Synthetic Construct
cagagtcccttggatctgttctca

SEQ ID NO: 12609 - DNA, 19 bp, Artificial Sequence
  Synthetic Construct
ctggggcaggaccaggaaa

SEQ ID NO: 12610 - DNA, 22 bp, Artificial Sequence
  Synthetic Construct
cagtggagcttgctggttgact

SEQ ID NO: 12611 - DNA, 26 bp, Artificial Sequence
  Synthetic Construct
gggtaccttctctcaaagcagcatct

SEQ ID NO: 12612 - DNA, 20 bp, Artificial Sequence
  Synthetic Construct
catccagcaccatggcatct

SEQ ID NO: 12613 - DNA, 19 bp, Artificial Sequence
  Synthetic Construct
tggcagagactggcaggaa

SEQ ID NO: 12614 - DNA, 23 bp, Artificial Sequence
  Synthetic Construct
ttcctgaagggttgtaccagttg

SEQ ID NO: 12615 - DNA, 21 bp, Artificial Sequence
  Synthetic Construct
agggccctgctgaacactgaa

SEQ ID NO: 12616 - DNA, 21 bp, Artificial Sequence
  Synthetic Construct
catctccagacggtggtgttc

SEQ ID NO: 12617 - DNA, 22 bp, Artificial Sequence
  Synthetic Construct
cttggcttgggactgtctctct

SEQ ID NO: 12618 - DNA, 19 bp, Artificial Sequence
  Synthetic Construct
actggcacagcccaggatt

SEQ ID NO: 12619 - DNA, 23 bp, Artificial Sequence
  Synthetic Construct
caggacttctggaaacccactgt

SEQ ID NO: 12620 - DNA, 22 bp, Artificial Sequence
  Synthetic Construct
catccctgcgcctaactctaag

SEQ ID NO: 12621 - DNA, 19 bp, Artificial Sequence
  Synthetic Construct
tgcacatggcggctaaaca

SEQ ID NO: 12622 - DNA, 24 bp, Artificial Sequence
  Synthetic Construct
ggagttcgcatggtacctccctta

SEQ ID NO: 12623 - DNA, 20 bp, Artificial Sequence
  Synthetic Construct
agccatgccgattgcctctt

SEQ ID NO: 12624 - DNA, 22 bp, Artificial Sequence
  Synthetic Construct
ttggtcttcaggtccggaggtt

SEQ ID NO: 12625 - DNA, 22 bp, Artificial Sequence
  Synthetic Construct
ggcttttgttggaagcacagaa

SEQ ID NO: 12626 - DNA, 19 bp, Artificial Sequence
  Synthetic Construct
ttgagtcgtggggctctct

SEQ ID NO: 12627 - DNA, 20 bp, Artificial Sequence
  Synthetic Construct
tgtggatggccaggatgtgt

SEQ ID NO: 12628 - DNA, 22 bp, Artificial Sequence
  Synthetic Construct
ccatgacagacacccagcatct

SEQ ID NO: 12629 - DNA, 24 bp, Artificial Sequence
  Synthetic Construct
cctgcctcaaacagaggaactcta

SEQ ID NO: 12630 - DNA, 23 bp, Artificial Sequence
  Synthetic Construct
cactgagcaatcatggcatttgt

SEQ ID NO: 12631 - DNA, 22 bp, Artificial Sequence
  Synthetic Construct
tccatccctgtcccagctccta

SEQ ID NO: 12632 - DNA, 22 bp, Artificial Sequence
  Synthetic Construct
ggaacagcagcctaagtcatgt

SEQ ID NO: 12633 - DNA, 22 bp, Artificial Sequence
  Synthetic Construct
gtaagaaggaggcgtcggaatc

SEQ ID NO: 12634 - DNA, 20 bp, Artificial Sequence
  Synthetic Construct
tgctgggtcttgcccaacat

SEQ ID NO: 12635 - DNA, 21 bp, Artificial Sequence
  Synthetic Construct
gcctggagatcaagctgcaaa

SEQ ID NO: 12636 - DNA, 25 bp, Artificial Sequence
  Synthetic Construct
caccagggtaggtatccaatactgt

SEQ ID NO: 12637 - DNA, 22 bp, Artificial Sequence
  Synthetic Construct
gcaactgaatgcacgtgtgtga

SEQ ID NO: 12638 - DNA, 23 bp, Artificial Sequence
  Synthetic Construct
ggaccttagagcaatgaccttca

SEQ ID NO: 12639 - DNA, 26 bp, Artificial Sequence
  Synthetic Construct
ggagtaggtggaaacaaactgcttct

SEQ ID NO: 12640 - DNA, 22 bp, Artificial Sequence
  Synthetic Construct
gaagcagtcagcagtgctcaga

SEQ ID NO: 12641 - DNA, 22 bp, Artificial Sequence
  Synthetic Construct
gcagtctctcctcctccagcaa

SEQ ID NO: 12642 - DNA, 25 bp, Artificial Sequence
  Synthetic Construct
gagctctacccaactcttggtccta

SEQ ID NO: 12643 - DNA, 24 bp, Artificial Sequence
  Synthetic Construct
ccctgaagagctgaatcacagaca

SEQ ID NO: 12644 - DNA, 25 bp, Artificial Sequence
  Synthetic Construct
aggaaggtgtaggaactgcaaatac

SEQ ID NO: 12645 - DNA, 22 bp, Artificial Sequence
  Synthetic Construct
cctcaacatacgggctaccaaa

SEQ ID NO: 12646 - DNA, 21 bp, Artificial Sequence
  Synthetic Construct
ggcaaggagttctgggagctt

SEQ ID NO: 12647 - DNA, 21 bp, Artificial Sequence
  Synthetic Construct
ggtggagggtttggtgctatg

SEQ ID NO: 12648 - DNA, 25 bp, Artificial Sequence
  Synthetic Construct
caaagcaaagaacctctacccatga

SEQ ID NO: 12649 - DNA, 20 bp, Artificial Sequence
  Synthetic Construct
gccaaacagctctgcactga

SEQ ID NO: 12650 - DNA, 23 bp, Artificial Sequence
  Synthetic Construct
gcagccaagaatgcacctgaaag

SEQ ID NO: 12651 - DNA, 20 bp, Artificial Sequence
  Synthetic Construct
gggaaggagctctcgaccta

SEQ ID NO: 12652 - DNA, 22 bp, Artificial Sequence
  Synthetic Construct
ctcccaagtcacctgcgtttgt

SEQ ID NO: 12653 - DNA, 20 bp, Artificial Sequence
  Synthetic Construct
gccgtacaactgacgccaaa

SEQ ID NO: 12654 - DNA, 21 bp, Artificial Sequence
  Synthetic Construct
gctcctcctccagctcaattt

SEQ ID NO: 12655 - DNA, 20 bp, Artificial Sequence
  Synthetic Construct
ctcgggtgcttggattgtgt

SEQ ID NO: 12656 - DNA, 22 bp, Artificial Sequence
  Synthetic Construct
tggttcctccgctccattctct

SEQ ID NO: 12657 - DNA, 22 bp, Artificial Sequence
  Synthetic Construct
ctgtgtgtctggctgctgacat

SEQ ID NO: 12658 - DNA, 22 bp, Artificial Sequence
  Synthetic Construct
gttagcgtgggtggctctgaat

SEQ ID NO: 12659 - DNA, 20 bp, Artificial Sequence
  Synthetic Construct
gggcacttctgagtgcttga

SEQ ID NO: 12660 - DNA, 21 bp, Artificial Sequence
  Synthetic Construct
ctctctgttcccacccaccta

SEQ ID NO: 12661 - DNA, 24 bp, Artificial Sequence
  Synthetic Construct
gtctgaggagataaaccccacact

SEQ ID NO: 12662 - DNA, 27 bp, Artificial Sequence
  Synthetic Construct
ggaatgcatgggcataaattctgtctt

SEQ ID NO: 12663 - DNA, 28 bp, Artificial Sequence
  Synthetic Construct
gcaaggagcctattgttactaagagaga

SEQ ID NO: 12664 - DNA, 22 bp, Artificial Sequence
  Synthetic Construct
gggttgtgtggcaaatggaagt

SEQ ID NO: 12665 - DNA, 28 bp, Artificial Sequence
  Synthetic Construct
caggagcaggaggaggtagaattaatga

SEQ ID NO: 12666 - DNA, 24 bp, Artificial Sequence
  Synthetic Construct
ggccccagtgatgttttaggttca

SEQ ID NO: 12667 - DNA, 25 bp, Artificial Sequence
  Synthetic Construct
tgatttttccatcgtgatggtgttg

SEQ ID NO: 12668 - DNA, 22 bp, Artificial Sequence
  Synthetic Construct
gggagagcagtcacttggaaga

SEQ ID NO: 12669 - DNA, 24 bp, Artificial Sequence
  Synthetic Construct
cgtggctagggttgtactgtcgtt

SEQ ID NO: 12670 - DNA, 22 bp, Artificial Sequence
  Synthetic Construct
ccatgcgtgcaggggagaatta

SEQ ID NO: 12671 - DNA, 24 bp, Artificial Sequence
  Synthetic Construct
tgtgctcagtaagtgcttgttaga

SEQ ID NO: 12672 - DNA, 21 bp, Artificial Sequence
  Synthetic Construct
tggtgaaggccctgactcgat

SEQ ID NO: 12673 - DNA, 23 bp, Artificial Sequence
  Synthetic Construct
gggtccctctctaggccactttt

SEQ ID NO: 12674 - DNA, 27 bp, Artificial Sequence
  Synthetic Construct
ggaccttagattcgggagaaaatcact

SEQ ID NO: 12675 - DNA, 22 bp, Artificial Sequence
  Synthetic Construct
cctgaccatcctagctgcaagt

SEQ ID NO: 12676 - DNA, 21 bp, Artificial Sequence
  Synthetic Construct
ggcaggcagggtgtggatttt

SEQ ID NO: 12677 - DNA, 21 bp, Artificial Sequence
  Synthetic Construct
ctgtgccagtgacgaaagaca

SEQ ID NO: 12678 - DNA, 25 bp, Artificial Sequence
  Synthetic Construct
gatgtgaaggtgcaatgaagttaca

SEQ ID NO: 12679 - DNA, 20 bp, Artificial Sequence
  Synthetic Construct
ccccagtttggtgcttctca

SEQ ID NO: 12680 - DNA, 21 bp, Artificial Sequence
  Synthetic Construct
ggacaggaagcagctctcaca

SEQ ID NO: 12681 - DNA, 23 bp, Artificial Sequence
  Synthetic Construct
cggctcctgaactggaaggagat

SEQ ID NO: 12682 - DNA, 20 bp, Artificial Sequence
  Synthetic Construct
actcacggccctgaagcaaa

SEQ ID NO: 12683 - DNA, 24 bp, Artificial Sequence
  Synthetic Construct
caggagcaccaagactggtagatg

SEQ ID NO: 12684 - DNA, 22 bp, Artificial Sequence
  Synthetic Construct
ccctccaagtgtcaccaagcaa

SEQ ID NO: 12685 - DNA, 24 bp, Artificial Sequence
  Synthetic Construct
cagtgccatgtcagtttaccattg

SEQ ID NO: 12686 - DNA, 22 bp, Artificial Sequence
  Synthetic Construct
aaggactggacccacccactga

SEQ ID NO: 12687 - DNA, 23 bp, Artificial Sequence
  Synthetic Construct
cagagaaaagccccactcgttac

SEQ ID NO: 12688 - DNA, 22 bp, Artificial Sequence
  Synthetic Construct
cacatctgcctgatgcctgcta

SEQ ID NO: 12689 - DNA, 19 bp, Artificial Sequence
  Synthetic Construct
gggttatggtgggcagcaa

SEQ ID NO: 12690 - DNA, 24 bp, Artificial Sequence
  Synthetic Construct
acagagaaaatgaccctccaggaa

SEQ ID NO: 12691 - DNA, 24 bp, Artificial Sequence
  Synthetic Construct
ctggtgccctggttataggaagaa

SEQ ID NO: 12692 - DNA, 25 bp, Artificial Sequence
  Synthetic Construct
cctttcagcctatggcattggattt

SEQ ID NO: 12693 - DNA, 22 bp, Artificial Sequence
  Synthetic Construct
cagaggcagtttggaccctaca

SEQ ID NO: 12694 - DNA, 23 bp, Artificial Sequence
  Synthetic Construct
agcaaaaatagcctctgggacaa

SEQ ID NO: 12695 - DNA, 22 bp, Artificial Sequence
  Synthetic Construct
gcatttggagggctagggacaa

SEQ ID NO: 12696 - DNA, 23 bp, Artificial Sequence
  Synthetic Construct
gcaagggcaggtagggagaaaat

SEQ ID NO: 12697 - DNA, 23 bp, Artificial Sequence
  Synthetic Construct
cctcccagtggagtctgtgtttc

SEQ ID NO: 12698 - DNA, 19 bp, Artificial Sequence
  Synthetic Construct
gctgtcagccccacagatg

SEQ ID NO: 12699 - DNA, 22 bp, Artificial Sequence
  Synthetic Construct
gaggacgcatatggacccgaat

SEQ ID NO: 12700 - DNA, 26 bp, Artificial Sequence
  Synthetic Construct
gtctagaagctgtatccccagagtca

SEQ ID NO: 12701 - DNA, 21 bp, Artificial Sequence
  Synthetic Construct
cgcttccgtaagggagcatct

SEQ ID NO: 12702 - DNA, 22 bp, Artificial Sequence
  Synthetic Construct
cacggtcacaatgtttgtgcat

SEQ ID NO: 12703 - DNA, 24 bp, Artificial Sequence
  Synthetic Construct
gcccttggctacatttgaggttgt

SEQ ID NO: 12704 - DNA, 23 bp, Artificial Sequence
  Synthetic Construct
ggattggggtgttcagagcaaga

SEQ ID NO: 12705 - DNA, 20 bp, Artificial Sequence
  Synthetic Construct
aggagcgtgcgtgaatgtgt

SEQ ID NO: 12706 - DNA, 21 bp, Artificial Sequence
  Synthetic Construct
ggcactgagggactggaactt

SEQ ID NO: 12707 - DNA, 22 bp, Artificial Sequence
  Synthetic Construct
gagactttgaggcagactgtca

SEQ ID NO: 12708 - DNA, 26 bp, Artificial Sequence
  Synthetic Construct
ctggaagtcaggaaagtacagttcta

SEQ ID NO: 12709 - DNA, 22 bp, Artificial Sequence
  Synthetic Construct
ggttgtcctggttcgcagagtt

SEQ ID NO: 12710 - DNA, 23 bp, Artificial Sequence
  Synthetic Construct
gcctgatgggagaatcagaaact

SEQ ID NO: 12711 - DNA, 23 bp, Artificial Sequence
  Synthetic Construct
ggcaaatcaaagcctgccttttc

SEQ ID NO: 12712 - DNA, 22 bp, Artificial Sequence
  Synthetic Construct
agtgtgggccctacctgtgatt

SEQ ID NO: 12713 - DNA, 19 bp, Artificial Sequence
  Synthetic Construct
ttttgccgctgcccctgat

SEQ ID NO: 12714 - DNA, 22 bp, Artificial Sequence
  Synthetic Construct
ggactgtgttgggtgcaataac

SEQ ID NO: 12715 - DNA, 18 bp, Artificial Sequence
  Synthetic Construct
acccgatgccccatgact

SEQ ID NO: 12716 - DNA, 22 bp, Artificial Sequence
  Synthetic Construct
cccagtgaagccccacctttag

SEQ ID NO: 12717 - DNA, 22 bp, Artificial Sequence
  Synthetic Construct
gtggcagacaaggacagtgagt

SEQ ID NO: 12718 - DNA, 23 bp, Artificial Sequence
  Synthetic Construct
ccatggcaactccatgcttccaa

SEQ ID NO: 12719 - DNA, 24 bp, Artificial Sequence
  Synthetic Construct
gcttcccaggatacccacccatta

SEQ ID NO: 12720 - DNA, 21 bp, Artificial Sequence
  Synthetic Construct
gctgtctcggtcctcgttagt

SEQ ID NO: 12721 - DNA, 27 bp, Artificial Sequence
  Synthetic Construct
gagccgattttatatccatgcctgtag

SEQ ID NO: 12722 - DNA, 22 bp, Artificial Sequence
  Synthetic Construct
cccagaaacgagccatggaaag

SEQ ID NO: 12723 - DNA, 20 bp, Artificial Sequence
  Synthetic Construct
aggtcgccagagtgctgtga

SEQ ID NO: 12724 - DNA, 25 bp, Artificial Sequence
  Synthetic Construct
ccaaacccaattgcagctgtgtaac

SEQ ID NO: 12725 - DNA, 24 bp, Artificial Sequence
  Synthetic Construct
gctgccttcttgagctcctgattt

SEQ ID NO: 12726 - DNA, 23 bp, Artificial Sequence
  Synthetic Construct
cagcctagaggcagcaaaactgt

SEQ ID NO: 12727 - DNA, 24 bp, Artificial Sequence
  Synthetic Construct
gcaagtgtcaggtccctctagtca

SEQ ID NO: 12728 - DNA, 20 bp, Artificial Sequence
  Synthetic Construct
agccaactgagccaggaaca

SEQ ID NO: 12729 - DNA, 24 bp, Artificial Sequence
  Synthetic Construct
cctgcatgcttgggttaattcttg

SEQ ID NO: 12730 - DNA, 20 bp, Artificial Sequence
  Synthetic Construct
aaggggagctgtgtgtcctt

SEQ ID NO: 12731 - DNA, 22 bp, Artificial Sequence
  Synthetic Construct
ccaatcctacgacgggaccaaa

SEQ ID NO: 12732 - DNA, 21 bp, Artificial Sequence
  Synthetic Construct
tgctgattgcctgtgttgcta

SEQ ID NO: 12733 - DNA, 22 bp, Artificial Sequence
  Synthetic Construct
gggacactgacctgcaccaaaa

SEQ ID NO: 12734 - DNA, 25 bp, Artificial Sequence
  Synthetic Construct
ggacccttctaagccactgatctct

SEQ ID NO: 12735 - DNA, 22 bp, Artificial Sequence
  Synthetic Construct
ctaaccccagctcaacctcttg

SEQ ID NO: 12736 - DNA, 22 bp, Artificial Sequence
  Synthetic Construct
gtgacacaggctgcttctcatc

SEQ ID NO: 12737 - DNA, 21 bp, Artificial Sequence
  Synthetic Construct
ttggtgtagggagcaggagat

SEQ ID NO: 12738 - DNA, 26 bp, Artificial Sequence
  Synthetic Construct
cctcttacacccactgttccactaag

SEQ ID NO: 12739 - DNA, 23 bp, Artificial Sequence
  Synthetic Construct
gaagcattctgggctgagagaga

SEQ ID NO: 12740 - DNA, 22 bp, Artificial Sequence
  Synthetic Construct
ggaaacctggtccaaaccacaa

SEQ ID NO: 12741 - DNA, 21 bp, Artificial Sequence
  Synthetic Construct
aggcacctgtttgcccgaatg

SEQ ID NO: 12742 - DNA, 23 bp, Artificial Sequence
  Synthetic Construct
gctgtcagaaccagcctgagtat

SEQ ID NO: 12743 - DNA, 24 bp, Artificial Sequence
  Synthetic Construct
gcggtaggatgttaaaggcagctt

SEQ ID NO: 12744 - DNA, 22 bp, Artificial Sequence
  Synthetic Construct
ggttcaatctcaggctcacact

SEQ ID NO: 12745 - DNA, 21 bp, Artificial Sequence
  Synthetic Construct
gcatggatctgcgtggagaca

SEQ ID NO: 12746 - DNA, 23 bp, Artificial Sequence
  Synthetic Construct
cagaactgggtggtgtcgttttg

SEQ ID NO: 12747 - DNA, 21 bp, Artificial Sequence
  Synthetic Construct
cagaccacttgagagcaggtt

SEQ ID NO: 12748 - DNA, 22 bp, Artificial Sequence
  Synthetic Construct
gctaccaagggaggtctcttct

SEQ ID NO: 12749 - DNA, 22 bp, Artificial Sequence
  Synthetic Construct
gaggtgggtaacagacccatca

SEQ ID NO: 12750 - DNA, 23 bp, Artificial Sequence
  Synthetic Construct
ggaagcaagcacatactcaccat

SEQ ID NO: 12751 - DNA, 20 bp, Artificial Sequence
  Synthetic Construct
actgcgtaagcggtggcata

SEQ ID NO: 12752 - DNA, 25 bp, Artificial Sequence
  Synthetic Construct
ggtatcagcagtgtgggttaaggat

SEQ ID NO: 12753 - DNA, 24 bp, Artificial Sequence
  Synthetic Construct
ctcggaagtcccagcagatctttc

SEQ ID NO: 12754 - DNA, 23 bp, Artificial Sequence
  Synthetic Construct
ggtgaggttcacaccctcctttc

SEQ ID NO: 12755 - DNA, 20 bp, Artificial Sequence
  Synthetic Construct
ctgcagtcatggctgtggaa

SEQ ID NO: 12756 - DNA, 23 bp, Artificial Sequence
  Synthetic Construct
cccctgcctgtggaccttatatt

SEQ ID NO: 12757 - DNA, 20 bp, Artificial Sequence
  Synthetic Construct
gggcattgccacaatggttt

SEQ ID NO: 12758 - DNA, 20 bp, Artificial Sequence
  Synthetic Construct
gtggcaacaggacagggatt

SEQ ID NO: 12759 - DNA, 22 bp, Artificial Sequence
  Synthetic Construct
tctaggaccaggagccatcaga

SEQ ID NO: 12760 - DNA, 23 bp, Artificial Sequence
  Synthetic Construct
cgaggggtctttgaggcaaactt

SEQ ID NO: 12761 - DNA, 26 bp, Artificial Sequence
  Synthetic Construct
tccccacctctctttctttagagtat

SEQ ID NO: 12762 - DNA, 21 bp, Artificial Sequence
  Synthetic Construct
ccaggaaagccaccaatgcaa

SEQ ID NO: 12763 - DNA, 26 bp, Artificial Sequence
  Synthetic Construct
gggctgatataatggaggcagcttag

SEQ ID NO: 12764 - DNA, 22 bp, Artificial Sequence
  Synthetic Construct
gccctgtcctgactgacattct

SEQ ID NO: 12765 - DNA, 26 bp, Artificial Sequence
  Synthetic Construct
tctttggccacacagatttactctac

SEQ ID NO: 12766 - DNA, 22 bp, Artificial Sequence
  Synthetic Construct
cagagtaggtgtgccgtaggaa

SEQ ID NO: 12767 - DNA, 23 bp, Artificial Sequence
  Synthetic Construct
cgctgtctctccatccaagtgtt

SEQ ID NO: 12768 - DNA, 24 bp, Artificial Sequence
  Synthetic Construct
cggagccttggagctaggtgatta

SEQ ID NO: 12769 - DNA, 25 bp, Artificial Sequence
  Synthetic Construct
cagggttcctagctctttcctgttc

SEQ ID NO: 12770 - DNA, 24 bp, Artificial Sequence
  Synthetic Construct
cattcccaaatggatgtggctaga

SEQ ID NO: 12771 - DNA, 21 bp, Artificial Sequence
  Synthetic Construct
gctccactttcgccctcactt

SEQ ID NO: 12772 - DNA, 24 bp, Artificial Sequence
  Synthetic Construct
ctttgctcttgtctgcactgagta

SEQ ID NO: 12773 - DNA, 19 bp, Artificial Sequence
  Synthetic Construct
ttgagctgtgcaggcttgt

SEQ ID NO: 12774 - DNA, 23 bp, Artificial Sequence
  Synthetic Construct
tgtggctactttcccacagtttg

SEQ ID NO: 12775 - DNA, 24 bp, Artificial Sequence
  Synthetic Construct
caaaggacaatcacagagctgttc

SEQ ID NO: 12776 - DNA, 25 bp, Artificial Sequence
  Synthetic Construct
ggaatggaccaagtttgtcttgatt

SEQ ID NO: 12777 - DNA, 20 bp, Artificial Sequence
  Synthetic Construct
tggatgtggcccgcatttgt

SEQ ID NO: 12778 - DNA, 23 bp, Artificial Sequence
  Synthetic Construct
cccctgccccaaatagcatttta

SEQ ID NO: 12779 - DNA, 22 bp, Artificial Sequence
  Synthetic Construct
accaagcactggggaaactaaa

SEQ ID NO: 12780 - DNA, 19 bp, Artificial Sequence
  Synthetic Construct
ggcatgctccgcaccaaga

SEQ ID NO: 12781 - DNA, 22 bp, Artificial Sequence
  Synthetic Construct
caggccatgtaaacgactctca

SEQ ID NO: 12782 - DNA, 23 bp, Artificial Sequence
  Synthetic Construct
tgctgaatggtttgctcagtttg

SEQ ID NO: 12783 - DNA, 24 bp, Artificial Sequence
  Synthetic Construct
tcgagtcacttacctgctcaaatg

SEQ ID NO: 12784 - DNA, 20 bp, Artificial Sequence
  Synthetic Construct
agcaagcgacggtcctccat

SEQ ID NO: 12785 - DNA, 22 bp, Artificial Sequence
  Synthetic Construct
acctgcagaactgaggctctct

SEQ ID NO: 12786 - DNA, 21 bp, Artificial Sequence
  Synthetic Construct
agtgtcaggaggggaaacgaa

SEQ ID NO: 12787 - DNA, 25 bp, Artificial Sequence
  Synthetic Construct
ccactccttcccttatacccttgta

SEQ ID NO: 12788 - DNA, 21 bp, Artificial Sequence
  Synthetic Construct
gcaaagattgctgcccgttca

SEQ ID NO: 12789 - DNA, 24 bp, Artificial Sequence
  Synthetic Construct
tggacaagaatggagaaagacgtt

SEQ ID NO: 12790 - DNA, 22 bp, Artificial Sequence
  Synthetic Construct
gcctttcccaggactcaacagt

SEQ ID NO: 12791 - DNA, 24 bp, Artificial Sequence
  Synthetic Construct
ctgctttgaggcagataggagctt

SEQ ID NO: 12792 - DNA, 22 bp, Artificial Sequence
  Synthetic Construct
cctgcacaaagtggctgtcaac

SEQ ID NO: 12793 - DNA, 25 bp, Artificial Sequence
  Synthetic Construct
gcaggaaaccacaaaacatcaccta

SEQ ID NO: 12794 - DNA, 26 bp, Artificial Sequence
  Synthetic Construct
gctttctctcccctaggacatacagt

SEQ ID NO: 12795 - DNA, 20 bp, Artificial Sequence
  Synthetic Construct
agcctggctccctacacatt

SEQ ID NO: 12796 - DNA, 21 bp, Artificial Sequence
  Synthetic Construct
tgctattggggcattggtgtt

SEQ ID NO: 12797 - DNA, 20 bp, Artificial Sequence
  Synthetic Construct
tgcatcccgttgctgtcaag

SEQ ID NO: 12798 - DNA, 23 bp, Artificial Sequence
  Synthetic Construct
gacctgtgtccctttgtccttag

SEQ ID NO: 12799 - DNA, 24 bp, Artificial Sequence
  Synthetic Construct
cctttgcccttccagagtctcctt

SEQ ID NO: 12800 - DNA, 23 bp, Artificial Sequence
  Synthetic Construct
gcctggtactctcccagttttag

SEQ ID NO: 12801 - DNA, 24 bp, Artificial Sequence
  Synthetic Construct
gggaccagtcaactttgccagatt

SEQ ID NO: 12802 - DNA, 24 bp, Artificial Sequence
  Synthetic Construct
attcccattcctaaaagccgtgta

SEQ ID NO: 12803 - DNA, 20 bp, Artificial Sequence
  Synthetic Construct
tccaggcacgcacctctgat

SEQ ID NO: 12804 - DNA, 22 bp, Artificial Sequence
  Synthetic Construct
ggcaggcatctgtgcagtcatt

SEQ ID NO: 12805 - DNA, 21 bp, Artificial Sequence
  Synthetic Construct
tgccgacataaccccttcctt

SEQ ID NO: 12806 - DNA, 22 bp, Artificial Sequence
  Synthetic Construct
cgccaatctcagtggttggaat

SEQ ID NO: 12807 - DNA, 25 bp, Artificial Sequence
  Synthetic Construct
cggagcaacttggcatgttaataca

SEQ ID NO: 12808 - DNA, 22 bp, Artificial Sequence
  Synthetic Construct
gtggcagcctttctgtagttga

SEQ ID NO: 12809 - DNA, 25 bp, Artificial Sequence
  Synthetic Construct
gctcgttaagaattagccccacatc

SEQ ID NO: 12810 - DNA, 23 bp, Artificial Sequence
  Synthetic Construct
caccagctagaacctcctgtagt

SEQ ID NO: 12811 - DNA, 18 bp, Artificial Sequence
  Synthetic Construct
gctgctttgcgggacctt

SEQ ID NO: 12812 - DNA, 24 bp, Artificial Sequence
  Synthetic Construct
ggcaggagtcagtgacaagtggta

SEQ ID NO: 12813 - DNA, 25 bp, Artificial Sequence
  Synthetic Construct
tgtgtcaagcagatttgaagctaac

SEQ ID NO: 12814 - DNA, 22 bp, Artificial Sequence
  Synthetic Construct
tgcacattccttccttggtgat

SEQ ID NO: 12815 - DNA, 19 bp, Artificial Sequence
  Synthetic Construct
cctgcattgcaagccgttt

SEQ ID NO: 12816 - DNA, 21 bp, Artificial Sequence
  Synthetic Construct
acctgcctgtgtggtatggaa

SEQ ID NO: 12817 - DNA, 25 bp, Artificial Sequence
  Synthetic Construct
gagccgaatgttcacttatggagtt

SEQ ID NO: 12818 - DNA, 24 bp, Artificial Sequence
  Synthetic Construct
ctgaagcctaatggggatccagaa

SEQ ID NO: 12819 - DNA, 24 bp, Artificial Sequence
  Synthetic Construct
aaatagctgtcccattctggttgt

SEQ ID NO: 12820 - DNA, 21 bp, Artificial Sequence
  Synthetic Construct
tccccggatttccacagtagt

SEQ ID NO: 12821 - DNA, 27 bp, Artificial Sequence
  Synthetic Construct
gggtaggatgcatgagaagaactggat

SEQ ID NO: 12822 - DNA, 25 bp, Artificial Sequence
  Synthetic Construct
gccagctgaggaactattagacact

SEQ ID NO: 12823 - DNA, 23 bp, Artificial Sequence
  Synthetic Construct
ctgcagatctagccaatgaggtt

SEQ ID NO: 12824 - DNA, 25 bp, Artificial Sequence
  Synthetic Construct
ggccaagattttggtgttcaagtag

SEQ ID NO: 12825 - DNA, 20 bp, Artificial Sequence
  Synthetic Construct
acagctgcgaatggcctaat

SEQ ID NO: 12826 - DNA, 24 bp, Artificial Sequence
  Synthetic Construct
gatctcatggctacggagatcaag

SEQ ID NO: 12827 - DNA, 25 bp, Artificial Sequence
  Synthetic Construct
cctcctgggaaactggcaagtaaag

SEQ ID NO: 12828 - DNA, 24 bp, Artificial Sequence
  Synthetic Construct
gtacatggttatggctaccaggaa

SEQ ID NO: 12829 - DNA, 20 bp, Artificial Sequence
  Synthetic Construct
tggtcagtgctcccagagtt

SEQ ID NO: 12830 - DNA, 20 bp, Artificial Sequence
  Synthetic Construct
cgcacatgtctcgtgtcact

SEQ ID NO: 12831 - DNA, 21 bp, Artificial Sequence
  Synthetic Construct
accactgacaaacctgtgcat

SEQ ID NO: 12832 - DNA, 26 bp, Artificial Sequence
  Synthetic Construct
cagggatgaataagcctcatgaaaga

SEQ ID NO: 12833 - DNA, 24 bp, Artificial Sequence
  Synthetic Construct
actgcaacactgtgattgtcttca

SEQ ID NO: 12834 - DNA, 20 bp, Artificial Sequence
  Synthetic Construct
ttggctccccagagtgttgt

SEQ ID NO: 12835 - DNA, 24 bp, Artificial Sequence
  Synthetic Construct
cagtcgaaagagtggaaaggatga

SEQ ID NO: 12836 - DNA, 21 bp, Artificial Sequence
  Synthetic Construct
tgaagcatctggcctgtctga

SEQ ID NO: 12837 - DNA, 20 bp, Artificial Sequence
  Synthetic Construct
ttcggggtgcatcctcacat

SEQ ID NO: 12838 - DNA, 22 bp, Artificial Sequence
  Synthetic Construct
catccacagctgtctccgtgta

SEQ ID NO: 12839 - DNA, 25 bp, Artificial Sequence
  Synthetic Construct
ttccaggttgttttctgcaaagtag

SEQ ID NO: 12840 - DNA, 26 bp, Artificial Sequence
  Synthetic Construct
tcccagagacacagctagttaaaaac

SEQ ID NO: 12841 - DNA, 21 bp, Artificial Sequence
  Synthetic Construct
tgctgctcgtacagtggaaag

SEQ ID NO: 12842 - DNA, 25 bp, Artificial Sequence
  Synthetic Construct
ggagcagtatcattttggtgcattg

SEQ ID NO: 12843 - DNA, 22 bp, Artificial Sequence
  Synthetic Construct
cggtggtgcctttgttttaact

SEQ ID NO: 12844 - DNA, 25 bp, Artificial Sequence
  Synthetic Construct
ggagaaggaatgtcaggaagcaaac

SEQ ID NO: 12845 - DNA, 21 bp, Artificial Sequence
  Synthetic Construct
agtaggtgtgatggccaggat

SEQ ID NO: 12846 - DNA, 23 bp, Artificial Sequence
  Synthetic Construct
tgtcttcctagcctcatctctca

SEQ ID NO: 12847 - DNA, 24 bp, Artificial Sequence
  Synthetic Construct
gctaggggatactgagtcctgcat

SEQ ID NO: 12848 - DNA, 22 bp, Artificial Sequence
  Synthetic Construct
cccaaagagtccccatctggtt

SEQ ID NO: 12849 - DNA, 20 bp, Artificial Sequence
  Synthetic Construct
agacctaggcggcaaacaaa

SEQ ID NO: 12850 - DNA, 25 bp, Artificial Sequence
  Synthetic Construct
agtttcctggaagccagctattaaa

SEQ ID NO: 12851 - DNA, 22 bp, Artificial Sequence
  Synthetic Construct
cgtaagcataggggctgcagta

SEQ ID NO: 12852 - DNA, 25 bp, Artificial Sequence
  Synthetic Construct
gcagttgagggagttcaactaaaga

SEQ ID NO: 12853 - DNA, 23 bp, Artificial Sequence
  Synthetic Construct
cctaggctagaagcccagaaaac

SEQ ID NO: 12854 - DNA, 23 bp, Artificial Sequence
  Synthetic Construct
ccttccctttgtcacaccacatc

SEQ ID NO: 12855 - DNA, 24 bp, Artificial Sequence
  Synthetic Construct
cctgtgttcaggaagaatgaggat

SEQ ID NO: 12856 - DNA, 26 bp, Artificial Sequence
  Synthetic Construct
gaaggaaactgactttgcagcttaac

SEQ ID NO: 12857 - DNA, 24 bp, Artificial Sequence
  Synthetic Construct
agggagaaaatcacactcttgcat

SEQ ID NO: 12858 - DNA, 21 bp, Artificial Sequence
  Synthetic Construct
ggggacgaagtcaaggtgtag

SEQ ID NO: 12859 - DNA, 25 bp, Artificial Sequence
  Synthetic Construct
ccagagaaaacagagggcattggtt

SEQ ID NO: 12860 - DNA, 21 bp, Artificial Sequence
  Synthetic Construct
tggtccccaggtttggatttc

SEQ ID NO: 12861 - DNA, 26 bp, Artificial Sequence
  Synthetic Construct
gaaagtacaggctatagctgatggat

SEQ ID NO: 12862 - DNA, 20 bp, Artificial Sequence
  Synthetic Construct
gggccattgtgctggtctct

SEQ ID NO: 12863 - DNA, 24 bp, Artificial Sequence
  Synthetic Construct
ctgtgaaaactgggactagcaaag

SEQ ID NO: 12864 - DNA, 25 bp, Artificial Sequence
  Synthetic Construct
ctccttgtaatcccagtgagagaaa

SEQ ID NO: 12865 - DNA, 23 bp, Artificial Sequence
  Synthetic Construct
gggtgggagcagaaagtatgttg

SEQ ID NO: 12866 - DNA, 20 bp, Artificial Sequence
  Synthetic Construct
acaagaacgcagagctgtca

SEQ ID NO: 12867 - DNA, 23 bp, Artificial Sequence
  Synthetic Construct
tggagtctgctccagtagctaag

SEQ ID NO: 12868 - DNA, 22 bp, Artificial Sequence
  Synthetic Construct
gtccacagtgagtgtctggaaa

SEQ ID NO: 12869 - DNA, 22 bp, Artificial Sequence
  Synthetic Construct
tgcctggccctatagcttggta

SEQ ID NO: 12870 - DNA, 21 bp, Artificial Sequence
  Synthetic Construct
tcttgggattctggggctttc

SEQ ID NO: 12871 - DNA, 19 bp, Artificial Sequence
  Synthetic Construct
cgtctgcgccgagaccttt

SEQ ID NO: 12872 - DNA, 20 bp, Artificial Sequence
  Synthetic Construct
ggcctgtcatctcagcatgt

SEQ ID NO: 12873 - DNA, 24 bp, Artificial Sequence
  Synthetic Construct
gaggagtcctaactgcagggatac

SEQ ID NO: 12874 - DNA, 25 bp, Artificial Sequence
  Synthetic Construct
ggctgagtttctttgtggcatgtaa

SEQ ID NO: 12875 - DNA, 27 bp, Artificial Sequence
  Synthetic Construct
gacccttgcatagttagaagagtggtt

SEQ ID NO: 12876 - DNA, 29 bp, Artificial Sequence
  Synthetic Construct
gccctaaataacctctactcacgggattt

SEQ ID NO: 12877 - DNA, 20 bp, Artificial Sequence
  Synthetic Construct
acccagtgctttggtgttca

SEQ ID NO: 12878 - DNA, 22 bp, Artificial Sequence
  Synthetic Construct
gccccatccatgacttggtgaa

SEQ ID NO: 12879 - DNA, 19 bp, Artificial Sequence
  Synthetic Construct
ggggcctggggtcaaagaa

SEQ ID NO: 12880 - DNA, 22 bp, Artificial Sequence
  Synthetic Construct
gccaagaacctaccctgcattg

SEQ ID NO: 12881 - DNA, 20 bp, Artificial Sequence
  Synthetic Construct
ttccctggccctgtttctct

SEQ ID NO: 12882 - DNA, 23 bp, Artificial Sequence
  Synthetic Construct
cccactttgctggtctatagctt

SEQ ID NO: 12883 - DNA, 21 bp, Artificial Sequence
  Synthetic Construct
cctgagcatgtggtgtggttt

SEQ ID NO: 12884 - DNA, 23 bp, Artificial Sequence
  Synthetic Construct
cctcaaaatgggagccagcgata

SEQ ID NO: 12885 - DNA, 27 bp, Artificial Sequence
  Synthetic Construct
gacatagggaaaagtgtgtctacttca

SEQ ID NO: 12886 - DNA, 26 bp, Artificial Sequence
  Synthetic Construct
agatctcaaggtaggaatgtgtctca

SEQ ID NO: 12887 - DNA, 24 bp, Artificial Sequence
  Synthetic Construct
ggcaggtagaaaggcacaccctat

SEQ ID NO: 12888 - DNA, 22 bp, Artificial Sequence
  Synthetic Construct
tgactccagctccagggttaca

SEQ ID NO: 12889 - DNA, 20 bp, Artificial Sequence
  Synthetic Construct
aggcaacgggacacaccatt

SEQ ID NO: 12890 - DNA, 25 bp, Artificial Sequence
  Synthetic Construct
cagggataccatggagaagttggta

SEQ ID NO: 12891 - DNA, 24 bp, Artificial Sequence
  Synthetic Construct
aaatgactgcttccttcactgaga

SEQ ID NO: 12892 - DNA, 25 bp, Artificial Sequence
  Synthetic Construct
gtatcccatgtcccattacttctgt

SEQ ID NO: 12893 - DNA, 19 bp, Artificial Sequence
  Synthetic Construct
tcgcaggggttgcctcagt

SEQ ID NO: 12894 - DNA, 23 bp, Artificial Sequence
  Synthetic Construct
caagacagagtgtgggcaatcaa

SEQ ID NO: 12895 - DNA, 19 bp, Artificial Sequence
  Synthetic Construct
tgtccatggccacctctgt

SEQ ID NO: 12896 - DNA, 25 bp, Artificial Sequence
  Synthetic Construct
tgctgatcaagccaaaatctaccat

SEQ ID NO: 12897 - DNA, 24 bp, Artificial Sequence
  Synthetic Construct
ccatcattcctggcacagggtttg

SEQ ID NO: 12898 - DNA, 24 bp, Artificial Sequence
  Synthetic Construct
gcaactccagccaaacatcttttc

SEQ ID NO: 12899 - DNA, 25 bp, Artificial Sequence
  Synthetic Construct
cagcagtatcacctccattttgcta

SEQ ID NO: 12900 - DNA, 22 bp, Artificial Sequence
  Synthetic Construct
ccagctcacattggcagcgatt

SEQ ID NO: 12901 - DNA, 20 bp, Artificial Sequence
  Synthetic Construct
aggggcagcaccttacttca

SEQ ID NO: 12902 - DNA, 22 bp, Artificial Sequence
  Synthetic Construct
cagagcgcaggcatgcttattg

SEQ ID NO: 12903 - DNA, 24 bp, Artificial Sequence
  Synthetic Construct
tttacccaaccttcacgcttagat

SEQ ID NO: 12904 - DNA, 25 bp, Artificial Sequence
  Synthetic Construct
gagcctaagaggcatattggcattg

SEQ ID NO: 12905 - DNA, 22 bp, Artificial Sequence
  Synthetic Construct
ccccaaaggagtcactctggtt

SEQ ID NO: 12906 - DNA, 20 bp, Artificial Sequence
  Synthetic Construct
ggaagtgcgtggagcacaga

SEQ ID NO: 12907 - DNA, 22 bp, Artificial Sequence
  Synthetic Construct
ggagatgctgatgcgtccttag

SEQ ID NO: 12908 - DNA, 24 bp, Artificial Sequence
  Synthetic Construct
ggtctcaattctggcacactatca

SEQ ID NO: 12909 - DNA, 22 bp, Artificial Sequence
  Synthetic Construct
gcatgaggctgttttcccatgt

SEQ ID NO: 12910 - DNA, 23 bp, Artificial Sequence
  Synthetic Construct
caggaccatgcttcctctgaaac

SEQ ID NO: 12911 - DNA, 21 bp, Artificial Sequence
  Synthetic Construct
gatgctgcaggacagcaatca

SEQ ID NO: 12912 - DNA, 24 bp, Artificial Sequence
  Synthetic Construct
gcccataaaggactctctctccat

SEQ ID NO: 12913 - DNA, 21 bp, Artificial Sequence
  Synthetic Construct
cccgcttgatcttgggaaagt

SEQ ID NO: 12914 - DNA, 21 bp, Artificial Sequence
  Synthetic Construct
acacctcaacacggcgactct

SEQ ID NO: 12915 - DNA, 25 bp, Artificial Sequence
  Synthetic Construct
gttggtgacagaagtgatctaggaa

SEQ ID NO: 12916 - DNA, 19 bp, Artificial Sequence
  Synthetic Construct
gccactgggacgcctgttt

SEQ ID NO: 12917 - DNA, 21 bp, Artificial Sequence
  Synthetic Construct
ctgagagtgggcatgcattgt

SEQ ID NO: 12918 - DNA, 22 bp, Artificial Sequence
  Synthetic Construct
ggaacaaaaatgcgtggtcaga

SEQ ID NO: 12919 - DNA, 23 bp, Artificial Sequence
  Synthetic Construct
ctgtccttcccctcctgacatct

SEQ ID NO: 12920 - DNA, 20 bp, Artificial Sequence
  Synthetic Construct
tgtcctcctgggtggtgagt

SEQ ID NO: 12921 - DNA, 19 bp, Artificial Sequence
  Synthetic Construct
agggcggtgagggtgttga

SEQ ID NO: 12922 - DNA, 23 bp, Artificial Sequence
  Synthetic Construct
acccatgacttctggttccaaat

SEQ ID NO: 12923 - DNA, 22 bp, Artificial Sequence
  Synthetic Construct
gagggaaagttggccctcatca

SEQ ID NO: 12924 - DNA, 27 bp, Artificial Sequence
  Synthetic Construct
ccctactgcttttgtcttaactgagaa

SEQ ID NO: 12925 - DNA, 24 bp, Artificial Sequence
  Synthetic Construct
gctcagcaatactgcagttaggaa

SEQ ID NO: 12926 - DNA, 19 bp, Artificial Sequence
  Synthetic Construct
gtggtaggggcgtctcact

SEQ ID NO: 12927 - DNA, 20 bp, Artificial Sequence
  Synthetic Construct
ctgctggctgctcaaagcta

SEQ ID NO: 12928 - DNA, 25 bp, Artificial Sequence
  Synthetic Construct
caagacatccaccatcagacagcta

SEQ ID NO: 12929 - DNA, 21 bp, Artificial Sequence
  Synthetic Construct
ggcagacaccgagcatctaca

SEQ ID NO: 12930 - DNA, 26 bp, Artificial Sequence
  Synthetic Construct
caaggaccatatgtaacctaccatca

SEQ ID NO: 12931 - DNA, 22 bp, Artificial Sequence
  Synthetic Construct
ccgcttttgctcctcacacatc

SEQ ID NO: 12932 - DNA, 24 bp, Artificial Sequence
  Synthetic Construct
ggaacaaaaatggctcttggacat

SEQ ID NO: 12933 - DNA, 20 bp, Artificial Sequence
  Synthetic Construct
ccgtggtttcctcacaccat

SEQ ID NO: 12934 - DNA, 20 bp, Artificial Sequence
  Synthetic Construct
tgcgcttccaaactccagaa

SEQ ID NO: 12935 - DNA, 25 bp, Artificial Sequence
  Synthetic Construct
cgtgtccgttcctctaggtcattag

SEQ ID NO: 12936 - DNA, 23 bp, Artificial Sequence
  Synthetic Construct
tgtctggaacacctaaggactca

SEQ ID NO: 12937 - DNA, 26 bp, Artificial Sequence
  Synthetic Construct
ccccttttcctaaagcagaatgatgt

SEQ ID NO: 12938 - DNA, 21 bp, Artificial Sequence
  Synthetic Construct
cggtaaccgggaaaactcaga

SEQ ID NO: 12939 - DNA, 21 bp, Artificial Sequence
  Synthetic Construct
tctgctagccactggacttca

SEQ ID NO: 12940 - DNA, 22 bp, Artificial Sequence
  Synthetic Construct
cacctggcaggaatgatggttt

SEQ ID NO: 12941 - DNA, 24 bp, Artificial Sequence
  Synthetic Construct
gggcttcattcatcacatgactct

SEQ ID NO: 12942 - DNA, 26 bp, Artificial Sequence
  Synthetic Construct
gcagaaatgttcccatgtgcttgaaa

SEQ ID NO: 12943 - DNA, 24 bp, Artificial Sequence
  Synthetic Construct
caggctgaaggagagtttccaatc

SEQ ID NO: 12944 - DNA, 20 bp, Artificial Sequence
  Synthetic Construct
caacgtgccgcattgtgttg

SEQ ID NO: 12945 - DNA, 20 bp, Artificial Sequence
  Synthetic Construct
gcaacagcctgcagatggat

SEQ ID NO: 12946 - DNA, 22 bp, Artificial Sequence
  Synthetic Construct
ctcctccaccttttgctacagt

SEQ ID NO: 12947 - DNA, 24 bp, Artificial Sequence
  Synthetic Construct
gagggaacgatagctttgcagtta

SEQ ID NO: 12948 - DNA, 27 bp, Artificial Sequence
  Synthetic Construct
caagttctattctgcaggtgtcttttg

SEQ ID NO: 12949 - DNA, 24 bp, Artificial Sequence
  Synthetic Construct
catagggcagtagcagtgagattt

SEQ ID NO: 12950 - DNA, 21 bp, Artificial Sequence
  Synthetic Construct
ccgatcaggcgtctgtcttgt

SEQ ID NO: 12951 - DNA, 23 bp, Artificial Sequence
  Synthetic Construct
gtccttcagactgtccgttttca

SEQ ID NO: 12952 - DNA, 21 bp, Artificial Sequence
  Synthetic Construct
agtgctgtgggctggagttga

SEQ ID NO: 12953 - DNA, 21 bp, Artificial Sequence
  Synthetic Construct
ccattgggcaggttccacatc

SEQ ID NO: 12954 - DNA, 25 bp, Artificial Sequence
  Synthetic Construct
cacataggaaggactggaagctatg

SEQ ID NO: 12955 - DNA, 22 bp, Artificial Sequence
  Synthetic Construct
taggggcatgctgtagctctga

SEQ ID NO: 12956 - DNA, 22 bp, Artificial Sequence
  Synthetic Construct
cagccacaccaaattgctggtt

SEQ ID NO: 12957 - DNA, 24 bp, Artificial Sequence
  Synthetic Construct
ctggcacaacggtgtttttagtgt

SEQ ID NO: 12958 - DNA, 21 bp, Artificial Sequence
  Synthetic Construct
gcccacagtatcctggactga

SEQ ID NO: 12959 - DNA, 27 bp, Artificial Sequence
  Synthetic Construct
ggcttagttgtaagggctttaggatca

SEQ ID NO: 12960 - DNA, 24 bp, Artificial Sequence
  Synthetic Construct
ggcagacgggtttagtcttcaagt

SEQ ID NO: 12961 - DNA, 23 bp, Artificial Sequence
  Synthetic Construct
tgcacatcatccattgcaagaac

SEQ ID NO: 12962 - DNA, 23 bp, Artificial Sequence
  Synthetic Construct
gaggtaaatgggtcaagcacact

SEQ ID NO: 12963 - DNA, 21 bp, Artificial Sequence
  Synthetic Construct
tgggtaggccctaatggactt

SEQ ID NO: 12964 - DNA, 22 bp, Artificial Sequence
  Synthetic Construct
tcggcctctgactggtgaatgt

SEQ ID NO: 12965 - DNA, 24 bp, Artificial Sequence
  Synthetic Construct
gtgagaggctggtagcaaggtaga

SEQ ID NO: 12966 - DNA, 21 bp, Artificial Sequence
  Synthetic Construct
cccgaaatccaaaggcaggaa

SEQ ID NO: 12967 - DNA, 23 bp, Artificial Sequence
  Synthetic Construct
ggttggttcatgccctttgtact

SEQ ID NO: 12968 - DNA, 21 bp, Artificial Sequence
  Synthetic Construct
caccttcattgcagcgtgtga

SEQ ID NO: 12969 - DNA, 20 bp, Artificial Sequence
  Synthetic Construct
tggccttgttggtcctcagt

SEQ ID NO: 12970 - DNA, 23 bp, Artificial Sequence
  Synthetic Construct
gggttgaacttgactgggtggtt

SEQ ID NO: 12971 - DNA, 20 bp, Artificial Sequence
  Synthetic Construct
agctgaatgctgccagttgt

SEQ ID NO: 12972 - DNA, 25 bp, Artificial Sequence
  Synthetic Construct
gccgaaaggaaagcatgagtcatca

SEQ ID NO: 12973 - DNA, 26 bp, Artificial Sequence
  Synthetic Construct
ctttccctgcatttttgacacctaac

SEQ ID NO: 12974 - DNA, 23 bp, Artificial Sequence
  Synthetic Construct
cctcactttgttccccaaagaca

SEQ ID NO: 12975 - DNA, 24 bp, Artificial Sequence
  Synthetic Construct
gcatcattctgcctgggtttgaag

SEQ ID NO: 12976 - DNA, 27 bp, Artificial Sequence
  Synthetic Construct
gtgaaacaagcagtaagtgtgggatga

SEQ ID NO: 12977 - DNA, 22 bp, Artificial Sequence
  Synthetic Construct
gagtgtgaccgagacaggatgt

SEQ ID NO: 12978 - DNA, 20 bp, Artificial Sequence
  Synthetic Construct
gcttgaccaggcagctttga

SEQ ID NO: 12979 - DNA, 19 bp, Artificial Sequence
  Synthetic Construct
gcccacatgccacccacta

SEQ ID NO: 12980 - DNA, 21 bp, Artificial Sequence
  Synthetic Construct
gggacacaggctgtagtgtca

SEQ ID NO: 12981 - DNA, 22 bp, Artificial Sequence
  Synthetic Construct
gcctactcaccttcaagctcaa

SEQ ID NO: 12982 - DNA, 21 bp, Artificial Sequence
  Synthetic Construct
aatgcctgaagtggctgatgt

SEQ ID NO: 12983 - DNA, 22 bp, Artificial Sequence
  Synthetic Construct
ggacatggtgacattccacagt

SEQ ID NO: 12984 - DNA, 23 bp, Artificial Sequence
  Synthetic Construct
gtcttcccacaatgtcaggcttt

SEQ ID NO: 12985 - DNA, 24 bp, Artificial Sequence
  Synthetic Construct
gctcagccttcatgtgacctggat

SEQ ID NO: 12986 - DNA, 21 bp, Artificial Sequence
  Synthetic Construct
tacggacagagcccggtaatc

SEQ ID NO: 12987 - DNA, 24 bp, Artificial Sequence
  Synthetic Construct
tcctcataggatggcatctctcaa

SEQ ID NO: 12988 - DNA, 22 bp, Artificial Sequence
  Synthetic Construct
ggatgagcccaaagcacacaga

SEQ ID NO: 12989 - DNA, 22 bp, Artificial Sequence
  Synthetic Construct
aagcttgccatcatggtgtact

SEQ ID NO: 12990 - DNA, 21 bp, Artificial Sequence
  Synthetic Construct
cccaccacacccagaacacaa

SEQ ID NO: 12991 - DNA, 20 bp, Artificial Sequence
  Synthetic Construct
cccaaagtggctcccaaaga

SEQ ID NO: 12992 - DNA, 24 bp, Artificial Sequence
  Synthetic Construct
gttggaaaaggagggaaagacaga

SEQ ID NO: 12993 - DNA, 24 bp, Artificial Sequence
  Synthetic Construct
ggggtaggcagtttttcctgtgat

SEQ ID NO: 12994 - DNA, 22 bp, Artificial Sequence
  Synthetic Construct
agtaccccatggcactggaaga

SEQ ID NO: 12995 - DNA, 21 bp, Artificial Sequence
  Synthetic Construct
tgagctgggatagccccagaa

SEQ ID NO: 12996 - DNA, 23 bp, Artificial Sequence
  Synthetic Construct
cagctcgttcctgtccaatccat

SEQ ID NO: 12997 - DNA, 28 bp, Artificial Sequence
  Synthetic Construct
ggtagtggagtaggtaaaagggtactgt

SEQ ID NO: 12998 - DNA, 23 bp, Artificial Sequence
  Synthetic Construct
tgccgtgagaactaatcaaggtt

SEQ ID NO: 12999 - DNA, 25 bp, Artificial Sequence
  Synthetic Construct
cttcatgtgccatgagactttcctt

SEQ ID NO: 13000 - DNA, 23 bp, Artificial Sequence
  Synthetic Construct
agggtgggacatggcaaataaag

SEQ ID NO: 13001 - DNA, 27 bp, Artificial Sequence
  Synthetic Construct
gagttgacgcctgtaacatcaatttca

SEQ ID NO: 13002 - DNA, 21 bp, Artificial Sequence
  Synthetic Construct
agggtgtccgtggtgtagcaa

SEQ ID NO: 13003 - DNA, 25 bp, Artificial Sequence
  Synthetic Construct
cacttccaagatgaccattctctgt

SEQ ID NO: 13004 - DNA, 23 bp, Artificial Sequence
  Synthetic Construct
gctggagggtagagagtcctgtt

SEQ ID NO: 13005 - DNA, 22 bp, Artificial Sequence
  Synthetic Construct
ttgcttcgagcttggggtcatc

SEQ ID NO: 13006 - DNA, 23 bp, Artificial Sequence
  Synthetic Construct
gggcccagctctgaactatcctt

SEQ ID NO: 13007 - DNA, 22 bp, Artificial Sequence
  Synthetic Construct
gccatcttctcactggttccaa

SEQ ID NO: 13008 - DNA, 22 bp, Artificial Sequence
  Synthetic Construct
gtgccaggttgtagcagagaag

SEQ ID NO: 13009 - DNA, 23 bp, Artificial Sequence
  Synthetic Construct
tgtaggttgtcaggaggaagtca

SEQ ID NO: 13010 - DNA, 22 bp, Artificial Sequence
  Synthetic Construct
agcccttcttggtggaagttac

SEQ ID NO: 13011 - DNA, 20 bp, Artificial Sequence
  Synthetic Construct
tcccaaccactgccatcctt

SEQ ID NO: 13012 - DNA, 20 bp, Artificial Sequence
  Synthetic Construct
gcaggagtgggtcgaagatg

SEQ ID NO: 13013 - DNA, 22 bp, Artificial Sequence
  Synthetic Construct
ccccacaaaaagcaaaccaaga

SEQ ID NO: 13014 - DNA, 21 bp, Artificial Sequence
  Synthetic Construct
tctgcaggaagtgctgtctct

SEQ ID NO: 13015 - DNA, 22 bp, Artificial Sequence
  Synthetic Construct
ctcaatgctgcgaaggcgaatc

SEQ ID NO: 13016 - DNA, 25 bp, Artificial Sequence
  Synthetic Construct
ggagttcaaagctgctgggattagt

SEQ ID NO: 13017 - DNA, 23 bp, Artificial Sequence
  Synthetic Construct
ggtactccattgcttccggtact

SEQ ID NO: 13018 - DNA, 22 bp, Artificial Sequence
  Synthetic Construct
ccagtcatcctccgtgtctgat

SEQ ID NO: 13019 - DNA, 24 bp, Artificial Sequence
  Synthetic Construct
ccaaccctcctagtgatgcagtat

SEQ ID NO: 13020 - DNA, 20 bp, Artificial Sequence
  Synthetic Construct
acagcacttcacctgcatga

SEQ ID NO: 13021 - DNA, 26 bp, Artificial Sequence
  Synthetic Construct
caacaggatgtatctcaaccaagtca

SEQ ID NO: 13022 - DNA, 20 bp, Artificial Sequence
  Synthetic Construct
tccccattccaccccaccaa

SEQ ID NO: 13023 - DNA, 22 bp, Artificial Sequence
  Synthetic Construct
cggggattgtcatccaggttgt

SEQ ID NO: 13024 - DNA, 23 bp, Artificial Sequence
  Synthetic Construct
cgttctcacggaagacaacttct

SEQ ID NO: 13025 - DNA, 23 bp, Artificial Sequence
  Synthetic Construct
ctctgtcacaaccactccattct

SEQ ID NO: 13026 - DNA, 24 bp, Artificial Sequence
  Synthetic Construct
gttcccagaatgaattcccacgta

SEQ ID NO: 13027 - DNA, 21 bp, Artificial Sequence
  Synthetic Construct
aaggacctgcccctcctcagt

SEQ ID NO: 13028 - DNA, 26 bp, Artificial Sequence
  Synthetic Construct
cctatcaaaaagatgaggcactggaa

SEQ ID NO: 13029 - DNA, 24 bp, Artificial Sequence
  Synthetic Construct
gactgttacctcgggattgctttg

SEQ ID NO: 13030 - DNA, 22 bp, Artificial Sequence
  Synthetic Construct
gggaaggttggggtgttcattg

SEQ ID NO: 13031 - DNA, 24 bp, Artificial Sequence
  Synthetic Construct
ccccagcttattgccaggagagtt

SEQ ID NO: 13032 - DNA, 22 bp, Artificial Sequence
  Synthetic Construct
gccaggattgaagcccaagtca

SEQ ID NO: 13033 - DNA, 25 bp, Artificial Sequence
  Synthetic Construct
tccatgcactagtggttttcttaca

SEQ ID NO: 13034 - DNA, 24 bp, Artificial Sequence
  Synthetic Construct
cctttctaacagactctggctcaa

SEQ ID NO: 13035 - DNA, 20 bp, Artificial Sequence
  Synthetic Construct
agcactgtgccatcctgtga

SEQ ID NO: 13036 - DNA, 24 bp, Artificial Sequence
  Synthetic Construct
gctgcctgagctgaatttcaaaac

SEQ ID NO: 13037 - DNA, 20 bp, Artificial Sequence
  Synthetic Construct
tagggtctgcgaggcactga

SEQ ID NO: 13038 - DNA, 24 bp, Artificial Sequence
  Synthetic Construct
catgacattgcaactccctctgtt

SEQ ID NO: 13039 - DNA, 24 bp, Artificial Sequence
  Synthetic Construct
gaaaacgcggtaggatacaaggtt

SEQ ID NO: 13040 - DNA, 21 bp, Artificial Sequence
  Synthetic Construct
tgagctggttagagcacgttt

SEQ ID NO: 13041 - DNA, 23 bp, Artificial Sequence
  Synthetic Construct
acatggggtattcagccaaatgt

SEQ ID NO: 13042 - DNA, 21 bp, Artificial Sequence
  Synthetic Construct
agcaactccgtggtcaagaat

SEQ ID NO: 13043 - DNA, 24 bp, Artificial Sequence
  Synthetic Construct
cacagtgacctgcatttaaccttt

SEQ ID NO: 13044 - DNA, 22 bp, Artificial Sequence
  Synthetic Construct
gctcaggtcagctggtcttcaa

SEQ ID NO: 13045 - DNA, 27 bp, Artificial Sequence
  Synthetic Construct
gtgagactaagaggttaagtgccttgt

SEQ ID NO: 13046 - DNA, 20 bp, Artificial Sequence
  Synthetic Construct
gagcagcaaacgtcctcaac

SEQ ID NO: 13047 - DNA, 19 bp, Artificial Sequence
  Synthetic Construct
ccacagaggggctgcaaaa

SEQ ID NO: 13048 - DNA, 24 bp, Artificial Sequence
  Synthetic Construct
ggcctcagaacactatacaccaaa

SEQ ID NO: 13049 - DNA, 22 bp, Artificial Sequence
  Synthetic Construct
gcctccagagaccgcaaataca

SEQ ID NO: 13050 - DNA, 22 bp, Artificial Sequence
  Synthetic Construct
aggcctccatctgctcttctgt

SEQ ID NO: 13051 - DNA, 25 bp, Artificial Sequence
  Synthetic Construct
cctgcagcttccatgtggacattac

SEQ ID NO: 13052 - DNA, 22 bp, Artificial Sequence
  Synthetic Construct
cctgtgtggtaccagcttcttc

SEQ ID NO: 13053 - DNA, 22 bp, Artificial Sequence
  Synthetic Construct
tggagggcaaaaccaaaaggat

SEQ ID NO: 13054 - DNA, 23 bp, Artificial Sequence
  Synthetic Construct
cctcctccatgtggccatattac

SEQ ID NO: 13055 - DNA, 26 bp, Artificial Sequence
  Synthetic Construct
cctaaccgctagaccatatgggaagt

SEQ ID NO: 13056 - DNA, 18 bp, Artificial Sequence
  Synthetic Construct
accgccaccaccaactgt

SEQ ID NO: 13057 - DNA, 24 bp, Artificial Sequence
  Synthetic Construct
gttcaatagctgcagtggggttac

SEQ ID NO: 13058 - DNA, 20 bp, Artificial Sequence
  Synthetic Construct
ccccagattccccactgtca

SEQ ID NO: 13059 - DNA, 25 bp, Artificial Sequence
  Synthetic Construct
gacctgaagatggtagatgctcttg

SEQ ID NO: 13060 - DNA, 22 bp, Artificial Sequence
  Synthetic Construct
tgggtcctgtcttctccacctt

SEQ ID NO: 13061 - DNA, 22 bp, Artificial Sequence
  Synthetic Construct
tgtggtggaacgggtacaggat

SEQ ID NO: 13062 - DNA, 24 bp, Artificial Sequence
  Synthetic Construct
agaaacacttacccacccaatcaa

SEQ ID NO: 13063 - DNA, 26 bp, Artificial Sequence
  Synthetic Construct
ccaaaccagcatgaagcatttacaga

SEQ ID NO: 13064 - DNA, 23 bp, Artificial Sequence
  Synthetic Construct
ccacctaggacatgaaggagtca

SEQ ID NO: 13065 - DNA, 23 bp, Artificial Sequence
  Synthetic Construct
gcggctagaactaagtgcgaaca

SEQ ID NO: 13066 - DNA, 23 bp, Artificial Sequence
  Synthetic Construct
atggatcgcgtttgagaacaatc

SEQ ID NO: 13067 - DNA, 26 bp, Artificial Sequence
  Synthetic Construct
gggtagaaagcagtttgtaggggtta

SEQ ID NO: 13068 - DNA, 25 bp, Artificial Sequence
  Synthetic Construct
gcgagcaaacctttgacttttcctt

SEQ ID NO: 13069 - DNA, 22 bp, Artificial Sequence
  Synthetic Construct
agccatcatgtccacattccat

SEQ ID NO: 13070 - DNA, 23 bp, Artificial Sequence
  Synthetic Construct
gttctgtcagagggtgtgcttca

SEQ ID NO: 13071 - DNA, 27 bp, Artificial Sequence
  Synthetic Construct
ggaaggcttagtcaacagacgacattt

SEQ ID NO: 13072 - DNA, 19 bp, Artificial Sequence
  Synthetic Construct
gctgaaagggccaggttgt

SEQ ID NO: 13073 - DNA, 22 bp, Artificial Sequence
  Synthetic Construct
catgaccggcttctgtctagtt

SEQ ID NO: 13074 - DNA, 22 bp, Artificial Sequence
  Synthetic Construct
cagaccctgctatcaccagttt

SEQ ID NO: 13075 - DNA, 22 bp, Artificial Sequence
  Synthetic Construct
tgagagtcagcaagtgccttag

SEQ ID NO: 13076 - DNA, 24 bp, Artificial Sequence
  Synthetic Construct
gcagatgcactgtcaagctgtact

SEQ ID NO: 13077 - DNA, 24 bp, Artificial Sequence
  Synthetic Construct
cgatgggtgtggttcaaggtcaaa

SEQ ID NO: 13078 - DNA, 21 bp, Artificial Sequence
  Synthetic Construct
ggctcccacccactgagtttt

SEQ ID NO: 13079 - DNA, 27 bp, Artificial Sequence
  Synthetic Construct
caccctgtaaacatcattttcgcatca

SEQ ID NO: 13080 - DNA, 20 bp, Artificial Sequence
  Synthetic Construct
ttcctgacctcgcgatcctt

SEQ ID NO: 13081 - DNA, 24 bp, Artificial Sequence
  Synthetic Construct
ccttcattcagccactgtcctgta

SEQ ID NO: 13082 - DNA, 23 bp, Artificial Sequence
  Synthetic Construct
gcccacctcagtcagggaagata

SEQ ID NO: 13083 - DNA, 24 bp, Artificial Sequence
  Synthetic Construct
ggagtcaagcaaaggcaatagtga

SEQ ID NO: 13084 - DNA, 21 bp, Artificial Sequence
  Synthetic Construct
gggctgtggaaaccacaaatg

SEQ ID NO: 13085 - DNA, 22 bp, Artificial Sequence
  Synthetic Construct
acgagagaggtgaagtcacaga

SEQ ID NO: 13086 - DNA, 20 bp, Artificial Sequence
  Synthetic Construct
agccctgaaggtcgtccata

SEQ ID NO: 13087 - DNA, 24 bp, Artificial Sequence
  Synthetic Construct
ccttgaagctgagctgaagcagtt

SEQ ID NO: 13088 - DNA, 23 bp, Artificial Sequence
  Synthetic Construct
tcaggcttagatccctggagtag

SEQ ID NO: 13089 - DNA, 23 bp, Artificial Sequence
  Synthetic Construct
gctgcttatagcacaggcaccaa

SEQ ID NO: 13090 - DNA, 21 bp, Artificial Sequence
  Synthetic Construct
tgttgggacccacctctgcaa

SEQ ID NO: 13091 - DNA, 20 bp, Artificial Sequence
  Synthetic Construct
gctgatctgctggcgaggtt

SEQ ID NO: 13092 - DNA, 23 bp, Artificial Sequence
  Synthetic Construct
cacatggccttggatggtattct

SEQ ID NO: 13093 - DNA, 23 bp, Artificial Sequence
  Synthetic Construct
ggtgtttgagccactcagtcaag

SEQ ID NO: 13094 - DNA, 21 bp, Artificial Sequence
  Synthetic Construct
caggtttccaggcatgtgtca

SEQ ID NO: 13095 - DNA, 20 bp, Artificial Sequence
  Synthetic Construct
cagcagcccaaactcgcttt

SEQ ID NO: 13096 - DNA, 22 bp, Artificial Sequence
  Synthetic Construct
gcagaactcaggccctctgtat

SEQ ID NO: 13097 - DNA, 24 bp, Artificial Sequence
  Synthetic Construct
gctgcctgaatggatttgaagttg

SEQ ID NO: 13098 - DNA, 25 bp, Artificial Sequence
  Synthetic Construct
gtgtggaaaatggcaagacagttct

SEQ ID NO: 13099 - DNA, 21 bp, Artificial Sequence
  Synthetic Construct
cctcacctttcaggctcaagt

SEQ ID NO: 13100 - DNA, 21 bp, Artificial Sequence
  Synthetic Construct
tttacccaggctgtggacaag

SEQ ID NO: 13101 - DNA, 23 bp, Artificial Sequence
  Synthetic Construct
gagggtagggactgtgttgatct

SEQ ID NO: 13102 - DNA, 25 bp, Artificial Sequence
  Synthetic Construct
gctgggacactaagtcatgaagcta

SEQ ID NO: 13103 - DNA, 25 bp, Artificial Sequence
  Synthetic Construct
gactgatgtccacatatccctctga

SEQ ID NO: 13104 - DNA, 24 bp, Artificial Sequence
  Synthetic Construct
ctggtcccagggatttgtttcttg

SEQ ID NO: 13105 - DNA, 22 bp, Artificial Sequence
  Synthetic Construct
ctgccaagcaacaatggctatg

SEQ ID NO: 13106 - DNA, 21 bp, Artificial Sequence
  Synthetic Construct
gcgagggaaattcagccagat

SEQ ID NO: 13107 - DNA, 21 bp, Artificial Sequence
  Synthetic Construct
gtcctgggctcgaaacacact

SEQ ID NO: 13108 - DNA, 22 bp, Artificial Sequence
  Synthetic Construct
ggaacagactatgtgggcatca

SEQ ID NO: 13109 - DNA, 22 bp, Artificial Sequence
  Synthetic Construct
acctcccgttcctctctacctt

SEQ ID NO: 13110 - DNA, 25 bp, Artificial Sequence
  Synthetic Construct
ctgaaacatctgcactgtctaggaa

SEQ ID NO: 13111 - DNA, 24 bp, Artificial Sequence
  Synthetic Construct
cctgtcttcagcaagaagcagatg

SEQ ID NO: 13112 - DNA, 23 bp, Artificial Sequence
  Synthetic Construct
tgcttgctccctatggaaaatgt

SEQ ID NO: 13113 - DNA, 21 bp, Artificial Sequence
  Synthetic Construct
atgggaagggaggctgcagtt

SEQ ID NO: 13114 - DNA, 23 bp, Artificial Sequence
  Synthetic Construct
tcccctcttctgtgatggaaaga

SEQ ID NO: 13115 - DNA, 22 bp, Artificial Sequence
  Synthetic Construct
cccaggcttcttcacccttttg

SEQ ID NO: 13116 - DNA, 24 bp, Artificial Sequence
  Synthetic Construct
cctaaacaaaggcgagcatgatga

SEQ ID NO: 13117 - DNA, 22 bp, Artificial Sequence
  Synthetic Construct
agtggacgggattcagaactca

SEQ ID NO: 13118 - DNA, 24 bp, Artificial Sequence
  Synthetic Construct
ggagggaagtgttgtggttgaaga

SEQ ID NO: 13119 - DNA, 22 bp, Artificial Sequence
  Synthetic Construct
ggtgtgaactctccagctcatc

SEQ ID NO: 13120 - DNA, 21 bp, Artificial Sequence
  Synthetic Construct
tcatctgcagtttgcccttga

SEQ ID NO: 13121 - DNA, 24 bp, Artificial Sequence
  Synthetic Construct
ccctggacctgtaagtgccttttc

SEQ ID NO: 13122 - DNA, 25 bp, Artificial Sequence
  Synthetic Construct
gcggagatcctgtagaagaggacaa

SEQ ID NO: 13123 - DNA, 24 bp, Artificial Sequence
  Synthetic Construct
ggccactttccatggagttagtca

SEQ ID NO: 13124 - DNA, 27 bp, Artificial Sequence
  Synthetic Construct
ggcctggaatctaaaatcgcaatcaga

SEQ ID NO: 13125 - DNA, 22 bp, Artificial Sequence
  Synthetic Construct
tacctccggaccttcccacagt

SEQ ID NO: 13126 - DNA, 21 bp, Artificial Sequence
  Synthetic Construct
ttgccagacccgctgagtaca

SEQ ID NO: 13127 - DNA, 22 bp, Artificial Sequence
  Synthetic Construct
ctctcacctcaaggccttcttc

SEQ ID NO: 13128 - DNA, 26 bp, Artificial Sequence
  Synthetic Construct
cctctgatgggccagatggattttta

SEQ ID NO: 13129 - DNA, 26 bp, Artificial Sequence
  Synthetic Construct
gttcaaatagtagtgcctggtgttac

SEQ ID NO: 13130 - DNA, 24 bp, Artificial Sequence
  Synthetic Construct
gctccttccccacaagagagagaa

SEQ ID NO: 13131 - DNA, 24 bp, Artificial Sequence
  Synthetic Construct
gcttttccgactccaaccatcact

SEQ ID NO: 13132 - DNA, 22 bp, Artificial Sequence
  Synthetic Construct
gaaaaggtgaccacctgagcaa

SEQ ID NO: 13133 - DNA, 27 bp, Artificial Sequence
  Synthetic Construct
ccttttctttagagcctccttcccaat

SEQ ID NO: 13134 - DNA, 21 bp, Artificial Sequence
  Synthetic Construct
gcttgttcagcttgcatgtgt

SEQ ID NO: 13135 - DNA, 21 bp, Artificial Sequence
  Synthetic Construct
aggcctggccctttattgttg

SEQ ID NO: 13136 - DNA, 25 bp, Artificial Sequence
  Synthetic Construct
ctgactgatagcagtttgcctctct

SEQ ID NO: 13137 - DNA, 20 bp, Artificial Sequence
  Synthetic Construct
acgcagctcagccctgatga

SEQ ID NO: 13138 - DNA, 26 bp, Artificial Sequence
  Synthetic Construct
caaagggcatgtgtaatctgtaggta

SEQ ID NO: 13139 - DNA, 23 bp, Artificial Sequence
  Synthetic Construct
tgagctggtgtaggattgactct

SEQ ID NO: 13140 - DNA, 22 bp, Artificial Sequence
  Synthetic Construct
ccaacatgcaggccatatgtga

SEQ ID NO: 13141 - DNA, 21 bp, Artificial Sequence
  Synthetic Construct
cactggtgcacttggggatga

SEQ ID NO: 13142 - DNA, 23 bp, Artificial Sequence
  Synthetic Construct
gccaagatccacccatctcaaca

SEQ ID NO: 13143 - DNA, 25 bp, Artificial Sequence
  Synthetic Construct
ccctagttccagcttcctattcatc

SEQ ID NO: 13144 - DNA, 23 bp, Artificial Sequence
  Synthetic Construct
cctagaaatgggtggtacagcaa

SEQ ID NO: 13145 - DNA, 22 bp, Artificial Sequence
  Synthetic Construct
acagagtggtgggagggtatca

SEQ ID NO: 13146 - DNA, 23 bp, Artificial Sequence
  Synthetic Construct
ggcctggatttctggcagtgatt

SEQ ID NO: 13147 - DNA, 24 bp, Artificial Sequence
  Synthetic Construct
cgcttccttaatgcccactttact

SEQ ID NO: 13148 - DNA, 20 bp, Artificial Sequence
  Synthetic Construct
tgctggagcgtggtgacatc

SEQ ID NO: 13149 - DNA, 23 bp, Artificial Sequence
  Synthetic Construct
gcagtgctacctatcgtctccaa

SEQ ID NO: 13150 - DNA, 22 bp, Artificial Sequence
  Synthetic Construct
agctggtgagttggtctgtttg

SEQ ID NO: 13151 - DNA, 22 bp, Artificial Sequence
  Synthetic Construct
gtccagagcaactgagggtttc

SEQ ID NO: 13152 - DNA, 22 bp, Artificial Sequence
  Synthetic Construct
gtcaccacatggatgggtttca

SEQ ID NO: 13153 - DNA, 21 bp, Artificial Sequence
  Synthetic Construct
cagggacaaggctggcaaaga

SEQ ID NO: 13154 - DNA, 20 bp, Artificial Sequence
  Synthetic Construct
gtgacggaccatgagccaaa

SEQ ID NO: 13155 - DNA, 21 bp, Artificial Sequence
  Synthetic Construct
ccctcgatggaggtggtcaga

SEQ ID NO: 13156 - DNA, 23 bp, Artificial Sequence
  Synthetic Construct
cacccagatggatgagtctccta

SEQ ID NO: 13157 - DNA, 20 bp, Artificial Sequence
  Synthetic Construct
gaacacactccgtggcagat

SEQ ID NO: 13158 - DNA, 22 bp, Artificial Sequence
  Synthetic Construct
caggctgccaattagggaggta

SEQ ID NO: 13159 - DNA, 27 bp, Artificial Sequence
  Synthetic Construct
ccctaaatatcagccactttgggctta

SEQ ID NO: 13160 - DNA, 18 bp, Artificial Sequence
  Synthetic Construct
tctgccgggtgagcactt

SEQ ID NO: 13161 - DNA, 25 bp, Artificial Sequence
  Synthetic Construct
gggaacttcttccctctgaatgtct

SEQ ID NO: 13162 - DNA, 24 bp, Artificial Sequence
  Synthetic Construct
gagaggaaatgactcccacaagat

SEQ ID NO: 13163 - DNA, 25 bp, Artificial Sequence
  Synthetic Construct
tgacagtgccttatgaagcaaagat

SEQ ID NO: 13164 - DNA, 21 bp, Artificial Sequence
  Synthetic Construct
ctttgctcggtcagtgaggat

SEQ ID NO: 13165 - DNA, 19 bp, Artificial Sequence
  Synthetic Construct
aaagtccggcccagtgatg

SEQ ID NO: 13166 - DNA, 25 bp, Artificial Sequence
  Synthetic Construct
cgggtctctgtgcttaacgcaattc

SEQ ID NO: 13167 - DNA, 20 bp, Artificial Sequence
  Synthetic Construct
cttcgcgccgttccaaacta

SEQ ID NO: 13168 - DNA, 25 bp, Artificial Sequence
  Synthetic Construct
ctgagcaaatatcagtgagcaccta

SEQ ID NO: 13169 - DNA, 22 bp, Artificial Sequence
  Synthetic Construct
tgacattttcccaccaggtgtt

SEQ ID NO: 13170 - DNA, 24 bp, Artificial Sequence
  Synthetic Construct
ccagcagatcctgaaggagaggaa

SEQ ID NO: 13171 - DNA, 22 bp, Artificial Sequence
  Synthetic Construct
gctcctgaagaggctgtgagat

SEQ ID NO: 13172 - DNA, 22 bp, Artificial Sequence
  Synthetic Construct
cccatccttgttggcccatagt

SEQ ID NO: 13173 - DNA, 22 bp, Artificial Sequence
  Synthetic Construct
gcaaagtcacggtcaagctcat

SEQ ID NO: 13174 - DNA, 20 bp, Artificial Sequence
  Synthetic Construct
tcctccagtcccgagagcta

SEQ ID NO: 13175 - DNA, 20 bp, Artificial Sequence
  Synthetic Construct
cctggggtagaggccaaatg

SEQ ID NO: 13176 - DNA, 23 bp, Artificial Sequence
  Synthetic Construct
gtggacagattcctcactgttct

SEQ ID NO: 13177 - DNA, 21 bp, Artificial Sequence
  Synthetic Construct
aggggaggcaagcagaggaaa

SEQ ID NO: 13178 - DNA, 24 bp, Artificial Sequence
  Synthetic Construct
tgccatagttctcggcttactttc

SEQ ID NO: 13179 - DNA, 24 bp, Artificial Sequence
  Synthetic Construct
cacagactcgtcttgataggtgat

SEQ ID NO: 13180 - DNA, 22 bp, Artificial Sequence
  Synthetic Construct
cggtatcgctgaaggctcttgt

SEQ ID NO: 13181 - DNA, 22 bp, Artificial Sequence
  Synthetic Construct
ccttagtgctggtgctcgtttg

SEQ ID NO: 13182 - DNA, 22 bp, Artificial Sequence
  Synthetic Construct
gcaggttcctgggatgagaaag

SEQ ID NO: 13183 - DNA, 23 bp, Artificial Sequence
  Synthetic Construct
gggctgactcacaaaaccatcta

SEQ ID NO: 13184 - DNA, 24 bp, Artificial Sequence
  Synthetic Construct
ccaccctactgtcccctctagttt

SEQ ID NO: 13185 - DNA, 23 bp, Artificial Sequence
  Synthetic Construct
tgattgtgagccaagaactggat

SEQ ID NO: 13186 - DNA, 25 bp, Artificial Sequence
  Synthetic Construct
ggcagctgttaaactgcctctctaa

SEQ ID NO: 13187 - DNA, 20 bp, Artificial Sequence
  Synthetic Construct
tcccaggccgtgaaggtaag

SEQ ID NO: 13188 - DNA, 26 bp, Artificial Sequence
  Synthetic Construct
gtggtggggatgaattgagaaaacat

SEQ ID NO: 13189 - DNA, 25 bp, Artificial Sequence
  Synthetic Construct
gctgagtccaggatctttgagcaat

SEQ ID NO: 13190 - DNA, 21 bp, Artificial Sequence
  Synthetic Construct
actcacctgccctctgtctgt

SEQ ID NO: 13191 - DNA, 19 bp, Artificial Sequence
  Synthetic Construct
tgagctgcagccaccatgt

SEQ ID NO: 13192 - DNA, 25 bp, Artificial Sequence
  Synthetic Construct
tggatgagaaagtggagcttcatag

SEQ ID NO: 13193 - DNA, 22 bp, Artificial Sequence
  Synthetic Construct
ctgggtttgcatttccgcctta

SEQ ID NO: 13194 - DNA, 28 bp, Artificial Sequence
  Synthetic Construct
gtgcagactctaatacaagtgaggttct

SEQ ID NO: 13195 - DNA, 22 bp, Artificial Sequence
  Synthetic Construct
tgtgctgctttacactctgctt

SEQ ID NO: 13196 - DNA, 24 bp, Artificial Sequence
  Synthetic Construct
ttcaagagaggtcgctttgttttg

SEQ ID NO: 13197 - DNA, 21 bp, Artificial Sequence
  Synthetic Construct
cccaccaccacacctttcaca

SEQ ID NO: 13198 - DNA, 20 bp, Artificial Sequence
  Synthetic Construct
ggcggcagaattccatgttg

SEQ ID NO: 13199 - DNA, 22 bp, Artificial Sequence
  Synthetic Construct
ggagatccagcatgtggtgaca

SEQ ID NO: 13200 - DNA, 23 bp, Artificial Sequence
  Synthetic Construct
cactgtatttgcagcaggtggtt

SEQ ID NO: 13201 - DNA, 24 bp, Artificial Sequence
  Synthetic Construct
gacagttctcagcatggggatttg

SEQ ID NO: 13202 - DNA, 23 bp, Artificial Sequence
  Synthetic Construct
cggtgcgactaaagggtagtttg

SEQ ID NO: 13203 - DNA, 24 bp, Artificial Sequence
  Synthetic Construct
cagtgggcctagaaacttccactt

SEQ ID NO: 13204 - DNA, 21 bp, Artificial Sequence
  Synthetic Construct
actccacagacaggaggacat

SEQ ID NO: 13205 - DNA, 22 bp, Artificial Sequence
  Synthetic Construct
tctccctcacacactgtgacat

SEQ ID NO: 13206 - DNA, 21 bp, Artificial Sequence
  Synthetic Construct
ggagggtacaggcatgccaaa

SEQ ID NO: 13207 - DNA, 22 bp, Artificial Sequence
  Synthetic Construct
acagggagcccactgtcatttg

SEQ ID NO: 13208 - DNA, 26 bp, Artificial Sequence
  Synthetic Construct
ggcagatgcttccagacaaaagaaaa

SEQ ID NO: 13209 - DNA, 27 bp, Artificial Sequence
  Synthetic Construct
gctaaacctggaatataacgtctgtct

SEQ ID NO: 13210 - DNA, 23 bp, Artificial Sequence
  Synthetic Construct
acttttgattcctgggtcccaat

SEQ ID NO: 13211 - DNA, 21 bp, Artificial Sequence
  Synthetic Construct
ggtctttgttcgccactgtct

SEQ ID NO: 13212 - DNA, 24 bp, Artificial Sequence
  Synthetic Construct
cggctttccatgctgaagtcagtt

SEQ ID NO: 13213 - DNA, 24 bp, Artificial Sequence
  Synthetic Construct
gcatcaacggaaccagtgcatttt

SEQ ID NO: 13214 - DNA, 21 bp, Artificial Sequence
  Synthetic Construct
cccctgttgggcataaagcaa

SEQ ID NO: 13215 - DNA, 20 bp, Artificial Sequence
  Synthetic Construct
agtggcaggctgctctcata

SEQ ID NO: 13216 - DNA, 24 bp, Artificial Sequence
  Synthetic Construct
gtggtgctttagggaaatccaatc

SEQ ID NO: 13217 - DNA, 28 bp, Artificial Sequence
  Synthetic Construct
gtgcctcctataatgataatggctcact

SEQ ID NO: 13218 - DNA, 25 bp, Artificial Sequence
  Synthetic Construct
caggagtgtgtgtatccaaggctat

SEQ ID NO: 13219 - DNA, 22 bp, Artificial Sequence
  Synthetic Construct
ggcaaggtctacccaggatcaa

SEQ ID NO: 13220 - DNA, 22 bp, Artificial Sequence
  Synthetic Construct
tgcctgagaggatctggtgaca

SEQ ID NO: 13221 - DNA, 24 bp, Artificial Sequence
  Synthetic Construct
gcagacaaaagtagcaactggaaa

SEQ ID NO: 13222 - DNA, 20 bp, Artificial Sequence
  Synthetic Construct
ggttcagggacacaggcttt

SEQ ID NO: 13223 - DNA, 21 bp, Artificial Sequence
  Synthetic Construct
gcaagctcaaaccccagaagt

SEQ ID NO: 13224 - DNA, 22 bp, Artificial Sequence
  Synthetic Construct
ggtgcccaggtctcatgaatgt

SEQ ID NO: 13225 - DNA, 22 bp, Artificial Sequence
  Synthetic Construct
ggaaatcagccaccctcagcaa

SEQ ID NO: 13226 - DNA, 27 bp, Artificial Sequence
  Synthetic Construct
ggtactgtaggtggttttatgagtcaa

SEQ ID NO: 13227 - DNA, 22 bp, Artificial Sequence
  Synthetic Construct
ccagcatggtgggtttctgttg

SEQ ID NO: 13228 - DNA, 23 bp, Artificial Sequence
  Synthetic Construct
actccaggatgcacaatttgtct

SEQ ID NO: 13229 - DNA, 22 bp, Artificial Sequence
  Synthetic Construct
gcactccagcttcactgacaag

SEQ ID NO: 13230 - DNA, 25 bp, Artificial Sequence
  Synthetic Construct
gaaggagattttcctcccattgcta

SEQ ID NO: 13231 - DNA, 25 bp, Artificial Sequence
  Synthetic Construct
gccagactatcgctgatgtttcctt

SEQ ID NO: 13232 - DNA, 20 bp, Artificial Sequence
  Synthetic Construct
tgaacagccccagagtctca

SEQ ID NO: 13233 - DNA, 25 bp, Artificial Sequence
  Synthetic Construct
gctgctgaagtgagtatctctgttg

SEQ ID NO: 13234 - DNA, 23 bp, Artificial Sequence
  Synthetic Construct
gctgacccatacttgggtaggaa

SEQ ID NO: 13235 - DNA, 21 bp, Artificial Sequence
  Synthetic Construct
gccaatgcaaagaccctgaag

SEQ ID NO: 13236 - DNA, 24 bp, Artificial Sequence
  Synthetic Construct
cactctgcgcttatgcttacactt

SEQ ID NO: 13237 - DNA, 28 bp, Artificial Sequence
  Synthetic Construct
gcctgttactgtatgtgacaaggatagt

SEQ ID NO: 13238 - DNA, 22 bp, Artificial Sequence
  Synthetic Construct
gtgctgtgcattctgcggtttg

SEQ ID NO: 13239 - DNA, 23 bp, Artificial Sequence
  Synthetic Construct
ccctgacaggttctccttcattc

SEQ ID NO: 13240 - DNA, 22 bp, Artificial Sequence
  Synthetic Construct
agtgtgggaagggaagtggata

SEQ ID NO: 13241 - DNA, 26 bp, Artificial Sequence
  Synthetic Construct
gggagtctaggattgtggagttcagt

SEQ ID NO: 13242 - DNA, 21 bp, Artificial Sequence
  Synthetic Construct
aggcttttctccctgggttga

SEQ ID NO: 13243 - DNA, 21 bp, Artificial Sequence
  Synthetic Construct
tggtggcacccaaaggcattc

SEQ ID NO: 13244 - DNA, 25 bp, Artificial Sequence
  Synthetic Construct
gatggcttggacatgaaggatggta

SEQ ID NO: 13245 - DNA, 22 bp, Artificial Sequence
  Synthetic Construct
cccaaaatgcaacacaccatga

SEQ ID NO: 13246 - DNA, 24 bp, Artificial Sequence
  Synthetic Construct
gtgttggcctaagttcccgagttc

SEQ ID NO: 13247 - DNA, 22 bp, Artificial Sequence
  Synthetic Construct
gggaagctgacttcacatccat

SEQ ID NO: 13248 - DNA, 21 bp, Artificial Sequence
  Synthetic Construct
tttggtcccaggctcctccta

SEQ ID NO: 13249 - DNA, 19 bp, Artificial Sequence
  Synthetic Construct
ctctcacgcccagcactct

SEQ ID NO: 13250 - DNA, 25 bp, Artificial Sequence
  Synthetic Construct
cgtggcaacaattccctctatctca

SEQ ID NO: 13251 - DNA, 25 bp, Artificial Sequence
  Synthetic Construct
ggcagtggtacaatcatagctccat

SEQ ID NO: 13252 - DNA, 22 bp, Artificial Sequence
  Synthetic Construct
gatcccttaggctgtgcgaaag

SEQ ID NO: 13253 - DNA, 25 bp, Artificial Sequence
  Synthetic Construct
cactgttttctagtcccagttctgt

SEQ ID NO: 13254 - DNA, 19 bp, Artificial Sequence
  Synthetic Construct
gcgcagtacctcgggcata

SEQ ID NO: 13255 - DNA, 25 bp, Artificial Sequence
  Synthetic Construct
cctgtggattctggctgaggatttg

SEQ ID NO: 13256 - DNA, 23 bp, Artificial Sequence
  Synthetic Construct
gggctccacacattccaccttag

SEQ ID NO: 13257 - DNA, 25 bp, Artificial Sequence
  Synthetic Construct
gtcaagaaactgactgtcactccta

SEQ ID NO: 13258 - DNA, 24 bp, Artificial Sequence
  Synthetic Construct
ctgaatcaccatcacacgaaccat

SEQ ID NO: 13259 - DNA, 23 bp, Artificial Sequence
  Synthetic Construct
cgctgtgtatcaggcataccata

SEQ ID NO: 13260 - DNA, 26 bp, Artificial Sequence
  Synthetic Construct
agagggaaagactctgaaatctgaac

SEQ ID NO: 13261 - DNA, 23 bp, Artificial Sequence
  Synthetic Construct
ccagcgtgtttcaaaggcaaatg

SEQ ID NO: 13262 - DNA, 21 bp, Artificial Sequence
  Synthetic Construct
agggcctagaggacgatgctt

SEQ ID NO: 13263 - DNA, 24 bp, Artificial Sequence
  Synthetic Construct
cctcctgccatgtggttagagagt

SEQ ID NO: 13264 - DNA, 27 bp, Artificial Sequence
  Synthetic Construct
ggattagttactgtgagagtgggttgt

SEQ ID NO: 13265 - DNA, 26 bp, Artificial Sequence
  Synthetic Construct
gcaagacatttggtagccttttcaga

SEQ ID NO: 13266 - DNA, 25 bp, Artificial Sequence
  Synthetic Construct
tcccaatgtaatttgaggcagaaca

SEQ ID NO: 13267 - DNA, 23 bp, Artificial Sequence
  Synthetic Construct
ggggtgaaaacaacaaccactac

SEQ ID NO: 13268 - DNA, 23 bp, Artificial Sequence
  Synthetic Construct
ggaacttcgggaggatgtaggta

SEQ ID NO: 13269 - DNA, 22 bp, Artificial Sequence
  Synthetic Construct
cgcacaaaagacctggcacaga

SEQ ID NO: 13270 - DNA, 25 bp, Artificial Sequence
  Synthetic Construct
cccagtctgctcctttggaatcttg

SEQ ID NO: 13271 - DNA, 24 bp, Artificial Sequence
  Synthetic Construct
ttccaagtgtaaggctgaagaagt

SEQ ID NO: 13272 - DNA, 23 bp, Artificial Sequence
  Synthetic Construct
ggctggagaaagtagtccacaga

SEQ ID NO: 13273 - DNA, 21 bp, Artificial Sequence
  Synthetic Construct
gtggaccacgtgcagaagtca

SEQ ID NO: 13274 - DNA, 22 bp, Artificial Sequence
  Synthetic Construct
gcatggtaggacagtggacgaa

SEQ ID NO: 13275 - DNA, 20 bp, Artificial Sequence
  Synthetic Construct
gggatgcagaggctgtttca

SEQ ID NO: 13276 - DNA, 22 bp, Artificial Sequence
  Synthetic Construct
cccatgcctaccaagagctagt

SEQ ID NO: 13277 - DNA, 24 bp, Artificial Sequence
  Synthetic Construct
agggctctgaccttgaagaatttg

SEQ ID NO: 13278 - DNA, 24 bp, Artificial Sequence
  Synthetic Construct
ttctccatcaaactcgggatgaat

SEQ ID NO: 13279 - DNA, 25 bp, Artificial Sequence
  Synthetic Construct
ccttctaccaggttggacaaagtct

SEQ ID NO: 13280 - DNA, 25 bp, Artificial Sequence
  Synthetic Construct
caggaatcctcagataggaggtaga

SEQ ID NO: 13281 - DNA, 22 bp, Artificial Sequence
  Synthetic Construct
accaggacgaaccttcccattc

SEQ ID NO: 13282 - DNA, 26 bp, Artificial Sequence
  Synthetic Construct
ctggactctgggacttctttttgagt

SEQ ID NO: 13283 - DNA, 25 bp, Artificial Sequence
  Synthetic Construct
accaacttatacgagcttcttggat

SEQ ID NO: 13284 - DNA, 20 bp, Artificial Sequence
  Synthetic Construct
agcttcaggtcgccccacta

SEQ ID NO: 13285 - DNA, 25 bp, Artificial Sequence
  Synthetic Construct
tgtacagatacttggtggaagcaat

SEQ ID NO: 13286 - DNA, 23 bp, Artificial Sequence
  Synthetic Construct
agtgatgcaattgaaggcactga

SEQ ID NO: 13287 - DNA, 20 bp, Artificial Sequence
  Synthetic Construct
agacgtgtgccctgttcatc

SEQ ID NO: 13288 - DNA, 22 bp, Artificial Sequence
  Synthetic Construct
actggaccagcaccttctcttc

SEQ ID NO: 13289 - DNA, 22 bp, Artificial Sequence
  Synthetic Construct
gagattggcccagtcctgtttg

SEQ ID NO: 13290 - DNA, 20 bp, Artificial Sequence
  Synthetic Construct
agcagcagtaccacgtctga

SEQ ID NO: 13291 - DNA, 23 bp, Artificial Sequence
  Synthetic Construct
tggtgctgtttcaggactaggat

SEQ ID NO: 13292 - DNA, 18 bp, Artificial Sequence
  Synthetic Construct
tgcaggcacgtgacgaat

SEQ ID NO: 13293 - DNA, 24 bp, Artificial Sequence
  Synthetic Construct
cctgggaaggatcggcattatttg

SEQ ID NO: 13294 - DNA, 21 bp, Artificial Sequence
  Synthetic Construct
gctttcagcagcgtcccagat

SEQ ID NO: 13295 - DNA, 24 bp, Artificial Sequence
  Synthetic Construct
aggtcgtgcttttagtagcaatgt

SEQ ID NO: 13296 - DNA, 22 bp, Artificial Sequence
  Synthetic Construct
gcttcgcacttgaatcctgact

SEQ ID NO: 13297 - DNA, 21 bp, Artificial Sequence
  Synthetic Construct
gggacaggcttcctgtgaact

SEQ ID NO: 13298 - DNA, 26 bp, Artificial Sequence
  Synthetic Construct
gtcatccaagctcaaaatccaagaga

SEQ ID NO: 13299 - DNA, 20 bp, Artificial Sequence
  Synthetic Construct
cccacttcccgtgtttctca

SEQ ID NO: 13300 - DNA, 20 bp, Artificial Sequence
  Synthetic Construct
ctcagcctgctagggagtga

SEQ ID NO: 13301 - DNA, 25 bp, Artificial Sequence
  Synthetic Construct
cctctctgtgtgggctagaatgctt

SEQ ID NO: 13302 - DNA, 27 bp, Artificial Sequence
  Synthetic Construct
gcacctggtgttttacagtttgacaat

SEQ ID NO: 13303 - DNA, 24 bp, Artificial Sequence
  Synthetic Construct
gcacagtgggtgagagagaagcat

SEQ ID NO: 13304 - DNA, 23 bp, Artificial Sequence
  Synthetic Construct
gttgtccattgcccctttactga

SEQ ID NO: 13305 - DNA, 20 bp, Artificial Sequence
  Synthetic Construct
tggtggtgccactcttggaa

SEQ ID NO: 13306 - DNA, 25 bp, Artificial Sequence
  Synthetic Construct
ctgcatagctttgcttcacttcttc

SEQ ID NO: 13307 - DNA, 22 bp, Artificial Sequence
  Synthetic Construct
gtgagagctgctagaggctgat

SEQ ID NO: 13308 - DNA, 22 bp, Artificial Sequence
  Synthetic Construct
atcttaggcctagggagcaagt

SEQ ID NO: 13309 - DNA, 26 bp, Artificial Sequence
  Synthetic Construct
gctagaaggtgatgctacaggacgaa

SEQ ID NO: 13310 - DNA, 24 bp, Artificial Sequence
  Synthetic Construct
ctttgaagtctctgcacctcagtt

SEQ ID NO: 13311 - DNA, 21 bp, Artificial Sequence
  Synthetic Construct
tgatgcctgctcgagacattg

SEQ ID NO: 13312 - DNA, 19 bp, Artificial Sequence
  Synthetic Construct
tgtcggccgagcccatttt

SEQ ID NO: 13313 - DNA, 22 bp, Artificial Sequence
  Synthetic Construct
tccctgcaaaggggtcaaggta

SEQ ID NO: 13314 - DNA, 26 bp, Artificial Sequence
  Synthetic Construct
ccctaatcacagcaaatctgctcctt

SEQ ID NO: 13315 - DNA, 22 bp, Artificial Sequence
  Synthetic Construct
gcttgcgggatgtatcttcctt

SEQ ID NO: 13316 - DNA, 23 bp, Artificial Sequence
  Synthetic Construct
ggtgaggctcagccgtctatact

SEQ ID NO: 13317 - DNA, 20 bp, Artificial Sequence
  Synthetic Construct
ctgccacttgctctgtctca

SEQ ID NO: 13318 - DNA, 24 bp, Artificial Sequence
  Synthetic Construct
gcttggctcaaacatcacctccta

SEQ ID NO: 13319 - DNA, 20 bp, Artificial Sequence
  Synthetic Construct
acaggcctaccaaccacaga

SEQ ID NO: 13320 - DNA, 20 bp, Artificial Sequence
  Synthetic Construct
tcaggtggactgcgagtctt

SEQ ID NO: 13321 - DNA, 27 bp, Artificial Sequence
  Synthetic Construct
ggtaaggtatccatccttatggagttt

SEQ ID NO: 13322 - DNA, 22 bp, Artificial Sequence
  Synthetic Construct
cctgccctaacctccgtttaca

SEQ ID NO: 13323 - DNA, 20 bp, Artificial Sequence
  Synthetic Construct
tgccctctgggctccccttt

SEQ ID NO: 13324 - DNA, 26 bp, Artificial Sequence
  Synthetic Construct
gcatgcttattcaagcgagagatgat

SEQ ID NO: 13325 - DNA, 23 bp, Artificial Sequence
  Synthetic Construct
gtaagccagggaagagtggaaag

SEQ ID NO: 13326 - DNA, 25 bp, Artificial Sequence
  Synthetic Construct
gacagagttgatgtgggattacctt

SEQ ID NO: 13327 - DNA, 24 bp, Artificial Sequence
  Synthetic Construct
caggcctccccttaaaatgtcatc

SEQ ID NO: 13328 - DNA, 20 bp, Artificial Sequence
  Synthetic Construct
agggctgtgctgatggaaca

SEQ ID NO: 13329 - DNA, 26 bp, Artificial Sequence
  Synthetic Construct
ctccaactgttgctgaatatgtctac

SEQ ID NO: 13330 - DNA, 27 bp, Artificial Sequence
  Synthetic Construct
gacaacacagttccctttccattttca

SEQ ID NO: 13331 - DNA, 22 bp, Artificial Sequence
  Synthetic Construct
gtggacctctcagggctacatc

SEQ ID NO: 13332 - DNA, 20 bp, Artificial Sequence
  Synthetic Construct
agtcgatgggtggtggaaga

SEQ ID NO: 13333 - DNA, 26 bp, Artificial Sequence
  Synthetic Construct
tccaggaaagtcaattcatggagtag

SEQ ID NO: 13334 - DNA, 21 bp, Artificial Sequence
  Synthetic Construct
gggccaggtaaggagcagtag

SEQ ID NO: 13335 - DNA, 22 bp, Artificial Sequence
  Synthetic Construct
ctgtgaatgcaggtccttgttg

SEQ ID NO: 13336 - DNA, 26 bp, Artificial Sequence
  Synthetic Construct
ctcaacattgcatgctacaacctgaa

SEQ ID NO: 13337 - DNA, 27 bp, Artificial Sequence
  Synthetic Construct
ctcacagagctatcaaggtcattcaca

SEQ ID NO: 13338 - DNA, 23 bp, Artificial Sequence
  Synthetic Construct
ggcagaggagtgacataagttga

SEQ ID NO: 13339 - DNA, 21 bp, Artificial Sequence
  Synthetic Construct
acctgcggttcgtttaacaca

SEQ ID NO: 13340 - DNA, 24 bp, Artificial Sequence
  Synthetic Construct
ctggagagccaccaataccctaga

SEQ ID NO: 13341 - DNA, 20 bp, Artificial Sequence
  Synthetic Construct
ggcctggagatggacagctt

SEQ ID NO: 13342 - DNA, 22 bp, Artificial Sequence
  Synthetic Construct
accccgtcttggttcttacctt

SEQ ID NO: 13343 - DNA, 23 bp, Artificial Sequence
  Synthetic Construct
ctcggatttccatccagcgttga

SEQ ID NO: 13344 - DNA, 21 bp, Artificial Sequence
  Synthetic Construct
ggctcacagcagcttcagtct

SEQ ID NO: 13345 - DNA, 24 bp, Artificial Sequence
  Synthetic Construct
cccgtcccaccctttgtttagaag

SEQ ID NO: 13346 - DNA, 23 bp, Artificial Sequence
  Synthetic Construct
cccgcatggctacagagttaata

SEQ ID NO: 13347 - DNA, 23 bp, Artificial Sequence
  Synthetic Construct
tgccttgttgaacttaggccatt

SEQ ID NO: 13348 - DNA, 21 bp, Artificial Sequence
  Synthetic Construct
gggctggcagacaggaaaaca

SEQ ID NO: 13349 - DNA, 24 bp, Artificial Sequence
  Synthetic Construct
ccagttccagagtccctcgttttc

SEQ ID NO: 13350 - DNA, 24 bp, Artificial Sequence
  Synthetic Construct
gactcggtgcattcactgtttatc

SEQ ID NO: 13351 - DNA, 27 bp, Artificial Sequence
  Synthetic Construct
gtgtttgcaagttatagggtctcacaa

SEQ ID NO: 13352 - DNA, 27 bp, Artificial Sequence
  Synthetic Construct
ccatccccatcaccttattttgacaag

SEQ ID NO: 13353 - DNA, 23 bp, Artificial Sequence
  Synthetic Construct
gcgcaagtcctatactggtctgt

SEQ ID NO: 13354 - DNA, 22 bp, Artificial Sequence
  Synthetic Construct
ctccctgccaatatgccagttc

SEQ ID NO: 13355 - DNA, 24 bp, Artificial Sequence
  Synthetic Construct
tggatgctcaagagttggatcttc

SEQ ID NO: 13356 - DNA, 24 bp, Artificial Sequence
  Synthetic Construct
tgagctgaagttcttgctgagatt

SEQ ID NO: 13357 - DNA, 23 bp, Artificial Sequence
  Synthetic Construct
ccctgaggctatccagggaagat

SEQ ID NO: 13358 - DNA, 25 bp, Artificial Sequence
  Synthetic Construct
tggctcataggcagcaaattattca

SEQ ID NO: 13359 - DNA, 24 bp, Artificial Sequence
  Synthetic Construct
ccaggttggttaggctctgctcaa

SEQ ID NO: 13360 - DNA, 24 bp, Artificial Sequence
  Synthetic Construct
caccaaaggcatactcccatcagt

SEQ ID NO: 13361 - DNA, 20 bp, Artificial Sequence
  Synthetic Construct
tcttccctgctgcccaccaa

SEQ ID NO: 13362 - DNA, 22 bp, Artificial Sequence
  Synthetic Construct
gcaaagaggccccatgatccta

SEQ ID NO: 13363 - DNA, 22 bp, Artificial Sequence
  Synthetic Construct
tcttctgctggagatgcgattc

SEQ ID NO: 13364 - DNA, 24 bp, Artificial Sequence
  Synthetic Construct
gatggccattccttactctcagtt

SEQ ID NO: 13365 - DNA, 22 bp, Artificial Sequence
  Synthetic Construct
ggtgctttatcccagggagatg

SEQ ID NO: 13366 - DNA, 22 bp, Artificial Sequence
  Synthetic Construct
cacaagggtggaggttaccttt

SEQ ID NO: 13367 - DNA, 19 bp, Artificial Sequence
  Synthetic Construct
tgcgatggcattcgtcaca

SEQ ID NO: 13368 - DNA, 21 bp, Artificial Sequence
  Synthetic Construct
tgcatgaggagaggtgtccaa

SEQ ID NO: 13369 - DNA, 22 bp, Artificial Sequence
  Synthetic Construct
ctgcacatcagtttgcttgcat

SEQ ID NO: 13370 - DNA, 23 bp, Artificial Sequence
  Synthetic Construct
ggtcccaagttacagccaaccat

SEQ ID NO: 13371 - DNA, 23 bp, Artificial Sequence
  Synthetic Construct
ggggtcatccacaaatgtcttct

SEQ ID NO: 13372 - DNA, 20 bp, Artificial Sequence
  Synthetic Construct
acaccatcccctgagtgaca

SEQ ID NO: 13373 - DNA, 22 bp, Artificial Sequence
  Synthetic Construct
gcaggactttggaggctgacta

SEQ ID NO: 13374 - DNA, 22 bp, Artificial Sequence
  Synthetic Construct
agctcaacctgagcccttcctt

SEQ ID NO: 13375 - DNA, 21 bp, Artificial Sequence
  Synthetic Construct
agtggcccaggtgaatacaga

SEQ ID NO: 13376 - DNA, 20 bp, Artificial Sequence
  Synthetic Construct
caggtcaggaacggcaggta

SEQ ID NO: 13377 - DNA, 27 bp, Artificial Sequence
  Synthetic Construct
ggaacagtattctgactccagatccta

SEQ ID NO: 13378 - DNA, 21 bp, Artificial Sequence
  Synthetic Construct
tctttgcacccacctcacatc

SEQ ID NO: 13379 - DNA, 26 bp, Artificial Sequence
  Synthetic Construct
gcaatgacctagcaaggtgtatgtct

SEQ ID NO: 13380 - DNA, 23 bp, Artificial Sequence
  Synthetic Construct
ccaagccccaagtcagaaaagtt

SEQ ID NO: 13381 - DNA, 24 bp, Artificial Sequence
  Synthetic Construct
gctttaggtaatgagccagactga

SEQ ID NO: 13382 - DNA, 25 bp, Artificial Sequence
  Synthetic Construct
tttacaggacccctttttctgtctt

SEQ ID NO: 13383 - DNA, 22 bp, Artificial Sequence
  Synthetic Construct
gtctggctctcgggaaagagaa

SEQ ID NO: 13384 - DNA, 24 bp, Artificial Sequence
  Synthetic Construct
gcctgctagacaggagagttgctt

SEQ ID NO: 13385 - DNA, 24 bp, Artificial Sequence
  Synthetic Construct
cctggccttaggattgggagatga

SEQ ID NO: 13386 - DNA, 22 bp, Artificial Sequence
  Synthetic Construct
gaagctgcaggtgctgtactct

SEQ ID NO: 13387 - DNA, 22 bp, Artificial Sequence
  Synthetic Construct
tgggtggactggattcctgctt

SEQ ID NO: 13388 - DNA, 26 bp, Artificial Sequence
  Synthetic Construct
ggaaccccagtaaagatagagcagaa

SEQ ID NO: 13389 - DNA, 21 bp, Artificial Sequence
  Synthetic Construct
ggtgggagtagtggggagaaa

SEQ ID NO: 13390 - DNA, 23 bp, Artificial Sequence
  Synthetic Construct
gccggagtcaggtattggcaaag

SEQ ID NO: 13391 - DNA, 22 bp, Artificial Sequence
  Synthetic Construct
ggcaggccccaaatcacttaca

SEQ ID NO: 13392 - DNA, 21 bp, Artificial Sequence
  Synthetic Construct
agagccagcccagtggtctta

SEQ ID NO: 13393 - DNA, 20 bp, Artificial Sequence
  Synthetic Construct
tgggtcacgccaacctattc

SEQ ID NO: 13394 - DNA, 20 bp, Artificial Sequence
  Synthetic Construct
aagctgcagccctccttttg

SEQ ID NO: 13395 - DNA, 23 bp, Artificial Sequence
  Synthetic Construct
attaacgctgggtacctgaaagt

SEQ ID NO: 13396 - DNA, 22 bp, Artificial Sequence
  Synthetic Construct
ctgcaacaaacgccacttatca

SEQ ID NO: 13397 - DNA, 26 bp, Artificial Sequence
  Synthetic Construct
gcttctgagggtttctaccactaact

SEQ ID NO: 13398 - DNA, 25 bp, Artificial Sequence
  Synthetic Construct
caaagaaaggaaagccaggtagcat

SEQ ID NO: 13399 - DNA, 21 bp, Artificial Sequence
  Synthetic Construct
cacttgctgttggcagagcta

SEQ ID NO: 13400 - DNA, 26 bp, Artificial Sequence
  Synthetic Construct
cacctgaaggcaagaattgctacaaa

SEQ ID NO: 13401 - DNA, 22 bp, Artificial Sequence
  Synthetic Construct
ccaacacggaacggtgctgata

SEQ ID NO: 13402 - DNA, 22 bp, Artificial Sequence
  Synthetic Construct
gcacgggccacttttctagatg

SEQ ID NO: 13403 - DNA, 27 bp, Artificial Sequence
  Synthetic Construct
gcaacacttgagaaatgctggttctct

SEQ ID NO: 13404 - DNA, 22 bp, Artificial Sequence
  Synthetic Construct
tctattgctggcccctctatct

SEQ ID NO: 13405 - DNA, 24 bp, Artificial Sequence
  Synthetic Construct
aagaatccagaaggaaaccagtgt

SEQ ID NO: 13406 - DNA, 18 bp, Artificial Sequence
  Synthetic Construct
taggagagcgccgtgcat

SEQ ID NO: 13407 - DNA, 20 bp, Artificial Sequence
  Synthetic Construct
tgaggctagctcggtgaact

SEQ ID NO: 13408 - DNA, 23 bp, Artificial Sequence
  Synthetic Construct
ctctactggtctggggtcctagt

SEQ ID NO: 13409 - DNA, 19 bp, Artificial Sequence
  Synthetic Construct
gtggcagcctcgtgcagta

SEQ ID NO: 13410 - DNA, 21 bp, Artificial Sequence
  Synthetic Construct
gctgacttgctgtgggtctct

SEQ ID NO: 13411 - DNA, 26 bp, Artificial Sequence
  Synthetic Construct
gcccatcagcaagtcttattgactct

SEQ ID NO: 13412 - DNA, 25 bp, Artificial Sequence
  Synthetic Construct
ccttccctgtgtgtaagactgatct

SEQ ID NO: 13413 - DNA, 24 bp, Artificial Sequence
  Synthetic Construct
ctcgggttggctgttacaatcgaa

SEQ ID NO: 13414 - DNA, 19 bp, Artificial Sequence
  Synthetic Construct
tggccggtggggtctaagt

SEQ ID NO: 13415 - DNA, 23 bp, Artificial Sequence
  Synthetic Construct
cctggcagagtagcttcccattc

SEQ ID NO: 13416 - DNA, 21 bp, Artificial Sequence
  Synthetic Construct
agcggtgtttgaggagacatt

SEQ ID NO: 13417 - DNA, 22 bp, Artificial Sequence
  Synthetic Construct
gcctctaggagaactggcaaca

SEQ ID NO: 13418 - DNA, 23 bp, Artificial Sequence
  Synthetic Construct
gaggggaaatcagagctttgtca

SEQ ID NO: 13419 - DNA, 20 bp, Artificial Sequence
  Synthetic Construct
cgccccaacacttccagtct

SEQ ID NO: 13420 - DNA, 24 bp, Artificial Sequence
  Synthetic Construct
cactcagatctctggttccaatgt

SEQ ID NO: 13421 - DNA, 24 bp, Artificial Sequence
  Synthetic Construct
caggaagccccaaagagttgaaga

SEQ ID NO: 13422 - DNA, 24 bp, Artificial Sequence
  Synthetic Construct
tcggactctgtacctctcttcttt

SEQ ID NO: 13423 - DNA, 27 bp, Artificial Sequence
  Synthetic Construct
gcaggaacttactaatgggatccagaa

SEQ ID NO: 13424 - DNA, 21 bp, Artificial Sequence
  Synthetic Construct
cggtgggaatccctgactttc

SEQ ID NO: 13425 - DNA, 26 bp, Artificial Sequence
  Synthetic Construct
cagatgtatcttttcagggccattac

SEQ ID NO: 13426 - DNA, 21 bp, Artificial Sequence
  Synthetic Construct
ggacggtttggccaggtttct

SEQ ID NO: 13427 - DNA, 22 bp, Artificial Sequence
  Synthetic Construct
aggagggctgcaccaatcctat

SEQ ID NO: 13428 - DNA, 26 bp, Artificial Sequence
  Synthetic Construct
cccctgtgaattctaacctaggaagt

SEQ ID NO: 13429 - DNA, 23 bp, Artificial Sequence
  Synthetic Construct
gcttctcccaagctgatctctgt

SEQ ID NO: 13430 - DNA, 22 bp, Artificial Sequence
  Synthetic Construct
ggaagtgaccaggtgccatgat

SEQ ID NO: 13431 - DNA, 22 bp, Artificial Sequence
  Synthetic Construct
caccagaccttcccttcagtgt

SEQ ID NO: 13432 - DNA, 21 bp, Artificial Sequence
  Synthetic Construct
agggaacagagaggcagtaca

SEQ ID NO: 13433 - DNA, 20 bp, Artificial Sequence
  Synthetic Construct
ccccagttgcacatgactgt

SEQ ID NO: 13434 - DNA, 19 bp, Artificial Sequence
  Synthetic Construct
aggctggagcgagacactt

SEQ ID NO: 13435 - DNA, 25 bp, Artificial Sequence
  Synthetic Construct
gccagggataagttccttctctaac

SEQ ID NO: 13436 - DNA, 23 bp, Artificial Sequence
  Synthetic Construct
ctacttctgccattctggtccaa

SEQ ID NO: 13437 - DNA, 25 bp, Artificial Sequence
  Synthetic Construct
gcttccatctgtaccctgttaccta

SEQ ID NO: 13438 - DNA, 22 bp, Artificial Sequence
  Synthetic Construct
caggaggccaatccaaatcaca

SEQ ID NO: 13439 - DNA, 25 bp, Artificial Sequence
  Synthetic Construct
caccctcccagatctgacgatctaa

SEQ ID NO: 13440 - DNA, 22 bp, Artificial Sequence
  Synthetic Construct
cagtcacaacaggggcatctca

SEQ ID NO: 13441 - DNA, 24 bp, Artificial Sequence
  Synthetic Construct
ggagcccttatctggagacagaac

SEQ ID NO: 13442 - DNA, 21 bp, Artificial Sequence
  Synthetic Construct
tggtcgtcctgatggaacttg

SEQ ID NO: 13443 - DNA, 24 bp, Artificial Sequence
  Synthetic Construct
tcattgaggctggatgtgtatcaa

SEQ ID NO: 13444 - DNA, 22 bp, Artificial Sequence
  Synthetic Construct
ggggtcagctgagctaatgtgt

SEQ ID NO: 13445 - DNA, 21 bp, Artificial Sequence
  Synthetic Construct
gtcgaagttggcatccgttca

SEQ ID NO: 13446 - DNA, 25 bp, Artificial Sequence
  Synthetic Construct
cttcctaagaaggcaaagactgaga

SEQ ID NO: 13447 - DNA, 20 bp, Artificial Sequence
  Synthetic Construct
ggcctgtctggatggtggtt

SEQ ID NO: 13448 - DNA, 23 bp, Artificial Sequence
  Synthetic Construct
ccccaagccctgtcatccaatac

SEQ ID NO: 13449 - DNA, 21 bp, Artificial Sequence
  Synthetic Construct
cagaaccgtctctgcgtccaa

SEQ ID NO: 13450 - DNA, 27 bp, Artificial Sequence
  Synthetic Construct
ggattggctaaattgatagctcctcat

SEQ ID NO: 13451 - DNA, 22 bp, Artificial Sequence
  Synthetic Construct
caaagcaggcgggagaactaga

SEQ ID NO: 13452 - DNA, 22 bp, Artificial Sequence
  Synthetic Construct
cagctatctcgctcttgacact

SEQ ID NO: 13453 - DNA, 22 bp, Artificial Sequence
  Synthetic Construct
cctcctactcaccaagcaggaa

SEQ ID NO: 13454 - DNA, 22 bp, Artificial Sequence
  Synthetic Construct
cagcctcttcacgttgccttgt

SEQ ID NO: 13455 - DNA, 21 bp, Artificial Sequence
  Synthetic Construct
agcatggcaacactcaaccaa

SEQ ID NO: 13456 - DNA, 24 bp, Artificial Sequence
  Synthetic Construct
ctcagggacctacggtgtcatttg

SEQ ID NO: 13457 - DNA, 22 bp, Artificial Sequence
  Synthetic Construct
ccccgtgatcctggtctacaca

SEQ ID NO: 13458 - DNA, 23 bp, Artificial Sequence
  Synthetic Construct
cacaaacctggctgtctttgtga

SEQ ID NO: 13459 - DNA, 22 bp, Artificial Sequence
  Synthetic Construct
gtcgctgggatgcataggaaca

SEQ ID NO: 13460 - DNA, 21 bp, Artificial Sequence
  Synthetic Construct
gtgactgtttgcctgcctttc

SEQ ID NO: 13461 - DNA, 22 bp, Artificial Sequence
  Synthetic Construct
gctgacaggtgagactctgaag

SEQ ID NO: 13462 - DNA, 24 bp, Artificial Sequence
  Synthetic Construct
gtcgcgggaagctaaagataacat

SEQ ID NO: 13463 - DNA, 21 bp, Artificial Sequence
  Synthetic Construct
ggggtggaatcaggactgtga

SEQ ID NO: 13464 - DNA, 25 bp, Artificial Sequence
  Synthetic Construct
ggaggccttaacatacgaggtgaga

SEQ ID NO: 13465 - DNA, 21 bp, Artificial Sequence
  Synthetic Construct
ggttgtgggctacgcttgtca

SEQ ID NO: 13466 - DNA, 24 bp, Artificial Sequence
  Synthetic Construct
catcaggccctacttccagagatg

SEQ ID NO: 13467 - DNA, 22 bp, Artificial Sequence
  Synthetic Construct
cgggtaagccgtgaacagtagt

SEQ ID NO: 13468 - DNA, 23 bp, Artificial Sequence
  Synthetic Construct
gccttggaagggagtctgggaat

SEQ ID NO: 13469 - DNA, 27 bp, Artificial Sequence
  Synthetic Construct
caacactaagacatgcccttgaagaag

SEQ ID NO: 13470 - DNA, 25 bp, Artificial Sequence
  Synthetic Construct
gcatacaatatgacccactcagctt

SEQ ID NO: 13471 - DNA, 22 bp, Artificial Sequence
  Synthetic Construct
gaggtgcggcagctactttttc

SEQ ID NO: 13472 - DNA, 20 bp, Artificial Sequence
  Synthetic Construct
cgtagcccgtccttcagaga

SEQ ID NO: 13473 - DNA, 26 bp, Artificial Sequence
  Synthetic Construct
gagctgtgtatgtactgagagatcaa

SEQ ID NO: 13474 - DNA, 22 bp, Artificial Sequence
  Synthetic Construct
gagagaccgcttcaccatcttc

SEQ ID NO: 13475 - DNA, 20 bp, Artificial Sequence
  Synthetic Construct
ctgtgcctttccaccgaaga

SEQ ID NO: 13476 - DNA, 27 bp, Artificial Sequence
  Synthetic Construct
ggaaatacgactcagggaaaatacagt

SEQ ID NO: 13477 - DNA, 21 bp, Artificial Sequence
  Synthetic Construct
tgctccaaccccacagtaaag

SEQ ID NO: 13478 - DNA, 20 bp, Artificial Sequence
  Synthetic Construct
gccatgggccatcctgacat

SEQ ID NO: 13479 - DNA, 23 bp, Artificial Sequence
  Synthetic Construct
ctggtggattttgcggagagtag

SEQ ID NO: 13480 - DNA, 23 bp, Artificial Sequence
  Synthetic Construct
tcccaggtgtgttcaaagattgt

SEQ ID NO: 13481 - DNA, 22 bp, Artificial Sequence
  Synthetic Construct
cctctgcccttttgccattttt

SEQ ID NO: 13482 - DNA, 24 bp, Artificial Sequence
  Synthetic Construct
cttcaggttggggagatgccttag

SEQ ID NO: 13483 - DNA, 22 bp, Artificial Sequence
  Synthetic Construct
gtgttggtcattcctggagagt

SEQ ID NO: 13484 - DNA, 26 bp, Artificial Sequence
  Synthetic Construct
gctgagagcttgggttattcccatac

SEQ ID NO: 13485 - DNA, 23 bp, Artificial Sequence
  Synthetic Construct
cttttgtgccagacaccaattct

SEQ ID NO: 13486 - DNA, 26 bp, Artificial Sequence
  Synthetic Construct
ggactgtgtacttgctgaatgaggta

SEQ ID NO: 13487 - DNA, 23 bp, Artificial Sequence
  Synthetic Construct
cttcaaggaggagaaggcaccta

SEQ ID NO: 13488 - DNA, 22 bp, Artificial Sequence
  Synthetic Construct
gctgaaaattgccctgcacact

SEQ ID NO: 13489 - DNA, 20 bp, Artificial Sequence
  Synthetic Construct
agtgaagggacgccacgttt

SEQ ID NO: 13490 - DNA, 21 bp, Artificial Sequence
  Synthetic Construct
agtgagagacccagggaccaa

SEQ ID NO: 13491 - DNA, 22 bp, Artificial Sequence
  Synthetic Construct
gcaacactggatcctggagagt

SEQ ID NO: 13492 - DNA, 22 bp, Artificial Sequence
  Synthetic Construct
tggtcgagaaatgtgacccaaa

SEQ ID NO: 13493 - DNA, 25 bp, Artificial Sequence
  Synthetic Construct
ccaggaccaatgggtaaaagtaaca

SEQ ID NO: 13494 - DNA, 20 bp, Artificial Sequence
  Synthetic Construct
gcctttccaagggcatgaca

SEQ ID NO: 13495 - DNA, 23 bp, Artificial Sequence
  Synthetic Construct
cctgtttggccagtagacaaatg

SEQ ID NO: 13496 - DNA, 25 bp, Artificial Sequence
  Synthetic Construct
cgtcattggatctgtctcctttttc

SEQ ID NO: 13497 - DNA, 21 bp, Artificial Sequence
  Synthetic Construct
ctgaccgcatttgaggagtct

SEQ ID NO: 13498 - DNA, 22 bp, Artificial Sequence
  Synthetic Construct
ggccttcctggagcgagttaat

SEQ ID NO: 13499 - DNA, 20 bp, Artificial Sequence
  Synthetic Construct
tgcaccatggagacctggaa

SEQ ID NO: 13500 - DNA, 21 bp, Artificial Sequence
  Synthetic Construct
aaatgggtgaccagcaagtga

SEQ ID NO: 13501 - DNA, 20 bp, Artificial Sequence
  Synthetic Construct
gcatccagttgcctgacact

SEQ ID NO: 13502 - DNA, 22 bp, Artificial Sequence
  Synthetic Construct
ggcactgacttgagtggaaagt

SEQ ID NO: 13503 - DNA, 26 bp, Artificial Sequence
  Synthetic Construct
cgaatccattctacccgcctaatttc

SEQ ID NO: 13504 - DNA, 23 bp, Artificial Sequence
  Synthetic Construct
aggtggtgaccttagccaataac

SEQ ID NO: 13505 - DNA, 21 bp, Artificial Sequence
  Synthetic Construct
aacacgagggatttcgcagat

SEQ ID NO: 13506 - DNA, 22 bp, Artificial Sequence
  Synthetic Construct
ggaatctcccttcgtggactgt

SEQ ID NO: 13507 - DNA, 20 bp, Artificial Sequence
  Synthetic Construct
tcccggtctctggcttttca

SEQ ID NO: 13508 - DNA, 24 bp, Artificial Sequence
  Synthetic Construct
tggttttatcagctcacccaaact

SEQ ID NO: 13509 - DNA, 23 bp, Artificial Sequence
  Synthetic Construct
tgggagattgcaaaggtcacaat

SEQ ID NO: 13510 - DNA, 23 bp, Artificial Sequence
  Synthetic Construct
agagctccatgcaaattccagat

SEQ ID NO: 13511 - DNA, 22 bp, Artificial Sequence
  Synthetic Construct
tggcacattcctccctgataca

SEQ ID NO: 13512 - DNA, 19 bp, Artificial Sequence
  Synthetic Construct
tggggctttgggctgacaa

SEQ ID NO: 13513 - DNA, 22 bp, Artificial Sequence
  Synthetic Construct
tgtggggagaaatggcaaaact

SEQ ID NO: 13514 - DNA, 20 bp, Artificial Sequence
  Synthetic Construct
gttcgcaccttggcttctgt

SEQ ID NO: 13515 - DNA, 22 bp, Artificial Sequence
  Synthetic Construct
ccggtgcatctctcatgcctta

SEQ ID NO: 13516 - DNA, 21 bp, Artificial Sequence
  Synthetic Construct
tccggtcacttggccttcttg

SEQ ID NO: 13517 - DNA, 24 bp, Artificial Sequence
  Synthetic Construct
gcctggaataccctttgcctgtct

SEQ ID NO: 13518 - DNA, 25 bp, Artificial Sequence
  Synthetic Construct
gataaggctcagggcttaatgatga

SEQ ID NO: 13519 - DNA, 24 bp, Artificial Sequence
  Synthetic Construct
cctccccaaatcctcactccattg

SEQ ID NO: 13520 - DNA, 23 bp, Artificial Sequence
  Synthetic Construct
ccttcctgtaggagacccagcta

SEQ ID NO: 13521 - DNA, 22 bp, Artificial Sequence
  Synthetic Construct
cagcttaagcctggtgaactct

SEQ ID NO: 13522 - DNA, 20 bp, Artificial Sequence
  Synthetic Construct
gcccattttgccctctgttg

SEQ ID NO: 13523 - DNA, 22 bp, Artificial Sequence
  Synthetic Construct
gtctcgcccaacctcattcttc

SEQ ID NO: 13524 - DNA, 27 bp, Artificial Sequence
  Synthetic Construct
cactccattcacagctaatgttacgat

SEQ ID NO: 13525 - DNA, 20 bp, Artificial Sequence
  Synthetic Construct
gcactagcagttggggcaat

SEQ ID NO: 13526 - DNA, 20 bp, Artificial Sequence
  Synthetic Construct
cccctaccccaaagccaaaa

SEQ ID NO: 13527 - DNA, 21 bp, Artificial Sequence
  Synthetic Construct
gctgtcgctcagccagttctt

SEQ ID NO: 13528 - DNA, 21 bp, Artificial Sequence
  Synthetic Construct
gcaggccctgtgatggatgat

SEQ ID NO: 13529 - DNA, 27 bp, Artificial Sequence
  Synthetic Construct
gccaatatccatggcataaatgaggtt

SEQ ID NO: 13530 - DNA, 24 bp, Artificial Sequence
  Synthetic Construct
gccagttgccgttgatctaagact

SEQ ID NO: 13531 - DNA, 22 bp, Artificial Sequence
  Synthetic Construct
cagcaggatgacttctgcgtta

SEQ ID NO: 13532 - DNA, 24 bp, Artificial Sequence
  Synthetic Construct
cttcctgagtggatggttgactct

SEQ ID NO: 13533 - DNA, 20 bp, Artificial Sequence
  Synthetic Construct
tgcgtgcagtgcagacagat

SEQ ID NO: 13534 - DNA, 21 bp, Artificial Sequence
  Synthetic Construct
aggactcctggaagcatgaga

SEQ ID NO: 13535 - DNA, 22 bp, Artificial Sequence
  Synthetic Construct
acactgtcccttccctcagcta

SEQ ID NO: 13536 - DNA, 21 bp, Artificial Sequence
  Synthetic Construct
tgacggaggtagacggtcagt

SEQ ID NO: 13537 - DNA, 25 bp, Artificial Sequence
  Synthetic Construct
gtggaaaagggtagcagtgatatgt

SEQ ID NO: 13538 - DNA, 20 bp, Artificial Sequence
  Synthetic Construct
acaggctgggaagtgtgctt

SEQ ID NO: 13539 - DNA, 22 bp, Artificial Sequence
  Synthetic Construct
cttcccctgtccttggcataac

SEQ ID NO: 13540 - DNA, 21 bp, Artificial Sequence
  Synthetic Construct
tgagttgaggcagggacatca

SEQ ID NO: 13541 - DNA, 23 bp, Artificial Sequence
  Synthetic Construct
cctgggagaccatttggaaaact

SEQ ID NO: 13542 - DNA, 22 bp, Artificial Sequence
  Synthetic Construct
tccctcctgtgtcctgttggaa

SEQ ID NO: 13543 - DNA, 20 bp, Artificial Sequence
  Synthetic Construct
catttgcccagctggccttt

SEQ ID NO: 13544 - DNA, 20 bp, Artificial Sequence
  Synthetic Construct
aggcccctgtctcctagtct

SEQ ID NO: 13545 - DNA, 21 bp, Artificial Sequence
  Synthetic Construct
cagggtagggaggtggagaag

SEQ ID NO: 13546 - DNA, 26 bp, Artificial Sequence
  Synthetic Construct
tgtagacaacctggaagaaacagatg

SEQ ID NO: 13547 - DNA, 24 bp, Artificial Sequence
  Synthetic Construct
cagaaaaggctggtatcccagaaa

SEQ ID NO: 13548 - DNA, 22 bp, Artificial Sequence
  Synthetic Construct
aaaccaagcaggtggaatcagt

SEQ ID NO: 13549 - DNA, 27 bp, Artificial Sequence
  Synthetic Construct
ggtttaaagaccgtgaatgatcccaaa

SEQ ID NO: 13550 - DNA, 23 bp, Artificial Sequence
  Synthetic Construct
gtgcctaaggctagtgtcattct

SEQ ID NO: 13551 - DNA, 24 bp, Artificial Sequence
  Synthetic Construct
gacagagcatttcaggtggagagt

SEQ ID NO: 13552 - DNA, 24 bp, Artificial Sequence
  Synthetic Construct
gagtctccccaggcctattaggtt

SEQ ID NO: 13553 - DNA, 21 bp, Artificial Sequence
  Synthetic Construct
ccattcctcccggtacagtct

SEQ ID NO: 13554 - DNA, 20 bp, Artificial Sequence
  Synthetic Construct
ttctggggctgctactcaca

SEQ ID NO: 13555 - DNA, 23 bp, Artificial Sequence
  Synthetic Construct
gcacttctgccattcagtgtgta

SEQ ID NO: 13556 - DNA, 23 bp, Artificial Sequence
  Synthetic Construct
gggtggttccaaagaagggatca

SEQ ID NO: 13557 - DNA, 21 bp, Artificial Sequence
  Synthetic Construct
tccacccgcttctccacatga

SEQ ID NO: 13558 - DNA, 22 bp, Artificial Sequence
  Synthetic Construct
gatgactggtgcctgagggaaa

SEQ ID NO: 13559 - DNA, 23 bp, Artificial Sequence
  Synthetic Construct
ctgagactagagtgcctccttca

SEQ ID NO: 13560 - DNA, 23 bp, Artificial Sequence
  Synthetic Construct
ggggttttgccagtcatctaagt

SEQ ID NO: 13561 - DNA, 23 bp, Artificial Sequence
  Synthetic Construct
gcatggtggtctctgggtagttg

SEQ ID NO: 13562 - DNA, 22 bp, Artificial Sequence
  Synthetic Construct
gggatggggacaagggaaatca

SEQ ID NO: 13563 - DNA, 24 bp, Artificial Sequence
  Synthetic Construct
ctctctgggtttctgtctgcattc

SEQ ID NO: 13564 - DNA, 24 bp, Artificial Sequence
  Synthetic Construct
caccttgtcttcaggtgagtgcta

SEQ ID NO: 13565 - DNA, 19 bp, Artificial Sequence
  Synthetic Construct
ggcacgctgcacactcctt

SEQ ID NO: 13566 - DNA, 20 bp, Artificial Sequence
  Synthetic Construct
gggaatgggccaagactcaa

SEQ ID NO: 13567 - DNA, 20 bp, Artificial Sequence
  Synthetic Construct
gggcagcgtcctgacatagt

SEQ ID NO: 13568 - DNA, 24 bp, Artificial Sequence
  Synthetic Construct
gggaatggagaccagcagagacta

SEQ ID NO: 13569 - DNA, 22 bp, Artificial Sequence
  Synthetic Construct
ttgtaaagtggttgccgagtct

SEQ ID NO: 13570 - DNA, 20 bp, Artificial Sequence
  Synthetic Construct
agaccccagggccaccatga

SEQ ID NO: 13571 - DNA, 22 bp, Artificial Sequence
  Synthetic Construct
gccagtctgtcgatgctcttgt

SEQ ID NO: 13572 - DNA, 24 bp, Artificial Sequence
  Synthetic Construct
gtgttacaccaaatgccactgaag

SEQ ID NO: 13573 - DNA, 21 bp, Artificial Sequence
  Synthetic Construct
tgggctgtacaagctgctttc

SEQ ID NO: 13574 - DNA, 25 bp, Artificial Sequence
  Synthetic Construct
ctgtaacacaagaatgcgtgcatca

SEQ ID NO: 13575 - DNA, 23 bp, Artificial Sequence
  Synthetic Construct
ggcagatgggacactttttcttg

SEQ ID NO: 13576 - DNA, 21 bp, Artificial Sequence
  Synthetic Construct
gggttgacaccaggtgagaga

SEQ ID NO: 13577 - DNA, 24 bp, Artificial Sequence
  Synthetic Construct
cacttaatctccaccacagtgcta

SEQ ID NO: 13578 - DNA, 19 bp, Artificial Sequence
  Synthetic Construct
aggccagctttgcctctgt

SEQ ID NO: 13579 - DNA, 21 bp, Artificial Sequence
  Synthetic Construct
gatgcactggagtgggcattt

SEQ ID NO: 13580 - DNA, 25 bp, Artificial Sequence
  Synthetic Construct
caggctcacttttggatcaggcaat

SEQ ID NO: 13581 - DNA, 24 bp, Artificial Sequence
  Synthetic Construct
cagctggtatctggtggaatactt

SEQ ID NO: 13582 - DNA, 21 bp, Artificial Sequence
  Synthetic Construct
acccctctcactcaggagaca

SEQ ID NO: 13583 - DNA, 22 bp, Artificial Sequence
  Synthetic Construct
ccacaaaggggttgccttgaga

SEQ ID NO: 13584 - DNA, 21 bp, Artificial Sequence
  Synthetic Construct
cagaactgtgtgctgcctgaa

SEQ ID NO: 13585 - DNA, 24 bp, Artificial Sequence
  Synthetic Construct
gactcagaggagactcccttcata

SEQ ID NO: 13586 - DNA, 20 bp, Artificial Sequence
  Synthetic Construct
aggtctgccccagaggaaat

SEQ ID NO: 13587 - DNA, 22 bp, Artificial Sequence
  Synthetic Construct
cctctgtgccttggtagaggaa

SEQ ID NO: 13588 - DNA, 20 bp, Artificial Sequence
  Synthetic Construct
agtaccagccctgccactga

SEQ ID NO: 13589 - DNA, 20 bp, Artificial Sequence
  Synthetic Construct
gttggccctgcttggtactt

SEQ ID NO: 13590 - DNA, 22 bp, Artificial Sequence
  Synthetic Construct
gcactacgctaccctgaactac

SEQ ID NO: 13591 - DNA, 25 bp, Artificial Sequence
  Synthetic Construct
ctggcattgtgtaggaaaggagaga

SEQ ID NO: 13592 - DNA, 21 bp, Artificial Sequence
  Synthetic Construct
ctcaggcttcgcacttgatct

SEQ ID NO: 13593 - DNA, 24 bp, Artificial Sequence
  Synthetic Construct
cccaattcctaatgcggcaaatgt

SEQ ID NO: 13594 - DNA, 25 bp, Artificial Sequence
  Synthetic Construct
gaagggagcaggaattcactcaatc

SEQ ID NO: 13595 - DNA, 22 bp, Artificial Sequence
  Synthetic Construct
ggtggctatccagagtgtgtct

SEQ ID NO: 13596 - DNA, 24 bp, Artificial Sequence
  Synthetic Construct
ggggcagagtggtgatggataaca

SEQ ID NO: 13597 - DNA, 24 bp, Artificial Sequence
  Synthetic Construct
catcagaagacctgcatagctaca

SEQ ID NO: 13598 - DNA, 25 bp, Artificial Sequence
  Synthetic Construct
gtgctggcactaaaaggatacaatg

SEQ ID NO: 13599 - DNA, 20 bp, Artificial Sequence
  Synthetic Construct
gcaagcggtttccactctga

SEQ ID NO: 13600 - DNA, 25 bp, Artificial Sequence
  Synthetic Construct
cttgctcactgctaaactctcagat

SEQ ID NO: 13601 - DNA, 20 bp, Artificial Sequence
  Synthetic Construct
ggcatccaaggagcaacaga

SEQ ID NO: 13602 - DNA, 22 bp, Artificial Sequence
  Synthetic Construct
ccgtccatgtgctgtcatctct

SEQ ID NO: 13603 - DNA, 21 bp, Artificial Sequence
  Synthetic Construct
tccggtacctggctcttggat

SEQ ID NO: 13604 - DNA, 24 bp, Artificial Sequence
  Synthetic Construct
gttaggtggcataacaagctgatg

SEQ ID NO: 13605 - DNA, 25 bp, Artificial Sequence
  Synthetic Construct
cagccctttagggtatctgcacttg

SEQ ID NO: 13606 - DNA, 22 bp, Artificial Sequence
  Synthetic Construct
aggtggtctgaccttcctcctt

SEQ ID NO: 13607 - DNA, 22 bp, Artificial Sequence
  Synthetic Construct
gtccctactccagggcatattg

SEQ ID NO: 13608 - DNA, 21 bp, Artificial Sequence
  Synthetic Construct
gggactgtgcagacaaaccaa

SEQ ID NO: 13609 - DNA, 26 bp, Artificial Sequence
  Synthetic Construct
cagtgagaagagagtgcaaagtcatt

SEQ ID NO: 13610 - DNA, 23 bp, Artificial Sequence
  Synthetic Construct
cacagtcacagacatggatggta

SEQ ID NO: 13611 - DNA, 24 bp, Artificial Sequence
  Synthetic Construct
gaggataacctttgcttgggtaca

SEQ ID NO: 13612 - DNA, 22 bp, Artificial Sequence
  Synthetic Construct
agtgtgatgtgctgttgtgttg

SEQ ID NO: 13613 - DNA, 25 bp, Artificial Sequence
  Synthetic Construct
gggtttcagcagcatattccaggta

SEQ ID NO: 13614 - DNA, 22 bp, Artificial Sequence
  Synthetic Construct
aggcctggttgtcatccctcaa

SEQ ID NO: 13615 - DNA, 20 bp, Artificial Sequence
  Synthetic Construct
gcgtggattgtgggcagtca

SEQ ID NO: 13616 - DNA, 22 bp, Artificial Sequence
  Synthetic Construct
gtgctggcctgttctccataag

SEQ ID NO: 13617 - DNA, 21 bp, Artificial Sequence
  Synthetic Construct
aggctgctggcacagacctat

SEQ ID NO: 13618 - DNA, 22 bp, Artificial Sequence
  Synthetic Construct
gacggcctcattggagcatagt

SEQ ID NO: 13619 - DNA, 22 bp, Artificial Sequence
  Synthetic Construct
aggagcagatctggctgagttg

SEQ ID NO: 13620 - DNA, 22 bp, Artificial Sequence
  Synthetic Construct
gcctcacccattcattccatca

SEQ ID NO: 13621 - DNA, 23 bp, Artificial Sequence
  Synthetic Construct
actggagtcaggaagggtaatca

SEQ ID NO: 13622 - DNA, 22 bp, Artificial Sequence
  Synthetic Construct
actgcaagtgggtgatttgcta

SEQ ID NO: 13623 - DNA, 22 bp, Artificial Sequence
  Synthetic Construct
acagtgctcaccattggaaaca

SEQ ID NO: 13624 - DNA, 24 bp, Artificial Sequence
  Synthetic Construct
gggcaatgtgttacataggtggaa

SEQ ID NO: 13625 - DNA, 20 bp, Artificial Sequence
  Synthetic Construct
tgggcctttgaggacacaga

SEQ ID NO: 13626 - DNA, 22 bp, Artificial Sequence
  Synthetic Construct
ctggcctcgcaataaacctttc

SEQ ID NO: 13627 - DNA, 24 bp, Artificial Sequence
  Synthetic Construct
gggagcaggaaggcaagaacatta

SEQ ID NO: 13628 - DNA, 21 bp, Artificial Sequence
  Synthetic Construct
tcccacccctgtcacagactt

SEQ ID NO: 13629 - DNA, 21 bp, Artificial Sequence
  Synthetic Construct
tgctagacccggagtcacttg

SEQ ID NO: 13630 - DNA, 21 bp, Artificial Sequence
  Synthetic Construct
ccactggcggcaggaatgaat

SEQ ID NO: 13631 - DNA, 26 bp, Artificial Sequence
  Synthetic Construct
gcctggagatgtatcggtgtaacttg

SEQ ID NO: 13632 - DNA, 21 bp, Artificial Sequence
  Synthetic Construct
ttcctggctttgctgcttttc

SEQ ID NO: 13633 - DNA, 23 bp, Artificial Sequence
  Synthetic Construct
ggtgactgttttaatccgtgcaa

SEQ ID NO: 13634 - DNA, 22 bp, Artificial Sequence
  Synthetic Construct
gaaccgggacttcccagctaat

SEQ ID NO: 13635 - DNA, 23 bp, Artificial Sequence
  Synthetic Construct
caggtgctatggctgtgaacttg

SEQ ID NO: 13636 - DNA, 23 bp, Artificial Sequence
  Synthetic Construct
ccaccacctcagttccacacaaa

SEQ ID NO: 13637 - DNA, 22 bp, Artificial Sequence
  Synthetic Construct
tctccttgttgctgtgcttttg

SEQ ID NO: 13638 - DNA, 24 bp, Artificial Sequence
  Synthetic Construct
ctgtcctggtcttcattgaccaaa

SEQ ID NO: 13639 - DNA, 21 bp, Artificial Sequence
  Synthetic Construct
gctacctcattcgggcgcatt

SEQ ID NO: 13640 - DNA, 19 bp, Artificial Sequence
  Synthetic Construct
gaggaagggcacgggtttg

SEQ ID NO: 13641 - DNA, 24 bp, Artificial Sequence
  Synthetic Construct
cagaaggaagccttcaaagacact

SEQ ID NO: 13642 - DNA, 21 bp, Artificial Sequence
  Synthetic Construct
tgcagtgaggtttggaacaca

SEQ ID NO: 13643 - DNA, 22 bp, Artificial Sequence
  Synthetic Construct
gtgccttgccaaacagggaaga

SEQ ID NO: 13644 - DNA, 21 bp, Artificial Sequence
  Synthetic Construct
ctcagagggctctccttccat

SEQ ID NO: 13645 - DNA, 22 bp, Artificial Sequence
  Synthetic Construct
gtccaagcagggccttctgatt

SEQ ID NO: 13646 - DNA, 22 bp, Artificial Sequence
  Synthetic Construct
gcgaagaggaatacgctcaaag

SEQ ID NO: 13647 - DNA, 25 bp, Artificial Sequence
  Synthetic Construct
gtcttgggctctatttgccaggttt

SEQ ID NO: 13648 - DNA, 23 bp, Artificial Sequence
  Synthetic Construct
cagtggaaatctgcccattttgt

SEQ ID NO: 13649 - DNA, 22 bp, Artificial Sequence
  Synthetic Construct
gagcctgtggacagaaccacta

SEQ ID NO: 13650 - DNA, 25 bp, Artificial Sequence
  Synthetic Construct
ggatgagtcctctagttttggtgtt

SEQ ID NO: 13651 - DNA, 25 bp, Artificial Sequence
  Synthetic Construct
ccctcaaagcaacattggctacact

SEQ ID NO: 13652 - DNA, 24 bp, Artificial Sequence
  Synthetic Construct
gagctggacttccttttctcactt

SEQ ID NO: 13653 - DNA, 22 bp, Artificial Sequence
  Synthetic Construct
gccctcccaagggaaggtctta

SEQ ID NO: 13654 - DNA, 22 bp, Artificial Sequence
  Synthetic Construct
agtccaagggtaggggagttag

SEQ ID NO: 13655 - DNA, 20 bp, Artificial Sequence
  Synthetic Construct
ccgttcgcgctctgttcctt

SEQ ID NO: 13656 - DNA, 24 bp, Artificial Sequence
  Synthetic Construct
ccaaaagcaggagaatggggttct

SEQ ID NO: 13657 - DNA, 22 bp, Artificial Sequence
  Synthetic Construct
cggtttcctcgtagccctaaac

SEQ ID NO: 13658 - DNA, 22 bp, Artificial Sequence
  Synthetic Construct
aggcagctcttacctccccatt

SEQ ID NO: 13659 - DNA, 22 bp, Artificial Sequence
  Synthetic Construct
caggtcagagaacctgtgtgaa

SEQ ID NO: 13660 - DNA, 25 bp, Artificial Sequence
  Synthetic Construct
ggcaatgacactggaaaagaatcaa

SEQ ID NO: 13661 - DNA, 20 bp, Artificial Sequence
  Synthetic Construct
agctcctccatggcctgtct

SEQ ID NO: 13662 - DNA, 23 bp, Artificial Sequence
  Synthetic Construct
gaatggtgagagaggaggtctga

SEQ ID NO: 13663 - DNA, 20 bp, Artificial Sequence
  Synthetic Construct
agcatgggccttggtgacat

SEQ ID NO: 13664 - DNA, 27 bp, Artificial Sequence
  Synthetic Construct
gagaagggtggcatctaaaacagagaa

SEQ ID NO: 13665 - DNA, 24 bp, Artificial Sequence
  Synthetic Construct
ctctgctttgtgactgtgctcctt

SEQ ID NO: 13666 - DNA, 24 bp, Artificial Sequence
  Synthetic Construct
atccgagagcttcctagaatcaac

SEQ ID NO: 13667 - DNA, 21 bp, Artificial Sequence
  Synthetic Construct
ttggagtgcctcgccagcttt

SEQ ID NO: 13668 - DNA, 30 bp, Artificial Sequence
  Synthetic Construct
ccgtgtctctagtctcttcccatcctaata

SEQ ID NO: 13669 - DNA, 22 bp, Artificial Sequence
  Synthetic Construct
tcctcccttcctctgcctgaag

SEQ ID NO: 13670 - DNA, 23 bp, Artificial Sequence
  Synthetic Construct
cacaccagcttctccttcattct

SEQ ID NO: 13671 - DNA, 24 bp, Artificial Sequence
  Synthetic Construct
atcgtctctggattgcttctgatt

SEQ ID NO: 13672 - DNA, 22 bp, Artificial Sequence
  Synthetic Construct
gctcggttggcttctgtccaat

SEQ ID NO: 13673 - DNA, 20 bp, Artificial Sequence
  Synthetic Construct
ggtggttgcgtggcattgaa

SEQ ID NO: 13674 - DNA, 18 bp, Artificial Sequence
  Synthetic Construct
cgggagtcacggatgcaa

SEQ ID NO: 13675 - DNA, 22 bp, Artificial Sequence
  Synthetic Construct
ctcccatgcacagtgtctcaca

SEQ ID NO: 13676 - DNA, 22 bp, Artificial Sequence
  Synthetic Construct
acggctcagcttttccattagt

SEQ ID NO: 13677 - DNA, 22 bp, Artificial Sequence
  Synthetic Construct
gagaacctacaacgccgtctct

SEQ ID NO: 13678 - DNA, 22 bp, Artificial Sequence
  Synthetic Construct
ggggcagactcttggaaagaca

SEQ ID NO: 13679 - DNA, 23 bp, Artificial Sequence
  Synthetic Construct
cacccgcattggactgagagttt

SEQ ID NO: 13680 - DNA, 25 bp, Artificial Sequence
  Synthetic Construct
gacatgcaatgttccatgctgtcaa

SEQ ID NO: 13681 - DNA, 22 bp, Artificial Sequence
  Synthetic Construct
gcccaccaaccttctctcttct

SEQ ID NO: 13682 - DNA, 22 bp, Artificial Sequence
  Synthetic Construct
ctggagcctgaactttctgctt

SEQ ID NO: 13683 - DNA, 20 bp, Artificial Sequence
  Synthetic Construct
atgccggagctgtcctctaa

SEQ ID NO: 13684 - DNA, 23 bp, Artificial Sequence
  Synthetic Construct
gggagttctctaaggctgcagaa

SEQ ID NO: 13685 - DNA, 22 bp, Artificial Sequence
  Synthetic Construct
gactggtgttccagatgtcagt

SEQ ID NO: 13686 - DNA, 26 bp, Artificial Sequence
  Synthetic Construct
cgatcagaactatccatgcctctttg

SEQ ID NO: 13687 - DNA, 25 bp, Artificial Sequence
  Synthetic Construct
gcattgctgtttgtcatgcaatagt

SEQ ID NO: 13688 - DNA, 26 bp, Artificial Sequence
  Synthetic Construct
cccactgctcctattttgggttattg

SEQ ID NO: 13689 - DNA, 23 bp, Artificial Sequence
  Synthetic Construct
cctaacaggtctggaaggctcaa

SEQ ID NO: 13690 - DNA, 22 bp, Artificial Sequence
  Synthetic Construct
gcaagcagctttttcacgttgt

SEQ ID NO: 13691 - DNA, 25 bp, Artificial Sequence
  Synthetic Construct
caactcctttcacccctggagattc

SEQ ID NO: 13692 - DNA, 25 bp, Artificial Sequence
  Synthetic Construct
gaactgtacggaaagtgagctgaac

SEQ ID NO: 13693 - DNA, 24 bp, Artificial Sequence
  Synthetic Construct
aaagaaagactggaacgtgagact

SEQ ID NO: 13694 - DNA, 23 bp, Artificial Sequence
  Synthetic Construct
ggctacctccacaaacacacatc

SEQ ID NO: 13695 - DNA, 20 bp, Artificial Sequence
  Synthetic Construct
agggaccgctcaggtgatgt

SEQ ID NO: 13696 - DNA, 24 bp, Artificial Sequence
  Synthetic Construct
gcgagaggtaggaactgtgtgctt

SEQ ID NO: 13697 - DNA, 21 bp, Artificial Sequence
  Synthetic Construct
tcccctactggggactgtttt

SEQ ID NO: 13698 - DNA, 23 bp, Artificial Sequence
  Synthetic Construct
gccatgcaactctatcactcaca

SEQ ID NO: 13699 - DNA, 24 bp, Artificial Sequence
  Synthetic Construct
gctattggcagatgcagacattca

SEQ ID NO: 13700 - DNA, 25 bp, Artificial Sequence
  Synthetic Construct
cacacaggtgtagacctaactgcta

SEQ ID NO: 13701 - DNA, 24 bp, Artificial Sequence
  Synthetic Construct
tgctgggtgcagaaattaaacaag

SEQ ID NO: 13702 - DNA, 26 bp, Artificial Sequence
  Synthetic Construct
ccagacagagtgggaggttatagaga

SEQ ID NO: 13703 - DNA, 24 bp, Artificial Sequence
  Synthetic Construct
ggaatgcaaaacccttgagccaaa

SEQ ID NO: 13704 - DNA, 23 bp, Artificial Sequence
  Synthetic Construct
aggggagtttcacacacagaaaa

SEQ ID NO: 13705 - DNA, 23 bp, Artificial Sequence
  Synthetic Construct
ctctagacctcacgagcacaagt

SEQ ID NO: 13706 - DNA, 21 bp, Artificial Sequence
  Synthetic Construct
aggacccagcatcttcctttg

SEQ ID NO: 13707 - DNA, 26 bp, Artificial Sequence
  Synthetic Construct
ttctccctagaggaatacaacctcat

SEQ ID NO: 13708 - DNA, 22 bp, Artificial Sequence
  Synthetic Construct
agtggctgacacttttgacaga

SEQ ID NO: 13709 - DNA, 26 bp, Artificial Sequence
  Synthetic Construct
cttgctatgaactcccatcactttct

SEQ ID NO: 13710 - DNA, 20 bp, Artificial Sequence
  Synthetic Construct
acagtgcccagagctcacaa

SEQ ID NO: 13711 - DNA, 22 bp, Artificial Sequence
  Synthetic Construct
gctcaagggtgtggtgctttct

SEQ ID NO: 13712 - DNA, 21 bp, Artificial Sequence
  Synthetic Construct
ggggtggtgggtactgtctgt

SEQ ID NO: 13713 - DNA, 23 bp, Artificial Sequence
  Synthetic Construct
gcctggggctacaacttttatga

SEQ ID NO: 13714 - DNA, 22 bp, Artificial Sequence
  Synthetic Construct
tgttagggcttccctcttgact

SEQ ID NO: 13715 - DNA, 24 bp, Artificial Sequence
  Synthetic Construct
ggactactaaggggcatggttaga

SEQ ID NO: 13716 - DNA, 27 bp, Artificial Sequence
  Synthetic Construct
gactggatgctgttcagtgaaatttgt

SEQ ID NO: 13717 - DNA, 24 bp, Artificial Sequence
  Synthetic Construct
ggagatgcagctggtgagaacctt

SEQ ID NO: 13718 - DNA, 22 bp, Artificial Sequence
  Synthetic Construct
ggcccctctcagttgaagaaag

SEQ ID NO: 13719 - DNA, 23 bp, Artificial Sequence
  Synthetic Construct
gagaaagcccacttggagagact

SEQ ID NO: 13720 - DNA, 22 bp, Artificial Sequence
  Synthetic Construct
ggtgcaggactgataagcagat

SEQ ID NO: 13721 - DNA, 22 bp, Artificial Sequence
  Synthetic Construct
cttgccaccagatccactcaga

SEQ ID NO: 13722 - DNA, 22 bp, Artificial Sequence
  Synthetic Construct
cgccgttctcaagcccaagttt

SEQ ID NO: 13723 - DNA, 21 bp, Artificial Sequence
  Synthetic Construct
caagccaaagccacccattac

SEQ ID NO: 13724 - DNA, 23 bp, Artificial Sequence
  Synthetic Construct
gtacacgggtagggttgttttgt

SEQ ID NO: 13725 - DNA, 22 bp, Artificial Sequence
  Synthetic Construct
ctggggaaagggacaggttgaa

SEQ ID NO: 13726 - DNA, 22 bp, Artificial Sequence
  Synthetic Construct
gagattggcagtccaggtgtgt

SEQ ID NO: 13727 - DNA, 22 bp, Artificial Sequence
  Synthetic Construct
tggaagggtttgagtgggtttt

SEQ ID NO: 13728 - DNA, 23 bp, Artificial Sequence
  Synthetic Construct
gctgaactgcttgcacttcttac

SEQ ID NO: 13729 - DNA, 24 bp, Artificial Sequence
  Synthetic Construct
ggaacacataaggcctgagggaat

SEQ ID NO: 13730 - DNA, 24 bp, Artificial Sequence
  Synthetic Construct
ggcactgtactgggagatgaagaa

SEQ ID NO: 13731 - DNA, 22 bp, Artificial Sequence
  Synthetic Construct
gcaggacaaaagccaactctgt

SEQ ID NO: 13732 - DNA, 20 bp, Artificial Sequence
  Synthetic Construct
ccccagtgatttcgggttga

SEQ ID NO: 13733 - DNA, 22 bp, Artificial Sequence
  Synthetic Construct
ggaccacaccaatgaccagcaa

SEQ ID NO: 13734 - DNA, 20 bp, Artificial Sequence
  Synthetic Construct
ggtggtccccttgccagttt

SEQ ID NO: 13735 - DNA, 21 bp, Artificial Sequence
  Synthetic Construct
gcttctcatcgttgggcttga

SEQ ID NO: 13736 - DNA, 21 bp, Artificial Sequence
  Synthetic Construct
ccctggagtaccagctcctat

SEQ ID NO: 13737 - DNA, 24 bp, Artificial Sequence
  Synthetic Construct
gcagcacctggctcagagtagata

SEQ ID NO: 13738 - DNA, 20 bp, Artificial Sequence
  Synthetic Construct
tgcctcggatcaccaagtgt

SEQ ID NO: 13739 - DNA, 22 bp, Artificial Sequence
  Synthetic Construct
cgaggggcctgaagacttagaa

SEQ ID NO: 13740 - DNA, 26 bp, Artificial Sequence
  Synthetic Construct
ggttttacacaggtgaggttgtgatg

SEQ ID NO: 13741 - DNA, 22 bp, Artificial Sequence
  Synthetic Construct
aggaattgccctgcagcctatc

SEQ ID NO: 13742 - DNA, 25 bp, Artificial Sequence
  Synthetic Construct
cacaagtcccagaagaaaaggtgtt

SEQ ID NO: 13743 - DNA, 26 bp, Artificial Sequence
  Synthetic Construct
cacagacgcacacgtatacaccatag

SEQ ID NO: 13744 - DNA, 23 bp, Artificial Sequence
  Synthetic Construct
ggcacatggttccaaaggtggta

SEQ ID NO: 13745 - DNA, 21 bp, Artificial Sequence
  Synthetic Construct
ttcccaggtggtcacgctatg

SEQ ID NO: 13746 - DNA, 23 bp, Artificial Sequence
  Synthetic Construct
ggactgtgccaccatctctgtag

SEQ ID NO: 13747 - DNA, 24 bp, Artificial Sequence
  Synthetic Construct
ccagttgagaaggtcccagtctct

SEQ ID NO: 13748 - DNA, 21 bp, Artificial Sequence
  Synthetic Construct
gggaggccaagaaagctgcat

SEQ ID NO: 13749 - DNA, 27 bp, Artificial Sequence
  Synthetic Construct
cctagttatttccttgccacactttga

SEQ ID NO: 13750 - DNA, 20 bp, Artificial Sequence
  Synthetic Construct
gtgaccctgcgaccctgaag

SEQ ID NO: 13751 - DNA, 20 bp, Artificial Sequence
  Synthetic Construct
acccacagtacccacagctt

SEQ ID NO: 13752 - DNA, 20 bp, Artificial Sequence
  Synthetic Construct
gccagtcctcctgtcgaagt

SEQ ID NO: 13753 - DNA, 24 bp, Artificial Sequence
  Synthetic Construct
ccttccagaaaatcggccttgtgt

SEQ ID NO: 13754 - DNA, 21 bp, Artificial Sequence
  Synthetic Construct
cagacccaaaggtcccacttg

SEQ ID NO: 13755 - DNA, 21 bp, Artificial Sequence
  Synthetic Construct
ggcagacaagcaagacagcaa

SEQ ID NO: 13756 - DNA, 26 bp, Artificial Sequence
  Synthetic Construct
gtctgaaccagagagctcctatccta

SEQ ID NO: 13757 - DNA, 21 bp, Artificial Sequence
  Synthetic Construct
gccactgaggttctggtcgtt

SEQ ID NO: 13758 - DNA, 26 bp, Artificial Sequence
  Synthetic Construct
caagtttactgcaatggtgagtcaag

SEQ ID NO: 13759 - DNA, 25 bp, Artificial Sequence
  Synthetic Construct
cttgggaagcaatgaggcaaagaag

SEQ ID NO: 13760 - DNA, 23 bp, Artificial Sequence
  Synthetic Construct
gctgcttgtcacactgtctctct

SEQ ID NO: 13761 - DNA, 21 bp, Artificial Sequence
  Synthetic Construct
tgctacccttgtgaccaggaa

SEQ ID NO: 13762 - DNA, 22 bp, Artificial Sequence
  Synthetic Construct
tgaggcccaggtgttgttctca

SEQ ID NO: 13763 - DNA, 22 bp, Artificial Sequence
  Synthetic Construct
gccagttgctggctacagtgaa

SEQ ID NO: 13764 - DNA, 25 bp, Artificial Sequence
  Synthetic Construct
ttccatctaaacatggcctcataca

SEQ ID NO: 13765 - DNA, 22 bp, Artificial Sequence
  Synthetic Construct
gccctgctttctgcatctctgt

SEQ ID NO: 13766 - DNA, 20 bp, Artificial Sequence
  Synthetic Construct
agcagcagcatccagcactt

SEQ ID NO: 13767 - DNA, 26 bp, Artificial Sequence
  Synthetic Construct
cccttaagtagggacaggttggactt

SEQ ID NO: 13768 - DNA, 22 bp, Artificial Sequence
  Synthetic Construct
caaaggctcaactttgcaccaa

SEQ ID NO: 13769 - DNA, 23 bp, Artificial Sequence
  Synthetic Construct
cagagacaatgatggggctcttc

SEQ ID NO: 13770 - DNA, 18 bp, Artificial Sequence
  Synthetic Construct
gccaggccactgtgtgat

SEQ ID NO: 13771 - DNA, 24 bp, Artificial Sequence
  Synthetic Construct
ggtgtgagttttgttccctgacta

SEQ ID NO: 13772 - DNA, 21 bp, Artificial Sequence
  Synthetic Construct
ggggcctttgggaaagacact

SEQ ID NO: 13773 - DNA, 27 bp, Artificial Sequence
  Synthetic Construct
ccatgagttgagtgccttgtaaaatgt

SEQ ID NO: 13774 - DNA, 24 bp, Artificial Sequence
  Synthetic Construct
gttggatgctggtactctcagcta

SEQ ID NO: 13775 - DNA, 27 bp, Artificial Sequence
  Synthetic Construct
gacttacccaatagaagggtgagtaca

SEQ ID NO: 13776 - DNA, 22 bp, Artificial Sequence
  Synthetic Construct
ctggcattgtggggacagtcaa

SEQ ID NO: 13777 - DNA, 24 bp, Artificial Sequence
  Synthetic Construct
caccagtgggaagagactgagatg

SEQ ID NO: 13778 - DNA, 22 bp, Artificial Sequence
  Synthetic Construct
ggtgtcgagatctctggccatt

SEQ ID NO: 13779 - DNA, 23 bp, Artificial Sequence
  Synthetic Construct
gctggaggcaggttcacattttg

SEQ ID NO: 13780 - DNA, 22 bp, Artificial Sequence
  Synthetic Construct
actccacccagcgtgtcctatt

SEQ ID NO: 13781 - DNA, 24 bp, Artificial Sequence
  Synthetic Construct
gtataggaagtcactggtcagcaa

SEQ ID NO: 13782 - DNA, 26 bp, Artificial Sequence
  Synthetic Construct
cagaccctaagtggcatttttgagaa

SEQ ID NO: 13783 - DNA, 26 bp, Artificial Sequence
  Synthetic Construct
caacaggttccataggccagaattag

SEQ ID NO: 13784 - DNA, 23 bp, Artificial Sequence
  Synthetic Construct
catccagctagcagacactgaag

SEQ ID NO: 13785 - DNA, 22 bp, Artificial Sequence
  Synthetic Construct
tcagcttccatctcctgctttg

SEQ ID NO: 13786 - DNA, 23 bp, Artificial Sequence
  Synthetic Construct
tccttttgctacctgagcttgtt

SEQ ID NO: 13787 - DNA, 24 bp, Artificial Sequence
  Synthetic Construct
ggttgaagaaggggatgcgatgaa

SEQ ID NO: 13788 - DNA, 22 bp, Artificial Sequence
  Synthetic Construct
gtgagccattacctgggtttga

SEQ ID NO: 13789 - DNA, 23 bp, Artificial Sequence
  Synthetic Construct
tggattctggcaaatgcatgtct

SEQ ID NO: 13790 - DNA, 22 bp, Artificial Sequence
  Synthetic Construct
ccagaaatagctcctgctccaa

SEQ ID NO: 13791 - DNA, 20 bp, Artificial Sequence
  Synthetic Construct
aagtgagacgggtgccaact

SEQ ID NO: 13792 - DNA, 20 bp, Artificial Sequence
  Synthetic Construct
tcctctctggccagtggttt

SEQ ID NO: 13793 - DNA, 20 bp, Artificial Sequence
  Synthetic Construct
gccacagttcgggcttgact

SEQ ID NO: 13794 - DNA, 22 bp, Artificial Sequence
  Synthetic Construct
ccttctggatcaccaggtcact

SEQ ID NO: 13795 - DNA, 20 bp, Artificial Sequence
  Synthetic Construct
aagcatgccgagctgtggtt

SEQ ID NO: 13796 - DNA, 24 bp, Artificial Sequence
  Synthetic Construct
cctggcagtgaaactatggggatt

SEQ ID NO: 13797 - DNA, 23 bp, Artificial Sequence
  Synthetic Construct
cccgactaagtgtaagcactcaa

SEQ ID NO: 13798 - DNA, 24 bp, Artificial Sequence
  Synthetic Construct
ccctgattatgccacaagtcatct

SEQ ID NO: 13799 - DNA, 22 bp, Artificial Sequence
  Synthetic Construct
tggaagaaactgctgtgcaact

SEQ ID NO: 13800 - DNA, 24 bp, Artificial Sequence
  Synthetic Construct
ctacagtttggatgtgaggcattg

SEQ ID NO: 13801 - DNA, 22 bp, Artificial Sequence
  Synthetic Construct
ggaagcaaaggtctggttctga

SEQ ID NO: 13802 - DNA, 26 bp, Artificial Sequence
  Synthetic Construct
gctttgcatatccctacttactgcat

SEQ ID NO: 13803 - DNA, 25 bp, Artificial Sequence
  Synthetic Construct
cagcttgtaccctggtagggaaatg

SEQ ID NO: 13804 - DNA, 25 bp, Artificial Sequence
  Synthetic Construct
ctctgactgccttgtctccatcttc

SEQ ID NO: 13805 - DNA, 21 bp, Artificial Sequence
  Synthetic Construct
gggctgcaggaatacacaaca

SEQ ID NO: 13806 - DNA, 23 bp, Artificial Sequence
  Synthetic Construct
cagggctttacaacacccctgaa

SEQ ID NO: 13807 - DNA, 21 bp, Artificial Sequence
  Synthetic Construct
cctgcagcaagagcagtccta

SEQ ID NO: 13808 - DNA, 20 bp, Artificial Sequence
  Synthetic Construct
ccattgggccctacggcttt

SEQ ID NO: 13809 - DNA, 23 bp, Artificial Sequence
  Synthetic Construct
cctgcctccaagtgagaatcaga

SEQ ID NO: 13810 - DNA, 22 bp, Artificial Sequence
  Synthetic Construct
gcccgccatggaattgatttct

SEQ ID NO: 13811 - DNA, 23 bp, Artificial Sequence
  Synthetic Construct
gctggcgactctaaagccatctt

SEQ ID NO: 13812 - DNA, 20 bp, Artificial Sequence
  Synthetic Construct
cccctgacatctgggagtga

SEQ ID NO: 13813 - DNA, 21 bp, Artificial Sequence
  Synthetic Construct
gcactgtccccaaccctcaat

SEQ ID NO: 13814 - DNA, 23 bp, Artificial Sequence
  Synthetic Construct
ggagccattgaatcacgttcaca

SEQ ID NO: 13815 - DNA, 22 bp, Artificial Sequence
  Synthetic Construct
gagagacaggaaggaccactgt

SEQ ID NO: 13816 - DNA, 23 bp, Artificial Sequence
  Synthetic Construct
agtaacttgccaagggtttctga

SEQ ID NO: 13817 - DNA, 21 bp, Artificial Sequence
  Synthetic Construct
aggcaaacgtggatcccttac

SEQ ID NO: 13818 - DNA, 21 bp, Artificial Sequence
  Synthetic Construct
gagtgtgagcccattgctgta

SEQ ID NO: 13819 - DNA, 22 bp, Artificial Sequence
  Synthetic Construct
aagcaccagcatgcatgtgtaa

SEQ ID NO: 13820 - DNA, 24 bp, Artificial Sequence
  Synthetic Construct
gacatcccaagaaggtctacaagt

SEQ ID NO: 13821 - DNA, 22 bp, Artificial Sequence
  Synthetic Construct
cctgggtgagaccttcccttca

SEQ ID NO: 13822 - DNA, 21 bp, Artificial Sequence
  Synthetic Construct
cccagcatggttccagagtca

SEQ ID NO: 13823 - DNA, 23 bp, Artificial Sequence
  Synthetic Construct
aaccggaaaaggaagcatactca

SEQ ID NO: 13824 - DNA, 22 bp, Artificial Sequence
  Synthetic Construct
gtgacactgccgtcatcattca

SEQ ID NO: 13825 - DNA, 22 bp, Artificial Sequence
  Synthetic Construct
gacctttccaggaagagcttgt

SEQ ID NO: 13826 - DNA, 24 bp, Artificial Sequence
  Synthetic Construct
agggccaggtagaggtaggagtta

SEQ ID NO: 13827 - DNA, 22 bp, Artificial Sequence
  Synthetic Construct
cgtgcccagactgctgctttat

SEQ ID NO: 13828 - DNA, 24 bp, Artificial Sequence
  Synthetic Construct
ccagctctttctctcgatctttgt

SEQ ID NO: 13829 - DNA, 25 bp, Artificial Sequence
  Synthetic Construct
ctatcagattgcttgctgtttgctt

SEQ ID NO: 13830 - DNA, 24 bp, Artificial Sequence
  Synthetic Construct
gtcagggccttacattctcgacat

SEQ ID NO: 13831 - DNA, 22 bp, Artificial Sequence
  Synthetic Construct
cacctctaggcatccccacaaa

SEQ ID NO: 13832 - DNA, 24 bp, Artificial Sequence
  Synthetic Construct
gagccacaagcgataactttgaac

SEQ ID NO: 13833 - DNA, 20 bp, Artificial Sequence
  Synthetic Construct
cagccacactcctcatgctt

SEQ ID NO: 13834 - DNA, 24 bp, Artificial Sequence
  Synthetic Construct
gtccaggcttgatttcctcagtct

SEQ ID NO: 13835 - DNA, 22 bp, Artificial Sequence
  Synthetic Construct
ccctgtttcctgctgccttgat

SEQ ID NO: 13836 - DNA, 21 bp, Artificial Sequence
  Synthetic Construct
aagccaactcaactcgctgta

SEQ ID NO: 13837 - DNA, 22 bp, Artificial Sequence
  Synthetic Construct
cctgatggaagcatgggaatgt

SEQ ID NO: 13838 - DNA, 22 bp, Artificial Sequence
  Synthetic Construct
tgtggctaagacgtctgtgttg

SEQ ID NO: 13839 - DNA, 21 bp, Artificial Sequence
  Synthetic Construct
atggtcacctggaccgtgctt

SEQ ID NO: 13840 - DNA, 21 bp, Artificial Sequence
  Synthetic Construct
aactgggttctttgcctgtca

SEQ ID NO: 13841 - DNA, 20 bp, Artificial Sequence
  Synthetic Construct
ccaccatgcccagctagaaa

SEQ ID NO: 13842 - DNA, 22 bp, Artificial Sequence
  Synthetic Construct
aggccaggccaattcttaccta

SEQ ID NO: 13843 - DNA, 23 bp, Artificial Sequence
  Synthetic Construct
gcaccatggtaggtgttgaggat

SEQ ID NO: 13844 - DNA, 22 bp, Artificial Sequence
  Synthetic Construct
aagtcaaggctgggtaggtaga

SEQ ID NO: 13845 - DNA, 22 bp, Artificial Sequence
  Synthetic Construct
cagctactgggaggtggtttct

SEQ ID NO: 13846 - DNA, 23 bp, Artificial Sequence
  Synthetic Construct
cacccactcaccaagcctagttc

SEQ ID NO: 13847 - DNA, 21 bp, Artificial Sequence
  Synthetic Construct
tgtcctgcggcctcctaagtt

SEQ ID NO: 13848 - DNA, 19 bp, Artificial Sequence
  Synthetic Construct
agccccagttgctcacagt

SEQ ID NO: 13849 - DNA, 24 bp, Artificial Sequence
  Synthetic Construct
ctgtttactcagaggcacttgcta

SEQ ID NO: 13850 - DNA, 24 bp, Artificial Sequence
  Synthetic Construct
gtttcaggggttaggtgacagtct

SEQ ID NO: 13851 - DNA, 23 bp, Artificial Sequence
  Synthetic Construct
cccctgaacccaatttgcagaga

SEQ ID NO: 13852 - DNA, 21 bp, Artificial Sequence
  Synthetic Construct
tgagaaaggggccacccatca

SEQ ID NO: 13853 - DNA, 21 bp, Artificial Sequence
  Synthetic Construct
gtggagattccgccaggtgtt

SEQ ID NO: 13854 - DNA, 19 bp, Artificial Sequence
  Synthetic Construct
acctccaacgccgaacact

SEQ ID NO: 13855 - DNA, 22 bp, Artificial Sequence
  Synthetic Construct
gtcagctccacctgggtctttt

SEQ ID NO: 13856 - DNA, 22 bp, Artificial Sequence
  Synthetic Construct
tgcttaggccatttgccatttc

SEQ ID NO: 13857 - DNA, 21 bp, Artificial Sequence
  Synthetic Construct
cttgagagtggccttggaagt

SEQ ID NO: 13858 - DNA, 22 bp, Artificial Sequence
  Synthetic Construct
ccctcgcacatggctgaagaat

SEQ ID NO: 13859 - DNA, 19 bp, Artificial Sequence
  Synthetic Construct
tctgggcgatttggcagtt

SEQ ID NO: 13860 - DNA, 20 bp, Artificial Sequence
  Synthetic Construct
gcatgcccatgctcctgtgt

SEQ ID NO: 13861 - DNA, 23 bp, Artificial Sequence
  Synthetic Construct
ggataccatggctttaggcaagt

SEQ ID NO: 13862 - DNA, 24 bp, Artificial Sequence
  Synthetic Construct
gctgtctgcttagggttggtctct

SEQ ID NO: 13863 - DNA, 24 bp, Artificial Sequence
  Synthetic Construct
gacacagctaaagccccattaaac

SEQ ID NO: 13864 - DNA, 22 bp, Artificial Sequence
  Synthetic Construct
ggtttcccgcctcacagattga

SEQ ID NO: 13865 - DNA, 20 bp, Artificial Sequence
  Synthetic Construct
tgtgacgatggcctcagttc

SEQ ID NO: 13866 - DNA, 23 bp, Artificial Sequence
  Synthetic Construct
gggctccactacttactgggtta

SEQ ID NO: 13867 - DNA, 23 bp, Artificial Sequence
  Synthetic Construct
gggtcccggagttagtaatgttg

SEQ ID NO: 13868 - DNA, 23 bp, Artificial Sequence
  Synthetic Construct
ttggacctcaccttctggttttt

SEQ ID NO: 13869 - DNA, 25 bp, Artificial Sequence
  Synthetic Construct
cctctgctaaaatgcactcccttca

SEQ ID NO: 13870 - DNA, 21 bp, Artificial Sequence
  Synthetic Construct
gcctgtgggagtcaggtgaga

SEQ ID NO: 13871 - DNA, 21 bp, Artificial Sequence
  Synthetic Construct
ttcatccccacctccccatca

SEQ ID NO: 13872 - DNA, 21 bp, Artificial Sequence
  Synthetic Construct
ggcctgttgttaggcatgcaa

SEQ ID NO: 13873 - DNA, 20 bp, Artificial Sequence
  Synthetic Construct
ccaggggcctgaacatcttt

SEQ ID NO: 13874 - DNA, 25 bp, Artificial Sequence
  Synthetic Construct
ggtgatagcaaggccagaggttctt

SEQ ID NO: 13875 - DNA, 26 bp, Artificial Sequence
  Synthetic Construct
ccaaatgacttggaacaggagtttga

SEQ ID NO: 13876 - DNA, 22 bp, Artificial Sequence
  Synthetic Construct
ccagccctgattctggcattga

SEQ ID NO: 13877 - DNA, 22 bp, Artificial Sequence
  Synthetic Construct
gggcctcaaagctgcctttatc

SEQ ID NO: 13878 - DNA, 22 bp, Artificial Sequence
  Synthetic Construct
gcttctggaagccttcgctaac

SEQ ID NO: 13879 - DNA, 23 bp, Artificial Sequence
  Synthetic Construct
ggtctggtgcagtatcaccacta

SEQ ID NO: 13880 - DNA, 18 bp, Artificial Sequence
  Synthetic Construct
tcagcagcccctggtgat

SEQ ID NO: 13881 - DNA, 21 bp, Artificial Sequence
  Synthetic Construct
tgctggtggattggctctact

SEQ ID NO: 13882 - DNA, 22 bp, Artificial Sequence
  Synthetic Construct
agcattagcactgtgaggcttt

SEQ ID NO: 13883 - DNA, 25 bp, Artificial Sequence
  Synthetic Construct
cctggaatctcaggataacaaggaa

SEQ ID NO: 13884 - DNA, 22 bp, Artificial Sequence
  Synthetic Construct
cacaagtcctgcccttgtccat

SEQ ID NO: 13885 - DNA, 22 bp, Artificial Sequence
  Synthetic Construct
aacttcctggactgcaaagtca

SEQ ID NO: 13886 - DNA, 22 bp, Artificial Sequence
  Synthetic Construct
tggtccaattcagggccactct

SEQ ID NO: 13887 - DNA, 22 bp, Artificial Sequence
  Synthetic Construct
gcaaatactgccagaacagcaa

SEQ ID NO: 13888 - DNA, 19 bp, Artificial Sequence
  Synthetic Construct
agctggccttggcacttgt

SEQ ID NO: 13889 - DNA, 21 bp, Artificial Sequence
  Synthetic Construct
ggtgtcttgcaagcaggtgtt

SEQ ID NO: 13890 - DNA, 20 bp, Artificial Sequence
  Synthetic Construct
cccagcaccggtgagtgttt

SEQ ID NO: 13891 - DNA, 24 bp, Artificial Sequence
  Synthetic Construct
gctcttgcctactacaaggtcatc

SEQ ID NO: 13892 - DNA, 20 bp, Artificial Sequence
  Synthetic Construct
acgcagcagtaagcgtgcat

SEQ ID NO: 13893 - DNA, 25 bp, Artificial Sequence
  Synthetic Construct
ctccctacaccaaaacagaggatac

SEQ ID NO: 13894 - DNA, 24 bp, Artificial Sequence
  Synthetic Construct
tgatgagaggtgttgagtgcatta

SEQ ID NO: 13895 - DNA, 23 bp, Artificial Sequence
  Synthetic Construct
tgggtgcaaaatcactgagtagt

SEQ ID NO: 13896 - DNA, 20 bp, Artificial Sequence
  Synthetic Construct
tgcgctggtgtcactgatgt

SEQ ID NO: 13897 - DNA, 23 bp, Artificial Sequence
  Synthetic Construct
tgtctgacctgaaatcacagcat

SEQ ID NO: 13898 - DNA, 26 bp, Artificial Sequence
  Synthetic Construct
gccatggatttaatggaaaggtgtgt

SEQ ID NO: 13899 - DNA, 21 bp, Artificial Sequence
  Synthetic Construct
cgcacatagttgctgctgttg

SEQ ID NO: 13900 - DNA, 24 bp, Artificial Sequence
  Synthetic Construct
ggctcctgggttgattaaatctga

SEQ ID NO: 13901 - DNA, 23 bp, Artificial Sequence
  Synthetic Construct
cccagaaacaattcccgttggtt

SEQ ID NO: 13902 - DNA, 18 bp, Artificial Sequence
  Synthetic Construct
tccagcatgcccgcttgt

SEQ ID NO: 13903 - DNA, 20 bp, Artificial Sequence
  Synthetic Construct
tgccacgcaacccttcttgt

SEQ ID NO: 13904 - DNA, 22 bp, Artificial Sequence
  Synthetic Construct
gtgccgggtgctttccctataa

SEQ ID NO: 13905 - DNA, 20 bp, Artificial Sequence
  Synthetic Construct
tgtgtccgggcagagacttg

SEQ ID NO: 13906 - DNA, 26 bp, Artificial Sequence
  Synthetic Construct
ggtagcaaagcctcaaagaatccaaa

SEQ ID NO: 13907 - DNA, 21 bp, Artificial Sequence
  Synthetic Construct
tgtggacagattggcccaaag

SEQ ID NO: 13908 - DNA, 24 bp, Artificial Sequence
  Synthetic Construct
ggctggatcaaccagtcctttttc

SEQ ID NO: 13909 - DNA, 24 bp, Artificial Sequence
  Synthetic Construct
gagaagatccacggactctgttca

SEQ ID NO: 13910 - DNA, 22 bp, Artificial Sequence
  Synthetic Construct
aggtgctgctgattgagttctt

SEQ ID NO: 13911 - DNA, 21 bp, Artificial Sequence
  Synthetic Construct
tccaagacaagggagccagaa

SEQ ID NO: 13912 - DNA, 23 bp, Artificial Sequence
  Synthetic Construct
acagccctaaatgaggacctgta

SEQ ID NO: 13913 - DNA, 24 bp, Artificial Sequence
  Synthetic Construct
gggaacttctttctcactcacact

SEQ ID NO: 13914 - DNA, 25 bp, Artificial Sequence
  Synthetic Construct
ctctcttggaagttcggtggatttg

SEQ ID NO: 13915 - DNA, 23 bp, Artificial Sequence
  Synthetic Construct
ggtgcattccttctccccatttg

SEQ ID NO: 13916 - DNA, 20 bp, Artificial Sequence
  Synthetic Construct
tgtcaacagcagcacacact

SEQ ID NO: 13917 - DNA, 22 bp, Artificial Sequence
  Synthetic Construct
gagcgaggctgtcactaacgaa

SEQ ID NO: 13918 - DNA, 23 bp, Artificial Sequence
  Synthetic Construct
ccagggctttcagtgcaaataac

SEQ ID NO: 13919 - DNA, 21 bp, Artificial Sequence
  Synthetic Construct
ggccctgccaaattcctcaga

SEQ ID NO: 13920 - DNA, 21 bp, Artificial Sequence
  Synthetic Construct
tggggccagcagaattacttg

SEQ ID NO: 13921 - DNA, 19 bp, Artificial Sequence
  Synthetic Construct
atgacccgggagggcaaag

SEQ ID NO: 13922 - DNA, 24 bp, Artificial Sequence
  Synthetic Construct
gcaaaagcaggactaacaccacat

SEQ ID NO: 13923 - DNA, 19 bp, Artificial Sequence
  Synthetic Construct
tggcggatgggagggcatt

SEQ ID NO: 13924 - DNA, 24 bp, Artificial Sequence
  Synthetic Construct
gtgacgcaaacatcagcactcttc

SEQ ID NO: 13925 - DNA, 22 bp, Artificial Sequence
  Synthetic Construct
cctgtggggatttgagggttct

SEQ ID NO: 13926 - DNA, 25 bp, Artificial Sequence
  Synthetic Construct
gggatcttgggttaaaatgcaaaca

SEQ ID NO: 13927 - DNA, 23 bp, Artificial Sequence
  Synthetic Construct
gcctccagaaaaacttgccatca

SEQ ID NO: 13928 - DNA, 24 bp, Artificial Sequence
  Synthetic Construct
ggccacctgggaatagtttagtct

SEQ ID NO: 13929 - DNA, 26 bp, Artificial Sequence
  Synthetic Construct
gggccagagagttttgaataacaaag

SEQ ID NO: 13930 - DNA, 24 bp, Artificial Sequence
  Synthetic Construct
ccccagattctcagcttcatctct

SEQ ID NO: 13931 - DNA, 22 bp, Artificial Sequence
  Synthetic Construct
gctaaagaagctgggccgctaa

SEQ ID NO: 13932 - DNA, 23 bp, Artificial Sequence
  Synthetic Construct
gccaagtggcagtgaaaagaaga

SEQ ID NO: 13933 - DNA, 23 bp, Artificial Sequence
  Synthetic Construct
ttggagcttgcttcccatttttc

SEQ ID NO: 13934 - DNA, 23 bp, Artificial Sequence
  Synthetic Construct
ctcggatccatccagcaatgagt

SEQ ID NO: 13935 - DNA, 24 bp, Artificial Sequence
  Synthetic Construct
tgagaatcagggtcaaacttggaa

SEQ ID NO: 13936 - DNA, 23 bp, Artificial Sequence
  Synthetic Construct
ctattaagatgggctggcagtca

SEQ ID NO: 13937 - DNA, 26 bp, Artificial Sequence
  Synthetic Construct
cccctcttattatacaggagccttac

SEQ ID NO: 13938 - DNA, 22 bp, Artificial Sequence
  Synthetic Construct
tctccaatgaccgggtgacaag

SEQ ID NO: 13939 - DNA, 24 bp, Artificial Sequence
  Synthetic Construct
cttgactccctctggatcacattg

SEQ ID NO: 13940 - DNA, 20 bp, Artificial Sequence
  Synthetic Construct
cgtgagatgcgccaatgcaa

SEQ ID NO: 13941 - DNA, 23 bp, Artificial Sequence
  Synthetic Construct
ccacaaacacatgccacgaaaag

SEQ ID NO: 13942 - DNA, 21 bp, Artificial Sequence
  Synthetic Construct
gcttcctttcacggcatcaga

SEQ ID NO: 13943 - DNA, 20 bp, Artificial Sequence
  Synthetic Construct
cgtcccaggacaagttgaca

SEQ ID NO: 13944 - DNA, 23 bp, Artificial Sequence
  Synthetic Construct
ccacgtttgtgtaggatggaatg

SEQ ID NO: 13945 - DNA, 20 bp, Artificial Sequence
  Synthetic Construct
accgttcagcttccctcctt

SEQ ID NO: 13946 - DNA, 22 bp, Artificial Sequence
  Synthetic Construct
actctcccttcagactgggaat

SEQ ID NO: 13947 - DNA, 20 bp, Artificial Sequence
  Synthetic Construct
cagccaaccttgacctgtga

SEQ ID NO: 13948 - DNA, 19 bp, Artificial Sequence
  Synthetic Construct
acagcgcacgtgccattca

SEQ ID NO: 13949 - DNA, 26 bp, Artificial Sequence
  Synthetic Construct
gctacccaacacctaggagaaattca

SEQ ID NO: 13950 - DNA, 20 bp, Artificial Sequence
  Synthetic Construct
gaccacaagggtgacagcaa

SEQ ID NO: 13951 - DNA, 19 bp, Artificial Sequence
  Synthetic Construct
caatgccctcccgcagaca

SEQ ID NO: 13952 - DNA, 24 bp, Artificial Sequence
  Synthetic Construct
ggagcacaaaatgtgtgacaaaga

SEQ ID NO: 13953 - DNA, 24 bp, Artificial Sequence
  Synthetic Construct
gggcagcgatggtagttacctaaa

SEQ ID NO: 13954 - DNA, 24 bp, Artificial Sequence
  Synthetic Construct
cagggcaacgaaagttaccttcta

SEQ ID NO: 13955 - DNA, 22 bp, Artificial Sequence
  Synthetic Construct
tctctggcttccaaggtctcaa

SEQ ID NO: 13956 - DNA, 24 bp, Artificial Sequence
  Synthetic Construct
gtgactgagccacaagtgatgaag

SEQ ID NO: 13957 - DNA, 20 bp, Artificial Sequence
  Synthetic Construct
gcctcacttgccttgtcaga

SEQ ID NO: 13958 - DNA, 20 bp, Artificial Sequence
  Synthetic Construct
gacctgctcactgcagaaca

SEQ ID NO: 13959 - DNA, 21 bp, Artificial Sequence
  Synthetic Construct
cgtgaagcccctctactgact

SEQ ID NO: 13960 - DNA, 21 bp, Artificial Sequence
  Synthetic Construct
cgaccttcaccttcaccactt

SEQ ID NO: 13961 - DNA, 25 bp, Artificial Sequence
  Synthetic Construct
gtcatgaaactgaattccagccaat

SEQ ID NO: 13962 - DNA, 22 bp, Artificial Sequence
  Synthetic Construct
ggctctctgtgaggtaggattg

SEQ ID NO: 13963 - DNA, 21 bp, Artificial Sequence
  Synthetic Construct
ctagggcctggagaagtccat

SEQ ID NO: 13964 - DNA, 23 bp, Artificial Sequence
  Synthetic Construct
gctgatctgtcagtgtgcgttag

SEQ ID NO: 13965 - DNA, 20 bp, Artificial Sequence
  Synthetic Construct
aggccggggcatagcgagaa

SEQ ID NO: 13966 - DNA, 23 bp, Artificial Sequence
  Synthetic Construct
agcagtaaaaggagcaggtttga

SEQ ID NO: 13967 - DNA, 21 bp, Artificial Sequence
  Synthetic Construct
caggtgtgagtggagcgttag

SEQ ID NO: 13968 - DNA, 22 bp, Artificial Sequence
  Synthetic Construct
cggcagttgctagggctaagat

SEQ ID NO: 13969 - DNA, 22 bp, Artificial Sequence
  Synthetic Construct
ggcttggaaggcaggaggtttt

SEQ ID NO: 13970 - DNA, 22 bp, Artificial Sequence
  Synthetic Construct
gagttgcttggtagggctggaa

SEQ ID NO: 13971 - DNA, 25 bp, Artificial Sequence
  Synthetic Construct
ccagataggccatcttcctcctgtt

SEQ ID NO: 13972 - DNA, 25 bp, Artificial Sequence
  Synthetic Construct
ccgtgtgttttcccaaatgctttct

SEQ ID NO: 13973 - DNA, 26 bp, Artificial Sequence
  Synthetic Construct
gctctgaaggctacaaggatgagtag

SEQ ID NO: 13974 - DNA, 23 bp, Artificial Sequence
  Synthetic Construct
ggtgaagggaagatcccatctga

SEQ ID NO: 13975 - DNA, 23 bp, Artificial Sequence
  Synthetic Construct
ctgctcaaggcatttcacaagtt

SEQ ID NO: 13976 - DNA, 23 bp, Artificial Sequence
  Synthetic Construct
gaaggcggtgtaagcatgttaag

SEQ ID NO: 13977 - DNA, 23 bp, Artificial Sequence
  Synthetic Construct
tgagggatgtgtctgatgagcta

SEQ ID NO: 13978 - DNA, 23 bp, Artificial Sequence
  Synthetic Construct
ggtggtaggatgtgctgtattga

SEQ ID NO: 13979 - DNA, 24 bp, Artificial Sequence
  Synthetic Construct
gctcctgccaaacttgtaaaacat

SEQ ID NO: 13980 - DNA, 22 bp, Artificial Sequence
  Synthetic Construct
cccagcatctttgtgaggagaa

SEQ ID NO: 13981 - DNA, 22 bp, Artificial Sequence
  Synthetic Construct
ggcttgccgtttggaaaacaac

SEQ ID NO: 13982 - DNA, 18 bp, Artificial Sequence
  Synthetic Construct
acctgcgggaggtgaaca

SEQ ID NO: 13983 - DNA, 23 bp, Artificial Sequence
  Synthetic Construct
gtctgcatcccctacaattcaca

SEQ ID NO: 13984 - DNA, 19 bp, Artificial Sequence
  Synthetic Construct
ctgcgggctgcagtaagaa

SEQ ID NO: 13985 - DNA, 22 bp, Artificial Sequence
  Synthetic Construct
tcactactcctgggccactttt

SEQ ID NO: 13986 - DNA, 23 bp, Artificial Sequence
  Synthetic Construct
ggctcccttgagttgtgggttag

SEQ ID NO: 13987 - DNA, 21 bp, Artificial Sequence
  Synthetic Construct
tggccagtatgcgagtgattt

SEQ ID NO: 13988 - DNA, 23 bp, Artificial Sequence
  Synthetic Construct
caggatagcagaatggctgagat

SEQ ID NO: 13989 - DNA, 24 bp, Artificial Sequence
  Synthetic Construct
gccattggcgcgttaattatcagt

SEQ ID NO: 13990 - DNA, 24 bp, Artificial Sequence
  Synthetic Construct
cacagcaagaaaggtgagttcaag

SEQ ID NO: 13991 - DNA, 22 bp, Artificial Sequence
  Synthetic Construct
cagctacatctcaaccgcaaag

SEQ ID NO: 13992 - DNA, 20 bp, Artificial Sequence
  Synthetic Construct
aacccgactgacacctggat

SEQ ID NO: 13993 - DNA, 25 bp, Artificial Sequence
  Synthetic Construct
cccagggaaataggagtgaggagaa

SEQ ID NO: 13994 - DNA, 21 bp, Artificial Sequence
  Synthetic Construct
gtggcgttgttacctctcctt

SEQ ID NO: 13995 - DNA, 23 bp, Artificial Sequence
  Synthetic Construct
gggtccttcctgtagggagagtt

SEQ ID NO: 13996 - DNA, 23 bp, Artificial Sequence
  Synthetic Construct
gcgcagttacacaggcttccatt

SEQ ID NO: 13997 - DNA, 18 bp, Artificial Sequence
  Synthetic Construct
ttgacacaggccgtgctt

SEQ ID NO: 13998 - DNA, 22 bp, Artificial Sequence
  Synthetic Construct
gggagtatgggtggagcacttc

SEQ ID NO: 13999 - DNA, 23 bp, Artificial Sequence
  Synthetic Construct
agagccagcaaaatatggggaat

SEQ ID NO: 14000 - DNA, 22 bp, Artificial Sequence
  Synthetic Construct
gccacagctgttctctccttct

SEQ ID NO: 14001 - DNA, 22 bp, Artificial Sequence
  Synthetic Construct
ggctggaaactccactgccatt

SEQ ID NO: 14002 - DNA, 21 bp, Artificial Sequence
  Synthetic Construct
caggccaagtcccaggtcaag

SEQ ID NO: 14003 - DNA, 21 bp, Artificial Sequence
  Synthetic Construct
gcgcacagtgctttcacaatc

SEQ ID NO: 14004 - DNA, 21 bp, Artificial Sequence
  Synthetic Construct
cggacccaaccttgtgtcaac

SEQ ID NO: 14005 - DNA, 24 bp, Artificial Sequence
  Synthetic Construct
gggaactactccaaccagagtcaa

SEQ ID NO: 14006 - DNA, 23 bp, Artificial Sequence
  Synthetic Construct
accaatggcaaacatctgtgaga

SEQ ID NO: 14007 - DNA, 21 bp, Artificial Sequence
  Synthetic Construct
tgcgtggagcaaaaggtttga

SEQ ID NO: 14008 - DNA, 25 bp, Artificial Sequence
  Synthetic Construct
accttcagcctttttagcaactact

SEQ ID NO: 14009 - DNA, 24 bp, Artificial Sequence
  Synthetic Construct
gccttatcctctaccctgatccta

SEQ ID NO: 14010 - DNA, 24 bp, Artificial Sequence
  Synthetic Construct
acggcatggattgttacaagtttc

SEQ ID NO: 14011 - DNA, 21 bp, Artificial Sequence
  Synthetic Construct
tgccgtggatgaccgtgatga

SEQ ID NO: 14012 - DNA, 23 bp, Artificial Sequence
  Synthetic Construct
gacacgctcagaggatgagatac

SEQ ID NO: 14013 - DNA, 22 bp, Artificial Sequence
  Synthetic Construct
ccctgcctggttccacttacaa

SEQ ID NO: 14014 - DNA, 23 bp, Artificial Sequence
  Synthetic Construct
cagggaggcaatcggtaaagaaa

SEQ ID NO: 14015 - DNA, 22 bp, Artificial Sequence
  Synthetic Construct
gcatgtcagctgggtctttcta

SEQ ID NO: 14016 - DNA, 20 bp, Artificial Sequence
  Synthetic Construct
ggaactggcaaccctagcaa

SEQ ID NO: 14017 - DNA, 23 bp, Artificial Sequence
  Synthetic Construct
agtgcttgtttagctgctagagt

SEQ ID NO: 14018 - DNA, 23 bp, Artificial Sequence
  Synthetic Construct
ggtttccctgaactctgcctcat

SEQ ID NO: 14019 - DNA, 21 bp, Artificial Sequence
  Synthetic Construct
ggtggcctctgacacagcaaa

SEQ ID NO: 14020 - DNA, 22 bp, Artificial Sequence
  Synthetic Construct
agcccgggcacagtctactaat

SEQ ID NO: 14021 - DNA, 23 bp, Artificial Sequence
  Synthetic Construct
ggatgaaggcagatccctgaaac

SEQ ID NO: 14022 - DNA, 23 bp, Artificial Sequence
  Synthetic Construct
ccttgtgtgcataaagggtcttg

SEQ ID NO: 14023 - DNA, 20 bp, Artificial Sequence
  Synthetic Construct
ccatggcccttcccttcttg

SEQ ID NO: 14024 - DNA, 21 bp, Artificial Sequence
  Synthetic Construct
agcccaactgggtggtgcata

SEQ ID NO: 14025 - DNA, 26 bp, Artificial Sequence
  Synthetic Construct
gtatgactccccttaaggatgagaag

SEQ ID NO: 14026 - DNA, 24 bp, Artificial Sequence
  Synthetic Construct
ggagaggctgtcagtatgggatgt

SEQ ID NO: 14027 - DNA, 20 bp, Artificial Sequence
  Synthetic Construct
gacccaactgccaagacaga

SEQ ID NO: 14028 - DNA, 22 bp, Artificial Sequence
  Synthetic Construct
gtttggccctgtacttctgtct

SEQ ID NO: 14029 - DNA, 22 bp, Artificial Sequence
  Synthetic Construct
aactgccccaatgccaggatag

SEQ ID NO: 14030 - DNA, 21 bp, Artificial Sequence
  Synthetic Construct
cagcacatctgggacctggta

SEQ ID NO: 14031 - DNA, 23 bp, Artificial Sequence
  Synthetic Construct
ctgtctgaccaacttgctgtttg

SEQ ID NO: 14032 - DNA, 22 bp, Artificial Sequence
  Synthetic Construct
ctgggagggtaaggactgatct

SEQ ID NO: 14033 - DNA, 22 bp, Artificial Sequence
  Synthetic Construct
ccccgtctgaatgagaaagcat

SEQ ID NO: 14034 - DNA, 22 bp, Artificial Sequence
  Synthetic Construct
cctgaagggaggttctgagtct

SEQ ID NO: 14035 - DNA, 22 bp, Artificial Sequence
  Synthetic Construct
tcccagttcagggaggcattac

SEQ ID NO: 14036 - DNA, 22 bp, Artificial Sequence
  Synthetic Construct
cccctcctcaaagggacaaaac

SEQ ID NO: 14037 - DNA, 21 bp, Artificial Sequence
  Synthetic Construct
ccactccagggtccagagtca

SEQ ID NO: 14038 - DNA, 20 bp, Artificial Sequence
  Synthetic Construct
tcgcctccttcctggtctac

SEQ ID NO: 14039 - DNA, 26 bp, Artificial Sequence
  Synthetic Construct
gcagagatgcgacttcctttgtccta

SEQ ID NO: 14040 - DNA, 23 bp, Artificial Sequence
  Synthetic Construct
ctgcattccagccatttcaaact

SEQ ID NO: 14041 - DNA, 21 bp, Artificial Sequence
  Synthetic Construct
tgggtggtacaggcaagagat

SEQ ID NO: 14042 - DNA, 25 bp, Artificial Sequence
  Synthetic Construct
cactggcagaaacaaggagagaaga

SEQ ID NO: 14043 - DNA, 21 bp, Artificial Sequence
  Synthetic Construct
ggaagctctcactccccaaac

SEQ ID NO: 14044 - DNA, 21 bp, Artificial Sequence
  Synthetic Construct
ccaggcctctgtgctgtttgt

SEQ ID NO: 14045 - DNA, 19 bp, Artificial Sequence
  Synthetic Construct
cacgcagttggcagagcat

SEQ ID NO: 14046 - DNA, 22 bp, Artificial Sequence
  Synthetic Construct
ggcctgaaggagtttcccatca

SEQ ID NO: 14047 - DNA, 24 bp, Artificial Sequence
  Synthetic Construct
cccatgaattactgtgtggtgtga

SEQ ID NO: 14048 - DNA, 23 bp, Artificial Sequence
  Synthetic Construct
ggtcactgtgggagttttcttgt

SEQ ID NO: 14049 - DNA, 21 bp, Artificial Sequence
  Synthetic Construct
ctggaaagggaggagccaaaa

SEQ ID NO: 14050 - DNA, 23 bp, Artificial Sequence
  Synthetic Construct
gagcttgcccaggcagatttcta

SEQ ID NO: 14051 - DNA, 20 bp, Artificial Sequence
  Synthetic Construct
cacccactgtcgcagcattc

SEQ ID NO: 14052 - DNA, 23 bp, Artificial Sequence
  Synthetic Construct
gccttaggaaagggacagtgtag

SEQ ID NO: 14053 - DNA, 19 bp, Artificial Sequence
  Synthetic Construct
caggatggcgaggcagaca

SEQ ID NO: 14054 - DNA, 22 bp, Artificial Sequence
  Synthetic Construct
ctgtgcccaagtggagtcatgt

SEQ ID NO: 14055 - DNA, 25 bp, Artificial Sequence
  Synthetic Construct
ccagatgaactgagaaggtcagatt

SEQ ID NO: 14056 - DNA, 21 bp, Artificial Sequence
  Synthetic Construct
acatccctgtttgccctcttg

SEQ ID NO: 14057 - DNA, 26 bp, Artificial Sequence
  Synthetic Construct
cctacctgatgcattctgggaacatc

SEQ ID NO: 14058 - DNA, 24 bp, Artificial Sequence
  Synthetic Construct
gtgagagagaggcagaggggataa

SEQ ID NO: 14059 - DNA, 23 bp, Artificial Sequence
  Synthetic Construct
ctacagccaccttacacctttgt

SEQ ID NO: 14060 - DNA, 22 bp, Artificial Sequence
  Synthetic Construct
cccatagcgagggctggattta

SEQ ID NO: 14061 - DNA, 20 bp, Artificial Sequence
  Synthetic Construct
acgtgcagaagcctttgaga

SEQ ID NO: 14062 - DNA, 20 bp, Artificial Sequence
  Synthetic Construct
gcacttgccccactcctaga

SEQ ID NO: 14063 - DNA, 23 bp, Artificial Sequence
  Synthetic Construct
gcttctgagctatctcggtcctt

SEQ ID NO: 14064 - DNA, 24 bp, Artificial Sequence
  Synthetic Construct
gctgaagcctgagggtctggttta

SEQ ID NO: 14065 - DNA, 22 bp, Artificial Sequence
  Synthetic Construct
acaccattgcctgggctcttag

SEQ ID NO: 14066 - DNA, 25 bp, Artificial Sequence
  Synthetic Construct
ccacgcagtgttgaggattaagtca

SEQ ID NO: 14067 - DNA, 21 bp, Artificial Sequence
  Synthetic Construct
gctcttcaagcctcagtgcaa

SEQ ID NO: 14068 - DNA, 22 bp, Artificial Sequence
  Synthetic Construct
tcagaaggggctttctgtgaag

SEQ ID NO: 14069 - DNA, 21 bp, Artificial Sequence
  Synthetic Construct
cccattgctccgctgattttc

SEQ ID NO: 14070 - DNA, 21 bp, Artificial Sequence
  Synthetic Construct
ccaccctcagggcctggtatt

SEQ ID NO: 14071 - DNA, 23 bp, Artificial Sequence
  Synthetic Construct
gcccgttcctttcctgattcttt

SEQ ID NO: 14072 - DNA, 22 bp, Artificial Sequence
  Synthetic Construct
ccccagtaagcgcaaagttaga

SEQ ID NO: 14073 - DNA, 22 bp, Artificial Sequence
  Synthetic Construct
acaactcccacctcctgtctct

SEQ ID NO: 14074 - DNA, 22 bp, Artificial Sequence
  Synthetic Construct
cgccacagtgggagataagcaa

SEQ ID NO: 14075 - DNA, 24 bp, Artificial Sequence
  Synthetic Construct
ctagcccagcaaattttggagttt

SEQ ID NO: 14076 - DNA, 24 bp, Artificial Sequence
  Synthetic Construct
gcttgtttaacccatgttgtgtga

SEQ ID NO: 14077 - DNA, 25 bp, Artificial Sequence
  Synthetic Construct
ggacaagcttttgagactagccata

SEQ ID NO: 14078 - DNA, 20 bp, Artificial Sequence
  Synthetic Construct
gatctgctccgtgggacaaa

SEQ ID NO: 14079 - DNA, 24 bp, Artificial Sequence
  Synthetic Construct
aaatcctcttgctagctccagatg

SEQ ID NO: 14080 - DNA, 23 bp, Artificial Sequence
  Synthetic Construct
gtgtggtctacactgggaaagaa

SEQ ID NO: 14081 - DNA, 23 bp, Artificial Sequence
  Synthetic Construct
cctctcctcagatgcctgtttct

SEQ ID NO: 14082 - DNA, 24 bp, Artificial Sequence
  Synthetic Construct
ctgtagagagccatgtccctgaat

SEQ ID NO: 14083 - DNA, 25 bp, Artificial Sequence
  Synthetic Construct
caagacctactgtccactctgattc

SEQ ID NO: 14084 - DNA, 21 bp, Artificial Sequence
  Synthetic Construct
agcgttgaggaccattctgtt

SEQ ID NO: 14085 - DNA, 23 bp, Artificial Sequence
  Synthetic Construct
ggccctgtcaatcataccagctt

SEQ ID NO: 14086 - DNA, 21 bp, Artificial Sequence
  Synthetic Construct
gtctctctcccacttgcaaca

SEQ ID NO: 14087 - DNA, 22 bp, Artificial Sequence
  Synthetic Construct
cctcttgagcctttcccgtgtt

SEQ ID NO: 14088 - DNA, 26 bp, Artificial Sequence
  Synthetic Construct
ggggaacctaacttactcttggaaag

SEQ ID NO: 14089 - DNA, 24 bp, Artificial Sequence
  Synthetic Construct
gacatacaagggtagggagactga

SEQ ID NO: 14090 - DNA, 22 bp, Artificial Sequence
  Synthetic Construct
cctggagcaacctggggattag

SEQ ID NO: 14091 - DNA, 26 bp, Artificial Sequence
  Synthetic Construct
ccagcagcttttactctaggggattg

SEQ ID NO: 14092 - DNA, 20 bp, Artificial Sequence
  Synthetic Construct
gagcaggacaatggcagaca

SEQ ID NO: 14093 - DNA, 25 bp, Artificial Sequence
  Synthetic Construct
caccctgagccaatagggagaaaga

SEQ ID NO: 14094 - DNA, 22 bp, Artificial Sequence
  Synthetic Construct
gcactttccctcccaacccttt

SEQ ID NO: 14095 - DNA, 21 bp, Artificial Sequence
  Synthetic Construct
cctttgggaccaacgctgttt

SEQ ID NO: 14096 - DNA, 21 bp, Artificial Sequence
  Synthetic Construct
cccgacctcttgctcaggttt

SEQ ID NO: 14097 - DNA, 22 bp, Artificial Sequence
  Synthetic Construct
agctgtagaccggagtggttct

SEQ ID NO: 14098 - DNA, 25 bp, Artificial Sequence
  Synthetic Construct
ggggaaacaaatgctaaagttctca

SEQ ID NO: 14099 - DNA, 19 bp, Artificial Sequence
  Synthetic Construct
gccggggcggtaaagatgt

SEQ ID NO: 14100 - DNA, 25 bp, Artificial Sequence
  Synthetic Construct
gggattgcatccatagcacagtttt

SEQ ID NO: 14101 - DNA, 19 bp, Artificial Sequence
  Synthetic Construct
cctggcctaaggcaacgaa

SEQ ID NO: 14102 - DNA, 26 bp, Artificial Sequence
  Synthetic Construct
cgttttctttttccctctcccacaaa

SEQ ID NO: 14103 - DNA, 24 bp, Artificial Sequence
  Synthetic Construct
gagtcatcagaggctgacttttct

SEQ ID NO: 14104 - DNA, 24 bp, Artificial Sequence
  Synthetic Construct
cgtactttggggaagaatctggaa

SEQ ID NO: 14105 - DNA, 20 bp, Artificial Sequence
  Synthetic Construct
tgctcactggactcctggaa

SEQ ID NO: 14106 - DNA, 22 bp, Artificial Sequence
  Synthetic Construct
gggtcagaagtgtcctttgctt

SEQ ID NO: 14107 - DNA, 22 bp, Artificial Sequence
  Synthetic Construct
ccctccttccactgctctgtat

SEQ ID NO: 14108 - DNA, 22 bp, Artificial Sequence
  Synthetic Construct
ggcaggccatcacagtcataga

SEQ ID NO: 14109 - DNA, 22 bp, Artificial Sequence
  Synthetic Construct
gcaactgggctatcagggattg

SEQ ID NO: 14110 - DNA, 22 bp, Artificial Sequence
  Synthetic Construct
gctgagggacacacttggatca

SEQ ID NO: 14111 - DNA, 18 bp, Artificial Sequence
  Synthetic Construct
aagggccctgctggtagt

SEQ ID NO: 14112 - DNA, 21 bp, Artificial Sequence
  Synthetic Construct
gcatgtcagctgcacagaaaa

SEQ ID NO: 14113 - DNA, 22 bp, Artificial Sequence
  Synthetic Construct
gatgctgctccaaggataccaa

SEQ ID NO: 14114 - DNA, 25 bp, Artificial Sequence
  Synthetic Construct
ccaggaaggtcaaaatgtggactga

SEQ ID NO: 14115 - DNA, 20 bp, Artificial Sequence
  Synthetic Construct
tgtgcctgtgggtggagaag

SEQ ID NO: 14116 - DNA, 21 bp, Artificial Sequence
  Synthetic Construct
gctgtgtgaagcaggcagaag

SEQ ID NO: 14117 - DNA, 23 bp, Artificial Sequence
  Synthetic Construct
cagcagaagctaacaggggaagt

SEQ ID NO: 14118 - DNA, 25 bp, Artificial Sequence
  Synthetic Construct
cacttcccaaaaaggttccattgat

SEQ ID NO: 14119 - DNA, 22 bp, Artificial Sequence
  Synthetic Construct
actgctcctccagcttggtgat

SEQ ID NO: 14120 - DNA, 21 bp, Artificial Sequence
  Synthetic Construct
ggggtggtctccccaaactca

SEQ ID NO: 14121 - DNA, 22 bp, Artificial Sequence
  Synthetic Construct
ggccatggtgagtggtagcaaa

SEQ ID NO: 14122 - DNA, 24 bp, Artificial Sequence
  Synthetic Construct
agctaggatttagcccagagtttc

SEQ ID NO: 14123 - DNA, 26 bp, Artificial Sequence
  Synthetic Construct
gctgtttatcagtttgtgctgagtga

SEQ ID NO: 14124 - DNA, 20 bp, Artificial Sequence
  Synthetic Construct
ctgggcctcagctcttccat

SEQ ID NO: 14125 - DNA, 24 bp, Artificial Sequence
  Synthetic Construct
gactcctggagccactcttcattc

SEQ ID NO: 14126 - DNA, 20 bp, Artificial Sequence
  Synthetic Construct
agccagttgccataggcttt

SEQ ID NO: 14127 - DNA, 21 bp, Artificial Sequence
  Synthetic Construct
gggccacaccactcagagtaa

SEQ ID NO: 14128 - DNA, 23 bp, Artificial Sequence
  Synthetic Construct
actgggctgacccttttgatttc

SEQ ID NO: 14129 - DNA, 19 bp, Artificial Sequence
  Synthetic Construct
cgagggagatgcgggtcta

SEQ ID NO: 14130 - DNA, 19 bp, Artificial Sequence
  Synthetic Construct
accacagtgctccgtgcat

SEQ ID NO: 14131 - DNA, 20 bp, Artificial Sequence
  Synthetic Construct
ccagggagggaggtcacaca

SEQ ID NO: 14132 - DNA, 23 bp, Artificial Sequence
  Synthetic Construct
gtcagcatagggcagttgcaaag

SEQ ID NO: 14133 - DNA, 24 bp, Artificial Sequence
  Synthetic Construct
ggaaaccttagctggggtcttttc

SEQ ID NO: 14134 - DNA, 24 bp, Artificial Sequence
  Synthetic Construct
agaggttcccactagagagtcatc

SEQ ID NO: 14135 - DNA, 23 bp, Artificial Sequence
  Synthetic Construct
gttgagaccgaacactggcaaac

SEQ ID NO: 14136 - DNA, 24 bp, Artificial Sequence
  Synthetic Construct
ccaaggacatgacttacccagttt

SEQ ID NO: 14137 - DNA, 26 bp, Artificial Sequence
  Synthetic Construct
gcttaggacctatctggagtcacagt

SEQ ID NO: 14138 - DNA, 22 bp, Artificial Sequence
  Synthetic Construct
ccaggaagtgagcaggttgtag

SEQ ID NO: 14139 - DNA, 20 bp, Artificial Sequence
  Synthetic Construct
tgtctgcgtggcaaggtttc

SEQ ID NO: 14140 - DNA, 22 bp, Artificial Sequence
  Synthetic Construct
ggccccaaagaggttgcatttc

SEQ ID NO: 14141 - DNA, 21 bp, Artificial Sequence
  Synthetic Construct
tggcacagcattgcagttaga

SEQ ID NO: 14142 - DNA, 23 bp, Artificial Sequence
  Synthetic Construct
cagagcgagacatcatcctttca

SEQ ID NO: 14143 - DNA, 22 bp, Artificial Sequence
  Synthetic Construct
gctgcttctgaggcctttactt

SEQ ID NO: 14144 - DNA, 22 bp, Artificial Sequence
  Synthetic Construct
gcaactgccagcaaaggcatga

SEQ ID NO: 14145 - DNA, 20 bp, Artificial Sequence
  Synthetic Construct
cctgcccagttaccctgcat

SEQ ID NO: 14146 - DNA, 26 bp, Artificial Sequence
  Synthetic Construct
ccatcctatagtctggggcttgtttg

SEQ ID NO: 14147 - DNA, 24 bp, Artificial Sequence
  Synthetic Construct
caacagcaagacattccagcatag

SEQ ID NO: 14148 - DNA, 25 bp, Artificial Sequence
  Synthetic Construct
cctccacctcatttgagttgtttct

SEQ ID NO: 14149 - DNA, 22 bp, Artificial Sequence
  Synthetic Construct
aggtgcctctctcagcaggatt

SEQ ID NO: 14150 - DNA, 21 bp, Artificial Sequence
  Synthetic Construct
ccctgtccttgacgcttaact

SEQ ID NO: 14151 - DNA, 22 bp, Artificial Sequence
  Synthetic Construct
gtcagttcccatggacccagaa

SEQ ID NO: 14152 - DNA, 25 bp, Artificial Sequence
  Synthetic Construct
ctgagattatgccaatgccctgcta

SEQ ID NO: 14153 - DNA, 20 bp, Artificial Sequence
  Synthetic Construct
ctactggacgcagccctcta

SEQ ID NO: 14154 - DNA, 23 bp, Artificial Sequence
  Synthetic Construct
tggccgtgtttttatcccattgt

SEQ ID NO: 14155 - DNA, 25 bp, Artificial Sequence
  Synthetic Construct
ggtcatgcagagaggactggaatta

SEQ ID NO: 14156 - DNA, 19 bp, Artificial Sequence
  Synthetic Construct
cccactgtggcgaccatgt

SEQ ID NO: 14157 - DNA, 20 bp, Artificial Sequence
  Synthetic Construct
tctgcttgtcccgagctagt

SEQ ID NO: 14158 - DNA, 21 bp, Artificial Sequence
  Synthetic Construct
acaaaagggcaggcttgctta

SEQ ID NO: 14159 - DNA, 20 bp, Artificial Sequence
  Synthetic Construct
ttcggcacaggtgtgtcctt

SEQ ID NO: 14160 - DNA, 21 bp, Artificial Sequence
  Synthetic Construct
acagaccctatcagccacgat

SEQ ID NO: 14161 - DNA, 24 bp, Artificial Sequence
  Synthetic Construct
cctcacagcctccttgatctcctt

SEQ ID NO: 14162 - DNA, 26 bp, Artificial Sequence
  Synthetic Construct
ccataagcaaaacatagtccctgttc

SEQ ID NO: 14163 - DNA, 20 bp, Artificial Sequence
  Synthetic Construct
caggcagacacagagcaact

SEQ ID NO: 14164 - DNA, 20 bp, Artificial Sequence
  Synthetic Construct
gggtggtgaaatggcagaga

SEQ ID NO: 14165 - DNA, 22 bp, Artificial Sequence
  Synthetic Construct
gcttgcttgcttgcttgctttg

SEQ ID NO: 14166 - DNA, 21 bp, Artificial Sequence
  Synthetic Construct
agcttgcagggagtccaggaa

SEQ ID NO: 14167 - DNA, 26 bp, Artificial Sequence
  Synthetic Construct
gtggctccttacattactaccagtga

SEQ ID NO: 14168 - DNA, 25 bp, Artificial Sequence
  Synthetic Construct
ccctgtctgtctcaggaggagaaaa

SEQ ID NO: 14169 - DNA, 21 bp, Artificial Sequence
  Synthetic Construct
ggacatggtgcgtgcagtatc

SEQ ID NO: 14170 - DNA, 20 bp, Artificial Sequence
  Synthetic Construct
cagggaaatccggcatccat

SEQ ID NO: 14171 - DNA, 21 bp, Artificial Sequence
  Synthetic Construct
accgtgagtcccagaggttca

SEQ ID NO: 14172 - DNA, 25 bp, Artificial Sequence
  Synthetic Construct
ggcagggagatttattccttgctaa

SEQ ID NO: 14173 - DNA, 26 bp, Artificial Sequence
  Synthetic Construct
gcagtgctatagaagtagtggagtga

SEQ ID NO: 14174 - DNA, 20 bp, Artificial Sequence
  Synthetic Construct
tgctccctgcagcattggaa

SEQ ID NO: 14175 - DNA, 20 bp, Artificial Sequence
  Synthetic Construct
ttcaccctggggtctcttca

SEQ ID NO: 14176 - DNA, 21 bp, Artificial Sequence
  Synthetic Construct
ttgtggggccctaccttccaa

SEQ ID NO: 14177 - DNA, 23 bp, Artificial Sequence
  Synthetic Construct
ctcattaacactcagcccgtgaa

SEQ ID NO: 14178 - DNA, 22 bp, Artificial Sequence
  Synthetic Construct
tccagtgtgaggtgcgtttatg

SEQ ID NO: 14179 - DNA, 22 bp, Artificial Sequence
  Synthetic Construct
gcccaaatccagaccagtccta

SEQ ID NO: 14180 - DNA, 22 bp, Artificial Sequence
  Synthetic Construct
catggtgctagcctcactctca

SEQ ID NO: 14181 - DNA, 20 bp, Artificial Sequence
  Synthetic Construct
cccctggggaccttgtaaac

SEQ ID NO: 14182 - DNA, 27 bp, Artificial Sequence
  Synthetic Construct
ctaccaaagctgtatggtctgtaaaac

SEQ ID NO: 14183 - DNA, 22 bp, Artificial Sequence
  Synthetic Construct
gattggtgctcacccactgact

SEQ ID NO: 14184 - DNA, 20 bp, Artificial Sequence
  Synthetic Construct
cgagcaagaacacgctggaa

SEQ ID NO: 14185 - DNA, 21 bp, Artificial Sequence
  Synthetic Construct
ggatggtgcagcaacgaatga

SEQ ID NO: 14186 - DNA, 22 bp, Artificial Sequence
  Synthetic Construct
aggggccaagaaaccaggaaga

SEQ ID NO: 14187 - DNA, 20 bp, Artificial Sequence
  Synthetic Construct
aggctttggggtggtttgtt

SEQ ID NO: 14188 - DNA, 22 bp, Artificial Sequence
  Synthetic Construct
tcattcctcggctcacccttct

SEQ ID NO: 14189 - DNA, 24 bp, Artificial Sequence
  Synthetic Construct
ggtaactgatcagactgggagttc

SEQ ID NO: 14190 - DNA, 21 bp, Artificial Sequence
  Synthetic Construct
cctgggctccttcatgtgtct

SEQ ID NO: 14191 - DNA, 22 bp, Artificial Sequence
  Synthetic Construct
tcatggggctgacccaaagtct

SEQ ID NO: 14192 - DNA, 26 bp, Artificial Sequence
  Synthetic Construct
agcaagagtttgcttcacactcatca

SEQ ID NO: 14193 - DNA, 22 bp, Artificial Sequence
  Synthetic Construct
ggctcctttacggtcagcaact

SEQ ID NO: 14194 - DNA, 25 bp, Artificial Sequence
  Synthetic Construct
ggattcttcctgtttgaccgtgttg

SEQ ID NO: 14195 - DNA, 23 bp, Artificial Sequence
  Synthetic Construct
gtgtccacagctctctgttcgat

SEQ ID NO: 14196 - DNA, 19 bp, Artificial Sequence
  Synthetic Construct
actgcctcccgagaagtga

SEQ ID NO: 14197 - DNA, 21 bp, Artificial Sequence
  Synthetic Construct
gtggttgttacggggaaggtt

SEQ ID NO: 14198 - DNA, 25 bp, Artificial Sequence
  Synthetic Construct
gcaagttggcaagttttgtttcaca

SEQ ID NO: 14199 - DNA, 23 bp, Artificial Sequence
  Synthetic Construct
gggaaacaggcttatgcaagaca

SEQ ID NO: 14200 - DNA, 22 bp, Artificial Sequence
  Synthetic Construct
ggtcttgaatcgttggctctgt

SEQ ID NO: 14201 - DNA, 21 bp, Artificial Sequence
  Synthetic Construct
accaggtagccaggaaggtaa

SEQ ID NO: 14202 - DNA, 18 bp, Artificial Sequence
  Synthetic Construct
gccttggtgctggtggat

SEQ ID NO: 14203 - DNA, 22 bp, Artificial Sequence
  Synthetic Construct
aggtacagggagctgagagaag

SEQ ID NO: 14204 - DNA, 22 bp, Artificial Sequence
  Synthetic Construct
gaagtcaaggtgcttccagtga

SEQ ID NO: 14205 - DNA, 22 bp, Artificial Sequence
  Synthetic Construct
ctctcccacacttcccactact

SEQ ID NO: 14206 - DNA, 20 bp, Artificial Sequence
  Synthetic Construct
tggtgctgaaggctggttgt

SEQ ID NO: 14207 - DNA, 22 bp, Artificial Sequence
  Synthetic Construct
accagccaagggacccagttta

SEQ ID NO: 14208 - DNA, 26 bp, Artificial Sequence
  Synthetic Construct
ctggtccttgaaaagggaatggtttg

SEQ ID NO: 14209 - DNA, 22 bp, Artificial Sequence
  Synthetic Construct
ggccaagctccactcactcttc

SEQ ID NO: 14210 - DNA, 25 bp, Artificial Sequence
  Synthetic Construct
aaggaaacaaacgtctgcagaatac

SEQ ID NO: 14211 - DNA, 20 bp, Artificial Sequence
  Synthetic Construct
tatggactgccgctccttca

SEQ ID NO: 14212 - DNA, 24 bp, Artificial Sequence
  Synthetic Construct
aggacttttgtgctggtttagaca

SEQ ID NO: 14213 - DNA, 22 bp, Artificial Sequence
  Synthetic Construct
caaccgattcaggtccctttgt

SEQ ID NO: 14214 - DNA, 23 bp, Artificial Sequence
  Synthetic Construct
ccactgcggggttaggtagtaca

SEQ ID NO: 14215 - DNA, 24 bp, Artificial Sequence
  Synthetic Construct
caaaggcatgctggaacattctaa

SEQ ID NO: 14216 - DNA, 24 bp, Artificial Sequence
  Synthetic Construct
ccaacttgtccctccatgccttct

SEQ ID NO: 14217 - DNA, 23 bp, Artificial Sequence
  Synthetic Construct
ccatctccatctgctttggtgtt

SEQ ID NO: 14218 - DNA, 21 bp, Artificial Sequence
  Synthetic Construct
agctcccctaactccctgaca

SEQ ID NO: 14219 - DNA, 20 bp, Artificial Sequence
  Synthetic Construct
aggggtctgctggcaggtat

SEQ ID NO: 14220 - DNA, 24 bp, Artificial Sequence
  Synthetic Construct
gcctcccctctcatttcctgatct

SEQ ID NO: 14221 - DNA, 22 bp, Artificial Sequence
  Synthetic Construct
tgtcttccaaatggctcacgtt

SEQ ID NO: 14222 - DNA, 21 bp, Artificial Sequence
  Synthetic Construct
ccagttctgcgctggagtagt

SEQ ID NO: 14223 - DNA, 26 bp, Artificial Sequence
  Synthetic Construct
ctggctcaaagacattggaaacaagt

SEQ ID NO: 14224 - DNA, 22 bp, Artificial Sequence
  Synthetic Construct
ctgaggtcttgcagcgaagaag

SEQ ID NO: 14225 - DNA, 24 bp, Artificial Sequence
  Synthetic Construct
ggaaaacggtaggcatggtttaca

SEQ ID NO: 14226 - DNA, 22 bp, Artificial Sequence
  Synthetic Construct
gggtggccataaaatccagaca

SEQ ID NO: 14227 - DNA, 20 bp, Artificial Sequence
  Synthetic Construct
tccttgcccttgaggagctt

SEQ ID NO: 14228 - DNA, 22 bp, Artificial Sequence
  Synthetic Construct
aagctgaattggtgcaggaaga

SEQ ID NO: 14229 - DNA, 21 bp, Artificial Sequence
  Synthetic Construct
gtgtgtgagcgctggagattt

SEQ ID NO: 14230 - DNA, 23 bp, Artificial Sequence
  Synthetic Construct
ccagactggactagccaggattc

SEQ ID NO: 14231 - DNA, 22 bp, Artificial Sequence
  Synthetic Construct
ctgggcagtagtgactgtgagt

SEQ ID NO: 14232 - DNA, 23 bp, Artificial Sequence
  Synthetic Construct
tctgaacctagccttgtgagttg

SEQ ID NO: 14233 - DNA, 22 bp, Artificial Sequence
  Synthetic Construct
tcccagcctggtcttctagctt

SEQ ID NO: 14234 - DNA, 23 bp, Artificial Sequence
  Synthetic Construct
agcagtctgacatcccagtctta

SEQ ID NO: 14235 - DNA, 20 bp, Artificial Sequence
  Synthetic Construct
tgcggatgcgttccatgtca

SEQ ID NO: 14236 - DNA, 23 bp, Artificial Sequence
  Synthetic Construct
tggaggaagaagcaaagcaagat

SEQ ID NO: 14237 - DNA, 22 bp, Artificial Sequence
  Synthetic Construct
gcgggcagcctccttaacattt

SEQ ID NO: 14238 - DNA, 22 bp, Artificial Sequence
  Synthetic Construct
tcatggctatccgccagtcatc

SEQ ID NO: 14239 - DNA, 23 bp, Artificial Sequence
  Synthetic Construct
gccttgaaggatgtgcaggagtt

SEQ ID NO: 14240 - DNA, 23 bp, Artificial Sequence
  Synthetic Construct
cctcagctcacaaagttgctaca

SEQ ID NO: 14241 - DNA, 23 bp, Artificial Sequence
  Synthetic Construct
ccaggtggttgtgggaagagaag

SEQ ID NO: 14242 - DNA, 23 bp, Artificial Sequence
  Synthetic Construct
cgcctgcatcattatggctcatt

SEQ ID NO: 14243 - DNA, 29 bp, Artificial Sequence
  Synthetic Construct
cctgggttcatgttaatgacaagagtttg

SEQ ID NO: 14244 - DNA, 27 bp, Artificial Sequence
  Synthetic Construct
agggagagatagccagaatacaaaatc

SEQ ID NO: 14245 - DNA, 19 bp, Artificial Sequence
  Synthetic Construct
tggccagcacagttccaaa

SEQ ID NO: 14246 - DNA, 24 bp, Artificial Sequence
  Synthetic Construct
ctggcagaaagcctgagaagcata

SEQ ID NO: 14247 - DNA, 24 bp, Artificial Sequence
  Synthetic Construct
ggaaaagtgcttgatgaggcttga

SEQ ID NO: 14248 - DNA, 20 bp, Artificial Sequence
  Synthetic Construct
ttccagcaaggcggatcaca

SEQ ID NO: 14249 - DNA, 24 bp, Artificial Sequence
  Synthetic Construct
gatgggtattaccaggggagaaac

SEQ ID NO: 14250 - DNA, 21 bp, Artificial Sequence
  Synthetic Construct
gtgggcagaatgtcaccatca

SEQ ID NO: 14251 - DNA, 21 bp, Artificial Sequence
  Synthetic Construct
cacagcgggtttgtaccatgt

SEQ ID NO: 14252 - DNA, 28 bp, Artificial Sequence
  Synthetic Construct
ggagagagaggctagctttgtctaaaac

SEQ ID NO: 14253 - DNA, 19 bp, Artificial Sequence
  Synthetic Construct
gtctcgttgcccggagaga

SEQ ID NO: 14254 - DNA, 25 bp, Artificial Sequence
  Synthetic Construct
atcctggcacttgctacttattaca

SEQ ID NO: 14255 - DNA, 25 bp, Artificial Sequence
  Synthetic Construct
ctggtgtcttggttcccagaaatgt

SEQ ID NO: 14256 - DNA, 25 bp, Artificial Sequence
  Synthetic Construct
gggattcctgcactaaagaccttac

SEQ ID NO: 14257 - DNA, 24 bp, Artificial Sequence
  Synthetic Construct
ctcattccatccttccctgtccaa

SEQ ID NO: 14258 - DNA, 23 bp, Artificial Sequence
  Synthetic Construct
cagaagccatggtggagatttga

SEQ ID NO: 14259 - DNA, 20 bp, Artificial Sequence
  Synthetic Construct
agatggtggcaccccgtcat

SEQ ID NO: 14260 - DNA, 22 bp, Artificial Sequence
  Synthetic Construct
ccagaacagcttccgaaacact

SEQ ID NO: 14261 - DNA, 22 bp, Artificial Sequence
  Synthetic Construct
gctcagtggttgctgcagatgt

SEQ ID NO: 14262 - DNA, 23 bp, Artificial Sequence
  Synthetic Construct
gctcaagccccatgaataaggtt

SEQ ID NO: 14263 - DNA, 22 bp, Artificial Sequence
  Synthetic Construct
gagagacaactgcatgctcaga

SEQ ID NO: 14264 - DNA, 26 bp, Artificial Sequence
  Synthetic Construct
gatggactggtagtctgtaacccaat

SEQ ID NO: 14265 - DNA, 23 bp, Artificial Sequence
  Synthetic Construct
actgctcaaccaacatctgttca

SEQ ID NO: 14266 - DNA, 20 bp, Artificial Sequence
  Synthetic Construct
gggccatggcactagggtaa

SEQ ID NO: 14267 - DNA, 23 bp, Artificial Sequence
  Synthetic Construct
caagggaggctgaagaacgtcat

SEQ ID NO: 14268 - DNA, 22 bp, Artificial Sequence
  Synthetic Construct
tcacccactccacagcatgttc

SEQ ID NO: 14269 - DNA, 24 bp, Artificial Sequence
  Synthetic Construct
cttccccagttgacaaggacaaag

SEQ ID NO: 14270 - DNA, 21 bp, Artificial Sequence
  Synthetic Construct
tggtgatggggagccactctt

SEQ ID NO: 14271 - DNA, 22 bp, Artificial Sequence
  Synthetic Construct
ggtgcctgcttgtccctgaata

SEQ ID NO: 14272 - DNA, 24 bp, Artificial Sequence
  Synthetic Construct
gatcctccccaagggttaagaatg

SEQ ID NO: 14273 - DNA, 21 bp, Artificial Sequence
  Synthetic Construct
gccacagctgtctgagggtta

SEQ ID NO: 14274 - DNA, 22 bp, Artificial Sequence
  Synthetic Construct
cctttccatggactgtgcaact

SEQ ID NO: 14275 - DNA, 24 bp, Artificial Sequence
  Synthetic Construct
ggtgactcagatcaggggttccaa

SEQ ID NO: 14276 - DNA, 22 bp, Artificial Sequence
  Synthetic Construct
ggtgtgtgtggaaggactgtga

SEQ ID NO: 14277 - DNA, 25 bp, Artificial Sequence
  Synthetic Construct
gaggaaggagatattggaggtgtct

SEQ ID NO: 14278 - DNA, 20 bp, Artificial Sequence
  Synthetic Construct
gccagccttgagtccagtga

SEQ ID NO: 14279 - DNA, 21 bp, Artificial Sequence
  Synthetic Construct
aacctgtcagcttcagccaaa

SEQ ID NO: 14280 - DNA, 24 bp, Artificial Sequence
  Synthetic Construct
tgcgctgattattagtgtcaggtt

SEQ ID NO: 14281 - DNA, 25 bp, Artificial Sequence
  Synthetic Construct
gagttcacccttcagcaaatgaaca

SEQ ID NO: 14282 - DNA, 22 bp, Artificial Sequence
  Synthetic Construct
acactgatctccactcccagat

SEQ ID NO: 14283 - DNA, 19 bp, Artificial Sequence
  Synthetic Construct
agcctcgaacctccgcaaa

SEQ ID NO: 14284 - DNA, 22 bp, Artificial Sequence
  Synthetic Construct
ggagaaaccaaaggcccacagt

SEQ ID NO: 14285 - DNA, 25 bp, Artificial Sequence
  Synthetic Construct
gaagaagagaaggcaatgtgaccat

SEQ ID NO: 14286 - DNA, 20 bp, Artificial Sequence
  Synthetic Construct
accccacccgctttctccat

SEQ ID NO: 14287 - DNA, 20 bp, Artificial Sequence
  Synthetic Construct
ccagagaacacgggctgttt

SEQ ID NO: 14288 - DNA, 24 bp, Artificial Sequence
  Synthetic Construct
cccagttcccctcctgagtttaga

SEQ ID NO: 14289 - DNA, 22 bp, Artificial Sequence
  Synthetic Construct
caccctgaactccctgcgtaat

SEQ ID NO: 14290 - DNA, 21 bp, Artificial Sequence
  Synthetic Construct
cctttcacagcccggtgcata

SEQ ID NO: 14291 - DNA, 24 bp, Artificial Sequence
  Synthetic Construct
gtgacaatcagggtccttgtctct

SEQ ID NO: 14292 - DNA, 24 bp, Artificial Sequence
  Synthetic Construct
tgaatgactgatgagatccgttgt

SEQ ID NO: 14293 - DNA, 21 bp, Artificial Sequence
  Synthetic Construct
tggcaggaagatggcttgaga

SEQ ID NO: 14294 - DNA, 22 bp, Artificial Sequence
  Synthetic Construct
agccagtaagggatgggctgat

SEQ ID NO: 14295 - DNA, 25 bp, Artificial Sequence
  Synthetic Construct
tcttctccctcacagcaaatctttt

SEQ ID NO: 14296 - DNA, 23 bp, Artificial Sequence
  Synthetic Construct
ccaggcatctgattcagtgtcaa

SEQ ID NO: 14297 - DNA, 22 bp, Artificial Sequence
  Synthetic Construct
cctggaatgggcttaggcatca

SEQ ID NO: 14298 - DNA, 20 bp, Artificial Sequence
  Synthetic Construct
acaggcccttttggctttgt

SEQ ID NO: 14299 - DNA, 23 bp, Artificial Sequence
  Synthetic Construct
ggaggccatccaacagaagattg

SEQ ID NO: 14300 - DNA, 20 bp, Artificial Sequence
  Synthetic Construct
agcaggcaaggccagagtag

SEQ ID NO: 14301 - DNA, 23 bp, Artificial Sequence
  Synthetic Construct
gtgaaacccctgttcttggttga

SEQ ID NO: 14302 - DNA, 22 bp, Artificial Sequence
  Synthetic Construct
aggaggggcaccaacttacaga

SEQ ID NO: 14303 - DNA, 26 bp, Artificial Sequence
  Synthetic Construct
ggggctaaagtcatctcaccctaaag

SEQ ID NO: 14304 - DNA, 22 bp, Artificial Sequence
  Synthetic Construct
ctgccccattgacagaggttct

SEQ ID NO: 14305 - DNA, 22 bp, Artificial Sequence
  Synthetic Construct
cacctcctcacccgctattgta

SEQ ID NO: 14306 - DNA, 24 bp, Artificial Sequence
  Synthetic Construct
gatgtaggagtcatggggatcttg

SEQ ID NO: 14307 - DNA, 23 bp, Artificial Sequence
  Synthetic Construct
gagctagcagtatagcactggtt

SEQ ID NO: 14308 - DNA, 20 bp, Artificial Sequence
  Synthetic Construct
caagcgggtgcaacagatga

SEQ ID NO: 14309 - DNA, 20 bp, Artificial Sequence
  Synthetic Construct
cacgtggtccctgcagtcat

SEQ ID NO: 14310 - DNA, 25 bp, Artificial Sequence
  Synthetic Construct
gcctgaggagagaatgaagggttct

SEQ ID NO: 14311 - DNA, 23 bp, Artificial Sequence
  Synthetic Construct
gcagtggtgattgccttggagtt

SEQ ID NO: 14312 - DNA, 25 bp, Artificial Sequence
  Synthetic Construct
cgggaacaagcttctttggtaaatg

SEQ ID NO: 14313 - DNA, 23 bp, Artificial Sequence
  Synthetic Construct
ataccctgggacgagagggacat

SEQ ID NO: 14314 - DNA, 25 bp, Artificial Sequence
  Synthetic Construct
gaaaccttgcaggtgtattgactct

SEQ ID NO: 14315 - DNA, 24 bp, Artificial Sequence
  Synthetic Construct
ccactagcctgtagggtaaagttc

SEQ ID NO: 14316 - DNA, 25 bp, Artificial Sequence
  Synthetic Construct
ccttgccctccaaatctatgtgact

SEQ ID NO: 14317 - DNA, 22 bp, Artificial Sequence
  Synthetic Construct
gagcaaaaccaccagggaacaa

SEQ ID NO: 14318 - DNA, 26 bp, Artificial Sequence
  Synthetic Construct
gtgtagacagaaaccttgacccagat

SEQ ID NO: 14319 - DNA, 23 bp, Artificial Sequence
  Synthetic Construct
gcctgaggtggaactttggtctt

SEQ ID NO: 14320 - DNA, 20 bp, Artificial Sequence
  Synthetic Construct
gcctggatttggccttctct

SEQ ID NO: 14321 - DNA, 21 bp, Artificial Sequence
  Synthetic Construct
tcagggcctgctcttgcacta

SEQ ID NO: 14322 - DNA, 27 bp, Artificial Sequence
  Synthetic Construct
ggagagaacgtggattatagaccgttt

SEQ ID NO: 14323 - DNA, 25 bp, Artificial Sequence
  Synthetic Construct
cccatctagtcttctgctggcgata

SEQ ID NO: 14324 - DNA, 22 bp, Artificial Sequence
  Synthetic Construct
tcttggctagggcgttagtaga

SEQ ID NO: 14325 - DNA, 25 bp, Artificial Sequence
  Synthetic Construct
gtctgacccaaggaaaacgttctga

SEQ ID NO: 14326 - DNA, 24 bp, Artificial Sequence
  Synthetic Construct
gagctcaggtctggactacttgaa

SEQ ID NO: 14327 - DNA, 24 bp, Artificial Sequence
  Synthetic Construct
gggtctcccaaagattctccagat

SEQ ID NO: 14328 - DNA, 22 bp, Artificial Sequence
  Synthetic Construct
gggtggatgatgcttgggtaac

SEQ ID NO: 14329 - DNA, 23 bp, Artificial Sequence
  Synthetic Construct
gtgaggcaacccagagaatcata

SEQ ID NO: 14330 - DNA, 24 bp, Artificial Sequence
  Synthetic Construct
cccacaatcaggaaaattgcttca

SEQ ID NO: 14331 - DNA, 23 bp, Artificial Sequence
  Synthetic Construct
cagggaactgggcataagccttt

SEQ ID NO: 14332 - DNA, 22 bp, Artificial Sequence
  Synthetic Construct
agccctggctaattctctctca

SEQ ID NO: 14333 - DNA, 21 bp, Artificial Sequence
  Synthetic Construct
cttccggccgagaatatggaa

SEQ ID NO: 14334 - DNA, 23 bp, Artificial Sequence
  Synthetic Construct
ccagagccccattttcctaccaa

SEQ ID NO: 14335 - DNA, 22 bp, Artificial Sequence
  Synthetic Construct
ggtgcagacacaagtagtcaga

SEQ ID NO: 14336 - DNA, 21 bp, Artificial Sequence
  Synthetic Construct
ggcataaggcaagagcgtcat

SEQ ID NO: 14337 - DNA, 21 bp, Artificial Sequence
  Synthetic Construct
tgttgtgactgctgccttgta

SEQ ID NO: 14338 - DNA, 20 bp, Artificial Sequence
  Synthetic Construct
ccgtcgctgaagttgcatca

SEQ ID NO: 14339 - DNA, 22 bp, Artificial Sequence
  Synthetic Construct
gagcctccctcacctttcagat

SEQ ID NO: 14340 - DNA, 25 bp, Artificial Sequence
  Synthetic Construct
ctcaggggtggatctttaagccttt

SEQ ID NO: 14341 - DNA, 23 bp, Artificial Sequence
  Synthetic Construct
gccagcacacagtcatagtgaac

SEQ ID NO: 14342 - DNA, 21 bp, Artificial Sequence
  Synthetic Construct
aaccgcaggtttctgagtcaa

SEQ ID NO: 14343 - DNA, 22 bp, Artificial Sequence
  Synthetic Construct
ggtttgtgcagctggttgacat

SEQ ID NO: 14344 - DNA, 21 bp, Artificial Sequence
  Synthetic Construct
ccctcctgcaaacaagcaact

SEQ ID NO: 14345 - DNA, 23 bp, Artificial Sequence
  Synthetic Construct
gtgaggcagtatccagcttctca

SEQ ID NO: 14346 - DNA, 24 bp, Artificial Sequence
  Synthetic Construct
ccaaacctcccagctctgtcattc

SEQ ID NO: 14347 - DNA, 21 bp, Artificial Sequence
  Synthetic Construct
actcagcccctgccaaagaag

SEQ ID NO: 14348 - DNA, 21 bp, Artificial Sequence
  Synthetic Construct
cgcccagccctgtgatgtaaa

SEQ ID NO: 14349 - DNA, 19 bp, Artificial Sequence
  Synthetic Construct
ttgtgcccaggcccttttc

SEQ ID NO: 14350 - DNA, 23 bp, Artificial Sequence
  Synthetic Construct
tgttgttgaggtgttaccactgt

SEQ ID NO: 14351 - DNA, 21 bp, Artificial Sequence
  Synthetic Construct
tctgcccttggcactgtgaga

SEQ ID NO: 14352 - DNA, 19 bp, Artificial Sequence
  Synthetic Construct
gcatgtggggcagcacgta

SEQ ID NO: 14353 - DNA, 25 bp, Artificial Sequence
  Synthetic Construct
ggctattccgtcagttactgcacat

SEQ ID NO: 14354 - DNA, 20 bp, Artificial Sequence
  Synthetic Construct
gccaagccagagggagcatt

SEQ ID NO: 14355 - DNA, 22 bp, Artificial Sequence
  Synthetic Construct
ccacccagaggccaatgctaag

SEQ ID NO: 14356 - DNA, 20 bp, Artificial Sequence
  Synthetic Construct
tccaagcttcgctgctcttg

SEQ ID NO: 14357 - DNA, 23 bp, Artificial Sequence
  Synthetic Construct
agacatggccagacaagacatag

SEQ ID NO: 14358 - DNA, 22 bp, Artificial Sequence
  Synthetic Construct
cagtcttgctcttccccagagt

SEQ ID NO: 14359 - DNA, 20 bp, Artificial Sequence
  Synthetic Construct
agccaggtgcgtagcataag

SEQ ID NO: 14360 - DNA, 20 bp, Artificial Sequence
  Synthetic Construct
tgggcccttgttgacccaat

SEQ ID NO: 14361 - DNA, 26 bp, Artificial Sequence
  Synthetic Construct
gtagggtcgatttcatcttcccacta

SEQ ID NO: 14362 - DNA, 22 bp, Artificial Sequence
  Synthetic Construct
gcatctacacggcacatccata

SEQ ID NO: 14363 - DNA, 23 bp, Artificial Sequence
  Synthetic Construct
gagggtaagccagagaaccaatg

SEQ ID NO: 14364 - DNA, 22 bp, Artificial Sequence
  Synthetic Construct
aggagctccgagaaacaagact

SEQ ID NO: 14365 - DNA, 21 bp, Artificial Sequence
  Synthetic Construct
caggtggcgggaacttaatga

SEQ ID NO: 14366 - DNA, 22 bp, Artificial Sequence
  Synthetic Construct
gagctgcaggaggaagaagatg

SEQ ID NO: 14367 - DNA, 24 bp, Artificial Sequence
  Synthetic Construct
gtgcctattggaagcctgaattgt

SEQ ID NO: 14368 - DNA, 22 bp, Artificial Sequence
  Synthetic Construct
agcccttgtagacctgggattc

SEQ ID NO: 14369 - DNA, 21 bp, Artificial Sequence
  Synthetic Construct
ttcaggggcctttgcctcttc

SEQ ID NO: 14370 - DNA, 24 bp, Artificial Sequence
  Synthetic Construct
cctggacctaagccggaagtcata

SEQ ID NO: 14371 - DNA, 22 bp, Artificial Sequence
  Synthetic Construct
gggcatgatgaagaggcactaa

SEQ ID NO: 14372 - DNA, 21 bp, Artificial Sequence
  Synthetic Construct
gctctccccagcctgttctct

SEQ ID NO: 14373 - DNA, 22 bp, Artificial Sequence
  Synthetic Construct
cgacagccatctctgactggtt

SEQ ID NO: 14374 - DNA, 22 bp, Artificial Sequence
  Synthetic Construct
gatggccaggtaacggtcatag

SEQ ID NO: 14375 - DNA, 21 bp, Artificial Sequence
  Synthetic Construct
tcgggtttggaggggtagaga

SEQ ID NO: 14376 - DNA, 22 bp, Artificial Sequence
  Synthetic Construct
ggaaacaccctgaggctaggta

SEQ ID NO: 14377 - DNA, 24 bp, Artificial Sequence
  Synthetic Construct
ggagtggggttacagaggatgtag

SEQ ID NO: 14378 - DNA, 24 bp, Artificial Sequence
  Synthetic Construct
gtatgccaggtgctatgctaaaag

SEQ ID NO: 14379 - DNA, 24 bp, Artificial Sequence
  Synthetic Construct
gtttgccactttctctcacctctt

SEQ ID NO: 14380 - DNA, 26 bp, Artificial Sequence
  Synthetic Construct
gacttaatcccaggaccctctgtttt

SEQ ID NO: 14381 - DNA, 22 bp, Artificial Sequence
  Synthetic Construct
ggcccttgtcaagtttcagaca

SEQ ID NO: 14382 - DNA, 22 bp, Artificial Sequence
  Synthetic Construct
cccctcacaaaagcttctgcat

SEQ ID NO: 14383 - DNA, 22 bp, Artificial Sequence
  Synthetic Construct
tcccttagagaccgacctttgt

SEQ ID NO: 14384 - DNA, 21 bp, Artificial Sequence
  Synthetic Construct
ggcacgtgggatacaccacta

SEQ ID NO: 14385 - DNA, 19 bp, Artificial Sequence
  Synthetic Construct
aaacggggccttgctgctt

SEQ ID NO: 14386 - DNA, 22 bp, Artificial Sequence
  Synthetic Construct
ggacatctcctcaaggcttgtt

SEQ ID NO: 14387 - DNA, 25 bp, Artificial Sequence
  Synthetic Construct
cacccttcttgaagccttccttgat

SEQ ID NO: 14388 - DNA, 20 bp, Artificial Sequence
  Synthetic Construct
tgccaccatgcccatctaag

SEQ ID NO: 14389 - DNA, 20 bp, Artificial Sequence
  Synthetic Construct
tggcaggaagccactggaaa

SEQ ID NO: 14390 - DNA, 24 bp, Artificial Sequence
  Synthetic Construct
agcctccactctttctcataggat

SEQ ID NO: 14391 - DNA, 20 bp, Artificial Sequence
  Synthetic Construct
agcacctttgcaacctcctt

SEQ ID NO: 14392 - DNA, 27 bp, Artificial Sequence
  Synthetic Construct
gtccatgggaaattcacagagaaggaa

SEQ ID NO: 14393 - DNA, 22 bp, Artificial Sequence
  Synthetic Construct
caaggctggagcttaccaggtt

SEQ ID NO: 14394 - DNA, 23 bp, Artificial Sequence
  Synthetic Construct
cgccagctaaaacacccaaatca

SEQ ID NO: 14395 - DNA, 22 bp, Artificial Sequence
  Synthetic Construct
ccagcagacacagcagtctagt

SEQ ID NO: 14396 - DNA, 22 bp, Artificial Sequence
  Synthetic Construct
tgtaggcccagttgagctcttg

SEQ ID NO: 14397 - DNA, 21 bp, Artificial Sequence
  Synthetic Construct
accatggcccagggcttctat

SEQ ID NO: 14398 - DNA, 20 bp, Artificial Sequence
  Synthetic Construct
tggcagggctcattctgatg

SEQ ID NO: 14399 - DNA, 26 bp, Artificial Sequence
  Synthetic Construct
gccaaactggaaattgtttcggtact

SEQ ID NO: 14400 - DNA, 22 bp, Artificial Sequence
  Synthetic Construct
tggatggaatgctctcccttct

SEQ ID NO: 14401 - DNA, 24 bp, Artificial Sequence
  Synthetic Construct
tgagctgtgctaaaatggactctt

SEQ ID NO: 14402 - DNA, 22 bp, Artificial Sequence
  Synthetic Construct
ctccccgactcaccatttggat

SEQ ID NO: 14403 - DNA, 21 bp, Artificial Sequence
  Synthetic Construct
gcttgctggaaaatggcaagt

SEQ ID NO: 14404 - DNA, 20 bp, Artificial Sequence
  Synthetic Construct
tgttgacaggccccaacctt

SEQ ID NO: 14405 - DNA, 22 bp, Artificial Sequence
  Synthetic Construct
gcttggcctatggttggttact

SEQ ID NO: 14406 - DNA, 23 bp, Artificial Sequence
  Synthetic Construct
gatggaagcaggtgacagtgttc

SEQ ID NO: 14407 - DNA, 23 bp, Artificial Sequence
  Synthetic Construct
agcacccagttgtaacaaacagt

SEQ ID NO: 14408 - DNA, 21 bp, Artificial Sequence
  Synthetic Construct
atgtgggttctggggctctgt

SEQ ID NO: 14409 - DNA, 22 bp, Artificial Sequence
  Synthetic Construct
cttgcttgtgcaagaactggaa

SEQ ID NO: 14410 - DNA, 20 bp, Artificial Sequence
  Synthetic Construct
acccgccttcactgcaaatg

SEQ ID NO: 14411 - DNA, 23 bp, Artificial Sequence
  Synthetic Construct
aggtctacacctggcactatgta

SEQ ID NO: 14412 - DNA, 22 bp, Artificial Sequence
  Synthetic Construct
ggctgaaaggggcttgtaatga

SEQ ID NO: 14413 - DNA, 23 bp, Artificial Sequence
  Synthetic Construct
cttggcactgcagattcaaagtt

SEQ ID NO: 14414 - DNA, 21 bp, Artificial Sequence
  Synthetic Construct
acgcagaaaactggtggatgt

SEQ ID NO: 14415 - DNA, 19 bp, Artificial Sequence
  Synthetic Construct
tcctgcctcacgccctttc

SEQ ID NO: 14416 - DNA, 22 bp, Artificial Sequence
  Synthetic Construct
gcggggccactttcttacagtt

SEQ ID NO: 14417 - DNA, 21 bp, Artificial Sequence
  Synthetic Construct
gacctggggagcaaatagcaa

SEQ ID NO: 14418 - DNA, 23 bp, Artificial Sequence
  Synthetic Construct
gttttgcaaagttgctgggtaga

SEQ ID NO: 14419 - DNA, 22 bp, Artificial Sequence
  Synthetic Construct
tggaggcaccactcaggtttga

SEQ ID NO: 14420 - DNA, 23 bp, Artificial Sequence
  Synthetic Construct
gagtgcagtgtcgtatggtggaa

SEQ ID NO: 14421 - DNA, 20 bp, Artificial Sequence
  Synthetic Construct
ccctgcctgctgtgtttttc

SEQ ID NO: 14422 - DNA, 21 bp, Artificial Sequence
  Synthetic Construct
tgcacctccagctgtgtgact

SEQ ID NO: 14423 - DNA, 22 bp, Artificial Sequence
  Synthetic Construct
tcccttcactcaccatccagaa

SEQ ID NO: 14424 - DNA, 20 bp, Artificial Sequence
  Synthetic Construct
ggagccaccttggggatctt

SEQ ID NO: 14425 - DNA, 21 bp, Artificial Sequence
  Synthetic Construct
gggccagtcttcatggacctt

SEQ ID NO: 14426 - DNA, 21 bp, Artificial Sequence
  Synthetic Construct
ccagattggctcccactgaaa

SEQ ID NO: 14427 - DNA, 23 bp, Artificial Sequence
  Synthetic Construct
gcctctgttccatccccttcttc

SEQ ID NO: 14428 - DNA, 24 bp, Artificial Sequence
  Synthetic Construct
cagtaacgctcaccacaagttaca

SEQ ID NO: 14429 - DNA, 21 bp, Artificial Sequence
  Synthetic Construct
gctgctggacaccaagtgcat

SEQ ID NO: 14430 - DNA, 18 bp, Artificial Sequence
  Synthetic Construct
tcccctcacgtggctgaa

SEQ ID NO: 14431 - DNA, 25 bp, Artificial Sequence
  Synthetic Construct
tggtcacgaatcaaaatccttccta

SEQ ID NO: 14432 - DNA, 25 bp, Artificial Sequence
  Synthetic Construct
gaaggtagcagaaggaggtttgaga

SEQ ID NO: 14433 - DNA, 20 bp, Artificial Sequence
  Synthetic Construct
aacgggaagcctccaaccaa

SEQ ID NO: 14434 - DNA, 22 bp, Artificial Sequence
  Synthetic Construct
cccaactccattgccccagatt

SEQ ID NO: 14435 - DNA, 22 bp, Artificial Sequence
  Synthetic Construct
tttcaccacaatccagcagtct

SEQ ID NO: 14436 - DNA, 23 bp, Artificial Sequence
  Synthetic Construct
tcttttgtatccccacagtgctt

SEQ ID NO: 14437 - DNA, 27 bp, Artificial Sequence
  Synthetic Construct
gcaccacgtatgtacttgtaagggttt

SEQ ID NO: 14438 - DNA, 21 bp, Artificial Sequence
  Synthetic Construct
tgtcaagctggttgtgtcctt

SEQ ID NO: 14439 - DNA, 20 bp, Artificial Sequence
  Synthetic Construct
tggcagaacatcccgtgtct

SEQ ID NO: 14440 - DNA, 25 bp, Artificial Sequence
  Synthetic Construct
ggggaggcttaaaggaacagcttag

SEQ ID NO: 14441 - DNA, 23 bp, Artificial Sequence
  Synthetic Construct
gcatccgctgagaattggtgttg

SEQ ID NO: 14442 - DNA, 26 bp, Artificial Sequence
  Synthetic Construct
agagtctaaggggctctttatcctta

SEQ ID NO: 14443 - DNA, 24 bp, Artificial Sequence
  Synthetic Construct
tgtggtctcaagcagatgatacaa

SEQ ID NO: 14444 - DNA, 23 bp, Artificial Sequence
  Synthetic Construct
tgttctagggagttctcggcttt

SEQ ID NO: 14445 - DNA, 23 bp, Artificial Sequence
  Synthetic Construct
gggctgtattcacacagggaaca

SEQ ID NO: 14446 - DNA, 22 bp, Artificial Sequence
  Synthetic Construct
ggggccagtaagcaaagactca

SEQ ID NO: 14447 - DNA, 24 bp, Artificial Sequence
  Synthetic Construct
ccaatctgggcatctgagtaactt

SEQ ID NO: 14448 - DNA, 20 bp, Artificial Sequence
  Synthetic Construct
ccaggtgcccacatttctct

SEQ ID NO: 14449 - DNA, 20 bp, Artificial Sequence
  Synthetic Construct
aagacctgccagggtcatca

SEQ ID NO: 14450 - DNA, 25 bp, Artificial Sequence
  Synthetic Construct
ggtggggctaaaaatcaggtagatg

SEQ ID NO: 14451 - DNA, 28 bp, Artificial Sequence
  Synthetic Construct
cctctgatctcttgtatcagtgggaatc

SEQ ID NO: 14452 - DNA, 23 bp, Artificial Sequence
  Synthetic Construct
cgaacaacactggggtacagcta

SEQ ID NO: 14453 - DNA, 25 bp, Artificial Sequence
  Synthetic Construct
gggtctacgtttttatgcagtcaag

SEQ ID NO: 14454 - DNA, 23 bp, Artificial Sequence
  Synthetic Construct
gcctctgtgtcactcttggcttt

SEQ ID NO: 14455 - DNA, 24 bp, Artificial Sequence
  Synthetic Construct
ggctcttggtaattgttgccatgt

SEQ ID NO: 14456 - DNA, 24 bp, Artificial Sequence
  Synthetic Construct
cagagtgtctcagctgtcctaagt

SEQ ID NO: 14457 - DNA, 21 bp, Artificial Sequence
  Synthetic Construct
gcacaggtttggtgcctgaca

SEQ ID NO: 14458 - DNA, 22 bp, Artificial Sequence
  Synthetic Construct
ctcactgcttgctgtgttgttg

SEQ ID NO: 14459 - DNA, 25 bp, Artificial Sequence
  Synthetic Construct
ggtgtgcctaagaatgtagtcctaa

SEQ ID NO: 14460 - DNA, 24 bp, Artificial Sequence
  Synthetic Construct
gtcactacaactgcaccttgtcta

SEQ ID NO: 14461 - DNA, 20 bp, Artificial Sequence
  Synthetic Construct
tgtgctctaccccactgtgt

SEQ ID NO: 14462 - DNA, 21 bp, Artificial Sequence
  Synthetic Construct
gcagaagcttcctcctagcaa

SEQ ID NO: 14463 - DNA, 20 bp, Artificial Sequence
  Synthetic Construct
tccccatcgcttgttgttga

SEQ ID NO: 14464 - DNA, 21 bp, Artificial Sequence
  Synthetic Construct
aggatggccttagctgctttg

SEQ ID NO: 14465 - DNA, 23 bp, Artificial Sequence
  Synthetic Construct
gggagaggaaaccagtagccatt

SEQ ID NO: 14466 - DNA, 24 bp, Artificial Sequence
  Synthetic Construct
ctggaaggctgtctttcactggtt

SEQ ID NO: 14467 - DNA, 21 bp, Artificial Sequence
  Synthetic Construct
aagaggctccgatggtgtttc

SEQ ID NO: 14468 - DNA, 22 bp, Artificial Sequence
  Synthetic Construct
ccgcatggtacctgaggacatc

SEQ ID NO: 14469 - DNA, 20 bp, Artificial Sequence
  Synthetic Construct
gctgaccacatcggctttca

SEQ ID NO: 14470 - DNA, 22 bp, Artificial Sequence
  Synthetic Construct
acagggctatttcaggctcctt

SEQ ID NO: 14471 - DNA, 18 bp, Artificial Sequence
  Synthetic Construct
ttgcaggcgccggtagtt

SEQ ID NO: 14472 - DNA, 21 bp, Artificial Sequence
  Synthetic Construct
cggggaaatggcaaacaggat

SEQ ID NO: 14473 - DNA, 20 bp, Artificial Sequence
  Synthetic Construct
tgggccgaattcaccacagt

SEQ ID NO: 14474 - DNA, 20 bp, Artificial Sequence
  Synthetic Construct
ccaagccgatgcccactcta

SEQ ID NO: 14475 - DNA, 24 bp, Artificial Sequence
  Synthetic Construct
cgtctttttcccagggttcgtact

SEQ ID NO: 14476 - DNA, 25 bp, Artificial Sequence
  Synthetic Construct
ctcagacagatcactgctttgaaga

SEQ ID NO: 14477 - DNA, 22 bp, Artificial Sequence
  Synthetic Construct
ctcatccctttctccccagcat

SEQ ID NO: 14478 - DNA, 22 bp, Artificial Sequence
  Synthetic Construct
cccgaggcttgtcgttttagtt

SEQ ID NO: 14479 - DNA, 26 bp, Artificial Sequence
  Synthetic Construct
caaagctctttgcattactggcttac

SEQ ID NO: 14480 - DNA, 22 bp, Artificial Sequence
  Synthetic Construct
atggcagtagtgccttctcttc

SEQ ID NO: 14481 - DNA, 25 bp, Artificial Sequence
  Synthetic Construct
gtggaaatgaagagagggttgacat

SEQ ID NO: 14482 - DNA, 26 bp, Artificial Sequence
  Synthetic Construct
ggggagtgacagaagggaataggatt

SEQ ID NO: 14483 - DNA, 19 bp, Artificial Sequence
  Synthetic Construct
cgtgacctcggccttcact

SEQ ID NO: 14484 - DNA, 22 bp, Artificial Sequence
  Synthetic Construct
gacaaagacagcttggcagtga

SEQ ID NO: 14485 - DNA, 26 bp, Artificial Sequence
  Synthetic Construct
cagtgctgggtctacaaaacactttc

SEQ ID NO: 14486 - DNA, 24 bp, Artificial Sequence
  Synthetic Construct
tgaggaattcaaggctgaagatgt

SEQ ID NO: 14487 - DNA, 22 bp, Artificial Sequence
  Synthetic Construct
ggcttgtcaccccaccaatgaa

SEQ ID NO: 14488 - DNA, 23 bp, Artificial Sequence
  Synthetic Construct
ggcaatggtgaagcaggtaaaac

SEQ ID NO: 14489 - DNA, 24 bp, Artificial Sequence
  Synthetic Construct
cctatcctgagacgcaggtgtgta

SEQ ID NO: 14490 - DNA, 21 bp, Artificial Sequence
  Synthetic Construct
caccccacactgtccatttca

SEQ ID NO: 14491 - DNA, 22 bp, Artificial Sequence
  Synthetic Construct
aaccttcctgcaaggagacaaa

SEQ ID NO: 14492 - DNA, 22 bp, Artificial Sequence
  Synthetic Construct
gggtgggaagtctcctcctaga

SEQ ID NO: 14493 - DNA, 20 bp, Artificial Sequence
  Synthetic Construct
acgttgagagccaacaccat

SEQ ID NO: 14494 - DNA, 23 bp, Artificial Sequence
  Synthetic Construct
aattgtaccagtgcctgaagtga

SEQ ID NO: 14495 - DNA, 21 bp, Artificial Sequence
  Synthetic Construct
tggcacagccagggaacagat

SEQ ID NO: 14496 - DNA, 22 bp, Artificial Sequence
  Synthetic Construct
tggctacgactgtcctccttct

SEQ ID NO: 14497 - DNA, 23 bp, Artificial Sequence
  Synthetic Construct
ggcagacccatctttcacaatga

SEQ ID NO: 14498 - DNA, 19 bp, Artificial Sequence
  Synthetic Construct
ctggggacaagcgctcctt

SEQ ID NO: 14499 - DNA, 24 bp, Artificial Sequence
  Synthetic Construct
ctggggtctttgtactctgctatt

SEQ ID NO: 14500 - DNA, 21 bp, Artificial Sequence
  Synthetic Construct
gcctgctgtgtcagaggacat

SEQ ID NO: 14501 - DNA, 23 bp, Artificial Sequence
  Synthetic Construct
caccaggtactcgatccatctct

SEQ ID NO: 14502 - DNA, 21 bp, Artificial Sequence
  Synthetic Construct
agttccgagatgaccccatga

SEQ ID NO: 14503 - DNA, 20 bp, Artificial Sequence
  Synthetic Construct
tcttggggaccagtgcatca

SEQ ID NO: 14504 - DNA, 21 bp, Artificial Sequence
  Synthetic Construct
aggggacagggagagtgatct

SEQ ID NO: 14505 - DNA, 22 bp, Artificial Sequence
  Synthetic Construct
cagaacaggtggtagggagaga

SEQ ID NO: 14506 - DNA, 22 bp, Artificial Sequence
  Synthetic Construct
gcttccctcattcttgggaact

SEQ ID NO: 14507 - DNA, 24 bp, Artificial Sequence
  Synthetic Construct
cttccgtggtctatgggtttatga

SEQ ID NO: 14508 - DNA, 25 bp, Artificial Sequence
  Synthetic Construct
cctggactctttcaggttctgaagt

SEQ ID NO: 14509 - DNA, 20 bp, Artificial Sequence
  Synthetic Construct
gcaggccttaggctttgcta

SEQ ID NO: 14510 - DNA, 22 bp, Artificial Sequence
  Synthetic Construct
gagagatgctgcactggactca

SEQ ID NO: 14511 - DNA, 22 bp, Artificial Sequence
  Synthetic Construct
cagcctcgtggaagcagaagta

SEQ ID NO: 14512 - DNA, 25 bp, Artificial Sequence
  Synthetic Construct
ggcaatgtttaggaggactttctca

SEQ ID NO: 14513 - DNA, 22 bp, Artificial Sequence
  Synthetic Construct
aaggacatctgcgaggaaagtt

SEQ ID NO: 14514 - DNA, 23 bp, Artificial Sequence
  Synthetic Construct
cctcaatcaaacggggcaaccaa

SEQ ID NO: 14515 - DNA, 20 bp, Artificial Sequence
  Synthetic Construct
tctcccgctgacccggtgta

SEQ ID NO: 14516 - DNA, 21 bp, Artificial Sequence
  Synthetic Construct
tgaccagttcccaccctctgt

SEQ ID NO: 14517 - DNA, 20 bp, Artificial Sequence
  Synthetic Construct
ggccacgtgaagatgacaga

SEQ ID NO: 14518 - DNA, 23 bp, Artificial Sequence
  Synthetic Construct
ggtttgtgggatcaagaccttct

SEQ ID NO: 14519 - DNA, 21 bp, Artificial Sequence
  Synthetic Construct
tgtctgtccccaagccagact

SEQ ID NO: 14520 - DNA, 25 bp, Artificial Sequence
  Synthetic Construct
gcccatctagcctgtgttaggaaga

SEQ ID NO: 14521 - DNA, 25 bp, Artificial Sequence
  Synthetic Construct
gcctggatttggatcgtaactctac

SEQ ID NO: 14522 - DNA, 21 bp, Artificial Sequence
  Synthetic Construct
aaggctgttggacagacacaa

SEQ ID NO: 14523 - DNA, 21 bp, Artificial Sequence
  Synthetic Construct
tggcgccatgacagagggata

SEQ ID NO: 14524 - DNA, 20 bp, Artificial Sequence
  Synthetic Construct
gcctgccacccacagaactt

SEQ ID NO: 14525 - DNA, 21 bp, Artificial Sequence
  Synthetic Construct
ggagcctgtactctgcactga

SEQ ID NO: 14526 - DNA, 21 bp, Artificial Sequence
  Synthetic Construct
gtggcgggaacagcaatatga

SEQ ID NO: 14527 - DNA, 23 bp, Artificial Sequence
  Synthetic Construct
ggccctagactggagccaaaaag

SEQ ID NO: 14528 - DNA, 22 bp, Artificial Sequence
  Synthetic Construct
aggactccatctgccttgtttc

SEQ ID NO: 14529 - DNA, 22 bp, Artificial Sequence
  Synthetic Construct
caccagcctcaccctttggatt

SEQ ID NO: 14530 - DNA, 21 bp, Artificial Sequence
  Synthetic Construct
ctcctgctgtcctttctgcaa

SEQ ID NO: 14531 - DNA, 20 bp, Artificial Sequence
  Synthetic Construct
gttgccagacctcccgttac

SEQ ID NO: 14532 - DNA, 20 bp, Artificial Sequence
  Synthetic Construct
ggaagtggtgggagggagaa

SEQ ID NO: 14533 - DNA, 23 bp, Artificial Sequence
  Synthetic Construct
accaggaagttggatgggactta

SEQ ID NO: 14534 - DNA, 26 bp, Artificial Sequence
  Synthetic Construct
cgcaggcaattatctcctatacttga

SEQ ID NO: 14535 - DNA, 24 bp, Artificial Sequence
  Synthetic Construct
tcacctcctattcactcctcaaca

SEQ ID NO: 14536 - DNA, 22 bp, Artificial Sequence
  Synthetic Construct
cagagcctccatttccttgcat

SEQ ID NO: 14537 - DNA, 22 bp, Artificial Sequence
  Synthetic Construct
tcacccatgtcacatcctgtct

SEQ ID NO: 14538 - DNA, 24 bp, Artificial Sequence
  Synthetic Construct
catcaacaaggtggtgacctgaga

SEQ ID NO: 14539 - DNA, 20 bp, Artificial Sequence
  Synthetic Construct
cgtgcggaaggcagttcaat

SEQ ID NO: 14540 - DNA, 19 bp, Artificial Sequence
  Synthetic Construct
tgtctccggcacaggtttg

SEQ ID NO: 14541 - DNA, 21 bp, Artificial Sequence
  Synthetic Construct
aggtcccagccttggttcatc

SEQ ID NO: 14542 - DNA, 24 bp, Artificial Sequence
  Synthetic Construct
tgagtggtgtttcagatcatcaca

SEQ ID NO: 14543 - DNA, 23 bp, Artificial Sequence
  Synthetic Construct
caccttccccactccaagttttg

SEQ ID NO: 14544 - DNA, 21 bp, Artificial Sequence
  Synthetic Construct
ggagccctgaatgaaccatga

SEQ ID NO: 14545 - DNA, 22 bp, Artificial Sequence
  Synthetic Construct
gaagccctgcagagtcaagaga

SEQ ID NO: 14546 - DNA, 22 bp, Artificial Sequence
  Synthetic Construct
ggaagggcctcaaccatccaaa

SEQ ID NO: 14547 - DNA, 21 bp, Artificial Sequence
  Synthetic Construct
tggccaccatctctgctgtca

SEQ ID NO: 14548 - DNA, 21 bp, Artificial Sequence
  Synthetic Construct
tcctggcaccatgacgtatct

SEQ ID NO: 14549 - DNA, 21 bp, Artificial Sequence
  Synthetic Construct
acagagccagcaagccccata

SEQ ID NO: 14550 - DNA, 20 bp, Artificial Sequence
  Synthetic Construct
ccagtgccacctgggtatgt

SEQ ID NO: 14551 - DNA, 21 bp, Artificial Sequence
  Synthetic Construct
gcttaccaaggaacgcgtaga

SEQ ID NO: 14552 - DNA, 21 bp, Artificial Sequence
  Synthetic Construct
cgtgtctctggctttgtgact

SEQ ID NO: 14553 - DNA, 22 bp, Artificial Sequence
  Synthetic Construct
cagccagtcacttcgtttgtca

SEQ ID NO: 14554 - DNA, 23 bp, Artificial Sequence
  Synthetic Construct
tcctttgcacttaacgctctagt

SEQ ID NO: 14555 - DNA, 19 bp, Artificial Sequence
  Synthetic Construct
ccaccaaggggccttgaca

SEQ ID NO: 14556 - DNA, 22 bp, Artificial Sequence
  Synthetic Construct
gttgggcgggaaaagcaaattc

SEQ ID NO: 14557 - DNA, 24 bp, Artificial Sequence
  Synthetic Construct
caaaaagacccctgaccactcaag

SEQ ID NO: 14558 - DNA, 19 bp, Artificial Sequence
  Synthetic Construct
gtggtgcttgtgcgtgtgt

SEQ ID NO: 14559 - DNA, 24 bp, Artificial Sequence
  Synthetic Construct
cagaggccagatgtagggaactgt

SEQ ID NO: 14560 - DNA, 20 bp, Artificial Sequence
  Synthetic Construct
tgcccagctggttggagact

SEQ ID NO: 14561 - DNA, 21 bp, Artificial Sequence
  Synthetic Construct
gtgccctgtgcagacatcact

SEQ ID NO: 14562 - DNA, 23 bp, Artificial Sequence
  Synthetic Construct
ccagagagtgggtccacaaggta

SEQ ID NO: 14563 - DNA, 22 bp, Artificial Sequence
  Synthetic Construct
aaaccccaagaggaccttgaac

SEQ ID NO: 14564 - DNA, 22 bp, Artificial Sequence
  Synthetic Construct
ccaaagaaccgagcccttcact

SEQ ID NO: 14565 - DNA, 22 bp, Artificial Sequence
  Synthetic Construct
tgcgccaggaaagaagtatgtt

SEQ ID NO: 14566 - DNA, 24 bp, Artificial Sequence
  Synthetic Construct
cctcagtggggagaatatgccttt

SEQ ID NO: 14567 - DNA, 21 bp, Artificial Sequence
  Synthetic Construct
agcggaacgctcacggagata

SEQ ID NO: 14568 - DNA, 22 bp, Artificial Sequence
  Synthetic Construct
gccagctgttctcggtttggaa

SEQ ID NO: 14569 - DNA, 18 bp, Artificial Sequence
  Synthetic Construct
tgcggcgttgggtggttt

SEQ ID NO: 14570 - DNA, 25 bp, Artificial Sequence
  Synthetic Construct
cagtcactgagaatcaggcagtgta

SEQ ID NO: 14571 - DNA, 20 bp, Artificial Sequence
  Synthetic Construct
agtgtgcagtgcccgagagt

SEQ ID NO: 14572 - DNA, 21 bp, Artificial Sequence
  Synthetic Construct
ggagacaacggccctcaaaca

SEQ ID NO: 14573 - DNA, 20 bp, Artificial Sequence
  Synthetic Construct
ccaggcaggctggagtttca

SEQ ID NO: 14574 - DNA, 20 bp, Artificial Sequence
  Synthetic Construct
tgaagcccacagccatccaa

SEQ ID NO: 14575 - DNA, 21 bp, Artificial Sequence
  Synthetic Construct
caggtgatggcgctgagattc

SEQ ID NO: 14576 - DNA, 19 bp, Artificial Sequence
  Synthetic Construct
ctggcctctggggacagaa

SEQ ID NO: 14577 - DNA, 22 bp, Artificial Sequence
  Synthetic Construct
tcttgcctcatctgccctctgt

SEQ ID NO: 14578 - DNA, 23 bp, Artificial Sequence
  Synthetic Construct
cccgcaagtactcatggctcttc

SEQ ID NO: 14579 - DNA, 22 bp, Artificial Sequence
  Synthetic Construct
cacacacactgaggacgctttc

SEQ ID NO: 14580 - DNA, 20 bp, Artificial Sequence
  Synthetic Construct
tgtcttggccgatgacacaa

SEQ ID NO: 14581 - DNA, 22 bp, Artificial Sequence
  Synthetic Construct
ccctgaccgctgatacaagcaa

SEQ ID NO: 14582 - DNA, 23 bp, Artificial Sequence
  Synthetic Construct
tcgggatggacaattccaagaac

SEQ ID NO: 14583 - DNA, 22 bp, Artificial Sequence
  Synthetic Construct
ccctcacacaagccacctgttt

SEQ ID NO: 14584 - DNA, 21 bp, Artificial Sequence
  Synthetic Construct
aacccaggactgtgagagtga

SEQ ID NO: 14585 - DNA, 22 bp, Artificial Sequence
  Synthetic Construct
tccacccctctgcgtaactttg

SEQ ID NO: 14586 - DNA, 20 bp, Artificial Sequence
  Synthetic Construct
acgcaccagctcccctttca

SEQ ID NO: 14587 - DNA, 20 bp, Artificial Sequence
  Synthetic Construct
ggggcatagcccaggaatga

SEQ ID NO: 14588 - DNA, 21 bp, Artificial Sequence
  Synthetic Construct
ggagacgggatggtggagaat

SEQ ID NO: 14589 - DNA, 19 bp, Artificial Sequence
  Synthetic Construct
tcgctgccaagcagtggat

SEQ ID NO: 14590 - DNA, 21 bp, Artificial Sequence
  Synthetic Construct
tggctcccagaagtgctgact

SEQ ID NO: 14591 - DNA, 23 bp, Artificial Sequence
  Synthetic Construct
ctgtcacgctttgtcacgctttg

SEQ ID NO: 14592 - DNA, 19 bp, Artificial Sequence
  Synthetic Construct
tgcccgcccattccatcat

SEQ ID NO: 14593 - DNA, 22 bp, Artificial Sequence
  Synthetic Construct
cgaaagccacaggacgtgctta

SEQ ID NO: 14594 - DNA, 25 bp, Artificial Sequence
  Synthetic Construct
gcaagatcagcacttctaggacgtt

SEQ ID NO: 14595 - DNA, 19 bp, Artificial Sequence
  Synthetic Construct
ccccgaggggaatcagcat

SEQ ID NO: 14596 - DNA, 22 bp, Artificial Sequence
  Synthetic Construct
cgtccagcttcatgctcagaga

SEQ ID NO: 14597 - DNA, 20 bp, Artificial Sequence
  Synthetic Construct
atcctccctccagcccatga

SEQ ID NO: 14598 - DNA, 20 bp, Artificial Sequence
  Synthetic Construct
tacctccaccgcagacagaa

SEQ ID NO: 14599 - DNA, 22 bp, Artificial Sequence
  Synthetic Construct
ggtttggcatggcctggaaagt

SEQ ID NO: 14600 - DNA, 23 bp, Artificial Sequence
  Synthetic Construct
gcccatttccaccctaactgtgt

SEQ ID NO: 14601 - DNA, 20 bp, Artificial Sequence
  Synthetic Construct
ttgtctggggaggggaagtt

SEQ ID NO: 14602 - DNA, 21 bp, Artificial Sequence
  Synthetic Construct
gcctggttcccctgacattct

SEQ ID NO: 14603 - DNA, 21 bp, Artificial Sequence
  Synthetic Construct
ccactagcgtggggtactgaa

SEQ ID NO: 14604 - DNA, 22 bp, Artificial Sequence
  Synthetic Construct
ccatgaccagagtccacctttc

SEQ ID NO: 14605 - DNA, 24 bp, Artificial Sequence
  Synthetic Construct
cactgacatccgtgttcccaaact

SEQ ID NO: 14606 - DNA, 20 bp, Artificial Sequence
  Synthetic Construct
tgccgtgcatgagtgcagat

SEQ ID NO: 14607 - DNA, 20 bp, Artificial Sequence
  Synthetic Construct
aaagggtgggacgtctcgaa

SEQ ID NO: 14608 - DNA, 21 bp, Artificial Sequence
  Synthetic Construct
aaagggccgtgtgggacacat

SEQ ID NO: 14609 - DNA, 22 bp, Artificial Sequence
  Synthetic Construct
catcagtgctccgtgcttgttc

SEQ ID NO: 14610 - DNA, 23 bp, Artificial Sequence
  Synthetic Construct
ccagccattctatcctcctccaa

SEQ ID NO: 14611 - DNA, 20 bp, Artificial Sequence
  Synthetic Construct
tttggacggtggaggtgagt

SEQ ID NO: 14612 - DNA, 22 bp, Artificial Sequence
  Synthetic Construct
cacactcagtttcgggcacagt

SEQ ID NO: 14613 - DNA, 22 bp, Artificial Sequence
  Synthetic Construct
gcttcccagcacctcctctaag

SEQ ID NO: 14614 - DNA, 24 bp, Artificial Sequence
  Synthetic Construct
accatggtggaaactccattcatt

SEQ ID NO: 14615 - DNA, 22 bp, Artificial Sequence
  Synthetic Construct
tggatctgcccacacccttaga

SEQ ID NO: 14616 - DNA, 20 bp, Artificial Sequence
  Synthetic Construct
gccgaaggacaggcacactt

SEQ ID NO: 14617 - DNA, 24 bp, Artificial Sequence
  Synthetic Construct
gagacaaccaaacccttcccaagt

SEQ ID NO: 14618 - DNA, 21 bp, Artificial Sequence
  Synthetic Construct
tacctccggcctgaccaatca

SEQ ID NO: 14619 - DNA, 23 bp, Artificial Sequence
  Synthetic Construct
gcagctcaagggtgttcggaaat

SEQ ID NO: 14620 - DNA, 20 bp, Artificial Sequence
  Synthetic Construct
tgccctgcccttgtcagtct

SEQ ID NO: 14621 - DNA, 22 bp, Artificial Sequence
  Synthetic Construct
tcccatgtcccgatccgacttc

SEQ ID NO: 14622 - DNA, 22 bp, Artificial Sequence
  Synthetic Construct
ctgttaccatccactggaccaa

SEQ ID NO: 14623 - DNA, 23 bp, Artificial Sequence
  Synthetic Construct
gcctgtgaggaggacttttccat

SEQ ID NO: 14624 - DNA, 24 bp, Artificial Sequence
  Synthetic Construct
gactctgtgtgagaacagcactat

SEQ ID NO: 14625 - DNA, 26 bp, Artificial Sequence
  Synthetic Construct
gtcatggtgagtcaaagactacgtta

SEQ ID NO: 14626 - DNA, 22 bp, Artificial Sequence
  Synthetic Construct
cgctgtgagcctccactgattt

SEQ ID NO: 14627 - DNA, 27 bp, Artificial Sequence
  Synthetic Construct
cacaccaggttgtctctatttacactt

SEQ ID NO: 14628 - DNA, 22 bp, Artificial Sequence
  Synthetic Construct
agcctggtggtagagggagaag

SEQ ID NO: 14629 - DNA, 23 bp, Artificial Sequence
  Synthetic Construct
ggcagtatccaaggcaggtgtag

SEQ ID NO: 14630 - DNA, 21 bp, Artificial Sequence
  Synthetic Construct
cagccactaccctgcaaccat

SEQ ID NO: 14631 - DNA, 23 bp, Artificial Sequence
  Synthetic Construct
cctcatgtactcctggtctcaca

SEQ ID NO: 14632 - DNA, 25 bp, Artificial Sequence
  Synthetic Construct
cagccccaacctcattagtcagtta

SEQ ID NO: 14633 - DNA, 24 bp, Artificial Sequence
  Synthetic Construct
cacaggcaggttagagacgctttc

SEQ ID NO: 14634 - DNA, 20 bp, Artificial Sequence
  Synthetic Construct
tcaggcctctctcagtcgaa

SEQ ID NO: 14635 - DNA, 24 bp, Artificial Sequence
  Synthetic Construct
gatcctcaaagcctgtaggagaag

SEQ ID NO: 14636 - DNA, 26 bp, Artificial Sequence
  Synthetic Construct
gtatcctggtttcagacactgaactt

SEQ ID NO: 14637 - DNA, 20 bp, Artificial Sequence
  Synthetic Construct
gccctcagagagccacaaga

SEQ ID NO: 14638 - DNA, 21 bp, Artificial Sequence
  Synthetic Construct
tcgggacctatccgctgcatt

SEQ ID NO: 14639 - DNA, 24 bp, Artificial Sequence
  Synthetic Construct
gcctggacttttgattacccctta

SEQ ID NO: 14640 - DNA, 23 bp, Artificial Sequence
  Synthetic Construct
gttccctctctcggctgacaatg

SEQ ID NO: 14641 - DNA, 24 bp, Artificial Sequence
  Synthetic Construct
gagcttcacattccatgtggcttt

SEQ ID NO: 14642 - DNA, 22 bp, Artificial Sequence
  Synthetic Construct
ttgagtctccccatctcccttt

SEQ ID NO: 14643 - DNA, 22 bp, Artificial Sequence
  Synthetic Construct
gagcaaggctgatgtcttcaca

SEQ ID NO: 14644 - DNA, 23 bp, Artificial Sequence
  Synthetic Construct
cgcaatgctgacacacatccttt

SEQ ID NO: 14645 - DNA, 24 bp, Artificial Sequence
  Synthetic Construct
ggaaattctgcaaggagggagaca

SEQ ID NO: 14646 - DNA, 26 bp, Artificial Sequence
  Synthetic Construct
ctcgcaagataacacacagagtaaca

SEQ ID NO: 14647 - DNA, 23 bp, Artificial Sequence
  Synthetic Construct
ctggaaccaaagggcaaagaaag

SEQ ID NO: 14648 - DNA, 21 bp, Artificial Sequence
  Synthetic Construct
gctgtccacgaagagccacat

SEQ ID NO: 14649 - DNA, 21 bp, Artificial Sequence
  Synthetic Construct
caccgctagccacagaggttt

SEQ ID NO: 14650 - DNA, 20 bp, Artificial Sequence
  Synthetic Construct
cccaccctgcacatgggttt

SEQ ID NO: 14651 - DNA, 21 bp, Artificial Sequence
  Synthetic Construct
aaggagcccagtgaccctgat

SEQ ID NO: 14652 - DNA, 23 bp, Artificial Sequence
  Synthetic Construct
actggactgtgatggttgctaag

SEQ ID NO: 14653 - DNA, 24 bp, Artificial Sequence
  Synthetic Construct
tgcttgggtataaagggagagaga

SEQ ID NO: 14654 - DNA, 26 bp, Artificial Sequence
  Synthetic Construct
gataatgtcaaagccggtagtgattg

SEQ ID NO: 14655 - DNA, 21 bp, Artificial Sequence
  Synthetic Construct
tgagggagccagggactaaga

SEQ ID NO: 14656 - DNA, 21 bp, Artificial Sequence
  Synthetic Construct
tcacagcaggccttggaccat

SEQ ID NO: 14657 - DNA, 21 bp, Artificial Sequence
  Synthetic Construct
gccacctacttgcaggttgaa

SEQ ID NO: 14658 - DNA, 22 bp, Artificial Sequence
  Synthetic Construct
tggtcacatacacgactgtgtt

SEQ ID NO: 14659 - DNA, 22 bp, Artificial Sequence
  Synthetic Construct
acccaccaagccatgtcctctt

SEQ ID NO: 14660 - DNA, 21 bp, Artificial Sequence
  Synthetic Construct
ggattgaggccaggcagacta

SEQ ID NO: 14661 - DNA, 21 bp, Artificial Sequence
  Synthetic Construct
cccagggctacctcggatttc

SEQ ID NO: 14662 - DNA, 24 bp, Artificial Sequence
  Synthetic Construct
gcgtgttagaaggtaacgcatact

SEQ ID NO: 14663 - DNA, 23 bp, Artificial Sequence
  Synthetic Construct
gagccgggaaagttttgtccaat

SEQ ID NO: 14664 - DNA, 23 bp, Artificial Sequence
  Synthetic Construct
gtgatgttctggctccctctttg

SEQ ID NO: 14665 - DNA, 22 bp, Artificial Sequence
  Synthetic Construct
ggcgtagaatgcagcagacact

SEQ ID NO: 14666 - DNA, 22 bp, Artificial Sequence
  Synthetic Construct
ctcagtgcccttccacatcagt

SEQ ID NO: 14667 - DNA, 24 bp, Artificial Sequence
  Synthetic Construct
gtggatggcttcctaattccaagt

SEQ ID NO: 14668 - DNA, 21 bp, Artificial Sequence
  Synthetic Construct
gagttcagagggcatgggttt

SEQ ID NO: 14669 - DNA, 20 bp, Artificial Sequence
  Synthetic Construct
tctggctccagcactcacta

SEQ ID NO: 14670 - DNA, 26 bp, Artificial Sequence
  Synthetic Construct
ccagattgtaccctcaattcctctca

SEQ ID NO: 14671 - DNA, 24 bp, Artificial Sequence
  Synthetic Construct
tcacctctctctcctccaccattc

SEQ ID NO: 14672 - DNA, 19 bp, Artificial Sequence
  Synthetic Construct
caggccacgtcgtcacact

SEQ ID NO: 14673 - DNA, 22 bp, Artificial Sequence
  Synthetic Construct
ctcacacatcgccgggaaaaag

SEQ ID NO: 14674 - DNA, 20 bp, Artificial Sequence
  Synthetic Construct
gccagccataacacctcaca

SEQ ID NO: 14675 - DNA, 20 bp, Artificial Sequence
  Synthetic Construct
aaaggccctggggtgaggaa

SEQ ID NO: 14676 - DNA, 19 bp, Artificial Sequence
  Synthetic Construct
tgtccccatgggaccttga

SEQ ID NO: 14677 - DNA, 25 bp, Artificial Sequence
  Synthetic Construct
gtcctacccaatgactgactgatac

SEQ ID NO: 14678 - DNA, 22 bp, Artificial Sequence
  Synthetic Construct
gaggctcaagcgtagagagaga

SEQ ID NO: 14679 - DNA, 20 bp, Artificial Sequence
  Synthetic Construct
agagaggagcactggacaca

SEQ ID NO: 14680 - DNA, 19 bp, Artificial Sequence
  Synthetic Construct
gctgctggcagtgctctct

SEQ ID NO: 14681 - DNA, 20 bp, Artificial Sequence
  Synthetic Construct
agccgtcactggttgtgtca

SEQ ID NO: 14682 - DNA, 22 bp, Artificial Sequence
  Synthetic Construct
cccgccaccacatcttgctaaa

SEQ ID NO: 14683 - DNA, 25 bp, Artificial Sequence
  Synthetic Construct
gacagagtgagtacgacatggaaac

SEQ ID NO: 14684 - DNA, 22 bp, Artificial Sequence
  Synthetic Construct
gtgcagcaaggctgtgatgagt

SEQ ID NO: 14685 - DNA, 21 bp, Artificial Sequence
  Synthetic Construct
ggccagatgctgtgtaacctt

SEQ ID NO: 14686 - DNA, 24 bp, Artificial Sequence
  Synthetic Construct
gtgtctctgtaaatcagcccttca

SEQ ID NO: 14687 - DNA, 22 bp, Artificial Sequence
  Synthetic Construct
ctgctccccagcttaccttttg

SEQ ID NO: 14688 - DNA, 22 bp, Artificial Sequence
  Synthetic Construct
tggcccctcctacaaccaaaac

SEQ ID NO: 14689 - DNA, 20 bp, Artificial Sequence
  Synthetic Construct
gctttgggctggtgacttct

SEQ ID NO: 14690 - DNA, 24 bp, Artificial Sequence
  Synthetic Construct
gaacttgaaggcacctctagctta

SEQ ID NO: 14691 - DNA, 22 bp, Artificial Sequence
  Synthetic Construct
tgggaaagcccttcaccagtca

SEQ ID NO: 14692 - DNA, 21 bp, Artificial Sequence
  Synthetic Construct
gccactttccagcaacgtatc

SEQ ID NO: 14693 - DNA, 26 bp, Artificial Sequence
  Synthetic Construct
cacttgcttttgcatccaacgattac

SEQ ID NO: 14694 - DNA, 26 bp, Artificial Sequence
  Synthetic Construct
ggattccaagactcagcttcaggaaa

SEQ ID NO: 14695 - DNA, 21 bp, Artificial Sequence
  Synthetic Construct
gcaggcaccaacacctcacat

SEQ ID NO: 14696 - DNA, 25 bp, Artificial Sequence
  Synthetic Construct
gctgacatttagtgagcccctgttc

SEQ ID NO: 14697 - DNA, 25 bp, Artificial Sequence
  Synthetic Construct
cacaagacagatagttgggctggat

SEQ ID NO: 14698 - DNA, 24 bp, Artificial Sequence
  Synthetic Construct
ctccccaaatgaagctgactgtag

SEQ ID NO: 14699 - DNA, 21 bp, Artificial Sequence
  Synthetic Construct
acatctccaaggcgtttctgt

SEQ ID NO: 14700 - DNA, 21 bp, Artificial Sequence
  Synthetic Construct
ggaaggggcaatggcacttag

SEQ ID NO: 14701 - DNA, 20 bp, Artificial Sequence
  Synthetic Construct
aggggttacggtgtggttca

SEQ ID NO: 14702 - DNA, 21 bp, Artificial Sequence
  Synthetic Construct
acctcctgctcacctgtcagt

SEQ ID NO: 14703 - DNA, 25 bp, Artificial Sequence
  Synthetic Construct
gtctagaagggcaaagtacttgaga

SEQ ID NO: 14704 - DNA, 19 bp, Artificial Sequence
  Synthetic Construct
agacctgctgggctgtagt

SEQ ID NO: 14705 - DNA, 22 bp, Artificial Sequence
  Synthetic Construct
gcttgtccaggtggagctatgt

SEQ ID NO: 14706 - DNA, 19 bp, Artificial Sequence
  Synthetic Construct
gcggggaggatgcaagact

SEQ ID NO: 14707 - DNA, 25 bp, Artificial Sequence
  Synthetic Construct
gaagactcacattgactcaggaact

SEQ ID NO: 14708 - DNA, 20 bp, Artificial Sequence
  Synthetic Construct
agcacccctccatccacctt

SEQ ID NO: 14709 - DNA, 22 bp, Artificial Sequence
  Synthetic Construct
tcccacctttcctgggttcagt

SEQ ID NO: 14710 - DNA, 20 bp, Artificial Sequence
  Synthetic Construct
cgtgccctgccatctgttct

SEQ ID NO: 14711 - DNA, 21 bp, Artificial Sequence
  Synthetic Construct
agcctgatctggtggacaaag

SEQ ID NO: 14712 - DNA, 27 bp, Artificial Sequence
  Synthetic Construct
cacaaacccagtgttttaggagcatga

SEQ ID NO: 14713 - DNA, 20 bp, Artificial Sequence
  Synthetic Construct
ccctccattcccagccatga

SEQ ID NO: 14714 - DNA, 23 bp, Artificial Sequence
  Synthetic Construct
gtatcccctatcagccaccagat

SEQ ID NO: 14715 - DNA, 22 bp, Artificial Sequence
  Synthetic Construct
gggaatcaccacacttgtgtct

SEQ ID NO: 14716 - DNA, 26 bp, Artificial Sequence
  Synthetic Construct
ccagtcatctccaaaaggtctgattc

SEQ ID NO: 14717 - DNA, 23 bp, Artificial Sequence
  Synthetic Construct
gcacacatccacattcgttcttg

SEQ ID NO: 14718 - DNA, 22 bp, Artificial Sequence
  Synthetic Construct
gtgatgtgcgttttggttcctt

SEQ ID NO: 14719 - DNA, 22 bp, Artificial Sequence
  Synthetic Construct
ggggcatgattccacctgtaac

SEQ ID NO: 14720 - DNA, 21 bp, Artificial Sequence
  Synthetic Construct
tgactcacaggtcaccagtct

SEQ ID NO: 14721 - DNA, 20 bp, Artificial Sequence
  Synthetic Construct
agacccctggtgcctcagat

SEQ ID NO: 14722 - DNA, 20 bp, Artificial Sequence
  Synthetic Construct
ctcctccgccctcatgtgaa

SEQ ID NO: 14723 - DNA, 20 bp, Artificial Sequence
  Synthetic Construct
aggtctgctccagcctcatc

SEQ ID NO: 14724 - DNA, 22 bp, Artificial Sequence
  Synthetic Construct
cccagctaagcacatgcacaat

SEQ ID NO: 14725 - DNA, 21 bp, Artificial Sequence
  Synthetic Construct
tgaaagcggatcccggctaga

SEQ ID NO: 14726 - DNA, 22 bp, Artificial Sequence
  Synthetic Construct
cggccagggagaagacaggata

SEQ ID NO: 14727 - DNA, 22 bp, Artificial Sequence
  Synthetic Construct
gagtcttcgtttgcacctctgt

SEQ ID NO: 14728 - DNA, 22 bp, Artificial Sequence
  Synthetic Construct
cagccataagccaagggacaca

SEQ ID NO: 14729 - DNA, 21 bp, Artificial Sequence
  Synthetic Construct
ccctcccttttcaccctggat

SEQ ID NO: 14730 - DNA, 24 bp, Artificial Sequence
  Synthetic Construct
gtggtttgtgtaatctcgctccaa

SEQ ID NO: 14731 - DNA, 21 bp, Artificial Sequence
  Synthetic Construct
caacttgccaggggcaacaac

SEQ ID NO: 14732 - DNA, 25 bp, Artificial Sequence
  Synthetic Construct
gcagctaggagtagtgaccaagaag

SEQ ID NO: 14733 - DNA, 23 bp, Artificial Sequence
  Synthetic Construct
caacccctctagccatgtagtct

SEQ ID NO: 14734 - DNA, 26 bp, Artificial Sequence
  Synthetic Construct
ctgaggtcaattccgattcccacatc

SEQ ID NO: 14735 - DNA, 25 bp, Artificial Sequence
  Synthetic Construct
aattgatagcaggggtgaatcaaga

SEQ ID NO: 14736 - DNA, 24 bp, Artificial Sequence
  Synthetic Construct
gggtttggtgacaatggctctttc

SEQ ID NO: 14737 - DNA, 25 bp, Artificial Sequence
  Synthetic Construct
gactttgatcttgggtgctttcttc

SEQ ID NO: 14738 - DNA, 24 bp, Artificial Sequence
  Synthetic Construct
gcgatggagtaaattaaggcacaa

SEQ ID NO: 14739 - DNA, 23 bp, Artificial Sequence
  Synthetic Construct
atccacccaggggtcaagagtag

SEQ ID NO: 14740 - DNA, 21 bp, Artificial Sequence
  Synthetic Construct
agcccatctcaggcatctagt

SEQ ID NO: 14741 - DNA, 23 bp, Artificial Sequence
  Synthetic Construct
gacagtgacggcataaccctgaa

SEQ ID NO: 14742 - DNA, 24 bp, Artificial Sequence
  Synthetic Construct
caggcactttcctctctgtgtttt

SEQ ID NO: 14743 - DNA, 21 bp, Artificial Sequence
  Synthetic Construct
tcacaccagacccctaaggaa

SEQ ID NO: 14744 - DNA, 22 bp, Artificial Sequence
  Synthetic Construct
acacaggtgtagccagtgtttg

SEQ ID NO: 14745 - DNA, 21 bp, Artificial Sequence
  Synthetic Construct
gtggacttcagagcacagcat

SEQ ID NO: 14746 - DNA, 22 bp, Artificial Sequence
  Synthetic Construct
cccttccctcctggtttcttca

SEQ ID NO: 14747 - DNA, 22 bp, Artificial Sequence
  Synthetic Construct
gactgctgatctggcctccaaa

SEQ ID NO: 14748 - DNA, 20 bp, Artificial Sequence
  Synthetic Construct
gcctagcagttgctcagtgt

SEQ ID NO: 14749 - DNA, 21 bp, Artificial Sequence
  Synthetic Construct
cacaccttggtgctcggtatg

SEQ ID NO: 14750 - DNA, 20 bp, Artificial Sequence
  Synthetic Construct
gcccatcaggtgcttgaaac

SEQ ID NO: 14751 - DNA, 25 bp, Artificial Sequence
  Synthetic Construct
tcctcccttgaatatcctcaactgt

SEQ ID NO: 14752 - DNA, 20 bp, Artificial Sequence
  Synthetic Construct
aaggggacctggtggcttta

SEQ ID NO: 14753 - DNA, 21 bp, Artificial Sequence
  Synthetic Construct
cctgcgacagttccgtcactt

SEQ ID NO: 14754 - DNA, 22 bp, Artificial Sequence
  Synthetic Construct
gctcacacgggcatgacctaat

SEQ ID NO: 14755 - DNA, 20 bp, Artificial Sequence
  Synthetic Construct
ttcagggcatgagcgcctta

SEQ ID NO: 14756 - DNA, 24 bp, Artificial Sequence
  Synthetic Construct
gagacaatcccttgagtgtctgat

SEQ ID NO: 14757 - DNA, 21 bp, Artificial Sequence
  Synthetic Construct
ggtccgcagagagaaggaaac

SEQ ID NO: 14758 - DNA, 23 bp, Artificial Sequence
  Synthetic Construct
ttgttcaagaacttgccctggta

SEQ ID NO: 14759 - DNA, 22 bp, Artificial Sequence
  Synthetic Construct
cctcagtgttctcagggcatct

SEQ ID NO: 14760 - DNA, 21 bp, Artificial Sequence
  Synthetic Construct
acccacagcccataggacaga

SEQ ID NO: 14761 - DNA, 21 bp, Artificial Sequence
  Synthetic Construct
tggtcccaagaggcttttgtt

SEQ ID NO: 14762 - DNA, 19 bp, Artificial Sequence
  Synthetic Construct
gcggaacggcctgtgaagt

SEQ ID NO: 14763 - DNA, 24 bp, Artificial Sequence
  Synthetic Construct
gccatttcatacaccgttgtcttt

SEQ ID NO: 14764 - DNA, 22 bp, Artificial Sequence
  Synthetic Construct
gagtttgcggggctgtttctac

SEQ ID NO: 14765 - DNA, 20 bp, Artificial Sequence
  Synthetic Construct
aggagcgcatgcctgtattc

SEQ ID NO: 14766 - DNA, 22 bp, Artificial Sequence
  Synthetic Construct
tgcagagggatggaggactatg

SEQ ID NO: 14767 - DNA, 22 bp, Artificial Sequence
  Synthetic Construct
ctgtatgttctcgggcctcagt

SEQ ID NO: 14768 - DNA, 19 bp, Artificial Sequence
  Synthetic Construct
ctccggaaacgctgcagat

SEQ ID NO: 14769 - DNA, 23 bp, Artificial Sequence
  Synthetic Construct
cctctggttgggatgagggtttg

SEQ ID NO: 14770 - DNA, 22 bp, Artificial Sequence
  Synthetic Construct
tggtctggaaacctggtgattc

SEQ ID NO: 14771 - DNA, 19 bp, Artificial Sequence
  Synthetic Construct
ttgccggctgacgtcttag

SEQ ID NO: 14772 - DNA, 20 bp, Artificial Sequence
  Synthetic Construct
gctggcatcacctcaacagt

SEQ ID NO: 14773 - DNA, 21 bp, Artificial Sequence
  Synthetic Construct
ggctttggcctgagactgttg

SEQ ID NO: 14774 - DNA, 27 bp, Artificial Sequence
  Synthetic Construct
gctaagaattcagcaagtaggacaaca

SEQ ID NO: 14775 - DNA, 19 bp, Artificial Sequence
  Synthetic Construct
cacccagacagcagctgaa

SEQ ID NO: 14776 - DNA, 22 bp, Artificial Sequence
  Synthetic Construct
cccaagcaatcctcccatctca

SEQ ID NO: 14777 - DNA, 25 bp, Artificial Sequence
  Synthetic Construct
gagggagaagggaacatgaactcta

SEQ ID NO: 14778 - DNA, 21 bp, Artificial Sequence
  Synthetic Construct
ggttgccctccactgtctgtt

SEQ ID NO: 14779 - DNA, 21 bp, Artificial Sequence
  Synthetic Construct
cagccttacctgccctgtact

SEQ ID NO: 14780 - DNA, 22 bp, Artificial Sequence
  Synthetic Construct
cagtggataaagtggcccatgt

SEQ ID NO: 14781 - DNA, 18 bp, Artificial Sequence
  Synthetic Construct
tggcccacacctccatca

SEQ ID NO: 14782 - DNA, 22 bp, Artificial Sequence
  Synthetic Construct
ggggaagttgctgtgtttctgt

SEQ ID NO: 14783 - DNA, 21 bp, Artificial Sequence
  Synthetic Construct
gctaccgacaacggcaacaac

SEQ ID NO: 14784 - DNA, 19 bp, Artificial Sequence
  Synthetic Construct
cgatttgagccccgcttct

SEQ ID NO: 14785 - DNA, 20 bp, Artificial Sequence
  Synthetic Construct
cctcggcacgtaggtggttt

SEQ ID NO: 14786 - DNA, 23 bp, Artificial Sequence
  Synthetic Construct
gcaaaggttgaacagacctggat

SEQ ID NO: 14787 - DNA, 20 bp, Artificial Sequence
  Synthetic Construct
ttcgatccgaccgggacaag

SEQ ID NO: 14788 - DNA, 19 bp, Artificial Sequence
  Synthetic Construct
agggcactcgtgcttttga

SEQ ID NO: 14789 - DNA, 23 bp, Artificial Sequence
  Synthetic Construct
tcatcctggagggtgtagagatg

SEQ ID NO: 14790 - DNA, 18 bp, Artificial Sequence
  Synthetic Construct
tgcactcggcacctgtct

SEQ ID NO: 14791 - DNA, 23 bp, Artificial Sequence
  Synthetic Construct
gcaacttgtgatgccttctttga

SEQ ID NO: 14792 - DNA, 21 bp, Artificial Sequence
  Synthetic Construct
gcaccacgggaactggtgaat

SEQ ID NO: 14793 - DNA, 22 bp, Artificial Sequence
  Synthetic Construct
ataaggcggtaggcaggactca

SEQ ID NO: 14794 - DNA, 19 bp, Artificial Sequence
  Synthetic Construct
tgtccgctaggccctctgt

SEQ ID NO: 14795 - DNA, 22 bp, Artificial Sequence
  Synthetic Construct
tcaaccacgacgaacccagaga

SEQ ID NO: 14796 - DNA, 22 bp, Artificial Sequence
  Synthetic Construct
catttccaccgtggtccctgtt

SEQ ID NO: 14797 - DNA, 22 bp, Artificial Sequence
  Synthetic Construct
gtgctgtgactatcgtgtgagt

SEQ ID NO: 14798 - DNA, 23 bp, Artificial Sequence
  Synthetic Construct
cagattgtaaccccaccccagaa

SEQ ID NO: 14799 - DNA, 25 bp, Artificial Sequence
  Synthetic Construct
aaactccagagtgacccttaaactt

SEQ ID NO: 14800 - DNA, 20 bp, Artificial Sequence
  Synthetic Construct
ccacagggcgaatgcaaagt

SEQ ID NO: 14801 - DNA, 23 bp, Artificial Sequence
  Synthetic Construct
gctcaagaatctgccaggtgtga

SEQ ID NO: 14802 - DNA, 25 bp, Artificial Sequence
  Synthetic Construct
gagtggagccaactttccttaccat

SEQ ID NO: 14803 - DNA, 20 bp, Artificial Sequence
  Synthetic Construct
gcaccaatccacgctgaaca

SEQ ID NO: 14804 - DNA, 21 bp, Artificial Sequence
  Synthetic Construct
aaccgcttcttgctgtgtcta

SEQ ID NO: 14805 - DNA, 26 bp, Artificial Sequence
  Synthetic Construct
ccaaggtcctaaactgacctgagact

SEQ ID NO: 14806 - DNA, 19 bp, Artificial Sequence
  Synthetic Construct
cacactgccacgctcttga

SEQ ID NO: 14807 - DNA, 22 bp, Artificial Sequence
  Synthetic Construct
acccaggtcttcagcagcattc

SEQ ID NO: 14808 - DNA, 23 bp, Artificial Sequence
  Synthetic Construct
aggagagaaccatcgagaggtaa

SEQ ID NO: 14809 - DNA, 21 bp, Artificial Sequence
  Synthetic Construct
gccaagactcacgctctcctt

SEQ ID NO: 14810 - DNA, 20 bp, Artificial Sequence
  Synthetic Construct
tcctatcagcgtccccttca

SEQ ID NO: 14811 - DNA, 24 bp, Artificial Sequence
  Synthetic Construct
cttgtggcctggttttggttaatg

SEQ ID NO: 14812 - DNA, 20 bp, Artificial Sequence
  Synthetic Construct
cctgggagtctggcgtcctt

SEQ ID NO: 14813 - DNA, 24 bp, Artificial Sequence
  Synthetic Construct
gcacgttactaagggcatgtgttc

SEQ ID NO: 14814 - DNA, 21 bp, Artificial Sequence
  Synthetic Construct
gctgctcttctgcagagttga

SEQ ID NO: 14815 - DNA, 25 bp, Artificial Sequence
  Synthetic Construct
ccttggcagcttagtgtatgtcagt

SEQ ID NO: 14816 - DNA, 24 bp, Artificial Sequence
  Synthetic Construct
tgaacccacgtaaagggacattag

SEQ ID NO: 14817 - DNA, 19 bp, Artificial Sequence
  Synthetic Construct
atgggcactgctccactct

SEQ ID NO: 14818 - DNA, 20 bp, Artificial Sequence
  Synthetic Construct
atgggccctgggactgatgt

SEQ ID NO: 14819 - DNA, 22 bp, Artificial Sequence
  Synthetic Construct
agattgggcatgataccgcttt

SEQ ID NO: 14820 - DNA, 21 bp, Artificial Sequence
  Synthetic Construct
cagagcttgttctcgggcaaa

SEQ ID NO: 14821 - DNA, 22 bp, Artificial Sequence
  Synthetic Construct
gccagaggaaactccgcttcta

SEQ ID NO: 14822 - DNA, 23 bp, Artificial Sequence
  Synthetic Construct
ccatcccctggtgaaggaaaatc

SEQ ID NO: 14823 - DNA, 23 bp, Artificial Sequence
  Synthetic Construct
ggttcccatgagcaggaggtagt

SEQ ID NO: 14824 - DNA, 22 bp, Artificial Sequence
  Synthetic Construct
cgctttcagctgcccaggaaat

SEQ ID NO: 14825 - DNA, 22 bp, Artificial Sequence
  Synthetic Construct
gcactaacccatcagcacatct

SEQ ID NO: 14826 - DNA, 25 bp, Artificial Sequence
  Synthetic Construct
cagactccaaagacgtggttgtgta

SEQ ID NO: 14827 - DNA, 19 bp, Artificial Sequence
  Synthetic Construct
ggagcccgtgggtgatgtt

SEQ ID NO: 14828 - DNA, 18 bp, Artificial Sequence
  Synthetic Construct
tgtcccgcagcacacctt

SEQ ID NO: 14829 - DNA, 24 bp, Artificial Sequence
  Synthetic Construct
ccttccaggagcttcgagaacaac

SEQ ID NO: 14830 - DNA, 22 bp, Artificial Sequence
  Synthetic Construct
gggctccgacactgctgtaaat

SEQ ID NO: 14831 - DNA, 20 bp, Artificial Sequence
  Synthetic Construct
tgcgtgatcggcctgaagaa

SEQ ID NO: 14832 - DNA, 25 bp, Artificial Sequence
  Synthetic Construct
gttcagtaatgtcagggcaaacaga

SEQ ID NO: 14833 - DNA, 20 bp, Artificial Sequence
  Synthetic Construct
tgagcacgtagcggtgcatt

SEQ ID NO: 14834 - DNA, 23 bp, Artificial Sequence
  Synthetic Construct
gcaaagcatgtcagtgtggttca

SEQ ID NO: 14835 - DNA, 25 bp, Artificial Sequence
  Synthetic Construct
gactagaaaattgccgtgggtctca

SEQ ID NO: 14836 - DNA, 22 bp, Artificial Sequence
  Synthetic Construct
cagatcagctggagggagcatt

SEQ ID NO: 14837 - DNA, 20 bp, Artificial Sequence
  Synthetic Construct
atctccagcacctgcactca

SEQ ID NO: 14838 - DNA, 23 bp, Artificial Sequence
  Synthetic Construct
gtgctgttgcaaagagtcgagaa

SEQ ID NO: 14839 - DNA, 23 bp, Artificial Sequence
  Synthetic Construct
ggttgaaagatggagccctctga

SEQ ID NO: 14840 - DNA, 22 bp, Artificial Sequence
  Synthetic Construct
gctactggggaagattgcttga

SEQ ID NO: 14841 - DNA, 24 bp, Artificial Sequence
  Synthetic Construct
gccagacgagtcatctacccttgt

SEQ ID NO: 14842 - DNA, 28 bp, Artificial Sequence
  Synthetic Construct
cagtcactattactgtaccaggagtgat

SEQ ID NO: 14843 - DNA, 26 bp, Artificial Sequence
  Synthetic Construct
cacccaaacattggcttttcttccaa

SEQ ID NO: 14844 - DNA, 26 bp, Artificial Sequence
  Synthetic Construct
gaggcactggttttggaaaaacaaca

SEQ ID NO: 14845 - DNA, 19 bp, Artificial Sequence
  Synthetic Construct
catggtccccacccacaag

SEQ ID NO: 14846 - DNA, 25 bp, Artificial Sequence
  Synthetic Construct
gagggagaatacagtccatgtttgt

SEQ ID NO: 14847 - DNA, 22 bp, Artificial Sequence
  Synthetic Construct
agggagggaaactggtgaggta

SEQ ID NO: 14848 - DNA, 24 bp, Artificial Sequence
  Synthetic Construct
ggcaaagtggagagatccagaaca

SEQ ID NO: 14849 - DNA, 25 bp, Artificial Sequence
  Synthetic Construct
ctgagaggagaaactgatgcttctt

SEQ ID NO: 14850 - DNA, 22 bp, Artificial Sequence
  Synthetic Construct
ggtaaccaccagtggccattct

SEQ ID NO: 14851 - DNA, 20 bp, Artificial Sequence
  Synthetic Construct
tctgaggggctgggaactga

SEQ ID NO: 14852 - DNA, 23 bp, Artificial Sequence
  Synthetic Construct
ccaagtggtcccatttcccctta

SEQ ID NO: 14853 - DNA, 22 bp, Artificial Sequence
  Synthetic Construct
ggtgttgctggaaaggtaggat

SEQ ID NO: 14854 - DNA, 21 bp, Artificial Sequence
  Synthetic Construct
aggagggtcacctttgtgtct

SEQ ID NO: 14855 - DNA, 22 bp, Artificial Sequence
  Synthetic Construct
ccagaaaccgtgagtcctgtca

SEQ ID NO: 14856 - DNA, 24 bp, Artificial Sequence
  Synthetic Construct
gaaccgcatagaccagtctaccta

SEQ ID NO: 14857 - DNA, 23 bp, Artificial Sequence
  Synthetic Construct
tggcatcaactccctttcttcaa

SEQ ID NO: 14858 - DNA, 22 bp, Artificial Sequence
  Synthetic Construct
ttgtccctgcctgaaggactca

SEQ ID NO: 14859 - DNA, 26 bp, Artificial Sequence
  Synthetic Construct
ggagcaatgtctacaaggatgagatg

SEQ ID NO: 14860 - DNA, 27 bp, Artificial Sequence
  Synthetic Construct
ggcacacagtcatggtagaataaactt

SEQ ID NO: 14861 - DNA, 22 bp, Artificial Sequence
  Synthetic Construct
cagtgaccaagtgggagagaag

SEQ ID NO: 14862 - DNA, 24 bp, Artificial Sequence
  Synthetic Construct
cacaaattccgggagatgaactga

SEQ ID NO: 14863 - DNA, 21 bp, Artificial Sequence
  Synthetic Construct
ctgcagcagaggtttgcaagt

SEQ ID NO: 14864 - DNA, 23 bp, Artificial Sequence
  Synthetic Construct
gacaggacttgcacagagcatga

SEQ ID NO: 14865 - DNA, 21 bp, Artificial Sequence
  Synthetic Construct
gatgacagacacgcaggaaga

SEQ ID NO: 14866 - DNA, 22 bp, Artificial Sequence
  Synthetic Construct
atatccgccccatctcctcagt

SEQ ID NO: 14867 - DNA, 24 bp, Artificial Sequence
  Synthetic Construct
caaacccaatgctacactccactt

SEQ ID NO: 14868 - DNA, 20 bp, Artificial Sequence
  Synthetic Construct
gggcctgcctccaagagtta

SEQ ID NO: 14869 - DNA, 20 bp, Artificial Sequence
  Synthetic Construct
gtcggcagttctgggcatga

SEQ ID NO: 14870 - DNA, 22 bp, Artificial Sequence
  Synthetic Construct
ctcacaacccagaagcccttga

SEQ ID NO: 14871 - DNA, 20 bp, Artificial Sequence
  Synthetic Construct
gcgccttccttcctccgttt

SEQ ID NO: 14872 - DNA, 19 bp, Artificial Sequence
  Synthetic Construct
tgctggccagaccctgcat

SEQ ID NO: 14873 - DNA, 21 bp, Artificial Sequence
  Synthetic Construct
gctttgcagaccagcaaggaa

SEQ ID NO: 14874 - DNA, 21 bp, Artificial Sequence
  Synthetic Construct
ggcccatcttggggttcagtt

SEQ ID NO: 14875 - DNA, 21 bp, Artificial Sequence
  Synthetic Construct
ccaagggcaggcagtgttttg

SEQ ID NO: 14876 - DNA, 25 bp, Artificial Sequence
  Synthetic Construct
ccatcgtggaatttttgtccaatct

SEQ ID NO: 14877 - DNA, 22 bp, Artificial Sequence
  Synthetic Construct
ggagaactggacggttgtgaag

SEQ ID NO: 14878 - DNA, 22 bp, Artificial Sequence
  Synthetic Construct
cctgttgaagccactagaccaa

SEQ ID NO: 14879 - DNA, 21 bp, Artificial Sequence
  Synthetic Construct
gtgtgatctggtggcttcaca

SEQ ID NO: 14880 - DNA, 22 bp, Artificial Sequence
  Synthetic Construct
agttccctgggtggaggaacaa

SEQ ID NO: 14881 - DNA, 21 bp, Artificial Sequence
  Synthetic Construct
gtcccaaagcagccatagaca

SEQ ID NO: 14882 - DNA, 23 bp, Artificial Sequence
  Synthetic Construct
ggtgcagttgaatggtggcctta

SEQ ID NO: 14883 - DNA, 19 bp, Artificial Sequence
  Synthetic Construct
cctcctgccaccacgtgaa

SEQ ID NO: 14884 - DNA, 22 bp, Artificial Sequence
  Synthetic Construct
gtgagcaagagaccctgactga

SEQ ID NO: 14885 - DNA, 22 bp, Artificial Sequence
  Synthetic Construct
cactgcaccatgctcttcatgt

SEQ ID NO: 14886 - DNA, 19 bp, Artificial Sequence
  Synthetic Construct
gatggccggaagcagaagt

SEQ ID NO: 14887 - DNA, 22 bp, Artificial Sequence
  Synthetic Construct
tcaacctcccgggctaacatga

SEQ ID NO: 14888 - DNA, 26 bp, Artificial Sequence
  Synthetic Construct
catggaatcactcagtgtcatagtca

SEQ ID NO: 14889 - DNA, 21 bp, Artificial Sequence
  Synthetic Construct
tggacacacaggtggaagatg

SEQ ID NO: 14890 - DNA, 22 bp, Artificial Sequence
  Synthetic Construct
actcagtgggttctggatgtga

SEQ ID NO: 14891 - DNA, 21 bp, Artificial Sequence
  Synthetic Construct
ccacctagaacccacgacaaa

SEQ ID NO: 14892 - DNA, 23 bp, Artificial Sequence
  Synthetic Construct
ctcacaaagggctacagggcatt

SEQ ID NO: 14893 - DNA, 24 bp, Artificial Sequence
  Synthetic Construct
ggataggcaactctcagggcaaat

SEQ ID NO: 14894 - DNA, 19 bp, Artificial Sequence
  Synthetic Construct
ctggccgatggggttcatc

SEQ ID NO: 14895 - DNA, 28 bp, Artificial Sequence
  Synthetic Construct
ctgggctcaaacaatacttctaccttag

SEQ ID NO: 14896 - DNA, 25 bp, Artificial Sequence
  Synthetic Construct
gagggactagcacagcaatacaaag

SEQ ID NO: 14897 - DNA, 22 bp, Artificial Sequence
  Synthetic Construct
acacccaacagcccctgataga

SEQ ID NO: 14898 - DNA, 25 bp, Artificial Sequence
  Synthetic Construct
ccctgatcttgcctaacccttcaga

SEQ ID NO: 14899 - DNA, 25 bp, Artificial Sequence
  Synthetic Construct
gccaagatccactgttagaccaaga

SEQ ID NO: 14900 - DNA, 24 bp, Artificial Sequence
  Synthetic Construct
ggaaagctctctgagctgaaaatg

SEQ ID NO: 14901 - DNA, 22 bp, Artificial Sequence
  Synthetic Construct
atgtgatggctttggaccagat

SEQ ID NO: 14902 - DNA, 23 bp, Artificial Sequence
  Synthetic Construct
ggagacagctagggtgtggacat

SEQ ID NO: 14903 - DNA, 26 bp, Artificial Sequence
  Synthetic Construct
gtccacctgacttgcattctttctct

SEQ ID NO: 14904 - DNA, 22 bp, Artificial Sequence
  Synthetic Construct
ccctcccaactctgaagtttgt

SEQ ID NO: 14905 - DNA, 25 bp, Artificial Sequence
  Synthetic Construct
gctgtgtcaaccctcaaagttcaga

SEQ ID NO: 14906 - DNA, 22 bp, Artificial Sequence
  Synthetic Construct
tgactacagctcactgctcttg

SEQ ID NO: 14907 - DNA, 24 bp, Artificial Sequence
  Synthetic Construct
gtcatcggaagttaagccgcatct

SEQ ID NO: 14908 - DNA, 23 bp, Artificial Sequence
  Synthetic Construct
gcaatgtaggagtggatggcttt

SEQ ID NO: 14909 - DNA, 23 bp, Artificial Sequence
  Synthetic Construct
gggtttcaacaactcaagtgcaa

SEQ ID NO: 14910 - DNA, 30 bp, Artificial Sequence
  Synthetic Construct
ctggaaaatcacctaattcaagcccaaatc

SEQ ID NO: 14911 - DNA, 26 bp, Artificial Sequence
  Synthetic Construct
ccaagcatatcatttactccccattc

SEQ ID NO: 14912 - DNA, 22 bp, Artificial Sequence
  Synthetic Construct
ctggcaagggttggagacacat

SEQ ID NO: 14913 - DNA, 22 bp, Artificial Sequence
  Synthetic Construct
tggggacttgtggtgccttttc

SEQ ID NO: 14914 - DNA, 22 bp, Artificial Sequence
  Synthetic Construct
cgggagattaagcgccagttac

SEQ ID NO: 14915 - DNA, 21 bp, Artificial Sequence
  Synthetic Construct
gcatagctggtcacacactct

SEQ ID NO: 14916 - DNA, 20 bp, Artificial Sequence
  Synthetic Construct
ggctccatcctcaggcttca

SEQ ID NO: 14917 - DNA, 24 bp, Artificial Sequence
  Synthetic Construct
cgaggtgagacgctatctatgcaa

SEQ ID NO: 14918 - DNA, 19 bp, Artificial Sequence
  Synthetic Construct
cgctcctgcaggtctctgt

SEQ ID NO: 14919 - DNA, 24 bp, Artificial Sequence
  Synthetic Construct
caggctatgacatcaaggctttct

SEQ ID NO: 14920 - DNA, 22 bp, Artificial Sequence
  Synthetic Construct
gcctcaatgggagcttctcaac

SEQ ID NO: 14921 - DNA, 24 bp, Artificial Sequence
  Synthetic Construct
gaggaccagggagtggaatgaagt

SEQ ID NO: 14922 - DNA, 28 bp, Artificial Sequence
  Synthetic Construct
ctgcctggaatgctctttctctagattt

SEQ ID NO: 14923 - DNA, 23 bp, Artificial Sequence
  Synthetic Construct
cagtgtcaggaaatgtgccttgt

SEQ ID NO: 14924 - DNA, 21 bp, Artificial Sequence
  Synthetic Construct
ggatggctgatgcttccgatt

SEQ ID NO: 14925 - DNA, 22 bp, Artificial Sequence
  Synthetic Construct
cgcgtgccttacattggtgtca

SEQ ID NO: 14926 - DNA, 24 bp, Artificial Sequence
  Synthetic Construct
tcggcttgaccaactacaaattct

SEQ ID NO: 14927 - DNA, 21 bp, Artificial Sequence
  Synthetic Construct
tcgcagtgcctggttctctga

SEQ ID NO: 14928 - DNA, 20 bp, Artificial Sequence
  Synthetic Construct
agttgctctcccagccaaga

SEQ ID NO: 14929 - DNA, 22 bp, Artificial Sequence
  Synthetic Construct
gaggactgacaggttcctgctt

SEQ ID NO: 14930 - DNA, 24 bp, Artificial Sequence
  Synthetic Construct
ccgcagagacaatgtaagatgttc

SEQ ID NO: 14931 - DNA, 20 bp, Artificial Sequence
  Synthetic Construct
agccacactgcctcagcaaa

SEQ ID NO: 14932 - DNA, 22 bp, Artificial Sequence
  Synthetic Construct
cctcaaacctccctgtggctaa

SEQ ID NO: 14933 - DNA, 20 bp, Artificial Sequence
  Synthetic Construct
catgaccctgctcacacctt

SEQ ID NO: 14934 - DNA, 20 bp, Artificial Sequence
  Synthetic Construct
tcccagtgttccctcactca

SEQ ID NO: 14935 - DNA, 22 bp, Artificial Sequence
  Synthetic Construct
ccccaaacccttttctggtgtt

SEQ ID NO: 14936 - DNA, 20 bp, Artificial Sequence
  Synthetic Construct
gcccaaatccagggacaaca

SEQ ID NO: 14937 - DNA, 19 bp, Artificial Sequence
  Synthetic Construct
gccggctggttccatcact

SEQ ID NO: 14938 - DNA, 23 bp, Artificial Sequence
  Synthetic Construct
gagctgggttcaaaccaaaaagt

SEQ ID NO: 14939 - DNA, 26 bp, Artificial Sequence
  Synthetic Construct
gtgcattctccatcatggcattgaaa

SEQ ID NO: 14940 - DNA, 25 bp, Artificial Sequence
  Synthetic Construct
gcttggcctctttctgaacctacta

SEQ ID NO: 14941 - DNA, 21 bp, Artificial Sequence
  Synthetic Construct
gcttcccagcatgaacccttt

SEQ ID NO: 14942 - DNA, 24 bp, Artificial Sequence
  Synthetic Construct
ccttccctgagaatagcacctgtt

SEQ ID NO: 14943 - DNA, 24 bp, Artificial Sequence
  Synthetic Construct
acactcgtaacagcatctttcaga

SEQ ID NO: 14944 - DNA, 22 bp, Artificial Sequence
  Synthetic Construct
tctctggccctcagtcctttgt

SEQ ID NO: 14945 - DNA, 24 bp, Artificial Sequence
  Synthetic Construct
cagccacatgagtcctttccagat

SEQ ID NO: 14946 - DNA, 23 bp, Artificial Sequence
  Synthetic Construct
tcttgccaggtaatagcctcaac

SEQ ID NO: 14947 - DNA, 26 bp, Artificial Sequence
  Synthetic Construct
accagggagactaagaaacacttttg

SEQ ID NO: 14948 - DNA, 24 bp, Artificial Sequence
  Synthetic Construct
catcccttccctacttctccattc

SEQ ID NO: 14949 - DNA, 20 bp, Artificial Sequence
  Synthetic Construct
cccgtccagttggtgctcat

SEQ ID NO: 14950 - DNA, 24 bp, Artificial Sequence
  Synthetic Construct
gcctcaaaaccagggaggatgaca

SEQ ID NO: 14951 - DNA, 25 bp, Artificial Sequence
  Synthetic Construct
ggcaaataaactcacttgcaggtat

SEQ ID NO: 14952 - DNA, 22 bp, Artificial Sequence
  Synthetic Construct
gcaacgggaacttccactcact

SEQ ID NO: 14953 - DNA, 22 bp, Artificial Sequence
  Synthetic Construct
aggaaccagtagggctatcaca

SEQ ID NO: 14954 - DNA, 21 bp, Artificial Sequence
  Synthetic Construct
ggcatgcaaggagagaggaaa

SEQ ID NO: 14955 - DNA, 20 bp, Artificial Sequence
  Synthetic Construct
acccaccctgcctgttatgt

SEQ ID NO: 14956 - DNA, 25 bp, Artificial Sequence
  Synthetic Construct
ccttaacttcctgcagagcttcaat

SEQ ID NO: 14957 - DNA, 23 bp, Artificial Sequence
  Synthetic Construct
gtgggctccaaagttccctttac

SEQ ID NO: 14958 - DNA, 23 bp, Artificial Sequence
  Synthetic Construct
ctcgacatggccctaggtaatga

SEQ ID NO: 14959 - DNA, 25 bp, Artificial Sequence
  Synthetic Construct
gatttctttcctgagtgaggtccaa

SEQ ID NO: 14960 - DNA, 22 bp, Artificial Sequence
  Synthetic Construct
ggggatctttcgccacaaggaa

SEQ ID NO: 14961 - DNA, 22 bp, Artificial Sequence
  Synthetic Construct
ccttcaacgcaaagtgcacaac

SEQ ID NO: 14962 - DNA, 20 bp, Artificial Sequence
  Synthetic Construct
gccgatagtcccagctgttt

SEQ ID NO: 14963 - DNA, 22 bp, Artificial Sequence
  Synthetic Construct
tggtttagcaagcagacagcat

SEQ ID NO: 14964 - DNA, 23 bp, Artificial Sequence
  Synthetic Construct
agcgttggtaagagccattgatt

SEQ ID NO: 14965 - DNA, 19 bp, Artificial Sequence
  Synthetic Construct
aggtgggctggggtcatgt

SEQ ID NO: 14966 - DNA, 20 bp, Artificial Sequence
  Synthetic Construct
tcagcaggcactggcgaatc

SEQ ID NO: 14967 - DNA, 28 bp, Artificial Sequence
  Synthetic Construct
ggttctgaggttctatccaaatgtcttc

SEQ ID NO: 14968 - DNA, 21 bp, Artificial Sequence
  Synthetic Construct
ctcacaggggatggtcgaatg

SEQ ID NO: 14969 - DNA, 22 bp, Artificial Sequence
  Synthetic Construct
tcaggtgtagcgggcagttagt

SEQ ID NO: 14970 - DNA, 21 bp, Artificial Sequence
  Synthetic Construct
cacctttcccaagtggccttt

SEQ ID NO: 14971 - DNA, 22 bp, Artificial Sequence
  Synthetic Construct
ttcccacggagaggagaacaca

SEQ ID NO: 14972 - DNA, 20 bp, Artificial Sequence
  Synthetic Construct
atggctgctgctgccctaga

SEQ ID NO: 14973 - DNA, 25 bp, Artificial Sequence
  Synthetic Construct
ctgtcggaaaacaaagagcatctga

SEQ ID NO: 14974 - DNA, 25 bp, Artificial Sequence
  Synthetic Construct
tctcaaagacgaccaagtgattctt

SEQ ID NO: 14975 - DNA, 22 bp, Artificial Sequence
  Synthetic Construct
cctcctgaattctgaggccttt

SEQ ID NO: 14976 - DNA, 21 bp, Artificial Sequence
  Synthetic Construct
ggaacaatgcccagccacact

SEQ ID NO: 14977 - DNA, 21 bp, Artificial Sequence
  Synthetic Construct
aggcttggttcagtggctcta

SEQ ID NO: 14978 - DNA, 19 bp, Artificial Sequence
  Synthetic Construct
actccgctgctgaggacta

SEQ ID NO: 14979 - DNA, 23 bp, Artificial Sequence
  Synthetic Construct
gaactgaagatgcacccacacta

SEQ ID NO: 14980 - DNA, 22 bp, Artificial Sequence
  Synthetic Construct
ggaccacatgcctggttagtca

SEQ ID NO: 14981 - DNA, 22 bp, Artificial Sequence
  Synthetic Construct
gccaccagagcttgacactgtt

SEQ ID NO: 14982 - DNA, 23 bp, Artificial Sequence
  Synthetic Construct
gagaagtaggggcatgtgtgtga

SEQ ID NO: 14983 - DNA, 23 bp, Artificial Sequence
  Synthetic Construct
gaccagagcagatttggatgaga

SEQ ID NO: 14984 - DNA, 24 bp, Artificial Sequence
  Synthetic Construct
ggaaaagctacagcctaccccaaa

SEQ ID NO: 14985 - DNA, 24 bp, Artificial Sequence
  Synthetic Construct
tgaacaccaacagtaagaggacaa

SEQ ID NO: 14986 - DNA, 21 bp, Artificial Sequence
  Synthetic Construct
acggattacctgtgtgccatt

SEQ ID NO: 14987 - DNA, 19 bp, Artificial Sequence
  Synthetic Construct
agggtgggcgaccagtttg

SEQ ID NO: 14988 - DNA, 23 bp, Artificial Sequence
  Synthetic Construct
ggacttcagggagcttctactca

SEQ ID NO: 14989 - DNA, 26 bp, Artificial Sequence
  Synthetic Construct
cttccaacacagggaatcaaagttca

SEQ ID NO: 14990 - DNA, 24 bp, Artificial Sequence
  Synthetic Construct
caccacgctagttggtgatagaac

SEQ ID NO: 14991 - DNA, 20 bp, Artificial Sequence
  Synthetic Construct
gccttgctgtcctccaaact

SEQ ID NO: 14992 - DNA, 22 bp, Artificial Sequence
  Synthetic Construct
gatgccactgtcattccagaca

SEQ ID NO: 14993 - DNA, 22 bp, Artificial Sequence
  Synthetic Construct
aacgtctcgccactccctgtct

SEQ ID NO: 14994 - DNA, 21 bp, Artificial Sequence
  Synthetic Construct
gtggtgctggatgggaaggaa

SEQ ID NO: 14995 - DNA, 22 bp, Artificial Sequence
  Synthetic Construct
caagacacccatgccctcactt

SEQ ID NO: 14996 - DNA, 23 bp, Artificial Sequence
  Synthetic Construct
gcttcagcaagtcatcctgatct

SEQ ID NO: 14997 - DNA, 20 bp, Artificial Sequence
  Synthetic Construct
cctcgaggaacttcgccttt

SEQ ID NO: 14998 - DNA, 23 bp, Artificial Sequence
  Synthetic Construct
tcaacctctcaggctctagtgat

SEQ ID NO: 14999 - DNA, 20 bp, Artificial Sequence
  Synthetic Construct
tccgctgcactcaaaacgaa

SEQ ID NO: 15000 - DNA, 25 bp, Artificial Sequence
  Synthetic Construct
ccactcacagaagtgccactgtttc

SEQ ID NO: 15001 - DNA, 23 bp, Artificial Sequence
  Synthetic Construct
gcacccaaaatggacatccaaca

SEQ ID NO: 15002 - DNA, 19 bp, Artificial Sequence
  Synthetic Construct
ggccagctcttcactgcat

SEQ ID NO: 15003 - DNA, 25 bp, Artificial Sequence
  Synthetic Construct
gcactaacacgtagcctgagtaatg

SEQ ID NO: 15004 - DNA, 20 bp, Artificial Sequence
  Synthetic Construct
tggtgtggttgcgggagaag

SEQ ID NO: 15005 - DNA, 21 bp, Artificial Sequence
  Synthetic Construct
ccatcgtgctaggcaggtagt

SEQ ID NO: 15006 - DNA, 26 bp, Artificial Sequence
  Synthetic Construct
cctctttaccttccagctccttgcat

SEQ ID NO: 15007 - DNA, 22 bp, Artificial Sequence
  Synthetic Construct
ggtggcgaagaccacagtaaag

SEQ ID NO: 15008 - DNA, 20 bp, Artificial Sequence
  Synthetic Construct
ggaacttcgcactggagcaa

SEQ ID NO: 15009 - DNA, 22 bp, Artificial Sequence
  Synthetic Construct
tccctgcaggtgaaatcttgtt

SEQ ID NO: 15010 - DNA, 23 bp, Artificial Sequence
  Synthetic Construct
gggacatttgaccagagacagaa

SEQ ID NO: 15011 - DNA, 23 bp, Artificial Sequence
  Synthetic Construct
tctccacctacccctttctgtag

SEQ ID NO: 15012 - DNA, 20 bp, Artificial Sequence
  Synthetic Construct
tctggcagggctggagtaga

SEQ ID NO: 15013 - DNA, 20 bp, Artificial Sequence
  Synthetic Construct
cccagcagcaatgtggaaca

SEQ ID NO: 15014 - DNA, 21 bp, Artificial Sequence
  Synthetic Construct
tctttccgctctcccttctct

SEQ ID NO: 15015 - DNA, 22 bp, Artificial Sequence
  Synthetic Construct
ccaagacacggaaactcctcat

SEQ ID NO: 15016 - DNA, 23 bp, Artificial Sequence
  Synthetic Construct
ggatcacttgaccacaggaggtt

SEQ ID NO: 15017 - DNA, 25 bp, Artificial Sequence
  Synthetic Construct
gatctagctcctgcctacttcatgt

SEQ ID NO: 15018 - DNA, 26 bp, Artificial Sequence
  Synthetic Construct
ctgtgtcctactgaacgttgtactga

SEQ ID NO: 15019 - DNA, 21 bp, Artificial Sequence
  Synthetic Construct
gcatcactgccttccaactca

SEQ ID NO: 15020 - DNA, 21 bp, Artificial Sequence
  Synthetic Construct
ggaaaaacaacccggggaaca

SEQ ID NO: 15021 - DNA, 23 bp, Artificial Sequence
  Synthetic Construct
ttcctggtatgaccctgaacttg

SEQ ID NO: 15022 - DNA, 21 bp, Artificial Sequence
  Synthetic Construct
cctgggacatagggagcacat

SEQ ID NO: 15023 - DNA, 30 bp, Artificial Sequence
  Synthetic Construct
cggttgagaggttatatcttaggcctgtta

SEQ ID NO: 15024 - DNA, 20 bp, Artificial Sequence
  Synthetic Construct
tgtggctgggatggagatca

SEQ ID NO: 15025 - DNA, 22 bp, Artificial Sequence
  Synthetic Construct
tcagccacacattaacccaact

SEQ ID NO: 15026 - DNA, 21 bp, Artificial Sequence
  Synthetic Construct
taaggcggtacaggggtgact

SEQ ID NO: 15027 - DNA, 23 bp, Artificial Sequence
  Synthetic Construct
gcagtttagcctctgggttgaag

SEQ ID NO: 15028 - DNA, 22 bp, Artificial Sequence
  Synthetic Construct
gaatacgccaggtcttgtcagt

SEQ ID NO: 15029 - DNA, 22 bp, Artificial Sequence
  Synthetic Construct
cccatgaaggttcttggctttg

SEQ ID NO: 15030 - DNA, 22 bp, Artificial Sequence
  Synthetic Construct
cacccttggatgctggtagtgt

SEQ ID NO: 15031 - DNA, 26 bp, Artificial Sequence
  Synthetic Construct
ggttgggattgttttgtgggctattt

SEQ ID NO: 15032 - DNA, 22 bp, Artificial Sequence
  Synthetic Construct
gcagacctgtgtttgagaccta

SEQ ID NO: 15033 - DNA, 22 bp, Artificial Sequence
  Synthetic Construct
tcttggtgaggtcctgcaattt

SEQ ID NO: 15034 - DNA, 24 bp, Artificial Sequence
  Synthetic Construct
ggaagcatctgcatcctagtagtt

SEQ ID NO: 15035 - DNA, 23 bp, Artificial Sequence
  Synthetic Construct
cgatacagctgttgtctccagaa

SEQ ID NO: 15036 - DNA, 20 bp, Artificial Sequence
  Synthetic Construct
gcctccactttgtgcagtgt

SEQ ID NO: 15037 - DNA, 20 bp, Artificial Sequence
  Synthetic Construct
tggaggtgagggcaagttca

SEQ ID NO: 15038 - DNA, 21 bp, Artificial Sequence
  Synthetic Construct
tggaaaggctggctgtctatg

SEQ ID NO: 15039 - DNA, 22 bp, Artificial Sequence
  Synthetic Construct
cagtccatcttctgtgctgcta

SEQ ID NO: 15040 - DNA, 24 bp, Artificial Sequence
  Synthetic Construct
cccctcccctataaaccttaggaa

SEQ ID NO: 15041 - DNA, 22 bp, Artificial Sequence
  Synthetic Construct
ctgctccaggaagctgctgaat

SEQ ID NO: 15042 - DNA, 20 bp, Artificial Sequence
  Synthetic Construct
ccttgcgtgctggctgtaga

SEQ ID NO: 15043 - DNA, 24 bp, Artificial Sequence
  Synthetic Construct
ctcagggactagaagcaccaggta

SEQ ID NO: 15044 - DNA, 24 bp, Artificial Sequence
  Synthetic Construct
gcagggtcttctttttccctcaca

SEQ ID NO: 15045 - DNA, 21 bp, Artificial Sequence
  Synthetic Construct
gaggtgcagatccacactgtt

SEQ ID NO: 15046 - DNA, 21 bp, Artificial Sequence
  Synthetic Construct
gccatcctttgctgtcagtgt

SEQ ID NO: 15047 - DNA, 23 bp, Artificial Sequence
  Synthetic Construct
gccatttaccacccaaactggat

SEQ ID NO: 15048 - DNA, 22 bp, Artificial Sequence
  Synthetic Construct
caggaaccacagagccccaaat

SEQ ID NO: 15049 - DNA, 27 bp, Artificial Sequence
  Synthetic Construct
ctgttgtgacctgattctcatgtattc

SEQ ID NO: 15050 - DNA, 23 bp, Artificial Sequence
  Synthetic Construct
gcaaggagtaccagctcaaggta

SEQ ID NO: 15051 - DNA, 26 bp, Artificial Sequence
  Synthetic Construct
gtctccatcaacctcacttgttttac

SEQ ID NO: 15052 - DNA, 26 bp, Artificial Sequence
  Synthetic Construct
ggtagcctctttcactcattgtggta

SEQ ID NO: 15053 - DNA, 22 bp, Artificial Sequence
  Synthetic Construct
gtgttttgctgttctccagcat

SEQ ID NO: 15054 - DNA, 23 bp, Artificial Sequence
  Synthetic Construct
gtgggagaaaagtagcagtggat

SEQ ID NO: 15055 - DNA, 25 bp, Artificial Sequence
  Synthetic Construct
cagagcaggtttgatgatcccgttt

SEQ ID NO: 15056 - DNA, 19 bp, Artificial Sequence
  Synthetic Construct
tggaagacgcctcctcact

SEQ ID NO: 15057 - DNA, 20 bp, Artificial Sequence
  Synthetic Construct
tggctgccttctcccttcat

SEQ ID NO: 15058 - DNA, 20 bp, Artificial Sequence
  Synthetic Construct
tgtactgaccgaggctgtga

SEQ ID NO: 15059 - DNA, 22 bp, Artificial Sequence
  Synthetic Construct
tgcttgcattgccagaactact

SEQ ID NO: 15060 - DNA, 21 bp, Artificial Sequence
  Synthetic Construct
tggccaagtggtcctgcttct

SEQ ID NO: 15061 - DNA, 19 bp, Artificial Sequence
  Synthetic Construct
acctgcctaaggccacact

SEQ ID NO: 15062 - DNA, 20 bp, Artificial Sequence
  Synthetic Construct
gcagcctttggcctcttcta

SEQ ID NO: 15063 - DNA, 20 bp, Artificial Sequence
  Synthetic Construct
cggcaagcctttagcccaat

SEQ ID NO: 15064 - DNA, 21 bp, Artificial Sequence
  Synthetic Construct
ggctctcgtgcccatttcttc

SEQ ID NO: 15065 - DNA, 28 bp, Artificial Sequence
  Synthetic Construct
gcagactcaaggtcacactatttctctt

SEQ ID NO: 15066 - DNA, 22 bp, Artificial Sequence
  Synthetic Construct
atccgggacccaggtgaaaaag

SEQ ID NO: 15067 - DNA, 22 bp, Artificial Sequence
  Synthetic Construct
tcacatgcccattgtgggttag

SEQ ID NO: 15068 - DNA, 23 bp, Artificial Sequence
  Synthetic Construct
cctccagccaccaaattgttgtt

SEQ ID NO: 15069 - DNA, 22 bp, Artificial Sequence
  Synthetic Construct
ggacagacaggcagggagaaaa

SEQ ID NO: 15070 - DNA, 24 bp, Artificial Sequence
  Synthetic Construct
cacacatcccttcctcaaggacat

SEQ ID NO: 15071 - DNA, 24 bp, Artificial Sequence
  Synthetic Construct
cacagacagtgtggaaggcatcta

SEQ ID NO: 15072 - DNA, 19 bp, Artificial Sequence
  Synthetic Construct
cgagctcgggatggggttt

SEQ ID NO: 15073 - DNA, 24 bp, Artificial Sequence
  Synthetic Construct
gctgatgcttagtgtttggacaac

SEQ ID NO: 15074 - DNA, 20 bp, Artificial Sequence
  Synthetic Construct
gccctctgcaaaaccagtga

SEQ ID NO: 15075 - DNA, 25 bp, Artificial Sequence
  Synthetic Construct
aggttcctgtgtatcagaattgctt

SEQ ID NO: 15076 - DNA, 20 bp, Artificial Sequence
  Synthetic Construct
aagcccaccctttcccaact

SEQ ID NO: 15077 - DNA, 25 bp, Artificial Sequence
  Synthetic Construct
ggttgtctggagtcagtatgagaca

SEQ ID NO: 15078 - DNA, 22 bp, Artificial Sequence
  Synthetic Construct
gggatagtcattgtgccctgtt

SEQ ID NO: 15079 - DNA, 22 bp, Artificial Sequence
  Synthetic Construct
caccaaatggctcatccacaga

SEQ ID NO: 15080 - DNA, 24 bp, Artificial Sequence
  Synthetic Construct
cagtaggagggcaaagtcacagaa

SEQ ID NO: 15081 - DNA, 25 bp, Artificial Sequence
  Synthetic Construct
ggagaggcaagagtcaaagctcaaa

SEQ ID NO: 15082 - DNA, 22 bp, Artificial Sequence
  Synthetic Construct
ccttcacgttgcatcgggtatt

SEQ ID NO: 15083 - DNA, 22 bp, Artificial Sequence
  Synthetic Construct
tcagaaggtctctgtgccatga

SEQ ID NO: 15084 - DNA, 21 bp, Artificial Sequence
  Synthetic Construct
accagccagtcccaggttttc

SEQ ID NO: 15085 - DNA, 24 bp, Artificial Sequence
  Synthetic Construct
cctgggtagtgcctttgcccatta

SEQ ID NO: 15086 - DNA, 21 bp, Artificial Sequence
  Synthetic Construct
aaggccccaccatccttcagt

SEQ ID NO: 15087 - DNA, 21 bp, Artificial Sequence
  Synthetic Construct
ggctcatctcagcccatgttc

SEQ ID NO: 15088 - DNA, 22 bp, Artificial Sequence
  Synthetic Construct
ttcacagaccagcctccaggaa

SEQ ID NO: 15089 - DNA, 25 bp, Artificial Sequence
  Synthetic Construct
gcattctccagggcatttgacttag

SEQ ID NO: 15090 - DNA, 23 bp, Artificial Sequence
  Synthetic Construct
ccaccttgtctaccacagagttc

SEQ ID NO: 15091 - DNA, 27 bp, Artificial Sequence
  Synthetic Construct
cacagtcttactagggttcaacaggat

SEQ ID NO: 15092 - DNA, 22 bp, Artificial Sequence
  Synthetic Construct
cgcacttcctcccttttaggtt

SEQ ID NO: 15093 - DNA, 23 bp, Artificial Sequence
  Synthetic Construct
gcctcatatccagagaccagaga

SEQ ID NO: 15094 - DNA, 20 bp, Artificial Sequence
  Synthetic Construct
aggcaaaggagcctccaaca

SEQ ID NO: 15095 - DNA, 22 bp, Artificial Sequence
  Synthetic Construct
gggtgacaacgtgtgctggaat

SEQ ID NO: 15096 - DNA, 22 bp, Artificial Sequence
  Synthetic Construct
gcacatagccctcaaggtcaca

SEQ ID NO: 15097 - DNA, 24 bp, Artificial Sequence
  Synthetic Construct
gaactttttggcctctgactgtct

SEQ ID NO: 15098 - DNA, 20 bp, Artificial Sequence
  Synthetic Construct
tgctggttcacggtgtccaa

SEQ ID NO: 15099 - DNA, 24 bp, Artificial Sequence
  Synthetic Construct
ccagccggtctgtacataggatct

SEQ ID NO: 15100 - DNA, 23 bp, Artificial Sequence
  Synthetic Construct
agcagggagagagactgattcat

SEQ ID NO: 15101 - DNA, 23 bp, Artificial Sequence
  Synthetic Construct
ccccaagtggtcctactgaaatc

SEQ ID NO: 15102 - DNA, 20 bp, Artificial Sequence
  Synthetic Construct
gtggtgaggggaccatggaa

SEQ ID NO: 15103 - DNA, 23 bp, Artificial Sequence
  Synthetic Construct
gctcattccttcagctggtgtgt

SEQ ID NO: 15104 - DNA, 25 bp, Artificial Sequence
  Synthetic Construct
ggcaaggaatctgaaaacaggacta

SEQ ID NO: 15105 - DNA, 20 bp, Artificial Sequence
  Synthetic Construct
aggtcgtcggctttgactgt

SEQ ID NO: 15106 - DNA, 19 bp, Artificial Sequence
  Synthetic Construct
gcctgccgtgggtcattgt

SEQ ID NO: 15107 - DNA, 22 bp, Artificial Sequence
  Synthetic Construct
tggggtttcgggatggtcaaac

SEQ ID NO: 15108 - DNA, 22 bp, Artificial Sequence
  Synthetic Construct
cagggtttggctcttgccttca

SEQ ID NO: 15109 - DNA, 23 bp, Artificial Sequence
  Synthetic Construct
tggatgtgcgataagtccatgtt

SEQ ID NO: 15110 - DNA, 24 bp, Artificial Sequence
  Synthetic Construct
gcgtccaaatgaccttgaatttgt

SEQ ID NO: 15111 - DNA, 23 bp, Artificial Sequence
  Synthetic Construct
gccaatgtggcagcataccatct

SEQ ID NO: 15112 - DNA, 20 bp, Artificial Sequence
  Synthetic Construct
ggtgcaaactgcggcaaatc

SEQ ID NO: 15113 - DNA, 22 bp, Artificial Sequence
  Synthetic Construct
ggaaatggtccctgtcgtgcat

SEQ ID NO: 15114 - DNA, 22 bp, Artificial Sequence
  Synthetic Construct
acacagtccagtggctccatgt

SEQ ID NO: 15115 - DNA, 20 bp, Artificial Sequence
  Synthetic Construct
aggcccaagggctgctaaac

SEQ ID NO: 15116 - DNA, 24 bp, Artificial Sequence
  Synthetic Construct
ggatggagacttggctggttctca

SEQ ID NO: 15117 - DNA, 23 bp, Artificial Sequence
  Synthetic Construct
cccacatccaggacctaccatct

SEQ ID NO: 15118 - DNA, 21 bp, Artificial Sequence
  Synthetic Construct
ggagttcgcgtggactcacaa

SEQ ID NO: 15119 - DNA, 24 bp, Artificial Sequence
  Synthetic Construct
ctgtggtagcaatgggaagactga

SEQ ID NO: 15120 - DNA, 22 bp, Artificial Sequence
  Synthetic Construct
cttgcattcctgggcctcagtt

SEQ ID NO: 15121 - DNA, 20 bp, Artificial Sequence
  Synthetic Construct
acactcaggcacccaacagt

SEQ ID NO: 15122 - DNA, 22 bp, Artificial Sequence
  Synthetic Construct
gtactcccgtggccttcagaac

SEQ ID NO: 15123 - DNA, 20 bp, Artificial Sequence
  Synthetic Construct
actggcccagcaggcacatc

SEQ ID NO: 15124 - DNA, 20 bp, Artificial Sequence
  Synthetic Construct
gtgcgctttgcagggatttg

SEQ ID NO: 15125 - DNA, 21 bp, Artificial Sequence
  Synthetic Construct
tgagctggtgccagaggtttg

SEQ ID NO: 15126 - DNA, 19 bp, Artificial Sequence
  Synthetic Construct
tggggcccacagccttgaa

SEQ ID NO: 15127 - DNA, 21 bp, Artificial Sequence
  Synthetic Construct
gggaagtgactggcccaatgt

SEQ ID NO: 15128 - DNA, 22 bp, Artificial Sequence
  Synthetic Construct
tcaagggaggctgggagacaaa

SEQ ID NO: 15129 - DNA, 21 bp, Artificial Sequence
  Synthetic Construct
tacctgcacagctccggacaa

SEQ ID NO: 15130 - DNA, 21 bp, Artificial Sequence
  Synthetic Construct
gcagggactgtgggaagtttg

SEQ ID NO: 15131 - DNA, 20 bp, Artificial Sequence
  Synthetic Construct
gtcaggtgaaaggcgggatt

SEQ ID NO: 15132 - DNA, 22 bp, Artificial Sequence
  Synthetic Construct
ccacacagaccctgaagacaca

SEQ ID NO: 15133 - DNA, 25 bp, Artificial Sequence
  Synthetic Construct
gggtgctctttctggactgagtttc

SEQ ID NO: 15134 - DNA, 25 bp, Artificial Sequence
  Synthetic Construct
gctggatggagagagatgagagtaa

SEQ ID NO: 15135 - DNA, 24 bp, Artificial Sequence
  Synthetic Construct
aacataatccgcttgcctagaact

SEQ ID NO: 15136 - DNA, 20 bp, Artificial Sequence
  Synthetic Construct
ctggtcactggcacacttct

SEQ ID NO: 15137 - DNA, 26 bp, Artificial Sequence
  Synthetic Construct
cactgtcacagagagttgggtcatac

SEQ ID NO: 15138 - DNA, 22 bp, Artificial Sequence
  Synthetic Construct
ggctttccaggttcccaagaca

SEQ ID NO: 15139 - DNA, 21 bp, Artificial Sequence
  Synthetic Construct
gctgaggtgcttcttctccat

SEQ ID NO: 15140 - DNA, 22 bp, Artificial Sequence
  Synthetic Construct
gagggaagcaaagagcccttga

SEQ ID NO: 15141 - DNA, 18 bp, Artificial Sequence
  Synthetic Construct
aagccctgccccttcaga

SEQ ID NO: 15142 - DNA, 24 bp, Artificial Sequence
  Synthetic Construct
gttccaggagaccataccttcctt

SEQ ID NO: 15143 - DNA, 21 bp, Artificial Sequence
  Synthetic Construct
ggcctgctgagtagctgcaat

SEQ ID NO: 15144 - DNA, 20 bp, Artificial Sequence
  Synthetic Construct
tggctcacactggacctgat

SEQ ID NO: 15145 - DNA, 20 bp, Artificial Sequence
  Synthetic Construct
caggctgcaagttggcttca

SEQ ID NO: 15146 - DNA, 20 bp, Artificial Sequence
  Synthetic Construct
tcgagttgggagggtgagtt

SEQ ID NO: 15147 - DNA, 21 bp, Artificial Sequence
  Synthetic Construct
ctgcaagctcaccgcattttc

SEQ ID NO: 15148 - DNA, 20 bp, Artificial Sequence
  Synthetic Construct
atggccacaccctggcattt

SEQ ID NO: 15149 - DNA, 22 bp, Artificial Sequence
  Synthetic Construct
gtgaggaaagcaggcactcact

SEQ ID NO: 15150 - DNA, 23 bp, Artificial Sequence
  Synthetic Construct
gcttagtggcctcattgctgtat

SEQ ID NO: 15151 - DNA, 22 bp, Artificial Sequence
  Synthetic Construct
gtctgtgatccctcgcgtttca

SEQ ID NO: 15152 - DNA, 22 bp, Artificial Sequence
  Synthetic Construct
ccacctcgaaagagggtacaga

SEQ ID NO: 15153 - DNA, 20 bp, Artificial Sequence
  Synthetic Construct
agagcaaaggctctggcatt

SEQ ID NO: 15154 - DNA, 24 bp, Artificial Sequence
  Synthetic Construct
gattggagggactgagaccagaga

SEQ ID NO: 15155 - DNA, 20 bp, Artificial Sequence
  Synthetic Construct
tggatgggacacgaccttga

SEQ ID NO: 15156 - DNA, 25 bp, Artificial Sequence
  Synthetic Construct
agtctgacattagacaggggataca

SEQ ID NO: 15157 - DNA, 22 bp, Artificial Sequence
  Synthetic Construct
ccagggaccagtaggaagcaat

SEQ ID NO: 15158 - DNA, 22 bp, Artificial Sequence
  Synthetic Construct
gaaagcaaccacgttgtgttca

SEQ ID NO: 15159 - DNA, 22 bp, Artificial Sequence
  Synthetic Construct
caaatggctctgcccagctcta

SEQ ID NO: 15160 - DNA, 24 bp, Artificial Sequence
  Synthetic Construct
cacgtcagcatagcgcttttaact

SEQ ID NO: 15161 - DNA, 22 bp, Artificial Sequence
  Synthetic Construct
ggcaatgtggccatcaggtttg

SEQ ID NO: 15162 - DNA, 22 bp, Artificial Sequence
  Synthetic Construct
gttagaaggggaaggggtccaa

SEQ ID NO: 15163 - DNA, 25 bp, Artificial Sequence
  Synthetic Construct
cacatggaggcatagttaccaggaa

SEQ ID NO: 15164 - DNA, 21 bp, Artificial Sequence
  Synthetic Construct
cgccctagcttcacagagctt

SEQ ID NO: 15165 - DNA, 22 bp, Artificial Sequence
  Synthetic Construct
tggactgtcccagaccttgaat

SEQ ID NO: 15166 - DNA, 25 bp, Artificial Sequence
  Synthetic Construct
caagtctgtgaactactggttcgtt

SEQ ID NO: 15167 - DNA, 24 bp, Artificial Sequence
  Synthetic Construct
caatagcaccgataaggcaaccta

SEQ ID NO: 15168 - DNA, 23 bp, Artificial Sequence
  Synthetic Construct
cccaatttggtctctccaacagt

SEQ ID NO: 15169 - DNA, 22 bp, Artificial Sequence
  Synthetic Construct
cctcgtctctctctgacaggta

SEQ ID NO: 15170 - DNA, 22 bp, Artificial Sequence
  Synthetic Construct
agagactgaggcagggccataa

SEQ ID NO: 15171 - DNA, 30 bp, Artificial Sequence
  Synthetic Construct
ggtccggatagtaaatagagatgagtaaca

SEQ ID NO: 15172 - DNA, 23 bp, Artificial Sequence
  Synthetic Construct
gcacaactgtttgcactatcctt

SEQ ID NO: 15173 - DNA, 24 bp, Artificial Sequence
  Synthetic Construct
gcttactaaagagcccttgggaat

SEQ ID NO: 15174 - DNA, 22 bp, Artificial Sequence
  Synthetic Construct
tgaggccagcacctctcgtaat

SEQ ID NO: 15175 - DNA, 24 bp, Artificial Sequence
  Synthetic Construct
gggtgatccgggagtgctaataac

SEQ ID NO: 15176 - DNA, 23 bp, Artificial Sequence
  Synthetic Construct
gggtgagggacaaggacagaaga

SEQ ID NO: 15177 - DNA, 23 bp, Artificial Sequence
  Synthetic Construct
gtccctaaagctttccgccaaca

SEQ ID NO: 15178 - DNA, 20 bp, Artificial Sequence
  Synthetic Construct
ggggtggggagaggcaagta

SEQ ID NO: 15179 - DNA, 24 bp, Artificial Sequence
  Synthetic Construct
gcagagcccagaatcattcgtcta

SEQ ID NO: 15180 - DNA, 26 bp, Artificial Sequence
  Synthetic Construct
caggtgacgttttcagtttggagaca

SEQ ID NO: 15181 - DNA, 22 bp, Artificial Sequence
  Synthetic Construct
ccatgcccacctctaagagaca

SEQ ID NO: 15182 - DNA, 21 bp, Artificial Sequence
  Synthetic Construct
gtacacagggcaccaggtcat

SEQ ID NO: 15183 - DNA, 25 bp, Artificial Sequence
  Synthetic Construct
gtgtgcaaaaggagggtgaaagtga

SEQ ID NO: 15184 - DNA, 22 bp, Artificial Sequence
  Synthetic Construct
gctgatctcagtggctcaaact

SEQ ID NO: 15185 - DNA, 26 bp, Artificial Sequence
  Synthetic Construct
ggtgggcaagtaatttacaggggaaa

SEQ ID NO: 15186 - DNA, 24 bp, Artificial Sequence
  Synthetic Construct
cagagctcagtgctagacatggat

SEQ ID NO: 15187 - DNA, 22 bp, Artificial Sequence
  Synthetic Construct
ttgggacatgggacagctccta

SEQ ID NO: 15188 - DNA, 23 bp, Artificial Sequence
  Synthetic Construct
ctgcaccagttcaaggcaagtct

SEQ ID NO: 15189 - DNA, 27 bp, Artificial Sequence
  Synthetic Construct
gccccatagatccaaagcatagtgtaa

SEQ ID NO: 15190 - DNA, 24 bp, Artificial Sequence
  Synthetic Construct
ggttgggttgagaagtgcctcaga

SEQ ID NO: 15191 - DNA, 23 bp, Artificial Sequence
  Synthetic Construct
ccccgaaggatctcgttaaaaca

SEQ ID NO: 15192 - DNA, 22 bp, Artificial Sequence
  Synthetic Construct
ccaactggcattcctgcctcta

SEQ ID NO: 15193 - DNA, 26 bp, Artificial Sequence
  Synthetic Construct
ggcgatcatctttaactactccttct

SEQ ID NO: 15194 - DNA, 21 bp, Artificial Sequence
  Synthetic Construct
cagaatgggtggggcaagaca

SEQ ID NO: 15195 - DNA, 20 bp, Artificial Sequence
  Synthetic Construct
agggagcctcaagtgcatca

SEQ ID NO: 15196 - DNA, 25 bp, Artificial Sequence
  Synthetic Construct
aagctctttccacttcaggatcttt

SEQ ID NO: 15197 - DNA, 22 bp, Artificial Sequence
  Synthetic Construct
tccccagaagtggtaacaggta

SEQ ID NO: 15198 - DNA, 20 bp, Artificial Sequence
  Synthetic Construct
agctagcagggctgatgcaa

SEQ ID NO: 15199 - DNA, 25 bp, Artificial Sequence
  Synthetic Construct
gtctcaccttttccacccttgaatg

SEQ ID NO: 15200 - DNA, 20 bp, Artificial Sequence
  Synthetic Construct
cagaccacagagcccgaagt

SEQ ID NO: 15201 - DNA, 24 bp, Artificial Sequence
  Synthetic Construct
tgcagtagttgaggtgaatggttt

SEQ ID NO: 15202 - DNA, 23 bp, Artificial Sequence
  Synthetic Construct
gaggaaaagcagccagacataca

SEQ ID NO: 15203 - DNA, 22 bp, Artificial Sequence
  Synthetic Construct
gtggaagatggactggccttgt

SEQ ID NO: 15204 - DNA, 24 bp, Artificial Sequence
  Synthetic Construct
gaacccaatctgtctaccttgtca

SEQ ID NO: 15205 - DNA, 20 bp, Artificial Sequence
  Synthetic Construct
acaaggcgcccaagtgatct

SEQ ID NO: 15206 - DNA, 23 bp, Artificial Sequence
  Synthetic Construct
cgttcagttgccatctgctgttc

SEQ ID NO: 15207 - DNA, 21 bp, Artificial Sequence
  Synthetic Construct
caccgagccatccctgagttc

SEQ ID NO: 15208 - DNA, 22 bp, Artificial Sequence
  Synthetic Construct
gggtgcccactcagggttattc

SEQ ID NO: 15209 - DNA, 20 bp, Artificial Sequence
  Synthetic Construct
atgtggcccagaacccacaa

SEQ ID NO: 15210 - DNA, 25 bp, Artificial Sequence
  Synthetic Construct
cgatcccactttgaggtgaacttga

SEQ ID NO: 15211 - DNA, 24 bp, Artificial Sequence
  Synthetic Construct
cctggttgtctctgtcccaagtca

SEQ ID NO: 15212 - DNA, 20 bp, Artificial Sequence
  Synthetic Construct
cccttgcagggatccagatg

SEQ ID NO: 15213 - DNA, 23 bp, Artificial Sequence
  Synthetic Construct
ggctacctccaaccatcatcttg

SEQ ID NO: 15214 - DNA, 22 bp, Artificial Sequence
  Synthetic Construct
acataggtggtagccaggaagt

SEQ ID NO: 15215 - DNA, 23 bp, Artificial Sequence
  Synthetic Construct
aaagaagtctgaccatgccttga

SEQ ID NO: 15216 - DNA, 20 bp, Artificial Sequence
  Synthetic Construct
cccaggccagcttgttctct

SEQ ID NO: 15217 - DNA, 24 bp, Artificial Sequence
  Synthetic Construct
gtgtaagggtgagtctttcagcaa

SEQ ID NO: 15218 - DNA, 21 bp, Artificial Sequence
  Synthetic Construct
ccaaaacaggcagccacaaga

SEQ ID NO: 15219 - DNA, 22 bp, Artificial Sequence
  Synthetic Construct
ccctttcatctccccagccatt

SEQ ID NO: 15220 - DNA, 22 bp, Artificial Sequence
  Synthetic Construct
attccttccctcctggggtcta

SEQ ID NO: 15221 - DNA, 25 bp, Artificial Sequence
  Synthetic Construct
gagcccaagtttcttcacttggaaa

SEQ ID NO: 15222 - DNA, 22 bp, Artificial Sequence
  Synthetic Construct
gggccatcagtgagctttcttc

SEQ ID NO: 15223 - DNA, 24 bp, Artificial Sequence
  Synthetic Construct
ggatctccactgttgcctagaatg

SEQ ID NO: 15224 - DNA, 21 bp, Artificial Sequence
  Synthetic Construct
ggtggttctgtgggtttctgt

SEQ ID NO: 15225 - DNA, 24 bp, Artificial Sequence
  Synthetic Construct
ggggtactttcagctctctctagt

SEQ ID NO: 15226 - DNA, 19 bp, Artificial Sequence
  Synthetic Construct
agcagcagcggaagcacat

SEQ ID NO: 15227 - DNA, 21 bp, Artificial Sequence
  Synthetic Construct
aggaacacagaggaggagcaa

SEQ ID NO: 15228 - DNA, 23 bp, Artificial Sequence
  Synthetic Construct
gtaaccactccctggctacttct

SEQ ID NO: 15229 - DNA, 26 bp, Artificial Sequence
  Synthetic Construct
ggactgcagaaaatgttacaggtctt

SEQ ID NO: 15230 - DNA, 25 bp, Artificial Sequence
  Synthetic Construct
cttctcattggaatcttggctcctt

SEQ ID NO: 15231 - DNA, 22 bp, Artificial Sequence
  Synthetic Construct
aggcatcctggaagcaatcaag

SEQ ID NO: 15232 - DNA, 24 bp, Artificial Sequence
  Synthetic Construct
ggccagtgtgtcaaaagaagacta

SEQ ID NO: 15233 - DNA, 24 bp, Artificial Sequence
  Synthetic Construct
gcctacgaggtacagctcaggata

SEQ ID NO: 15234 - DNA, 24 bp, Artificial Sequence
  Synthetic Construct
ctcttcaagttggaagggatgaga

SEQ ID NO: 15235 - DNA, 23 bp, Artificial Sequence
  Synthetic Construct
gctacagtggcagagtcgagtag

SEQ ID NO: 15236 - DNA, 23 bp, Artificial Sequence
  Synthetic Construct
gaggaaagcagagcgaagagtga

SEQ ID NO: 15237 - DNA, 21 bp, Artificial Sequence
  Synthetic Construct
ggtggaagaggcagacaccat

SEQ ID NO: 15238 - DNA, 20 bp, Artificial Sequence
  Synthetic Construct
acggtccatcgcttgcatct

SEQ ID NO: 15239 - DNA, 23 bp, Artificial Sequence
  Synthetic Construct
agaagcatctgaagtgccttgtt

SEQ ID NO: 15240 - DNA, 22 bp, Artificial Sequence
  Synthetic Construct
cgggccagggaaagaaaagatg

SEQ ID NO: 15241 - DNA, 19 bp, Artificial Sequence
  Synthetic Construct
tccacagggcctggtacat

SEQ ID NO: 15242 - DNA, 22 bp, Artificial Sequence
  Synthetic Construct
cctcacccagatccagcaccta

SEQ ID NO: 15243 - DNA, 27 bp, Artificial Sequence
  Synthetic Construct
ccacaggtggttcagatagactctaca

SEQ ID NO: 15244 - DNA, 23 bp, Artificial Sequence
  Synthetic Construct
tggaggaattccactgcttcatt

SEQ ID NO: 15245 - DNA, 21 bp, Artificial Sequence
  Synthetic Construct
tgggaaggcagaggcagttct

SEQ ID NO: 15246 - DNA, 23 bp, Artificial Sequence
  Synthetic Construct
cacttcagggatcagccaattca

SEQ ID NO: 15247 - DNA, 27 bp, Artificial Sequence
  Synthetic Construct
cctggataggtagcagacaagtactaa

SEQ ID NO: 15248 - DNA, 21 bp, Artificial Sequence
  Synthetic Construct
agggaggcagaggaagcaaag

SEQ ID NO: 15249 - DNA, 19 bp, Artificial Sequence
  Synthetic Construct
cccctcccctgtgcttaca

SEQ ID NO: 15250 - DNA, 21 bp, Artificial Sequence
  Synthetic Construct
ccaaagctgttccggttcttg

SEQ ID NO: 15251 - DNA, 23 bp, Artificial Sequence
  Synthetic Construct
atgcttcttgcctaccttgtctt

SEQ ID NO: 15252 - DNA, 20 bp, Artificial Sequence
  Synthetic Construct
tgaggtgggccaagttcaga

SEQ ID NO: 15253 - DNA, 25 bp, Artificial Sequence
  Synthetic Construct
gactggggattagctatggtgtcta

SEQ ID NO: 15254 - DNA, 20 bp, Artificial Sequence
  Synthetic Construct
tggtgggagggatccgcata

SEQ ID NO: 15255 - DNA, 21 bp, Artificial Sequence
  Synthetic Construct
gttgcctcaaagccacacttg

SEQ ID NO: 15256 - DNA, 23 bp, Artificial Sequence
  Synthetic Construct
ccctgaggttcattgagcacttt

SEQ ID NO: 15257 - DNA, 21 bp, Artificial Sequence
  Synthetic Construct
ggtgacaaacccagcccaaca

SEQ ID NO: 15258 - DNA, 25 bp, Artificial Sequence
  Synthetic Construct
acgtacatctaagccagtgtgtaag

SEQ ID NO: 15259 - DNA, 20 bp, Artificial Sequence
  Synthetic Construct
gcagccacacaaggagtctt

SEQ ID NO: 15260 - DNA, 24 bp, Artificial Sequence
  Synthetic Construct
ccacgcgtctaaacactaccttgt

SEQ ID NO: 15261 - DNA, 23 bp, Artificial Sequence
  Synthetic Construct
gggtggaacaggaataccaagaa

SEQ ID NO: 15262 - DNA, 21 bp, Artificial Sequence
  Synthetic Construct
agaactggagttggggcacta

SEQ ID NO: 15263 - DNA, 23 bp, Artificial Sequence
  Synthetic Construct
cacaaataagcacagcggggaat

SEQ ID NO: 15264 - DNA, 20 bp, Artificial Sequence
  Synthetic Construct
acgcgcctccagctacattt

SEQ ID NO: 15265 - DNA, 24 bp, Artificial Sequence
  Synthetic Construct
ccaaaacagctggctaccctattc

SEQ ID NO: 15266 - DNA, 20 bp, Artificial Sequence
  Synthetic Construct
accccaagtagccaccattg

SEQ ID NO: 15267 - DNA, 22 bp, Artificial Sequence
  Synthetic Construct
agagcaggagtctctgatgcaa

SEQ ID NO: 15268 - DNA, 22 bp, Artificial Sequence
  Synthetic Construct
caggcgaaaggctcacaggtta

SEQ ID NO: 15269 - DNA, 23 bp, Artificial Sequence
  Synthetic Construct
gggcttagcagctcttggttttg

SEQ ID NO: 15270 - DNA, 20 bp, Artificial Sequence
  Synthetic Construct
ccctttagccttggcactgt

SEQ ID NO: 15271 - DNA, 21 bp, Artificial Sequence
  Synthetic Construct
gggaagatgatggtgcaggaa

SEQ ID NO: 15272 - DNA, 22 bp, Artificial Sequence
  Synthetic Construct
tcctcacagagcctatctgcat

SEQ ID NO: 15273 - DNA, 21 bp, Artificial Sequence
  Synthetic Construct
tgaaggtcccttccagccatt

SEQ ID NO: 15274 - DNA, 19 bp, Artificial Sequence
  Synthetic Construct
tctcacagctggcctggta

SEQ ID NO: 15275 - DNA, 20 bp, Artificial Sequence
  Synthetic Construct
ggaggcggtgaagcattcta

SEQ ID NO: 15276 - DNA, 23 bp, Artificial Sequence
  Synthetic Construct
cctctacaactgcactgatcaca

SEQ ID NO: 15277 - DNA, 24 bp, Artificial Sequence
  Synthetic Construct
ccatgcacgatttctatggtcaag

SEQ ID NO: 15278 - DNA, 21 bp, Artificial Sequence
  Synthetic Construct
gggtggcaatagcccttggat

SEQ ID NO: 15279 - DNA, 22 bp, Artificial Sequence
  Synthetic Construct
cgcaatgatagccatgggaaga

SEQ ID NO: 15280 - DNA, 20 bp, Artificial Sequence
  Synthetic Construct
aaagtccccgaaggcaggta

SEQ ID NO: 15281 - DNA, 24 bp, Artificial Sequence
  Synthetic Construct
ggtcttgctgggtactatcaccat

SEQ ID NO: 15282 - DNA, 24 bp, Artificial Sequence
  Synthetic Construct
ccgcacttgaagtatgaggctgaa

SEQ ID NO: 15283 - DNA, 22 bp, Artificial Sequence
  Synthetic Construct
acagggcattgcttcagcttag

SEQ ID NO: 15284 - DNA, 21 bp, Artificial Sequence
  Synthetic Construct
tggtccagcccctttcagact

SEQ ID NO: 15285 - DNA, 24 bp, Artificial Sequence
  Synthetic Construct
gtcagctaacaactgacggtgtct

SEQ ID NO: 15286 - DNA, 22 bp, Artificial Sequence
  Synthetic Construct
gaagaaggcctcatcacagtca

SEQ ID NO: 15287 - DNA, 20 bp, Artificial Sequence
  Synthetic Construct
ccccaggaaacggagaaaca

SEQ ID NO: 15288 - DNA, 25 bp, Artificial Sequence
  Synthetic Construct
tggagtgtgactggaaaacaattca

SEQ ID NO: 15289 - DNA, 20 bp, Artificial Sequence
  Synthetic Construct
gcaggagcggggaagagtta

SEQ ID NO: 15290 - DNA, 23 bp, Artificial Sequence
  Synthetic Construct
acaaggaagggaagacagcctat

SEQ ID NO: 15291 - DNA, 22 bp, Artificial Sequence
  Synthetic Construct
caagctggtagcaagccctgat

SEQ ID NO: 15292 - DNA, 21 bp, Artificial Sequence
  Synthetic Construct
gttagcaagcagccaggttct

SEQ ID NO: 15293 - DNA, 23 bp, Artificial Sequence
  Synthetic Construct
tccccattgggttacatgggtta

SEQ ID NO: 15294 - DNA, 24 bp, Artificial Sequence
  Synthetic Construct
cttgaactggtcccattgtctagt

SEQ ID NO: 15295 - DNA, 22 bp, Artificial Sequence
  Synthetic Construct
acatgggcacttttacctcaca

SEQ ID NO: 15296 - DNA, 21 bp, Artificial Sequence
  Synthetic Construct
ggccacaagcatgtctgtctt

SEQ ID NO: 15297 - DNA, 20 bp, Artificial Sequence
  Synthetic Construct
tgcggctaatgtggctcaga

SEQ ID NO: 15298 - DNA, 23 bp, Artificial Sequence
  Synthetic Construct
tctgggtttcaactacagccaaa

SEQ ID NO: 15299 - DNA, 24 bp, Artificial Sequence
  Synthetic Construct
gtgtctgatggaacctgcccaatc

SEQ ID NO: 15300 - DNA, 25 bp, Artificial Sequence
  Synthetic Construct
cacatccgtgtaagttagctgcttt

SEQ ID NO: 15301 - DNA, 22 bp, Artificial Sequence
  Synthetic Construct
gtggtgctccagagcttgaact

SEQ ID NO: 15302 - DNA, 25 bp, Artificial Sequence
  Synthetic Construct
caccatgcataaccacagggcaata

SEQ ID NO: 15303 - DNA, 24 bp, Artificial Sequence
  Synthetic Construct
ccacacaggccccattacttccta

SEQ ID NO: 15304 - DNA, 24 bp, Artificial Sequence
  Synthetic Construct
ggtcaaggcctattacccatgctt

SEQ ID NO: 15305 - DNA, 24 bp, Artificial Sequence
  Synthetic Construct
tctcatgtaagagaggctggatct

SEQ ID NO: 15306 - DNA, 20 bp, Artificial Sequence
  Synthetic Construct
gtggcctcctttctgcttgt

SEQ ID NO: 15307 - DNA, 22 bp, Artificial Sequence
  Synthetic Construct
ttaggaatggctgtgtgtggtt

SEQ ID NO: 15308 - DNA, 22 bp, Artificial Sequence
  Synthetic Construct
gcggtgaaacccgtgttctctt

SEQ ID NO: 15309 - DNA, 22 bp, Artificial Sequence
  Synthetic Construct
tcccacctacctgctgttcttg

SEQ ID NO: 15310 - DNA, 24 bp, Artificial Sequence
  Synthetic Construct
ggtttgacccctcttgcttgtttg

SEQ ID NO: 15311 - DNA, 23 bp, Artificial Sequence
  Synthetic Construct
aaagagttgcatcctcagggttt

SEQ ID NO: 15312 - DNA, 18 bp, Artificial Sequence
  Synthetic Construct
tggcacggcagctcagtt

SEQ ID NO: 15313 - DNA, 20 bp, Artificial Sequence
  Synthetic Construct
caagctggccctgtgactga

SEQ ID NO: 15314 - DNA, 24 bp, Artificial Sequence
  Synthetic Construct
tggccctgaagaaagagaaatgat

SEQ ID NO: 15315 - DNA, 26 bp, Artificial Sequence
  Synthetic Construct
gcaggactacagggatgatgtaataa

SEQ ID NO: 15316 - DNA, 21 bp, Artificial Sequence
  Synthetic Construct
ggctgacggcaagacatgaag

SEQ ID NO: 15317 - DNA, 23 bp, Artificial Sequence
  Synthetic Construct
cttgatgctcctggcattgttct

SEQ ID NO: 15318 - DNA, 24 bp, Artificial Sequence
  Synthetic Construct
cacgtgctagatgtgaaggcaagt

SEQ ID NO: 15319 - DNA, 20 bp, Artificial Sequence
  Synthetic Construct
ttagcccggctggcctagtt

SEQ ID NO: 15320 - DNA, 20 bp, Artificial Sequence
  Synthetic Construct
agccagcccctttgttcctt

SEQ ID NO: 15321 - DNA, 23 bp, Artificial Sequence
  Synthetic Construct
aaaccctgtacagagactgcaaa

SEQ ID NO: 15322 - DNA, 21 bp, Artificial Sequence
  Synthetic Construct
gggagtgggacttgcaaccaa

SEQ ID NO: 15323 - DNA, 23 bp, Artificial Sequence
  Synthetic Construct
gcttaacgccaggtcagaagatg

SEQ ID NO: 15324 - DNA, 21 bp, Artificial Sequence
  Synthetic Construct
tgctggtaatcctgggaggtt

SEQ ID NO: 15325 - DNA, 22 bp, Artificial Sequence
  Synthetic Construct
tcctcctggccaagctctttag

SEQ ID NO: 15326 - DNA, 20 bp, Artificial Sequence
  Synthetic Construct
tccagggagggaagtgttca

SEQ ID NO: 15327 - DNA, 20 bp, Artificial Sequence
  Synthetic Construct
gacccagggtgcctggtaaa

SEQ ID NO: 15328 - DNA, 20 bp, Artificial Sequence
  Synthetic Construct
attcccgccggcagaccaaa

SEQ ID NO: 15329 - DNA, 26 bp, Artificial Sequence
  Synthetic Construct
ctccaacttcatttcccactgttttc

SEQ ID NO: 15330 - DNA, 27 bp, Artificial Sequence
  Synthetic Construct
gcctgcactttttcctcttctcctcta

SEQ ID NO: 15331 - DNA, 21 bp, Artificial Sequence
  Synthetic Construct
cagggtgaggatgtccagcta

SEQ ID NO: 15332 - DNA, 25 bp, Artificial Sequence
  Synthetic Construct
cactgtgcttttcctgatcgcatct

SEQ ID NO: 15333 - DNA, 26 bp, Artificial Sequence
  Synthetic Construct
gcccctttgcaccactataagaggat

SEQ ID NO: 15334 - DNA, 22 bp, Artificial Sequence
  Synthetic Construct
gttcttcccctggacccaaagt

SEQ ID NO: 15335 - DNA, 21 bp, Artificial Sequence
  Synthetic Construct
gtgcaaggctggcttcagttc

SEQ ID NO: 15336 - DNA, 21 bp, Artificial Sequence
  Synthetic Construct
gggctttgtctcagcttcctt

SEQ ID NO: 15337 - DNA, 22 bp, Artificial Sequence
  Synthetic Construct
agacggcccagagttctgatag

SEQ ID NO: 15338 - DNA, 23 bp, Artificial Sequence
  Synthetic Construct
tcccactgaagctgaaacgtatg

SEQ ID NO: 15339 - DNA, 22 bp, Artificial Sequence
  Synthetic Construct
aatcatctccccattcggcatt

SEQ ID NO: 15340 - DNA, 24 bp, Artificial Sequence
  Synthetic Construct
ctgaatggcctgaagtcagaaaac

SEQ ID NO: 15341 - DNA, 20 bp, Artificial Sequence
  Synthetic Construct
aggcaagacctcacctgttg

SEQ ID NO: 15342 - DNA, 20 bp, Artificial Sequence
  Synthetic Construct
ccagcatcacgggtgtgtga

SEQ ID NO: 15343 - DNA, 25 bp, Artificial Sequence
  Synthetic Construct
gatagtggtgctattcactgcctat

SEQ ID NO: 15344 - DNA, 20 bp, Artificial Sequence
  Synthetic Construct
gaccacatggtctgctgctt

SEQ ID NO: 15345 - DNA, 21 bp, Artificial Sequence
  Synthetic Construct
aagatcccaggcccacactca

SEQ ID NO: 15346 - DNA, 25 bp, Artificial Sequence
  Synthetic Construct
gtcaataagcgtgaaacgtggtaac

SEQ ID NO: 15347 - DNA, 24 bp, Artificial Sequence
  Synthetic Construct
gttccccagaccaccttctaccta

SEQ ID NO: 15348 - DNA, 23 bp, Artificial Sequence
  Synthetic Construct
acctctagacacactgcctatct

SEQ ID NO: 15349 - DNA, 23 bp, Artificial Sequence
  Synthetic Construct
cctgcttctcacaaagcaagcta

SEQ ID NO: 15350 - DNA, 19 bp, Artificial Sequence
  Synthetic Construct
cggctgctgtcctgctttg

SEQ ID NO: 15351 - DNA, 20 bp, Artificial Sequence
  Synthetic Construct
tggccattccaggcaggtaa

SEQ ID NO: 15352 - DNA, 22 bp, Artificial Sequence
  Synthetic Construct
tgaaaggttgaagctgcacaga

SEQ ID NO: 15353 - DNA, 20 bp, Artificial Sequence
  Synthetic Construct
tccaccgactccgcggctat

SEQ ID NO: 15354 - DNA, 21 bp, Artificial Sequence
  Synthetic Construct
ccttcctgcctctttgccttt

SEQ ID NO: 15355 - DNA, 22 bp, Artificial Sequence
  Synthetic Construct
actactgtgcccttaccccaat

SEQ ID NO: 15356 - DNA, 21 bp, Artificial Sequence
  Synthetic Construct
ctatccttccatcgccacgtt

SEQ ID NO: 15357 - DNA, 24 bp, Artificial Sequence
  Synthetic Construct
gtgggttacctctcaaagctaagt

SEQ ID NO: 15358 - DNA, 20 bp, Artificial Sequence
  Synthetic Construct
tggctggagtggcagcctta

SEQ ID NO: 15359 - DNA, 21 bp, Artificial Sequence
  Synthetic Construct
cgccctggaaactcacagctt

SEQ ID NO: 15360 - DNA, 22 bp, Artificial Sequence
  Synthetic Construct
gcatggcagggactggattgat

SEQ ID NO: 15361 - DNA, 24 bp, Artificial Sequence
  Synthetic Construct
gatgcctcccctctcttcctagat

SEQ ID NO: 15362 - DNA, 22 bp, Artificial Sequence
  Synthetic Construct
agaaagggcaaggtggttttgt

SEQ ID NO: 15363 - DNA, 25 bp, Artificial Sequence
  Synthetic Construct
ctgttgataccttgaggtgctggaa

SEQ ID NO: 15364 - DNA, 21 bp, Artificial Sequence
  Synthetic Construct
ggtcttgggacacgagccaat

SEQ ID NO: 15365 - DNA, 20 bp, Artificial Sequence
  Synthetic Construct
cagcggcaaaacaccctctt

SEQ ID NO: 15366 - DNA, 20 bp, Artificial Sequence
  Synthetic Construct
ggcctcgaaggcatcaccta

SEQ ID NO: 15367 - DNA, 23 bp, Artificial Sequence
  Synthetic Construct
gggagaagctatgagctgagtgt

SEQ ID NO: 15368 - DNA, 20 bp, Artificial Sequence
  Synthetic Construct
tgtcccacacgctgcatatc

SEQ ID NO: 15369 - DNA, 24 bp, Artificial Sequence
  Synthetic Construct
tctggcaactacagtgatgtgaaa

SEQ ID NO: 15370 - DNA, 25 bp, Artificial Sequence
  Synthetic Construct
cagtgaaaccttctaagcccctttg

SEQ ID NO: 15371 - DNA, 20 bp, Artificial Sequence
  Synthetic Construct
tccaccttcctgtccgaagt

SEQ ID NO: 15372 - DNA, 21 bp, Artificial Sequence
  Synthetic Construct
tagcctgggtcagggatgaag

SEQ ID NO: 15373 - DNA, 20 bp, Artificial Sequence
  Synthetic Construct
tgctgggcaaccaagctcat

SEQ ID NO: 15374 - DNA, 22 bp, Artificial Sequence
  Synthetic Construct
acgcctcaccctacaagccata

SEQ ID NO: 15375 - DNA, 20 bp, Artificial Sequence
  Synthetic Construct
cagcctgtttcagggtgaca

SEQ ID NO: 15376 - DNA, 23 bp, Artificial Sequence
  Synthetic Construct
ggtacggaagtcggcctaaatct

SEQ ID NO: 15377 - DNA, 22 bp, Artificial Sequence
  Synthetic Construct
cgccagtcaaaacagccgttag

SEQ ID NO: 15378 - DNA, 20 bp, Artificial Sequence
  Synthetic Construct
tcgtctcctccccgctctgt

SEQ ID NO: 15379 - DNA, 22 bp, Artificial Sequence
  Synthetic Construct
ctgtagtccaggctgtggatga

SEQ ID NO: 15380 - DNA, 22 bp, Artificial Sequence
  Synthetic Construct
atgggtccatgggaggggactt

SEQ ID NO: 15381 - DNA, 20 bp, Artificial Sequence
  Synthetic Construct
gcttctcgccaaggtcatct

SEQ ID NO: 15382 - DNA, 22 bp, Artificial Sequence
  Synthetic Construct
cttctgagggtgtggaagcaaa

SEQ ID NO: 15383 - DNA, 23 bp, Artificial Sequence
  Synthetic Construct
ccactgaccccaataagcccaat

SEQ ID NO: 15384 - DNA, 23 bp, Artificial Sequence
  Synthetic Construct
gagcgtctgcaaaacacatcttg

SEQ ID NO: 15385 - DNA, 22 bp, Artificial Sequence
  Synthetic Construct
ggtgaaggtagttggggtgaag

SEQ ID NO: 15386 - DNA, 22 bp, Artificial Sequence
  Synthetic Construct
ggagaactggggatgctgcttt

SEQ ID NO: 15387 - DNA, 20 bp, Artificial Sequence
  Synthetic Construct
tggagactggtcagcaccat

SEQ ID NO: 15388 - DNA, 24 bp, Artificial Sequence
  Synthetic Construct
aggaattgaacattgctgggtttc

SEQ ID NO: 15389 - DNA, 21 bp, Artificial Sequence
  Synthetic Construct
tcagagggaaggctccatgtt

SEQ ID NO: 15390 - DNA, 22 bp, Artificial Sequence
  Synthetic Construct
tctctgcaggactggcgtttag

SEQ ID NO: 15391 - DNA, 20 bp, Artificial Sequence
  Synthetic Construct
actggctgtgactggtggta

SEQ ID NO: 15392 - DNA, 23 bp, Artificial Sequence
  Synthetic Construct
cacaggactcatacctgggaaac

SEQ ID NO: 15393 - DNA, 22 bp, Artificial Sequence
  Synthetic Construct
ttccccacatcaggaggtgttc

SEQ ID NO: 15394 - DNA, 25 bp, Artificial Sequence
  Synthetic Construct
catcagcttatgtgaagctggtact

SEQ ID NO: 15395 - DNA, 22 bp, Artificial Sequence
  Synthetic Construct
ggtgaaggccaatctcctgttg

SEQ ID NO: 15396 - DNA, 20 bp, Artificial Sequence
  Synthetic Construct
agggctgcaactgccaagaa

SEQ ID NO: 15397 - DNA, 23 bp, Artificial Sequence
  Synthetic Construct
gtgcacctcagaggattggctta

SEQ ID NO: 15398 - DNA, 21 bp, Artificial Sequence
  Synthetic Construct
gaggcagtgggcttgagatac

SEQ ID NO: 15399 - DNA, 20 bp, Artificial Sequence
  Synthetic Construct
gctacagggctgtggcatca

SEQ ID NO: 15400 - DNA, 24 bp, Artificial Sequence
  Synthetic Construct
gcacagcgtgggaggataaggtat

SEQ ID NO: 15401 - DNA, 22 bp, Artificial Sequence
  Synthetic Construct
taagggcagcctctccgtggtt

SEQ ID NO: 15402 - DNA, 21 bp, Artificial Sequence
  Synthetic Construct
aggggtttccggaagactttg

SEQ ID NO: 15403 - DNA, 25 bp, Artificial Sequence
  Synthetic Construct
agggaagtgactgttcttccttcta

SEQ ID NO: 15404 - DNA, 24 bp, Artificial Sequence
  Synthetic Construct
gaattagggaccccaagagtcaac

SEQ ID NO: 15405 - DNA, 21 bp, Artificial Sequence
  Synthetic Construct
aggctcctcaaaaggcaaact

SEQ ID NO: 15406 - DNA, 22 bp, Artificial Sequence
  Synthetic Construct
gtagcccatagccctcaagtct

SEQ ID NO: 15407 - DNA, 23 bp, Artificial Sequence
  Synthetic Construct
ctggggctgattcttgcacacta

SEQ ID NO: 15408 - DNA, 21 bp, Artificial Sequence
  Synthetic Construct
ggctggatgttgagaggaaca

SEQ ID NO: 15409 - DNA, 24 bp, Artificial Sequence
  Synthetic Construct
gcctgtcatcctagttctggagta

SEQ ID NO: 15410 - DNA, 22 bp, Artificial Sequence
  Synthetic Construct
ggccaggtggcagccttaaaat

SEQ ID NO: 15411 - DNA, 26 bp, Artificial Sequence
  Synthetic Construct
gcctgccccattgatatttaaacaag

SEQ ID NO: 15412 - DNA, 22 bp, Artificial Sequence
  Synthetic Construct
gtgcctaaggccactccttatt

SEQ ID NO: 15413 - DNA, 23 bp, Artificial Sequence
  Synthetic Construct
tgactagccaatgtccacagaag

SEQ ID NO: 15414 - DNA, 22 bp, Artificial Sequence
  Synthetic Construct
atcctcccgctcctcttcagat

SEQ ID NO: 15415 - DNA, 23 bp, Artificial Sequence
  Synthetic Construct
caccaaattccaaagggccaagt

SEQ ID NO: 15416 - DNA, 20 bp, Artificial Sequence
  Synthetic Construct
ggcactgggccttttgttca

SEQ ID NO: 15417 - DNA, 22 bp, Artificial Sequence
  Synthetic Construct
tggcagtagtgcttcaggtatg

SEQ ID NO: 15418 - DNA, 22 bp, Artificial Sequence
  Synthetic Construct
gggtgaggctgaggaaagtgtt

SEQ ID NO: 15419 - DNA, 20 bp, Artificial Sequence
  Synthetic Construct
gctgagccccaagggaaaaa

SEQ ID NO: 15420 - DNA, 23 bp, Artificial Sequence
  Synthetic Construct
gaccgccagctaaaaatgctttg

SEQ ID NO: 15421 - DNA, 24 bp, Artificial Sequence
  Synthetic Construct
ctccaagacgctgaaaccttcctt

SEQ ID NO: 15422 - DNA, 20 bp, Artificial Sequence
  Synthetic Construct
ttggaggcaagtggcacaga

SEQ ID NO: 15423 - DNA, 25 bp, Artificial Sequence
  Synthetic Construct
gatgcatcagggctacagtgtatag

SEQ ID NO: 15424 - DNA, 21 bp, Artificial Sequence
  Synthetic Construct
agagagggagccctgatctga

SEQ ID NO: 15425 - DNA, 24 bp, Artificial Sequence
  Synthetic Construct
ccccagacatggtagaggagatac

SEQ ID NO: 15426 - DNA, 22 bp, Artificial Sequence
  Synthetic Construct
acttgtccatgtgcgtcatact

SEQ ID NO: 15427 - DNA, 20 bp, Artificial Sequence
  Synthetic Construct
tgtggggctttggcagagaa

SEQ ID NO: 15428 - DNA, 21 bp, Artificial Sequence
  Synthetic Construct
gccatgatctggtcggaaact

SEQ ID NO: 15429 - DNA, 22 bp, Artificial Sequence
  Synthetic Construct
gtgggagctgtcaagaggaaga

SEQ ID NO: 15430 - DNA, 22 bp, Artificial Sequence
  Synthetic Construct
ccctgaaggctccatcctgaga

SEQ ID NO: 15431 - DNA, 24 bp, Artificial Sequence
  Synthetic Construct
catgtttcagccctgacagctttg

SEQ ID NO: 15432 - DNA, 19 bp, Artificial Sequence
  Synthetic Construct
ggctttggccccggcttat

SEQ ID NO: 15433 - DNA, 24 bp, Artificial Sequence
  Synthetic Construct
gcaggctgatgtttgcatcgtctt

SEQ ID NO: 15434 - DNA, 21 bp, Artificial Sequence
  Synthetic Construct
attccctcctccggcactgat

SEQ ID NO: 15435 - DNA, 24 bp, Artificial Sequence
  Synthetic Construct
ctccgtacctggatgaggaagatg

SEQ ID NO: 15436 - DNA, 21 bp, Artificial Sequence
  Synthetic Construct
gtgccttggcacatgctgtag

SEQ ID NO: 15437 - DNA, 20 bp, Artificial Sequence
  Synthetic Construct
agtggtggagtcgtgctaga

SEQ ID NO: 15438 - DNA, 22 bp, Artificial Sequence
  Synthetic Construct
gtccccagatcccaggaaacaa

SEQ ID NO: 15439 - DNA, 23 bp, Artificial Sequence
  Synthetic Construct
gacagctagcctaaagcctccat

SEQ ID NO: 15440 - DNA, 21 bp, Artificial Sequence
  Synthetic Construct
gaaccagcaatggcagagaca

SEQ ID NO: 15441 - DNA, 20 bp, Artificial Sequence
  Synthetic Construct
agctgtgtccactgggtcat

SEQ ID NO: 15442 - DNA, 20 bp, Artificial Sequence
  Synthetic Construct
ccccacaatggccaaagcaa

SEQ ID NO: 15443 - DNA, 23 bp, Artificial Sequence
  Synthetic Construct
gtccagactataccctgcactca

SEQ ID NO: 15444 - DNA, 24 bp, Artificial Sequence
  Synthetic Construct
gtttggtacacaactgtccagcta

SEQ ID NO: 15445 - DNA, 24 bp, Artificial Sequence
  Synthetic Construct
ggatctgttgtagccccagaagtt

SEQ ID NO: 15446 - DNA, 21 bp, Artificial Sequence
  Synthetic Construct
taggcagtggcagggtggttt

SEQ ID NO: 15447 - DNA, 21 bp, Artificial Sequence
  Synthetic Construct
tgcttcttcacccctctgaac

SEQ ID NO: 15448 - DNA, 22 bp, Artificial Sequence
  Synthetic Construct
ctgtgttggctccttccctttc

SEQ ID NO: 15449 - DNA, 23 bp, Artificial Sequence
  Synthetic Construct
ccccattctatgcagccttggaa

SEQ ID NO: 15450 - DNA, 27 bp, Artificial Sequence
  Synthetic Construct
gctgcttctacaaatccagctagaaac

SEQ ID NO: 15451 - DNA, 21 bp, Artificial Sequence
  Synthetic Construct
ctccattggcctggtttgctt

SEQ ID NO: 15452 - DNA, 24 bp, Artificial Sequence
  Synthetic Construct
gacaccctggacccttgacttcta

SEQ ID NO: 15453 - DNA, 20 bp, Artificial Sequence
  Synthetic Construct
gtggttgggaagcaggtcaa

SEQ ID NO: 15454 - DNA, 22 bp, Artificial Sequence
  Synthetic Construct
gcagtttctgcaccacacattc

SEQ ID NO: 15455 - DNA, 28 bp, Artificial Sequence
  Synthetic Construct
catgcttccaataacctcttcgtagtct

SEQ ID NO: 15456 - DNA, 24 bp, Artificial Sequence
  Synthetic Construct
ggacgtttgcaatcctgggcatag

SEQ ID NO: 15457 - DNA, 21 bp, Artificial Sequence
  Synthetic Construct
ggtcctccgaggcttgttgaa

SEQ ID NO: 15458 - DNA, 21 bp, Artificial Sequence
  Synthetic Construct
aggggcagactccacttgctt

SEQ ID NO: 15459 - DNA, 22 bp, Artificial Sequence
  Synthetic Construct
gtatgggatgtgcaggatgaca

SEQ ID NO: 15460 - DNA, 20 bp, Artificial Sequence
  Synthetic Construct
agcttggggtatgggtgcaa

SEQ ID NO: 15461 - DNA, 20 bp, Artificial Sequence
  Synthetic Construct
ttgcaactcggcagggaact

SEQ ID NO: 15462 - DNA, 23 bp, Artificial Sequence
  Synthetic Construct
acaccaggtataaggtggcattg

SEQ ID NO: 15463 - DNA, 22 bp, Artificial Sequence
  Synthetic Construct
tgtctgggtgggtgctacactt

SEQ ID NO: 15464 - DNA, 20 bp, Artificial Sequence
  Synthetic Construct
agcctggaggctgaaagact

SEQ ID NO: 15465 - DNA, 20 bp, Artificial Sequence
  Synthetic Construct
agcgcgtcaaaggctgaagt

SEQ ID NO: 15466 - DNA, 24 bp, Artificial Sequence
  Synthetic Construct
gcttaatcctctggatgcagttct

SEQ ID NO: 15467 - DNA, 22 bp, Artificial Sequence
  Synthetic Construct
tggccgtgtgagtctgtaaaac

SEQ ID NO: 15468 - DNA, 22 bp, Artificial Sequence
  Synthetic Construct
gagtgggttggggaggtgataa

SEQ ID NO: 15469 - DNA, 22 bp, Artificial Sequence
  Synthetic Construct
caccatgccttcctcctccatt

SEQ ID NO: 15470 - DNA, 25 bp, Artificial Sequence
  Synthetic Construct
aatctgtactcccagaggtgaaaag

SEQ ID NO: 15471 - DNA, 21 bp, Artificial Sequence
  Synthetic Construct
atggctgcttcaggggcagtt

SEQ ID NO: 15472 - DNA, 24 bp, Artificial Sequence
  Synthetic Construct
gtgcaccagaatagatgtgagact

SEQ ID NO: 15473 - DNA, 25 bp, Artificial Sequence
  Synthetic Construct
cagggtctttcttccctcatgtaaa

SEQ ID NO: 15474 - DNA, 22 bp, Artificial Sequence
  Synthetic Construct
tgaaaggggagcccaagtctct

SEQ ID NO: 15475 - DNA, 23 bp, Artificial Sequence
  Synthetic Construct
gagtgcctgaagagggcagtatc

SEQ ID NO: 15476 - DNA, 22 bp, Artificial Sequence
  Synthetic Construct
gcaggaggacaggcaacttaga

SEQ ID NO: 15477 - DNA, 19 bp, Artificial Sequence
  Synthetic Construct
tgtcccagccaagcctaga

SEQ ID NO: 15478 - DNA, 24 bp, Artificial Sequence
  Synthetic Construct
gtggtcctaggtaagctggtgttg

SEQ ID NO: 15479 - DNA, 23 bp, Artificial Sequence
  Synthetic Construct
ggatatagtcgtggtgggcttca

SEQ ID NO: 15480 - DNA, 24 bp, Artificial Sequence
  Synthetic Construct
gaggcactggtatccatgttgaga

SEQ ID NO: 15481 - DNA, 20 bp, Artificial Sequence
  Synthetic Construct
aggtgacaggaacccaggaa

SEQ ID NO: 15482 - DNA, 23 bp, Artificial Sequence
  Synthetic Construct
acagaccgtaagacaagggtttg

SEQ ID NO: 15483 - DNA, 20 bp, Artificial Sequence
  Synthetic Construct
ccagcaacagcagtgccaaa

SEQ ID NO: 15484 - DNA, 21 bp, Artificial Sequence
  Synthetic Construct
cccagccaacatctcaccttt

SEQ ID NO: 15485 - DNA, 28 bp, Artificial Sequence
  Synthetic Construct
gcctaagcctctttttcactaccctcta

SEQ ID NO: 15486 - DNA, 25 bp, Artificial Sequence
  Synthetic Construct
ggttcacagatggttctgcacgata

SEQ ID NO: 15487 - DNA, 19 bp, Artificial Sequence
  Synthetic Construct
tcatggccaccaccagact

SEQ ID NO: 15488 - DNA, 24 bp, Artificial Sequence
  Synthetic Construct
ggaaaggtctaagcttggttcaca

SEQ ID NO: 15489 - DNA, 22 bp, Artificial Sequence
  Synthetic Construct
gcctggttgcatttccctatgt

SEQ ID NO: 15490 - DNA, 20 bp, Artificial Sequence
  Synthetic Construct
tctgtgcctgcgtggagttg

SEQ ID NO: 15491 - DNA, 25 bp, Artificial Sequence
  Synthetic Construct
ctgctgcatagccagagatctttac

SEQ ID NO: 15492 - DNA, 20 bp, Artificial Sequence
  Synthetic Construct
tgcccaggttgctccctagt

SEQ ID NO: 15493 - DNA, 21 bp, Artificial Sequence
  Synthetic Construct
gccatccactgagggcagaag

SEQ ID NO: 15494 - DNA, 24 bp, Artificial Sequence
  Synthetic Construct
cctgcccatcatccttcaggtctt

SEQ ID NO: 15495 - DNA, 22 bp, Artificial Sequence
  Synthetic Construct
ctgcctgctgtctcagcttttc

SEQ ID NO: 15496 - DNA, 22 bp, Artificial Sequence
  Synthetic Construct
tcaggcttcatctcctccagaa

SEQ ID NO: 15497 - DNA, 25 bp, Artificial Sequence
  Synthetic Construct
caagtagcagattggtgtaggaagt

SEQ ID NO: 15498 - DNA, 24 bp, Artificial Sequence
  Synthetic Construct
ggaattcaggacaggaaagtgtct

SEQ ID NO: 15499 - DNA, 26 bp, Artificial Sequence
  Synthetic Construct
gctcctaaggaaattcttggggatga

SEQ ID NO: 15500 - DNA, 19 bp, Artificial Sequence
  Synthetic Construct
ccacaggctgcaagacaca

SEQ ID NO: 15501 - DNA, 21 bp, Artificial Sequence
  Synthetic Construct
tgccagggctagagtttgaag

SEQ ID NO: 15502 - DNA, 26 bp, Artificial Sequence
  Synthetic Construct
gcaggcacacaatagtaaggaacaga

SEQ ID NO: 15503 - DNA, 23 bp, Artificial Sequence
  Synthetic Construct
ccccagaggtactgggtcaagat

SEQ ID NO: 15504 - DNA, 22 bp, Artificial Sequence
  Synthetic Construct
cgaatgggttactccccagtga

SEQ ID NO: 15505 - DNA, 22 bp, Artificial Sequence
  Synthetic Construct
tcagcttgtcctcttgcagaaa

SEQ ID NO: 15506 - DNA, 25 bp, Artificial Sequence
  Synthetic Construct
gggcttgaatgtgcttgaatagttg

SEQ ID NO: 15507 - DNA, 22 bp, Artificial Sequence
  Synthetic Construct
ttccttctggcccagggtgtat

SEQ ID NO: 15508 - DNA, 21 bp, Artificial Sequence
  Synthetic Construct
cctcaggcccaggggtgataa

SEQ ID NO: 15509 - DNA, 20 bp, Artificial Sequence
  Synthetic Construct
gcaggtctgtgggtcagcta

SEQ ID NO: 15510 - DNA, 26 bp, Artificial Sequence
  Synthetic Construct
ctctgaattaaagccagcagaagcta

SEQ ID NO: 15511 - DNA, 22 bp, Artificial Sequence
  Synthetic Construct
acagagagccggcacctattct

SEQ ID NO: 15512 - DNA, 22 bp, Artificial Sequence
  Synthetic Construct
tgggagcatccctcctcctaac

SEQ ID NO: 15513 - DNA, 22 bp, Artificial Sequence
  Synthetic Construct
aaccgcagagaaaaagggatgt

SEQ ID NO: 15514 - DNA, 26 bp, Artificial Sequence
  Synthetic Construct
gaggcagtgatgactcatgtttaaga

SEQ ID NO: 15515 - DNA, 20 bp, Artificial Sequence
  Synthetic Construct
gccccagcctactcctctga

SEQ ID NO: 15516 - DNA, 22 bp, Artificial Sequence
  Synthetic Construct
gagctgctgtaggagggatgaa

SEQ ID NO: 15517 - DNA, 20 bp, Artificial Sequence
  Synthetic Construct
tgccaaggctctgactgcaa

SEQ ID NO: 15518 - DNA, 24 bp, Artificial Sequence
  Synthetic Construct
gcaggtgctacactagatgcaaac

SEQ ID NO: 15519 - DNA, 22 bp, Artificial Sequence
  Synthetic Construct
gctactccagggcaaagctact

SEQ ID NO: 15520 - DNA, 22 bp, Artificial Sequence
  Synthetic Construct
tgccacttgacacccatcaaag

SEQ ID NO: 15521 - DNA, 21 bp, Artificial Sequence
  Synthetic Construct
ggccccaggtcaggacatagt

SEQ ID NO: 15522 - DNA, 23 bp, Artificial Sequence
  Synthetic Construct
gccatatacctagcaccacactt

SEQ ID NO: 15523 - DNA, 27 bp, Artificial Sequence
  Synthetic Construct
gtgatacctcaagactgagaccacaaa

SEQ ID NO: 15524 - DNA, 22 bp, Artificial Sequence
  Synthetic Construct
actggaacccagggcttttaac

SEQ ID NO: 15525 - DNA, 22 bp, Artificial Sequence
  Synthetic Construct
cgcagagacatgtgggcaaaga

SEQ ID NO: 15526 - DNA, 24 bp, Artificial Sequence
  Synthetic Construct
gactccactgggtgttaacttttg

SEQ ID NO: 15527 - DNA, 20 bp, Artificial Sequence
  Synthetic Construct
ttgccccacttcctccagaa

SEQ ID NO: 15528 - DNA, 21 bp, Artificial Sequence
  Synthetic Construct
aaggctggatgcagggctaga

SEQ ID NO: 15529 - DNA, 20 bp, Artificial Sequence
  Synthetic Construct
cagccccaccagagggtaag

SEQ ID NO: 15530 - DNA, 20 bp, Artificial Sequence
  Synthetic Construct
tgctccacacatgggcacaa

SEQ ID NO: 15531 - DNA, 21 bp, Artificial Sequence
  Synthetic Construct
agtggctctgggcctgtgtaa

SEQ ID NO: 15532 - DNA, 21 bp, Artificial Sequence
  Synthetic Construct
ggtgggccttgtggagaatgt

SEQ ID NO: 15533 - DNA, 21 bp, Artificial Sequence
  Synthetic Construct
ctgcatcttgccttcccagaa

SEQ ID NO: 15534 - DNA, 24 bp, Artificial Sequence
  Synthetic Construct
attaagacagggaggcacatgaat

SEQ ID NO: 15535 - DNA, 24 bp, Artificial Sequence
  Synthetic Construct
cgtaaggggaggaggtaagcaaca

SEQ ID NO: 15536 - DNA, 24 bp, Artificial Sequence
  Synthetic Construct
cactgaccatccagcctgattttg

SEQ ID NO: 15537 - DNA, 23 bp, Artificial Sequence
  Synthetic Construct
tgggccatgcataaaagctaaca

SEQ ID NO: 15538 - DNA, 23 bp, Artificial Sequence
  Synthetic Construct
gaatgggtggctcctctctgaag

SEQ ID NO: 15539 - DNA, 24 bp, Artificial Sequence
  Synthetic Construct
tcactctcatagcactgtgtttca

SEQ ID NO: 15540 - DNA, 21 bp, Artificial Sequence
  Synthetic Construct
caaagctgcaagacgccctaa

SEQ ID NO: 15541 - DNA, 22 bp, Artificial Sequence
  Synthetic Construct
ggccatgtggaaatgggacctt

SEQ ID NO: 15542 - DNA, 22 bp, Artificial Sequence
  Synthetic Construct
cagtgtttcgggtaggggtaga

SEQ ID NO: 15543 - DNA, 25 bp, Artificial Sequence
  Synthetic Construct
cgcttggaaagagagacaggaaatc

SEQ ID NO: 15544 - DNA, 22 bp, Artificial Sequence
  Synthetic Construct
cttgtcagcaagctgggtctct

SEQ ID NO: 15545 - DNA, 26 bp, Artificial Sequence
  Synthetic Construct
gcctaagaaatcgctacaagactaga

SEQ ID NO: 15546 - DNA, 23 bp, Artificial Sequence
  Synthetic Construct
gcagcctcgaaactaacccacaa

SEQ ID NO: 15547 - DNA, 25 bp, Artificial Sequence
  Synthetic Construct
ggaaggagtctctctcagagctgta

SEQ ID NO: 15548 - DNA, 22 bp, Artificial Sequence
  Synthetic Construct
ggctgttgccatgaacccatag

SEQ ID NO: 15549 - DNA, 24 bp, Artificial Sequence
  Synthetic Construct
aaccaacctgtttacagtctcact

SEQ ID NO: 15550 - DNA, 22 bp, Artificial Sequence
  Synthetic Construct
ccctctggtgcaggagagtaaa

SEQ ID NO: 15551 - DNA, 20 bp, Artificial Sequence
  Synthetic Construct
agcagagaccagcccatcat

SEQ ID NO: 15552 - DNA, 25 bp, Artificial Sequence
  Synthetic Construct
ccaaggactcctgcaatcctagtca

SEQ ID NO: 15553 - DNA, 24 bp, Artificial Sequence
  Synthetic Construct
cactaagacttgcctccccatcat

SEQ ID NO: 15554 - DNA, 25 bp, Artificial Sequence
  Synthetic Construct
ccttcctcacaagtgctttctgaat

SEQ ID NO: 15555 - DNA, 21 bp, Artificial Sequence
  Synthetic Construct
tcctcaaccctttgcacacat

SEQ ID NO: 15556 - DNA, 22 bp, Artificial Sequence
  Synthetic Construct
gtggcagtcttagcttccagtt

SEQ ID NO: 15557 - DNA, 22 bp, Artificial Sequence
  Synthetic Construct
cagcaaagcagcaggtgacaga

SEQ ID NO: 15558 - DNA, 20 bp, Artificial Sequence
  Synthetic Construct
agtggctgtcaagcccaact

SEQ ID NO: 15559 - DNA, 24 bp, Artificial Sequence
  Synthetic Construct
gcctaacacaaaacaggtccattt

SEQ ID NO: 15560 - DNA, 26 bp, Artificial Sequence
  Synthetic Construct
ggctctaagaccatgctacctcattc

SEQ ID NO: 15561 - DNA, 21 bp, Artificial Sequence
  Synthetic Construct
tgggaaccagcacatggattg

SEQ ID NO: 15562 - DNA, 20 bp, Artificial Sequence
  Synthetic Construct
ttctgtcgctgtgcgtcctt

SEQ ID NO: 15563 - DNA, 24 bp, Artificial Sequence
  Synthetic Construct
ccacgggtgagtcatcctcatatc

SEQ ID NO: 15564 - DNA, 23 bp, Artificial Sequence
  Synthetic Construct
ccagccattgtgttgaatccttt

SEQ ID NO: 15565 - DNA, 20 bp, Artificial Sequence
  Synthetic Construct
gggtggtactgtgcgtccaa

SEQ ID NO: 15566 - DNA, 26 bp, Artificial Sequence
  Synthetic Construct
ggggctcatttaaatactccctctgt

SEQ ID NO: 15567 - DNA, 23 bp, Artificial Sequence
  Synthetic Construct
tgctatttgggtgtcagtccttt

SEQ ID NO: 15568 - DNA, 22 bp, Artificial Sequence
  Synthetic Construct
cagagcccaagggcattgaaca

SEQ ID NO: 15569 - DNA, 22 bp, Artificial Sequence
  Synthetic Construct
tctctaccctgacagtgcaaca

SEQ ID NO: 15570 - DNA, 24 bp, Artificial Sequence
  Synthetic Construct
aaggttccatctgtggaagagttt

SEQ ID NO: 15571 - DNA, 19 bp, Artificial Sequence
  Synthetic Construct
ggctgccagcaggttgtct

SEQ ID NO: 15572 - DNA, 22 bp, Artificial Sequence
  Synthetic Construct
tcctcgggagagtgacctgtaa

SEQ ID NO: 15573 - DNA, 23 bp, Artificial Sequence
  Synthetic Construct
ggaactgcagacaagagctaaac

SEQ ID NO: 15574 - DNA, 23 bp, Artificial Sequence
  Synthetic Construct
cacatgcatcctgtcctaactgt

SEQ ID NO: 15575 - DNA, 25 bp, Artificial Sequence
  Synthetic Construct
cagacctgtttcctcatcaatctct

SEQ ID NO: 15576 - DNA, 23 bp, Artificial Sequence
  Synthetic Construct
gggttcttctaatgctggagaca

SEQ ID NO: 15577 - DNA, 23 bp, Artificial Sequence
  Synthetic Construct
tgtcctatagcagactcccaagt

SEQ ID NO: 15578 - DNA, 21 bp, Artificial Sequence
  Synthetic Construct
gcagcccttgccgagaataga

SEQ ID NO: 15579 - DNA, 22 bp, Artificial Sequence
  Synthetic Construct
cactccgatgccctggtattca

SEQ ID NO: 15580 - DNA, 23 bp, Artificial Sequence
  Synthetic Construct
gtcctgtgaggcattgtggaagt

SEQ ID NO: 15581 - DNA, 22 bp, Artificial Sequence
  Synthetic Construct
actgcatgaaggctctgtgatt

SEQ ID NO: 15582 - DNA, 24 bp, Artificial Sequence
  Synthetic Construct
gccaggactctaaagggagcttgt

SEQ ID NO: 15583 - DNA, 21 bp, Artificial Sequence
  Synthetic Construct
tcccacacctcagccttggaa

SEQ ID NO: 15584 - DNA, 19 bp, Artificial Sequence
  Synthetic Construct
actggccaggctcccattc

SEQ ID NO: 15585 - DNA, 23 bp, Artificial Sequence
  Synthetic Construct
tgcccttctgcctactgaaaatc

SEQ ID NO: 15586 - DNA, 22 bp, Artificial Sequence
  Synthetic Construct
acccctccacaacctcaagtca

SEQ ID NO: 15587 - DNA, 21 bp, Artificial Sequence
  Synthetic Construct
caccttagcagcccactttct

SEQ ID NO: 15588 - DNA, 21 bp, Artificial Sequence
  Synthetic Construct
cagcaggctccagttcaatct

SEQ ID NO: 15589 - DNA, 24 bp, Artificial Sequence
  Synthetic Construct
ggaagggatgcagagcacagatac

SEQ ID NO: 15590 - DNA, 25 bp, Artificial Sequence
  Synthetic Construct
cacctacccagtggtagtagtgaca

SEQ ID NO: 15591 - DNA, 25 bp, Artificial Sequence
  Synthetic Construct
gcccctactgatagtgtgcgtaaag

SEQ ID NO: 15592 - DNA, 21 bp, Artificial Sequence
  Synthetic Construct
aattctgccggatccgacttt

SEQ ID NO: 15593 - DNA, 21 bp, Artificial Sequence
  Synthetic Construct
ttctctctgcatgggttgcat

SEQ ID NO: 15594 - DNA, 21 bp, Artificial Sequence
  Synthetic Construct
gtgggagttctgtcccagaga

SEQ ID NO: 15595 - DNA, 21 bp, Artificial Sequence
  Synthetic Construct
gcctcggcctcctgtgttttt

SEQ ID NO: 15596 - DNA, 22 bp, Artificial Sequence
  Synthetic Construct
gcccctcctttctggagtgttt

SEQ ID NO: 15597 - DNA, 19 bp, Artificial Sequence
  Synthetic Construct
agacggcctctggggcatt

SEQ ID NO: 15598 - DNA, 20 bp, Artificial Sequence
  Synthetic Construct
ggtgggcaattgtggtgcat

SEQ ID NO: 15599 - DNA, 22 bp, Artificial Sequence
  Synthetic Construct
ggaaatcatcctgccaccagta

SEQ ID NO: 15600 - DNA, 18 bp, Artificial Sequence
  Synthetic Construct
tcggtggccttgggaaac

SEQ ID NO: 15601 - DNA, 26 bp, Artificial Sequence
  Synthetic Construct
ccccaggcaattcaattcattcatca

SEQ ID NO: 15602 - DNA, 20 bp, Artificial Sequence
  Synthetic Construct
agcttggctgggtgggtttt

SEQ ID NO: 15603 - DNA, 20 bp, Artificial Sequence
  Synthetic Construct
agctccaggtctcagtgcat

SEQ ID NO: 15604 - DNA, 20 bp, Artificial Sequence
  Synthetic Construct
aggtggcctgggaacctctt

SEQ ID NO: 15605 - DNA, 21 bp, Artificial Sequence
  Synthetic Construct
ccagtttcgccctgctgaaga

SEQ ID NO: 15606 - DNA, 25 bp, Artificial Sequence
  Synthetic Construct
gagttttcgagttccaagttccaat

SEQ ID NO: 15607 - DNA, 22 bp, Artificial Sequence
  Synthetic Construct
ccagttcccggacatagacact

SEQ ID NO: 15608 - DNA, 22 bp, Artificial Sequence
  Synthetic Construct
gtgtccagggtaaatggcaaga

SEQ ID NO: 15609 - DNA, 24 bp, Artificial Sequence
  Synthetic Construct
ccacttccctgtggaagagctaga

SEQ ID NO: 15610 - DNA, 22 bp, Artificial Sequence
  Synthetic Construct
gctcgcttttccttccgccatt

SEQ ID NO: 15611 - DNA, 24 bp, Artificial Sequence
  Synthetic Construct
caggttttgccacagttagtgatg

SEQ ID NO: 15612 - DNA, 21 bp, Artificial Sequence
  Synthetic Construct
tgggctcaagtgcctcctaga

SEQ ID NO: 15613 - DNA, 22 bp, Artificial Sequence
  Synthetic Construct
gaacggaggcagtgagatcaag

SEQ ID NO: 15614 - DNA, 22 bp, Artificial Sequence
  Synthetic Construct
ccccaccacagcatgaagatga

SEQ ID NO: 15615 - DNA, 22 bp, Artificial Sequence
  Synthetic Construct
ggggccacaggtgctaatgaaa

SEQ ID NO: 15616 - DNA, 21 bp, Artificial Sequence
  Synthetic Construct
ggtcacaaaacacgcgggaaa

SEQ ID NO: 15617 - DNA, 26 bp, Artificial Sequence
  Synthetic Construct
gctgaggtgaccttctccagattttc

SEQ ID NO: 15618 - DNA, 24 bp, Artificial Sequence
  Synthetic Construct
ggacccagaaacttgcacttaaac

SEQ ID NO: 15619 - DNA, 24 bp, Artificial Sequence
  Synthetic Construct
gctgtagaagggaagttagcacaa

SEQ ID NO: 15620 - DNA, 22 bp, Artificial Sequence
  Synthetic Construct
ctgctgtaagcctctgggacta

SEQ ID NO: 15621 - DNA, 21 bp, Artificial Sequence
  Synthetic Construct
ccgtggaatgtggcgatctga

SEQ ID NO: 15622 - DNA, 23 bp, Artificial Sequence
  Synthetic Construct
ctacaggtgctattgagctggaa

SEQ ID NO: 15623 - DNA, 22 bp, Artificial Sequence
  Synthetic Construct
gggacataccactgagtgcaaa

SEQ ID NO: 15624 - DNA, 25 bp, Artificial Sequence
  Synthetic Construct
ggggtcatatctctggacctatcat

SEQ ID NO: 15625 - DNA, 23 bp, Artificial Sequence
  Synthetic Construct
tgctccagggtttttagcatttg

SEQ ID NO: 15626 - DNA, 24 bp, Artificial Sequence
  Synthetic Construct
gctgtgggcagaactttgatctct

SEQ ID NO: 15627 - DNA, 22 bp, Artificial Sequence
  Synthetic Construct
tgtcagatcgtggggccctaaa

SEQ ID NO: 15628 - DNA, 24 bp, Artificial Sequence
  Synthetic Construct
ccacctatcaattcccagttggtt

SEQ ID NO: 15629 - DNA, 24 bp, Artificial Sequence
  Synthetic Construct
cttgctacaatcagaccaccctta

SEQ ID NO: 15630 - DNA, 22 bp, Artificial Sequence
  Synthetic Construct
tgctctgtcatcaggctgaatc

SEQ ID NO: 15631 - DNA, 20 bp, Artificial Sequence
  Synthetic Construct
tgtccaactgcctgcacact

SEQ ID NO: 15632 - DNA, 24 bp, Artificial Sequence
  Synthetic Construct
ccagcttcctctagtgacagattt

SEQ ID NO: 15633 - DNA, 21 bp, Artificial Sequence
  Synthetic Construct
ccacgtacgccctctagtgaa

SEQ ID NO: 15634 - DNA, 24 bp, Artificial Sequence
  Synthetic Construct
gccctacccattttgtgcaaggaa

SEQ ID NO: 15635 - DNA, 19 bp, Artificial Sequence
  Synthetic Construct
cccgcgtctgtgctcttca

SEQ ID NO: 15636 - DNA, 22 bp, Artificial Sequence
  Synthetic Construct
ccatgagctagagggtcctaca

SEQ ID NO: 15637 - DNA, 22 bp, Artificial Sequence
  Synthetic Construct
gccaggactgtagaaccaggat

SEQ ID NO: 15638 - DNA, 19 bp, Artificial Sequence
  Synthetic Construct
tgcctcagactggggatgt

SEQ ID NO: 15639 - DNA, 25 bp, Artificial Sequence
  Synthetic Construct
gctctcacacatttacccaacagat

SEQ ID NO: 15640 - DNA, 21 bp, Artificial Sequence
  Synthetic Construct
gcctgtcttctggaggtgtga

SEQ ID NO: 15641 - DNA, 19 bp, Artificial Sequence
  Synthetic Construct
aaggcacgtggtggcagaa

SEQ ID NO: 15642 - DNA, 20 bp, Artificial Sequence
  Synthetic Construct
ctgcaggctgtttggtctga

SEQ ID NO: 15643 - DNA, 22 bp, Artificial Sequence
  Synthetic Construct
cgtggggacttcatgatggaaa

SEQ ID NO: 15644 - DNA, 22 bp, Artificial Sequence
  Synthetic Construct
ctgggtgaagacggtgtgtcaa

SEQ ID NO: 15645 - DNA, 24 bp, Artificial Sequence
  Synthetic Construct
gggaaagcaaacctacacacaaac

SEQ ID NO: 15646 - DNA, 19 bp, Artificial Sequence
  Synthetic Construct
agaggctcgctggctgtga

SEQ ID NO: 15647 - DNA, 23 bp, Artificial Sequence
  Synthetic Construct
ggtgcatttctggaacgaacaag

SEQ ID NO: 15648 - DNA, 23 bp, Artificial Sequence
  Synthetic Construct
gggaagcttctagaggagccaat

SEQ ID NO: 15649 - DNA, 22 bp, Artificial Sequence
  Synthetic Construct
cctgctggaaatgtggctaaga

SEQ ID NO: 15650 - DNA, 23 bp, Artificial Sequence
  Synthetic Construct
agtggtgtgagagagatgtggaa

SEQ ID NO: 15651 - DNA, 22 bp, Artificial Sequence
  Synthetic Construct
ctcccatctcatccccatgcaa

SEQ ID NO: 15652 - DNA, 26 bp, Artificial Sequence
  Synthetic Construct
agaccgtaagcaatataccagtcttg

SEQ ID NO: 15653 - DNA, 23 bp, Artificial Sequence
  Synthetic Construct
ctggggagggagtaacaagaaga

SEQ ID NO: 15654 - DNA, 27 bp, Artificial Sequence
  Synthetic Construct
gaggtgatgggtgactatcctatcagt

SEQ ID NO: 15655 - DNA, 24 bp, Artificial Sequence
  Synthetic Construct
gccttgaccacccatctagagtaa

SEQ ID NO: 15656 - DNA, 27 bp, Artificial Sequence
  Synthetic Construct
catagttgtgtcttcattaggctgagt

SEQ ID NO: 15657 - DNA, 21 bp, Artificial Sequence
  Synthetic Construct
tggcacctttaacccctctgt

SEQ ID NO: 15658 - DNA, 22 bp, Artificial Sequence
  Synthetic Construct
aggcgtaaacacagtcaggaaa

SEQ ID NO: 15659 - DNA, 20 bp, Artificial Sequence
  Synthetic Construct
ggcccaacagcccagaagat

SEQ ID NO: 15660 - DNA, 22 bp, Artificial Sequence
  Synthetic Construct
ccctgtgagctgggccattttt

SEQ ID NO: 15661 - DNA, 22 bp, Artificial Sequence
  Synthetic Construct
cgggagtctgacacatggaact

SEQ ID NO: 15662 - DNA, 26 bp, Artificial Sequence
  Synthetic Construct
cctgaggtgaatgtactttgcaggtt

SEQ ID NO: 15663 - DNA, 19 bp, Artificial Sequence
  Synthetic Construct
tggccagaactgggccata

SEQ ID NO: 15664 - DNA, 23 bp, Artificial Sequence
  Synthetic Construct
ctgtctgcaagtaccacgttttc

SEQ ID NO: 15665 - DNA, 22 bp, Artificial Sequence
  Synthetic Construct
ccagtttcctgctcctgacaag

SEQ ID NO: 15666 - DNA, 22 bp, Artificial Sequence
  Synthetic Construct
attcttggccacaccaagctat

SEQ ID NO: 15667 - DNA, 25 bp, Artificial Sequence
  Synthetic Construct
ctgcgatgtgtggtgaattttcttc

SEQ ID NO: 15668 - DNA, 21 bp, Artificial Sequence
  Synthetic Construct
cctgggtctgatgctgcaatg

SEQ ID NO: 15669 - DNA, 22 bp, Artificial Sequence
  Synthetic Construct
acgagagacccacggttcctaa

SEQ ID NO: 15670 - DNA, 23 bp, Artificial Sequence
  Synthetic Construct
ggggccagatagtggagacattg

SEQ ID NO: 15671 - DNA, 22 bp, Artificial Sequence
  Synthetic Construct
ccaggccagaagcattatcagt

SEQ ID NO: 15672 - DNA, 21 bp, Artificial Sequence
  Synthetic Construct
acacacgccctctgacaccat

SEQ ID NO: 15673 - DNA, 25 bp, Artificial Sequence
  Synthetic Construct
gctcagtctccagcaattagtcctt

SEQ ID NO: 15674 - DNA, 23 bp, Artificial Sequence
  Synthetic Construct
ccaccttctggttgggaatgttt

SEQ ID NO: 15675 - DNA, 20 bp, Artificial Sequence
  Synthetic Construct
agaccaccacccttgagact

SEQ ID NO: 15676 - DNA, 24 bp, Artificial Sequence
  Synthetic Construct
ccacagtgcagttgtgcctaaaac

SEQ ID NO: 15677 - DNA, 22 bp, Artificial Sequence
  Synthetic Construct
tccacccctgcagactaagcat

SEQ ID NO: 15678 - DNA, 20 bp, Artificial Sequence
  Synthetic Construct
cttgccactccctgaacact

SEQ ID NO: 15679 - DNA, 22 bp, Artificial Sequence
  Synthetic Construct
cgcacaatgggaggaaacaaaa

SEQ ID NO: 15680 - DNA, 22 bp, Artificial Sequence
  Synthetic Construct
gcccaggaccaaactgtgaagt

SEQ ID NO: 15681 - DNA, 24 bp, Artificial Sequence
  Synthetic Construct
gacctacctaagcccttctctttg

SEQ ID NO: 15682 - DNA, 22 bp, Artificial Sequence
  Synthetic Construct
ggaggaactggacaggcattag

SEQ ID NO: 15683 - DNA, 23 bp, Artificial Sequence
  Synthetic Construct
tggtagggagttgggtggtgaag

SEQ ID NO: 15684 - DNA, 21 bp, Artificial Sequence
  Synthetic Construct
gctgcagtggaaagacgtaca

SEQ ID NO: 15685 - DNA, 26 bp, Artificial Sequence
  Synthetic Construct
ccctgctacctgtgttcttccattac

SEQ ID NO: 15686 - DNA, 23 bp, Artificial Sequence
  Synthetic Construct
ggtggcaccactttgaccaatac

SEQ ID NO: 15687 - DNA, 25 bp, Artificial Sequence
  Synthetic Construct
tgggatttctcgttatcccatttct

SEQ ID NO: 15688 - DNA, 19 bp, Artificial Sequence
  Synthetic Construct
gccgctgctgacagctaca

SEQ ID NO: 15689 - DNA, 20 bp, Artificial Sequence
  Synthetic Construct
aagggcccctgcctgaggat

SEQ ID NO: 15690 - DNA, 25 bp, Artificial Sequence
  Synthetic Construct
ggtacaaaagtgggcttctaagcta

SEQ ID NO: 15691 - DNA, 24 bp, Artificial Sequence
  Synthetic Construct
ggccacttaaaatgctcaggctat

SEQ ID NO: 15692 - DNA, 24 bp, Artificial Sequence
  Synthetic Construct
ctgctctgaggctgtagggaatca

SEQ ID NO: 15693 - DNA, 25 bp, Artificial Sequence
  Synthetic Construct
gttgtgaagttacacctctctggtt

SEQ ID NO: 15694 - DNA, 20 bp, Artificial Sequence
  Synthetic Construct
catgtcctgcctccaagcaa

SEQ ID NO: 15695 - DNA, 23 bp, Artificial Sequence
  Synthetic Construct
agcctgaatgcaccaatgtatga

SEQ ID NO: 15696 - DNA, 22 bp, Artificial Sequence
  Synthetic Construct
ggtctggctcacagtgaatctt

SEQ ID NO: 15697 - DNA, 23 bp, Artificial Sequence
  Synthetic Construct
caccttctccttctgtgggtaca

SEQ ID NO: 15698 - DNA, 22 bp, Artificial Sequence
  Synthetic Construct
gagaggggtaagtggagcagta

SEQ ID NO: 15699 - DNA, 22 bp, Artificial Sequence
  Synthetic Construct
gggacctaaccatctccagact

SEQ ID NO: 15700 - DNA, 22 bp, Artificial Sequence
  Synthetic Construct
cagctggggtctttcattcaca

SEQ ID NO: 15701 - DNA, 26 bp, Artificial Sequence
  Synthetic Construct
gagctgagaccctttaactttactga

SEQ ID NO: 15702 - DNA, 25 bp, Artificial Sequence
  Synthetic Construct
ccccaagataacctctccctctatc

SEQ ID NO: 15703 - DNA, 22 bp, Artificial Sequence
  Synthetic Construct
tggcaaagtgaagggtgacatc

SEQ ID NO: 15704 - DNA, 22 bp, Artificial Sequence
  Synthetic Construct
gcaggcaaaacacagaggtgat

SEQ ID NO: 15705 - DNA, 23 bp, Artificial Sequence
  Synthetic Construct
aaacttgccaagacatcctcctt

SEQ ID NO: 15706 - DNA, 20 bp, Artificial Sequence
  Synthetic Construct
gtcgggcaagagctttcact

SEQ ID NO: 15707 - DNA, 22 bp, Artificial Sequence
  Synthetic Construct
tctgcttgcggtctctgctttc

SEQ ID NO: 15708 - DNA, 22 bp, Artificial Sequence
  Synthetic Construct
gccccaactgtctttgttcttg

SEQ ID NO: 15709 - DNA, 24 bp, Artificial Sequence
  Synthetic Construct
ccattccctctgagccaactacta

SEQ ID NO: 15710 - DNA, 22 bp, Artificial Sequence
  Synthetic Construct
agagttcgatgcaaagccttct

SEQ ID NO: 15711 - DNA, 22 bp, Artificial Sequence
  Synthetic Construct
tcactgtctctcctccctttca

SEQ ID NO: 15712 - DNA, 25 bp, Artificial Sequence
  Synthetic Construct
ggcacagtgagaaggtagctgtttg

SEQ ID NO: 15713 - DNA, 27 bp, Artificial Sequence
  Synthetic Construct
cagaacatatatccctgctctctcttt

SEQ ID NO: 15714 - DNA, 21 bp, Artificial Sequence
  Synthetic Construct
tgagcagatggagctgtttgt

SEQ ID NO: 15715 - DNA, 22 bp, Artificial Sequence
  Synthetic Construct
gcagccccgatagagattgact

SEQ ID NO: 15716 - DNA, 22 bp, Artificial Sequence
  Synthetic Construct
ggggcctttttgtggggttaaa

SEQ ID NO: 15717 - DNA, 23 bp, Artificial Sequence
  Synthetic Construct
accccaatccctgctaatactga

SEQ ID NO: 15718 - DNA, 21 bp, Artificial Sequence
  Synthetic Construct
aagttgggctccctgggaaag

SEQ ID NO: 15719 - DNA, 23 bp, Artificial Sequence
  Synthetic Construct
gcttcctcccaatattcccttca

SEQ ID NO: 15720 - DNA, 19 bp, Artificial Sequence
  Synthetic Construct
accgggcaaccagccctat

SEQ ID NO: 15721 - DNA, 23 bp, Artificial Sequence
  Synthetic Construct
aaaaccagcgtaatgaggactga

SEQ ID NO: 15722 - DNA, 21 bp, Artificial Sequence
  Synthetic Construct
tggcagcatctctacctcaga

SEQ ID NO: 15723 - DNA, 24 bp, Artificial Sequence
  Synthetic Construct
gccctggataggaatggttaggaa

SEQ ID NO: 15724 - DNA, 24 bp, Artificial Sequence
  Synthetic Construct
cttggactgaaaggaagacactct

SEQ ID NO: 15725 - DNA, 21 bp, Artificial Sequence
  Synthetic Construct
tctctgccggcgatgtctcta

SEQ ID NO: 15726 - DNA, 25 bp, Artificial Sequence
  Synthetic Construct
cactgctcgggatgtaaagctattg

SEQ ID NO: 15727 - DNA, 22 bp, Artificial Sequence
  Synthetic Construct
cagtggcctaaggtggaggtaa

SEQ ID NO: 15728 - DNA, 21 bp, Artificial Sequence
  Synthetic Construct
agggcgcccagagatgaaaag

SEQ ID NO: 15729 - DNA, 23 bp, Artificial Sequence
  Synthetic Construct
atcttggaccacaaacctcaagt

SEQ ID NO: 15730 - DNA, 23 bp, Artificial Sequence
  Synthetic Construct
gttgtccttctccggttgcattc

SEQ ID NO: 15731 - DNA, 19 bp, Artificial Sequence
  Synthetic Construct
gagcccaagggcaccaagt

SEQ ID NO: 15732 - DNA, 26 bp, Artificial Sequence
  Synthetic Construct
gcaatcgactgaggtacttgggtaag

SEQ ID NO: 15733 - DNA, 24 bp, Artificial Sequence
  Synthetic Construct
cgaggaggttactctgaccacact

SEQ ID NO: 15734 - DNA, 23 bp, Artificial Sequence
  Synthetic Construct
ctaagacccaggacggagtcaga

SEQ ID NO: 15735 - DNA, 24 bp, Artificial Sequence
  Synthetic Construct
gaacctgaaaaacagggtgtggat

SEQ ID NO: 15736 - DNA, 19 bp, Artificial Sequence
  Synthetic Construct
aaggggtgcgtgagcaagt

SEQ ID NO: 15737 - DNA, 23 bp, Artificial Sequence
  Synthetic Construct
acaggctttctacaacaggttca

SEQ ID NO: 15738 - DNA, 19 bp, Artificial Sequence
  Synthetic Construct
ggggagcagtgtggacttg

SEQ ID NO: 15739 - DNA, 26 bp, Artificial Sequence
  Synthetic Construct
gaggaagaatctatctgtaggcacaa

SEQ ID NO: 15740 - DNA, 23 bp, Artificial Sequence
  Synthetic Construct
gcccaagaacaggccactctatg

SEQ ID NO: 15741 - DNA, 23 bp, Artificial Sequence
  Synthetic Construct
cagagccacacgtcttgatttga

SEQ ID NO: 15742 - DNA, 20 bp, Artificial Sequence
  Synthetic Construct
ggccaccaaggctgtgaaac

SEQ ID NO: 15743 - DNA, 20 bp, Artificial Sequence
  Synthetic Construct
aatggtgccgtcacctgaga

SEQ ID NO: 15744 - DNA, 22 bp, Artificial Sequence
  Synthetic Construct
gttcggaggtttgccagctttg

SEQ ID NO: 15745 - DNA, 25 bp, Artificial Sequence
  Synthetic Construct
ctgggttcaggagcaactaagaaac

SEQ ID NO: 15746 - DNA, 21 bp, Artificial Sequence
  Synthetic Construct
tctgtgttcccctccgtcttt

SEQ ID NO: 15747 - DNA, 22 bp, Artificial Sequence
  Synthetic Construct
agccaccctctcccaagacaaa

SEQ ID NO: 15748 - DNA, 22 bp, Artificial Sequence
  Synthetic Construct
cacagctctcatcacctacgaa

SEQ ID NO: 15749 - DNA, 20 bp, Artificial Sequence
  Synthetic Construct
agggagctgcaggttcatgt

SEQ ID NO: 15750 - DNA, 24 bp, Artificial Sequence
  Synthetic Construct
cctgcgaataacacgtttctgtag

SEQ ID NO: 15751 - DNA, 24 bp, Artificial Sequence
  Synthetic Construct
ttccaatcccaaagcatctcttct

SEQ ID NO: 15752 - DNA, 22 bp, Artificial Sequence
  Synthetic Construct
gccccgaattacagcttgttac

SEQ ID NO: 15753 - DNA, 21 bp, Artificial Sequence
  Synthetic Construct
accaatcccgaggtgcctaag

SEQ ID NO: 15754 - DNA, 27 bp, Artificial Sequence
  Synthetic Construct
cacactttatggaaatgcagagactga

SEQ ID NO: 15755 - DNA, 23 bp, Artificial Sequence
  Synthetic Construct
agtgcctgctttgcatctacata

SEQ ID NO: 15756 - DNA, 25 bp, Artificial Sequence
  Synthetic Construct
aagtatcggcgaaaatccctaatct

SEQ ID NO: 15757 - DNA, 23 bp, Artificial Sequence
  Synthetic Construct
aagcactggatttcactgagaca

SEQ ID NO: 15758 - DNA, 22 bp, Artificial Sequence
  Synthetic Construct
ggcagagaagccacatccaact

SEQ ID NO: 15759 - DNA, 20 bp, Artificial Sequence
  Synthetic Construct
gccgaggaaaagctgacagt

SEQ ID NO: 15760 - DNA, 26 bp, Artificial Sequence
  Synthetic Construct
cttctcaacctcagtactgtgctact

SEQ ID NO: 15761 - DNA, 22 bp, Artificial Sequence
  Synthetic Construct
aggaagctaaactgcagagcat

SEQ ID NO: 15762 - DNA, 24 bp, Artificial Sequence
  Synthetic Construct
cagtgaaacgatgaggcattgtga

SEQ ID NO: 15763 - DNA, 21 bp, Artificial Sequence
  Synthetic Construct
tgtcatcaaccggccattcaa

SEQ ID NO: 15764 - DNA, 20 bp, Artificial Sequence
  Synthetic Construct
ggcactgtagcttcccaagt

SEQ ID NO: 15765 - DNA, 26 bp, Artificial Sequence
  Synthetic Construct
ggtgaaagtccagctaggagtaaatg

SEQ ID NO: 15766 - DNA, 21 bp, Artificial Sequence
  Synthetic Construct
tcttgggccacctctgttact

SEQ ID NO: 15767 - DNA, 21 bp, Artificial Sequence
  Synthetic Construct
ggacactggttcatggcattg

SEQ ID NO: 15768 - DNA, 22 bp, Artificial Sequence
  Synthetic Construct
tttctctgctgtctccaagcaa

SEQ ID NO: 15769 - DNA, 21 bp, Artificial Sequence
  Synthetic Construct
gtggataccccttgccgctta

SEQ ID NO: 15770 - DNA, 23 bp, Artificial Sequence
  Synthetic Construct
ctagaaatcacgcggcatacaca

SEQ ID NO: 15771 - DNA, 24 bp, Artificial Sequence
  Synthetic Construct
gccatgtaccgagaaccatctttg

SEQ ID NO: 15772 - DNA, 21 bp, Artificial Sequence
  Synthetic Construct
gcgacccaaaggagtttgtct

SEQ ID NO: 15773 - DNA, 20 bp, Artificial Sequence
  Synthetic Construct
acaagccccgagggatatga

SEQ ID NO: 15774 - DNA, 20 bp, Artificial Sequence
  Synthetic Construct
atgcggggagtgaggaagtt

SEQ ID NO: 15775 - DNA, 21 bp, Artificial Sequence
  Synthetic Construct
caagccccagctttgggaaga

SEQ ID NO: 15776 - DNA, 22 bp, Artificial Sequence
  Synthetic Construct
ggctgtggggatatggggaaac

SEQ ID NO: 15777 - DNA, 22 bp, Artificial Sequence
  Synthetic Construct
gaatggggttgcctggtcatct

SEQ ID NO: 15778 - DNA, 22 bp, Artificial Sequence
  Synthetic Construct
gacgtggtaagtcccaggaagt

SEQ ID NO: 15779 - DNA, 22 bp, Artificial Sequence
  Synthetic Construct
gagaaagtctggcgtcttcaca

SEQ ID NO: 15780 - DNA, 22 bp, Artificial Sequence
  Synthetic Construct
catctctgcggctgcatctttg

SEQ ID NO: 15781 - DNA, 24 bp, Artificial Sequence
  Synthetic Construct
ccttctatcctagcaagtgccaat

SEQ ID NO: 15782 - DNA, 25 bp, Artificial Sequence
  Synthetic Construct
gggttcacagcttttagacgcatca

SEQ ID NO: 15783 - DNA, 20 bp, Artificial Sequence
  Synthetic Construct
ggggagttgggaggatctga

SEQ ID NO: 15784 - DNA, 27 bp, Artificial Sequence
  Synthetic Construct
gcccaatcagacaatgatccagagcta

SEQ ID NO: 15785 - DNA, 23 bp, Artificial Sequence
  Synthetic Construct
tccccgcagaacgtctatttaac

SEQ ID NO: 15786 - DNA, 24 bp, Artificial Sequence
  Synthetic Construct
tgtgcccaggctttattgatttct

SEQ ID NO: 15787 - DNA, 24 bp, Artificial Sequence
  Synthetic Construct
caccttttccaagaagtgttgctt

SEQ ID NO: 15788 - DNA, 22 bp, Artificial Sequence
  Synthetic Construct
tgcacgtggaggtctacagaga

SEQ ID NO: 15789 - DNA, 20 bp, Artificial Sequence
  Synthetic Construct
agcagccacctgcgtacaaa

SEQ ID NO: 15790 - DNA, 19 bp, Artificial Sequence
  Synthetic Construct
acgcaggcggctggatgtt

SEQ ID NO: 15791 - DNA, 20 bp, Artificial Sequence
  Synthetic Construct
gagcactgtgtgccacctat

SEQ ID NO: 15792 - DNA, 20 bp, Artificial Sequence
  Synthetic Construct
ctgttaggcggtgcttggat

SEQ ID NO: 15793 - DNA, 23 bp, Artificial Sequence
  Synthetic Construct
ccgctccccagattcaacagttc

SEQ ID NO: 15794 - DNA, 21 bp, Artificial Sequence
  Synthetic Construct
cgtgcagcgttttggatctgt

SEQ ID NO: 15795 - DNA, 25 bp, Artificial Sequence
  Synthetic Construct
gtaaagattggggacttggggatta

SEQ ID NO: 15796 - DNA, 19 bp, Artificial Sequence
  Synthetic Construct
tccaccgccctcctcactt

SEQ ID NO: 15797 - DNA, 24 bp, Artificial Sequence
  Synthetic Construct
cagtcatcaagcctaactgagcat

SEQ ID NO: 15798 - DNA, 20 bp, Artificial Sequence
  Synthetic Construct
cgcagtggccaatccacctt

SEQ ID NO: 15799 - DNA, 24 bp, Artificial Sequence
  Synthetic Construct
ccctgtgactttgggtagcttttg

SEQ ID NO: 15800 - DNA, 23 bp, Artificial Sequence
  Synthetic Construct
ggtgcattcacaggtgagtcatt

SEQ ID NO: 15801 - DNA, 22 bp, Artificial Sequence
  Synthetic Construct
ccctccacacctggttgtcata

SEQ ID NO: 15802 - DNA, 23 bp, Artificial Sequence
  Synthetic Construct
aagtagggaggtgtgagagacat

SEQ ID NO: 15803 - DNA, 22 bp, Artificial Sequence
  Synthetic Construct
tccccactcctttgacctgaga

SEQ ID NO: 15804 - DNA, 18 bp, Artificial Sequence
  Synthetic Construct
gctgccggctacgaaaga

SEQ ID NO: 15805 - DNA, 24 bp, Artificial Sequence
  Synthetic Construct
gcagaggtatttcagacccgctat

SEQ ID NO: 15806 - DNA, 20 bp, Artificial Sequence
  Synthetic Construct
gatttgcccggccctctact

SEQ ID NO: 15807 - DNA, 24 bp, Artificial Sequence
  Synthetic Construct
tgcacttccttactctccttgaac

SEQ ID NO: 15808 - DNA, 22 bp, Artificial Sequence
  Synthetic Construct
cattggtgggtatgggtgttct

SEQ ID NO: 15809 - DNA, 27 bp, Artificial Sequence
  Synthetic Construct
ggaactcaaagcatagcctcctcattt

SEQ ID NO: 15810 - DNA, 22 bp, Artificial Sequence
  Synthetic Construct
tgggcttcagagacaagcctat

SEQ ID NO: 15811 - DNA, 22 bp, Artificial Sequence
  Synthetic Construct
cctggagcaaacccgtttgtga

SEQ ID NO: 15812 - DNA, 24 bp, Artificial Sequence
  Synthetic Construct
gcaagcactaccacttcccaaaag

SEQ ID NO: 15813 - DNA, 26 bp, Artificial Sequence
  Synthetic Construct
ggaataatgcccgtggaccttaagaa

SEQ ID NO: 15814 - DNA, 22 bp, Artificial Sequence
  Synthetic Construct
cactgcagcctcaacctcttca

SEQ ID NO: 15815 - DNA, 21 bp, Artificial Sequence
  Synthetic Construct
gcaaagctcctactgctcact

SEQ ID NO: 15816 - DNA, 22 bp, Artificial Sequence
  Synthetic Construct
tccaatccaaggttggctgaat

SEQ ID NO: 15817 - DNA, 22 bp, Artificial Sequence
  Synthetic Construct
cctctgttggtgaggtgctaag

SEQ ID NO: 15818 - DNA, 20 bp, Artificial Sequence
  Synthetic Construct
gctgacagtggctcctgaga

SEQ ID NO: 15819 - DNA, 22 bp, Artificial Sequence
  Synthetic Construct
tggccttccatgctcaaagaac

SEQ ID NO: 15820 - DNA, 20 bp, Artificial Sequence
  Synthetic Construct
acacgtgcatgcgacactca

SEQ ID NO: 15821 - DNA, 24 bp, Artificial Sequence
  Synthetic Construct
cagtttcagtcctctgctggactt

SEQ ID NO: 15822 - DNA, 24 bp, Artificial Sequence
  Synthetic Construct
tggtcatatcgcttctcctctttg

SEQ ID NO: 15823 - DNA, 20 bp, Artificial Sequence
  Synthetic Construct
acaggcaccgagaggatgaa

SEQ ID NO: 15824 - DNA, 25 bp, Artificial Sequence
  Synthetic Construct
caccaagccgatgaaattgatcttg

SEQ ID NO: 15825 - DNA, 22 bp, Artificial Sequence
  Synthetic Construct
gacctgcaagatgcccagtaag

SEQ ID NO: 15826 - DNA, 22 bp, Artificial Sequence
  Synthetic Construct
cccagcacccttgcctgattta

SEQ ID NO: 15827 - DNA, 24 bp, Artificial Sequence
  Synthetic Construct
gcctccttctgttgactattctgt

SEQ ID NO: 15828 - DNA, 21 bp, Artificial Sequence
  Synthetic Construct
gcttgggcaggcatttctctt

SEQ ID NO: 15829 - DNA, 20 bp, Artificial Sequence
  Synthetic Construct
agaccgtcagcaggatcaca

SEQ ID NO: 15830 - DNA, 23 bp, Artificial Sequence
  Synthetic Construct
cctcgttgagtagtttggcattg

SEQ ID NO: 15831 - DNA, 24 bp, Artificial Sequence
  Synthetic Construct
gagagctgcaagtcatcctcattc

SEQ ID NO: 15832 - DNA, 22 bp, Artificial Sequence
  Synthetic Construct
agggaaatccagccttctcctt

SEQ ID NO: 15833 - DNA, 22 bp, Artificial Sequence
  Synthetic Construct
tggcttatgctctgagggtcta

SEQ ID NO: 15834 - DNA, 24 bp, Artificial Sequence
  Synthetic Construct
ggggtgccgtagtgatcagtagat

SEQ ID NO: 15835 - DNA, 20 bp, Artificial Sequence
  Synthetic Construct
agagcctggcactgggtatt

SEQ ID NO: 15836 - DNA, 23 bp, Artificial Sequence
  Synthetic Construct
gtgagcttggctcaaatccatga

SEQ ID NO: 15837 - DNA, 24 bp, Artificial Sequence
  Synthetic Construct
cagtttcctctggcacctttgttc

SEQ ID NO: 15838 - DNA, 23 bp, Artificial Sequence
  Synthetic Construct
gacgtaaagctgggaaaccttct

SEQ ID NO: 15839 - DNA, 19 bp, Artificial Sequence
  Synthetic Construct
cacatcaccggacgccttt

SEQ ID NO: 15840 - DNA, 25 bp, Artificial Sequence
  Synthetic Construct
ccttgacagcaaattcaggacaact

SEQ ID NO: 15841 - DNA, 24 bp, Artificial Sequence
  Synthetic Construct
ggtttggcacaggatgaagcaaga

SEQ ID NO: 15842 - DNA, 23 bp, Artificial Sequence
  Synthetic Construct
ccacaggccctcataagcctcta

SEQ ID NO: 15843 - DNA, 22 bp, Artificial Sequence
  Synthetic Construct
ccagggcaaaacagaggtccat

SEQ ID NO: 15844 - DNA, 21 bp, Artificial Sequence
  Synthetic Construct
gggcgtctacgatcactgaaa

SEQ ID NO: 15845 - DNA, 19 bp, Artificial Sequence
  Synthetic Construct
tgctgcccacctggcattt

SEQ ID NO: 15846 - DNA, 21 bp, Artificial Sequence
  Synthetic Construct
tgcgcacatgactcctctagt

SEQ ID NO: 15847 - DNA, 25 bp, Artificial Sequence
  Synthetic Construct
gcagatggaatcagcatctctcgat

SEQ ID NO: 15848 - DNA, 22 bp, Artificial Sequence
  Synthetic Construct
gctgggctatgtggcttcagat

SEQ ID NO: 15849 - DNA, 22 bp, Artificial Sequence
  Synthetic Construct
tgtgcttggcttaggctagagt

SEQ ID NO: 15850 - DNA, 23 bp, Artificial Sequence
  Synthetic Construct
aggcagggactggaggtagaaag

SEQ ID NO: 15851 - DNA, 22 bp, Artificial Sequence
  Synthetic Construct
ggactctgtctcagtggaggtt

SEQ ID NO: 15852 - DNA, 19 bp, Artificial Sequence
  Synthetic Construct
tggtgcggtcacccgtgtt

SEQ ID NO: 15853 - DNA, 22 bp, Artificial Sequence
  Synthetic Construct
ggccctatcccttgagagttgt

SEQ ID NO: 15854 - DNA, 21 bp, Artificial Sequence
  Synthetic Construct
atgcccttgagggaggtgttg

SEQ ID NO: 15855 - DNA, 24 bp, Artificial Sequence
  Synthetic Construct
cctcagaacgatgagggaatgaac

SEQ ID NO: 15856 - DNA, 22 bp, Artificial Sequence
  Synthetic Construct
ggccacaagaatcccaatctca

SEQ ID NO: 15857 - DNA, 24 bp, Artificial Sequence
  Synthetic Construct
aagttcgaggctcactacttttct

SEQ ID NO: 15858 - DNA, 24 bp, Artificial Sequence
  Synthetic Construct
ggggatctggggagtatctggtat

SEQ ID NO: 15859 - DNA, 24 bp, Artificial Sequence
  Synthetic Construct
gggtaaggcagagatgtgaactgt

SEQ ID NO: 15860 - DNA, 20 bp, Artificial Sequence
  Synthetic Construct
ccgcttccttgcctgggaat

SEQ ID NO: 15861 - DNA, 22 bp, Artificial Sequence
  Synthetic Construct
cccattgaggagggctttttga

SEQ ID NO: 15862 - DNA, 24 bp, Artificial Sequence
  Synthetic Construct
gacaggacagcagtgtcaatggtt

SEQ ID NO: 15863 - DNA, 25 bp, Artificial Sequence
  Synthetic Construct
gctcttttggtacccggaactctac

SEQ ID NO: 15864 - DNA, 20 bp, Artificial Sequence
  Synthetic Construct
ctcacagcctgacagctgaa

SEQ ID NO: 15865 - DNA, 24 bp, Artificial Sequence
  Synthetic Construct
gagcaggtcagtctccagatcctt

SEQ ID NO: 15866 - DNA, 22 bp, Artificial Sequence
  Synthetic Construct
ggcttgtcctgaatgccaggta

SEQ ID NO: 15867 - DNA, 21 bp, Artificial Sequence
  Synthetic Construct
ccaccctgagctcttcctgtt

SEQ ID NO: 15868 - DNA, 23 bp, Artificial Sequence
  Synthetic Construct
gggctttctcagacttcagagtt

SEQ ID NO: 15869 - DNA, 24 bp, Artificial Sequence
  Synthetic Construct
gacccatgaagggaggacactttg

SEQ ID NO: 15870 - DNA, 21 bp, Artificial Sequence
  Synthetic Construct
tgagcacagcttcagaccaat

SEQ ID NO: 15871 - DNA, 23 bp, Artificial Sequence
  Synthetic Construct
ggaagcatggtgaactgcacatt

SEQ ID NO: 15872 - DNA, 22 bp, Artificial Sequence
  Synthetic Construct
ctggaggtctctccactgcttt

SEQ ID NO: 15873 - DNA, 25 bp, Artificial Sequence
  Synthetic Construct
ttgggtaatgctcgctatgtctaat

SEQ ID NO: 15874 - DNA, 24 bp, Artificial Sequence
  Synthetic Construct
ctcctgtgaatctcatccctttca

SEQ ID NO: 15875 - DNA, 21 bp, Artificial Sequence
  Synthetic Construct
cccagggaatacagccagcat

SEQ ID NO: 15876 - DNA, 24 bp, Artificial Sequence
  Synthetic Construct
catatgcccttatgcctggattct

SEQ ID NO: 15877 - DNA, 24 bp, Artificial Sequence
  Synthetic Construct
gctgaagccaagggaagaggagaa

SEQ ID NO: 15878 - DNA, 21 bp, Artificial Sequence
  Synthetic Construct
agccagtagctgccctgagaa

SEQ ID NO: 15879 - DNA, 24 bp, Artificial Sequence
  Synthetic Construct
ccagaacctggccatctcttccat

SEQ ID NO: 15880 - DNA, 23 bp, Artificial Sequence
  Synthetic Construct
cccgataagcgtctgatggaaac

SEQ ID NO: 15881 - DNA, 24 bp, Artificial Sequence
  Synthetic Construct
ccttgaggcaaacacactgctact

SEQ ID NO: 15882 - DNA, 22 bp, Artificial Sequence
  Synthetic Construct
tccaggcttcatggcactccta

SEQ ID NO: 15883 - DNA, 26 bp, Artificial Sequence
  Synthetic Construct
cagagccccgttactctttcttgtag

SEQ ID NO: 15884 - DNA, 22 bp, Artificial Sequence
  Synthetic Construct
ggggaagggagattggtagaga

SEQ ID NO: 15885 - DNA, 24 bp, Artificial Sequence
  Synthetic Construct
ccgagcctttgtttcactctgttc

SEQ ID NO: 15886 - DNA, 24 bp, Artificial Sequence
  Synthetic Construct
gggtttgtcttaccttcagcttct

SEQ ID NO: 15887 - DNA, 25 bp, Artificial Sequence
  Synthetic Construct
tcagccagcaatgttaaaagacaag

SEQ ID NO: 15888 - DNA, 25 bp, Artificial Sequence
  Synthetic Construct
ggtatcgttctaagcagggaaaaga

SEQ ID NO: 15889 - DNA, 21 bp, Artificial Sequence
  Synthetic Construct
gcaggcctaacttggagaact

SEQ ID NO: 15890 - DNA, 22 bp, Artificial Sequence
  Synthetic Construct
aggacagcaggtcaggaacctt

SEQ ID NO: 15891 - DNA, 24 bp, Artificial Sequence
  Synthetic Construct
ccaggtgatctgccaacctattct

SEQ ID NO: 15892 - DNA, 25 bp, Artificial Sequence
  Synthetic Construct
gacttctgttacatgcccctcactt

SEQ ID NO: 15893 - DNA, 25 bp, Artificial Sequence
  Synthetic Construct
ggcaggaaacctgtagatgggagta

SEQ ID NO: 15894 - DNA, 25 bp, Artificial Sequence
  Synthetic Construct
gctggggaagagtctgtagacttag

SEQ ID NO: 15895 - DNA, 25 bp, Artificial Sequence
  Synthetic Construct
gcataatgaagccattcccaacctt

SEQ ID NO: 15896 - DNA, 24 bp, Artificial Sequence
  Synthetic Construct
ccaggaccacagttggaatcctat

SEQ ID NO: 15897 - DNA, 20 bp, Artificial Sequence
  Synthetic Construct
aggagtggcacctcccaaga

SEQ ID NO: 15898 - DNA, 24 bp, Artificial Sequence
  Synthetic Construct
gtactaagacgaagcgaggtccat

SEQ ID NO: 15899 - DNA, 24 bp, Artificial Sequence
  Synthetic Construct
gtgcttggaaatgggctaaattgt

SEQ ID NO: 15900 - DNA, 21 bp, Artificial Sequence
  Synthetic Construct
agggtcgggctgctgatgtta

SEQ ID NO: 15901 - DNA, 26 bp, Artificial Sequence
  Synthetic Construct
gggaattgccctgagcaaatactaac

SEQ ID NO: 15902 - DNA, 20 bp, Artificial Sequence
  Synthetic Construct
gccagctcaaaggccataca

SEQ ID NO: 15903 - DNA, 25 bp, Artificial Sequence
  Synthetic Construct
ggagtttcttggcaaaggagctatg

SEQ ID NO: 15904 - DNA, 20 bp, Artificial Sequence
  Synthetic Construct
cgtggccaggacctttcaca

SEQ ID NO: 15905 - DNA, 23 bp, Artificial Sequence
  Synthetic Construct
accgaggtttaaagaaggcaagt

SEQ ID NO: 15906 - DNA, 21 bp, Artificial Sequence
  Synthetic Construct
aaggcaggaatgttgcagcta

SEQ ID NO: 15907 - DNA, 20 bp, Artificial Sequence
  Synthetic Construct
gccgagaaatgcggccaaga

SEQ ID NO: 15908 - DNA, 22 bp, Artificial Sequence
  Synthetic Construct
aggaggggtacagatgcccaaa

SEQ ID NO: 15909 - DNA, 20 bp, Artificial Sequence
  Synthetic Construct
ccccgctgtttcccttcatt

SEQ ID NO: 15910 - DNA, 23 bp, Artificial Sequence
  Synthetic Construct
acactgtccttgactcctttgtt

SEQ ID NO: 15911 - DNA, 26 bp, Artificial Sequence
  Synthetic Construct
ggtgactaagcagcaattccctttac

SEQ ID NO: 15912 - DNA, 27 bp, Artificial Sequence
  Synthetic Construct
gtgtcctacttcaggaaggaatgttca

SEQ ID NO: 15913 - DNA, 23 bp, Artificial Sequence
  Synthetic Construct
gttgccagcacagtcaagctttt

SEQ ID NO: 15914 - DNA, 20 bp, Artificial Sequence
  Synthetic Construct
atgcccatggagacgcatgt

SEQ ID NO: 15915 - DNA, 24 bp, Artificial Sequence
  Synthetic Construct
gcccagaacccactgaaattattc

SEQ ID NO: 15916 - DNA, 22 bp, Artificial Sequence
  Synthetic Construct
gaggggttgatgagagcaaagt

SEQ ID NO: 15917 - DNA, 27 bp, Artificial Sequence
  Synthetic Construct
gccggcattaaaagtccatatctaagt

SEQ ID NO: 15918 - DNA, 26 bp, Artificial Sequence
  Synthetic Construct
ctgtgcaaacatcaagggattagaag

SEQ ID NO: 15919 - DNA, 22 bp, Artificial Sequence
  Synthetic Construct
cagcaagctcagctggggaaaa

SEQ ID NO: 15920 - DNA, 23 bp, Artificial Sequence
  Synthetic Construct
catgtctctgggaagttgcatgt

SEQ ID NO: 15921 - DNA, 22 bp, Artificial Sequence
  Synthetic Construct
ctctgcaaacccaggcaggtat

SEQ ID NO: 15922 - DNA, 21 bp, Artificial Sequence
  Synthetic Construct
aggaggttggtgaggcagact

SEQ ID NO: 15923 - DNA, 21 bp, Artificial Sequence
  Synthetic Construct
tctgcccttcgcatagacctt

SEQ ID NO: 15924 - DNA, 22 bp, Artificial Sequence
  Synthetic Construct
caccttgattggcaggttgact

SEQ ID NO: 15925 - DNA, 20 bp, Artificial Sequence
  Synthetic Construct
cagtgcgttaggccctgaga

SEQ ID NO: 15926 - DNA, 23 bp, Artificial Sequence
  Synthetic Construct
gctctccacattgattggcttca

SEQ ID NO: 15927 - DNA, 22 bp, Artificial Sequence
  Synthetic Construct
ggcatggtgaccaatgggttgt

SEQ ID NO: 15928 - DNA, 24 bp, Artificial Sequence
  Synthetic Construct
gctcctctcatcatttcggtatca

SEQ ID NO: 15929 - DNA, 22 bp, Artificial Sequence
  Synthetic Construct
ggcctcaggctaagttctttct

SEQ ID NO: 15930 - DNA, 19 bp, Artificial Sequence
  Synthetic Construct
acagcagtgttgccaccat

SEQ ID NO: 15931 - DNA, 24 bp, Artificial Sequence
  Synthetic Construct
ctgtgttaaccgtgtgatgactct

SEQ ID NO: 15932 - DNA, 24 bp, Artificial Sequence
  Synthetic Construct
ccatcaagatggctcctcgcattt

SEQ ID NO: 15933 - DNA, 24 bp, Artificial Sequence
  Synthetic Construct
ccactctgtctgaaacgtgttact

SEQ ID NO: 15934 - DNA, 29 bp, Artificial Sequence
  Synthetic Construct
gggcttgaaatgcaatatccctttcttga

SEQ ID NO: 15935 - DNA, 24 bp, Artificial Sequence
  Synthetic Construct
cctcacgaattcacaaggagacta

SEQ ID NO: 15936 - DNA, 23 bp, Artificial Sequence
  Synthetic Construct
ggcttaggtcaatgccatcaaga

SEQ ID NO: 15937 - DNA, 22 bp, Artificial Sequence
  Synthetic Construct
cattcagcaccccacacacatt

SEQ ID NO: 15938 - DNA, 21 bp, Artificial Sequence
  Synthetic Construct
tggggtcaggggaatgtggat

SEQ ID NO: 15939 - DNA, 22 bp, Artificial Sequence
  Synthetic Construct
ctctcccttgtgggttgtgctt

SEQ ID NO: 15940 - DNA, 21 bp, Artificial Sequence
  Synthetic Construct
ccccgtgttcttcccttcagt

SEQ ID NO: 15941 - DNA, 21 bp, Artificial Sequence
  Synthetic Construct
gcaggtggcgttagagcacat

SEQ ID NO: 15942 - DNA, 23 bp, Artificial Sequence
  Synthetic Construct
accagctgccaaaacattaggat

SEQ ID NO: 15943 - DNA, 24 bp, Artificial Sequence
  Synthetic Construct
agtttggaagctttctgggataca

SEQ ID NO: 15944 - DNA, 23 bp, Artificial Sequence
  Synthetic Construct
cagaatcaccacgtaaggcagat

SEQ ID NO: 15945 - DNA, 18 bp, Artificial Sequence
  Synthetic Construct
tgggtgccgcacatcaag

SEQ ID NO: 15946 - DNA, 24 bp, Artificial Sequence
  Synthetic Construct
ccatgtactgagagcctgacctaa

SEQ ID NO: 15947 - DNA, 20 bp, Artificial Sequence
  Synthetic Construct
aggacctggaagagccacaa

SEQ ID NO: 15948 - DNA, 25 bp, Artificial Sequence
  Synthetic Construct
gaacccaagagagacattagcaaca

SEQ ID NO: 15949 - DNA, 22 bp, Artificial Sequence
  Synthetic Construct
tctgcagttggggtggagatgt

SEQ ID NO: 15950 - DNA, 21 bp, Artificial Sequence
  Synthetic Construct
gcctgggccagctgttaagat

SEQ ID NO: 15951 - DNA, 23 bp, Artificial Sequence
  Synthetic Construct
ctacactgctcgctctgaaaatg

SEQ ID NO: 15952 - DNA, 20 bp, Artificial Sequence
  Synthetic Construct
aagcctgaacggagccctaa

SEQ ID NO: 15953 - DNA, 23 bp, Artificial Sequence
  Synthetic Construct
ggaggctgtaagcaaaccaaatc

SEQ ID NO: 15954 - DNA, 23 bp, Artificial Sequence
  Synthetic Construct
ctaccagcagttcatggttcaga

SEQ ID NO: 15955 - DNA, 22 bp, Artificial Sequence
  Synthetic Construct
gcttttgcacttggctccttgt

SEQ ID NO: 15956 - DNA, 21 bp, Artificial Sequence
  Synthetic Construct
aagctgggtggcctctgatag

SEQ ID NO: 15957 - DNA, 22 bp, Artificial Sequence
  Synthetic Construct
tgaggacccgactccttgatag

SEQ ID NO: 15958 - DNA, 22 bp, Artificial Sequence
  Synthetic Construct
ctctcccaaagcagtggctgtt

SEQ ID NO: 15959 - DNA, 23 bp, Artificial Sequence
  Synthetic Construct
tctgcgagaattagcaagggatt

SEQ ID NO: 15960 - DNA, 20 bp, Artificial Sequence
  Synthetic Construct
gggtccctgggtgcatttta

SEQ ID NO: 15961 - DNA, 21 bp, Artificial Sequence
  Synthetic Construct
ggcctccaagctctgaagcat

SEQ ID NO: 15962 - DNA, 22 bp, Artificial Sequence
  Synthetic Construct
ggactgtgacccaccaagagat

SEQ ID NO: 15963 - DNA, 20 bp, Artificial Sequence
  Synthetic Construct
agcgcctctgcatgcttttc

SEQ ID NO: 15964 - DNA, 23 bp, Artificial Sequence
  Synthetic Construct
cttggccctgaaaggaagataca

SEQ ID NO: 15965 - DNA, 22 bp, Artificial Sequence
  Synthetic Construct
tgaggaactgttggaggcaaat

SEQ ID NO: 15966 - DNA, 24 bp, Artificial Sequence
  Synthetic Construct
ctggcccttgtgagcttgtctaag

SEQ ID NO: 15967 - DNA, 23 bp, Artificial Sequence
  Synthetic Construct
ggcttcctcacacaaagccttca

SEQ ID NO: 15968 - DNA, 21 bp, Artificial Sequence
  Synthetic Construct
gcaagcaagggaagggcatga

SEQ ID NO: 15969 - DNA, 26 bp, Artificial Sequence
  Synthetic Construct
tctggtaggacttcgtaaactgtaag

SEQ ID NO: 15970 - DNA, 26 bp, Artificial Sequence
  Synthetic Construct
ggtggatcagtcctcaaaacctcaag

SEQ ID NO: 15971 - DNA, 25 bp, Artificial Sequence
  Synthetic Construct
ccaaatccatcacttgctcctgcat

SEQ ID NO: 15972 - DNA, 21 bp, Artificial Sequence
  Synthetic Construct
gctgaagagtggggttcagtt

SEQ ID NO: 15973 - DNA, 20 bp, Artificial Sequence
  Synthetic Construct
cgtggagagaacgccaccat

SEQ ID NO: 15974 - DNA, 24 bp, Artificial Sequence
  Synthetic Construct
ccaccatcttggctcttgttttct

SEQ ID NO: 15975 - DNA, 23 bp, Artificial Sequence
  Synthetic Construct
ccccagaaggtgactccagaaac

SEQ ID NO: 15976 - DNA, 27 bp, Artificial Sequence
  Synthetic Construct
ctctgtcctcatctcactgtttatctt

SEQ ID NO: 15977 - DNA, 22 bp, Artificial Sequence
  Synthetic Construct
cagcctttcaccctgtgactct

SEQ ID NO: 15978 - DNA, 23 bp, Artificial Sequence
  Synthetic Construct
ccttgtggaacacagagactcat

SEQ ID NO: 15979 - DNA, 19 bp, Artificial Sequence
  Synthetic Construct
cgcacagacacctgcaatg

SEQ ID NO: 15980 - DNA, 23 bp, Artificial Sequence
  Synthetic Construct
gtgccctatcttccaacttctgt

SEQ ID NO: 15981 - DNA, 22 bp, Artificial Sequence
  Synthetic Construct
acaccactgtggatctggaaga

SEQ ID NO: 15982 - DNA, 20 bp, Artificial Sequence
  Synthetic Construct
aaccacctgctgcctctttt

SEQ ID NO: 15983 - DNA, 21 bp, Artificial Sequence
  Synthetic Construct
ggctgccttggaaatctctct

SEQ ID NO: 15984 - DNA, 24 bp, Artificial Sequence
  Synthetic Construct
acgtacctaaaacccactgctaga

SEQ ID NO: 15985 - DNA, 23 bp, Artificial Sequence
  Synthetic Construct
agactgctgctgagtttttgagt

SEQ ID NO: 15986 - DNA, 25 bp, Artificial Sequence
  Synthetic Construct
gtgagctggattgtgtgctatggta

SEQ ID NO: 15987 - DNA, 24 bp, Artificial Sequence
  Synthetic Construct
ggccacatttcccaccaatattct

SEQ ID NO: 15988 - DNA, 22 bp, Artificial Sequence
  Synthetic Construct
gttagcacgaggggatcttgtt

SEQ ID NO: 15989 - DNA, 24 bp, Artificial Sequence
  Synthetic Construct
ggtgtaaagcaaggacaacagttc

SEQ ID NO: 15990 - DNA, 20 bp, Artificial Sequence
  Synthetic Construct
aggccacccatggtttcaca

SEQ ID NO: 15991 - DNA, 20 bp, Artificial Sequence
  Synthetic Construct
gtgccgcgtagggactgata

SEQ ID NO: 15992 - DNA, 22 bp, Artificial Sequence
  Synthetic Construct
cggtagacggtgtgatgtgtga

SEQ ID NO: 15993 - DNA, 20 bp, Artificial Sequence
  Synthetic Construct
ccatgtgggaccacctgctt

SEQ ID NO: 15994 - DNA, 23 bp, Artificial Sequence
  Synthetic Construct
gaagcaccaacagcagtttcagt

SEQ ID NO: 15995 - DNA, 23 bp, Artificial Sequence
  Synthetic Construct
ctcaagggtaggactgtctgtga

SEQ ID NO: 15996 - DNA, 22 bp, Artificial Sequence
  Synthetic Construct
ccagtggacacactgcttcttg

SEQ ID NO: 15997 - DNA, 22 bp, Artificial Sequence
  Synthetic Construct
ctcctcaaaggcggtgatggtt

SEQ ID NO: 15998 - DNA, 22 bp, Artificial Sequence
  Synthetic Construct
cctgagccacaaagagccttac

SEQ ID NO: 15999 - DNA, 21 bp, Artificial Sequence
  Synthetic Construct
cagcccctccattttgctgat

SEQ ID NO: 16000 - DNA, 22 bp, Artificial Sequence
  Synthetic Construct
ggcaggaattgtgagctgtagt

SEQ ID NO: 16001 - DNA, 20 bp, Artificial Sequence
  Synthetic Construct
ggacgcaagggaagctgtga

SEQ ID NO: 16002 - DNA, 24 bp, Artificial Sequence
  Synthetic Construct
ggcttcctttgaaactccctgaga

SEQ ID NO: 16003 - DNA, 25 bp, Artificial Sequence
  Synthetic Construct
cagtggcacaatcatagctcccttt

SEQ ID NO: 16004 - DNA, 24 bp, Artificial Sequence
  Synthetic Construct
ctggctaaaccgataggttcttct

SEQ ID NO: 16005 - DNA, 22 bp, Artificial Sequence
  Synthetic Construct
cagcagcattcacgacatccat

SEQ ID NO: 16006 - DNA, 25 bp, Artificial Sequence
  Synthetic Construct
cactgaatgcggtgtttgattaaga

SEQ ID NO: 16007 - DNA, 24 bp, Artificial Sequence
  Synthetic Construct
ggctggggtatacagaaggcatga

SEQ ID NO: 16008 - DNA, 23 bp, Artificial Sequence
  Synthetic Construct
gctctctcccaaacactgctttc

SEQ ID NO: 16009 - DNA, 24 bp, Artificial Sequence
  Synthetic Construct
ccctgtttgtcttggctctatgaa

SEQ ID NO: 16010 - DNA, 24 bp, Artificial Sequence
  Synthetic Construct
aggaagaccctgcatttacattga

SEQ ID NO: 16011 - DNA, 23 bp, Artificial Sequence
  Synthetic Construct
agtcaagctgggagatgaggata

SEQ ID NO: 16012 - DNA, 23 bp, Artificial Sequence
  Synthetic Construct
cagtgtctactgctccagtgctt

SEQ ID NO: 16013 - DNA, 22 bp, Artificial Sequence
  Synthetic Construct
gggagagggttggactcaaaag

SEQ ID NO: 16014 - DNA, 26 bp, Artificial Sequence
  Synthetic Construct
gcgtagtgtgtgtgaaagactcagat

SEQ ID NO: 16015 - DNA, 22 bp, Artificial Sequence
  Synthetic Construct
ccatggcagcttactcccaatc

SEQ ID NO: 16016 - DNA, 21 bp, Artificial Sequence
  Synthetic Construct
agccacagccttggtctcaca

SEQ ID NO: 16017 - DNA, 24 bp, Artificial Sequence
  Synthetic Construct
caccacacatctcctaagcatgta

SEQ ID NO: 16018 - DNA, 24 bp, Artificial Sequence
  Synthetic Construct
gtagctgagacatggtgtccaaac

SEQ ID NO: 16019 - DNA, 23 bp, Artificial Sequence
  Synthetic Construct
cctcctgaagacagagtccaact

SEQ ID NO: 16020 - DNA, 25 bp, Artificial Sequence
  Synthetic Construct
ccctggaaactataaatggctgcta

SEQ ID NO: 16021 - DNA, 20 bp, Artificial Sequence
  Synthetic Construct
tgacttcctggccagtccat

SEQ ID NO: 16022 - DNA, 22 bp, Artificial Sequence
  Synthetic Construct
ctgtctgaccagacctcagact

SEQ ID NO: 16023 - DNA, 23 bp, Artificial Sequence
  Synthetic Construct
ggccagagaacatgtctgtcatc

SEQ ID NO: 16024 - DNA, 22 bp, Artificial Sequence
  Synthetic Construct
gccttatcttcgcccctctttg

SEQ ID NO: 16025 - DNA, 24 bp, Artificial Sequence
  Synthetic Construct
gctgagaggttttcacacggatac

SEQ ID NO: 16026 - DNA, 26 bp, Artificial Sequence
  Synthetic Construct
cccaacttgttcaactctaagtgtct

SEQ ID NO: 16027 - DNA, 21 bp, Artificial Sequence
  Synthetic Construct
tgagggtgtccaggcagtttg

SEQ ID NO: 16028 - DNA, 26 bp, Artificial Sequence
  Synthetic Construct
gcttagccagtccttcattctacaac

SEQ ID NO: 16029 - DNA, 22 bp, Artificial Sequence
  Synthetic Construct
ggcctttggccttcctcatcat

SEQ ID NO: 16030 - DNA, 20 bp, Artificial Sequence
  Synthetic Construct
aggcctttggtgtcctggaa

SEQ ID NO: 16031 - DNA, 27 bp, Artificial Sequence
  Synthetic Construct
gcatggggatataacgtgttcagtttg

SEQ ID NO: 16032 - DNA, 24 bp, Artificial Sequence
  Synthetic Construct
ctcctcaaagccactgccttgaaa

SEQ ID NO: 16033 - DNA, 23 bp, Artificial Sequence
  Synthetic Construct
gccttgtgggtcaaagaaagcat

SEQ ID NO: 16034 - DNA, 20 bp, Artificial Sequence
  Synthetic Construct
ccaggctggaatccctgtgt

SEQ ID NO: 16035 - DNA, 23 bp, Artificial Sequence
  Synthetic Construct
gcgacacgaaaatacagcaaaac

SEQ ID NO: 16036 - DNA, 24 bp, Artificial Sequence
  Synthetic Construct
ggcagactgaaaaggagatacaga

SEQ ID NO: 16037 - DNA, 23 bp, Artificial Sequence
  Synthetic Construct
ccctgtgtcttctgaagctgatg

SEQ ID NO: 16038 - DNA, 27 bp, Artificial Sequence
  Synthetic Construct
gtctcttttcccctagaaaaggttact

SEQ ID NO: 16039 - DNA, 25 bp, Artificial Sequence
  Synthetic Construct
ggcaggcagcttttcaaaatgaagt

SEQ ID NO: 16040 - DNA, 24 bp, Artificial Sequence
  Synthetic Construct
cacacgtgatttatgggagacaag

SEQ ID NO: 16041 - DNA, 23 bp, Artificial Sequence
  Synthetic Construct
caggtcacttcttccaggtcctt

SEQ ID NO: 16042 - DNA, 23 bp, Artificial Sequence
  Synthetic Construct
gggagaaaggagcaggctaattg

SEQ ID NO: 16043 - DNA, 20 bp, Artificial Sequence
  Synthetic Construct
ggggactcaggcttctgtga

SEQ ID NO: 16044 - DNA, 24 bp, Artificial Sequence
  Synthetic Construct
gtgtaccctcggctatgttttact

SEQ ID NO: 16045 - DNA, 20 bp, Artificial Sequence
  Synthetic Construct
agagaggccagcagctccaa

SEQ ID NO: 16046 - DNA, 21 bp, Artificial Sequence
  Synthetic Construct
acaaaagcctcctcgggtact

SEQ ID NO: 16047 - DNA, 22 bp, Artificial Sequence
  Synthetic Construct
ggccacaagcattgtaggtgtt

SEQ ID NO: 16048 - DNA, 25 bp, Artificial Sequence
  Synthetic Construct
cagctctgccaaaaggatctctcta

SEQ ID NO: 16049 - DNA, 22 bp, Artificial Sequence
  Synthetic Construct
gcttgcaatgccctccccttat

SEQ ID NO: 16050 - DNA, 21 bp, Artificial Sequence
  Synthetic Construct
cccacaacacccaggttctga

SEQ ID NO: 16051 - DNA, 23 bp, Artificial Sequence
  Synthetic Construct
tggtgggctcagtaagttcaaag

SEQ ID NO: 16052 - DNA, 24 bp, Artificial Sequence
  Synthetic Construct
ccacacctctccttggattctaac

SEQ ID NO: 16053 - DNA, 20 bp, Artificial Sequence
  Synthetic Construct
tggtaggccccagaaagcta

SEQ ID NO: 16054 - DNA, 25 bp, Artificial Sequence
  Synthetic Construct
ctcaagctgctaagtgttaggtttc

SEQ ID NO: 16055 - DNA, 26 bp, Artificial Sequence
  Synthetic Construct
gaccacaggtttccatctacattact

SEQ ID NO: 16056 - DNA, 23 bp, Artificial Sequence
  Synthetic Construct
catcatgtcgcagctgcattttc

SEQ ID NO: 16057 - DNA, 26 bp, Artificial Sequence
  Synthetic Construct
caccaactctgctttcagacagaatc

SEQ ID NO: 16058 - DNA, 25 bp, Artificial Sequence
  Synthetic Construct
gggcaacaggagattagtagctatg

SEQ ID NO: 16059 - DNA, 20 bp, Artificial Sequence
  Synthetic Construct
aagaacctgggcccctgatg

SEQ ID NO: 16060 - DNA, 23 bp, Artificial Sequence
  Synthetic Construct
gggacaataaggaggaagagcaa

SEQ ID NO: 16061 - DNA, 21 bp, Artificial Sequence
  Synthetic Construct
accatgcttcagtgtgcaaga

SEQ ID NO: 16062 - DNA, 22 bp, Artificial Sequence
  Synthetic Construct
ggtaggtgcgtagaaacgttca

SEQ ID NO: 16063 - DNA, 20 bp, Artificial Sequence
  Synthetic Construct
acacctgtgactggctgagt

SEQ ID NO: 16064 - DNA, 24 bp, Artificial Sequence
  Synthetic Construct
ccctggtgctagtttcttacaaca

SEQ ID NO: 16065 - DNA, 23 bp, Artificial Sequence
  Synthetic Construct
gtggacctggatgacctgtcttg

SEQ ID NO: 16066 - DNA, 21 bp, Artificial Sequence
  Synthetic Construct
cgccatgtttcaggccacctt

SEQ ID NO: 16067 - DNA, 22 bp, Artificial Sequence
  Synthetic Construct
cagagcagttccaggcttcaca

SEQ ID NO: 16068 - DNA, 24 bp, Artificial Sequence
  Synthetic Construct
cggggtaaagtctcagggaagtga

SEQ ID NO: 16069 - DNA, 21 bp, Artificial Sequence
  Synthetic Construct
ggcacttggcatgtgtgattt

SEQ ID NO: 16070 - DNA, 23 bp, Artificial Sequence
  Synthetic Construct
ccagggagaagaaacccatcctt

SEQ ID NO: 16071 - DNA, 22 bp, Artificial Sequence
  Synthetic Construct
tccaaggggccttcaggtttct

SEQ ID NO: 16072 - DNA, 23 bp, Artificial Sequence
  Synthetic Construct
tcactgggctcaggtggagtaag

SEQ ID NO: 16073 - DNA, 20 bp, Artificial Sequence
  Synthetic Construct
aggggcttcatgaccggttt

SEQ ID NO: 16074 - DNA, 25 bp, Artificial Sequence
  Synthetic Construct
ggcaaagtccttacgaagtgagatg

SEQ ID NO: 16075 - DNA, 25 bp, Artificial Sequence
  Synthetic Construct
gctaactcccctagacaggaaaaag

SEQ ID NO: 16076 - DNA, 19 bp, Artificial Sequence
  Synthetic Construct
gccagtgcccactgaggaa

SEQ ID NO: 16077 - DNA, 23 bp, Artificial Sequence
  Synthetic Construct
gtctacacacacgcctcaatagt

SEQ ID NO: 16078 - DNA, 24 bp, Artificial Sequence
  Synthetic Construct
gggagaaggcgcctctatttctga

SEQ ID NO: 16079 - DNA, 23 bp, Artificial Sequence
  Synthetic Construct
tccctcaaaacccacgtatttgt

SEQ ID NO: 16080 - DNA, 21 bp, Artificial Sequence
  Synthetic Construct
cacagccctgctttaggaaga

SEQ ID NO: 16081 - DNA, 23 bp, Artificial Sequence
  Synthetic Construct
tttgagcccaggaggtcgagtct

SEQ ID NO: 16082 - DNA, 22 bp, Artificial Sequence
  Synthetic Construct
tccctacacactcccatgaaga

SEQ ID NO: 16083 - DNA, 21 bp, Artificial Sequence
  Synthetic Construct
acccagactggcctccaattc

SEQ ID NO: 16084 - DNA, 20 bp, Artificial Sequence
  Synthetic Construct
gtggcctcgaggaagcataa

SEQ ID NO: 16085 - DNA, 26 bp, Artificial Sequence
  Synthetic Construct
gtgcatgagtttcacatgtctctctt

SEQ ID NO: 16086 - DNA, 20 bp, Artificial Sequence
  Synthetic Construct
tgtggggctgtaggacacaa

SEQ ID NO: 16087 - DNA, 23 bp, Artificial Sequence
  Synthetic Construct
ggggtcaactcctatcacctttc

SEQ ID NO: 16088 - DNA, 22 bp, Artificial Sequence
  Synthetic Construct
gtggcaggggtctttgtacttc

SEQ ID NO: 16089 - DNA, 23 bp, Artificial Sequence
  Synthetic Construct
ggcagagacgctacagtaacgaa

SEQ ID NO: 16090 - DNA, 22 bp, Artificial Sequence
  Synthetic Construct
gagaccctttccttctgcttga

SEQ ID NO: 16091 - DNA, 23 bp, Artificial Sequence
  Synthetic Construct
gaacagcacaaggtgggacaaac

SEQ ID NO: 16092 - DNA, 25 bp, Artificial Sequence
  Synthetic Construct
ctgtttgtaaggtctctgggtatga

SEQ ID NO: 16093 - DNA, 22 bp, Artificial Sequence
  Synthetic Construct
caccatcagagctggggtcttt

SEQ ID NO: 16094 - DNA, 23 bp, Artificial Sequence
  Synthetic Construct
ggatgtgaaagctggagcactgt

SEQ ID NO: 16095 - DNA, 28 bp, Artificial Sequence
  Synthetic Construct
gacatctgtgtgcttgttaagggaatga

SEQ ID NO: 16096 - DNA, 24 bp, Artificial Sequence
  Synthetic Construct
tccaagttcagtgccagttctatc

SEQ ID NO: 16097 - DNA, 20 bp, Artificial Sequence
  Synthetic Construct
tgccttggcccttgcctttt

SEQ ID NO: 16098 - DNA, 23 bp, Artificial Sequence
  Synthetic Construct
caaagggaagacacgaactcctt

SEQ ID NO: 16099 - DNA, 23 bp, Artificial Sequence
  Synthetic Construct
cgatgtggcggtatacagtgttg

SEQ ID NO: 16100 - DNA, 21 bp, Artificial Sequence
  Synthetic Construct
cgcttcactggccagaacttg

SEQ ID NO: 16101 - DNA, 23 bp, Artificial Sequence
  Synthetic Construct
gcatttgttcattgtgcgtgtgt

SEQ ID NO: 16102 - DNA, 26 bp, Artificial Sequence
  Synthetic Construct
agggatagaattgctgaccagataga

SEQ ID NO: 16103 - DNA, 22 bp, Artificial Sequence
  Synthetic Construct
cgagccggacagcagttcatta

SEQ ID NO: 16104 - DNA, 20 bp, Artificial Sequence
  Synthetic Construct
cgtgaactgccctcctcaga

SEQ ID NO: 16105 - DNA, 24 bp, Artificial Sequence
  Synthetic Construct
gcagctgaggagttcagggttcaa

SEQ ID NO: 16106 - DNA, 23 bp, Artificial Sequence
  Synthetic Construct
caggcttggaaactcagggactt

SEQ ID NO: 16107 - DNA, 20 bp, Artificial Sequence
  Synthetic Construct
cccacatgggagaccgctaa

SEQ ID NO: 16108 - DNA, 25 bp, Artificial Sequence
  Synthetic Construct
gctgtggttttatgctcccctaaac

SEQ ID NO: 16109 - DNA, 20 bp, Artificial Sequence
  Synthetic Construct
accgcctggttcctgattct

SEQ ID NO: 16110 - DNA, 24 bp, Artificial Sequence
  Synthetic Construct
caggggaggcctagagttaagttc

SEQ ID NO: 16111 - DNA, 21 bp, Artificial Sequence
  Synthetic Construct
ggggctctccctctcgatgta

SEQ ID NO: 16112 - DNA, 23 bp, Artificial Sequence
  Synthetic Construct
cgggccacctggagaaagaatag

SEQ ID NO: 16113 - DNA, 19 bp, Artificial Sequence
  Synthetic Construct
atgggtggcttcggctcaa

SEQ ID NO: 16114 - DNA, 26 bp, Artificial Sequence
  Synthetic Construct
gccaagtttttcagagagcagcagat

SEQ ID NO: 16115 - DNA, 20 bp, Artificial Sequence
  Synthetic Construct
ccctcgctcaccttctcttc

SEQ ID NO: 16116 - DNA, 20 bp, Artificial Sequence
  Synthetic Construct
tgacactgaccggtgtggat

SEQ ID NO: 16117 - DNA, 24 bp, Artificial Sequence
  Synthetic Construct
cctatcccattcctcacagccatt

SEQ ID NO: 16118 - DNA, 24 bp, Artificial Sequence
  Synthetic Construct
tggctggaagctaattttggtttg

SEQ ID NO: 16119 - DNA, 23 bp, Artificial Sequence
  Synthetic Construct
gaggccacctacggtattcaaac

SEQ ID NO: 16120 - DNA, 23 bp, Artificial Sequence
  Synthetic Construct
gactccagaacagaagggtcttg

SEQ ID NO: 16121 - DNA, 21 bp, Artificial Sequence
  Synthetic Construct
agaagcctcccctccctctgt

SEQ ID NO: 16122 - DNA, 23 bp, Artificial Sequence
  Synthetic Construct
gtggctagagctttgagcctatg

SEQ ID NO: 16123 - DNA, 21 bp, Artificial Sequence
  Synthetic Construct
ccagctggcctgacactcaaa

SEQ ID NO: 16124 - DNA, 22 bp, Artificial Sequence
  Synthetic Construct
gtcctggctggctaaaggttgt

SEQ ID NO: 16125 - DNA, 21 bp, Artificial Sequence
  Synthetic Construct
gggcttcccaaacacacaatc

SEQ ID NO: 16126 - DNA, 25 bp, Artificial Sequence
  Synthetic Construct
acaacagattacaggagcacagtta

SEQ ID NO: 16127 - DNA, 22 bp, Artificial Sequence
  Synthetic Construct
ggtggatgaatgccctgtcaac

SEQ ID NO: 16128 - DNA, 20 bp, Artificial Sequence
  Synthetic Construct
tgtgggcccctggagctact

SEQ ID NO: 16129 - DNA, 24 bp, Artificial Sequence
  Synthetic Construct
gcgtccgtgtcactaattttcttg

SEQ ID NO: 16130 - DNA, 22 bp, Artificial Sequence
  Synthetic Construct
tgcccctcctgaaaccacattc

SEQ ID NO: 16131 - DNA, 25 bp, Artificial Sequence
  Synthetic Construct
catggctggaatgagtcaagtgcta

SEQ ID NO: 16132 - DNA, 25 bp, Artificial Sequence
  Synthetic Construct
tgactcctgggaagctagacttaaa

SEQ ID NO: 16133 - DNA, 24 bp, Artificial Sequence
  Synthetic Construct
tctgattatgaacccaaggctgtt

SEQ ID NO: 16134 - DNA, 24 bp, Artificial Sequence
  Synthetic Construct
ctccctgtctgcatctttccttat

SEQ ID NO: 16135 - DNA, 22 bp, Artificial Sequence
  Synthetic Construct
tgagtgaccatccactgacaag

SEQ ID NO: 16136 - DNA, 24 bp, Artificial Sequence
  Synthetic Construct
gaagtctccatgtagccactgaat

SEQ ID NO: 16137 - DNA, 22 bp, Artificial Sequence
  Synthetic Construct
gctctgtgctttgggagactgt

SEQ ID NO: 16138 - DNA, 22 bp, Artificial Sequence
  Synthetic Construct
gccaggaagcatccatcagaca

SEQ ID NO: 16139 - DNA, 25 bp, Artificial Sequence
  Synthetic Construct
gccactggaaaacctgcatgaatga

SEQ ID NO: 16140 - DNA, 22 bp, Artificial Sequence
  Synthetic Construct
gcgaggactagcttgcctcttt

SEQ ID NO: 16141 - DNA, 21 bp, Artificial Sequence
  Synthetic Construct
actgctgtgttgctagcactt

SEQ ID NO: 16142 - DNA, 20 bp, Artificial Sequence
  Synthetic Construct
acaaggcatcgccacaccat

SEQ ID NO: 16143 - DNA, 22 bp, Artificial Sequence
  Synthetic Construct
gcctacattcctccatcagctt

SEQ ID NO: 16144 - DNA, 20 bp, Artificial Sequence
  Synthetic Construct
acaatccaccccggtcttct

SEQ ID NO: 16145 - DNA, 27 bp, Artificial Sequence
  Synthetic Construct
gtagcaactctgcaatagtctttcctt

SEQ ID NO: 16146 - DNA, 24 bp, Artificial Sequence
  Synthetic Construct
cctttcactgcttgctgtgggata

SEQ ID NO: 16147 - DNA, 23 bp, Artificial Sequence
  Synthetic Construct
cggcctgcagaatccacactatt

SEQ ID NO: 16148 - DNA, 22 bp, Artificial Sequence
  Synthetic Construct
ggccttagtcattgcgccaaac

SEQ ID NO: 16149 - DNA, 22 bp, Artificial Sequence
  Synthetic Construct
tgtgtcgaccctttcctcaaac

SEQ ID NO: 16150 - DNA, 20 bp, Artificial Sequence
  Synthetic Construct
tgcaactgggaaggcgaaag

SEQ ID NO: 16151 - DNA, 21 bp, Artificial Sequence
  Synthetic Construct
ggcaatggcactactggtaca

SEQ ID NO: 16152 - DNA, 21 bp, Artificial Sequence
  Synthetic Construct
gccacaagctgtgagctgtct

SEQ ID NO: 16153 - DNA, 20 bp, Artificial Sequence
  Synthetic Construct
tggcggggatggggatctca

SEQ ID NO: 16154 - DNA, 25 bp, Artificial Sequence
  Synthetic Construct
gggacccttctcaactctactctct

SEQ ID NO: 16155 - DNA, 22 bp, Artificial Sequence
  Synthetic Construct
gctcctgggaagacatatgcaa

SEQ ID NO: 16156 - DNA, 23 bp, Artificial Sequence
  Synthetic Construct
ttctggctccactactgtgttac

SEQ ID NO: 16157 - DNA, 23 bp, Artificial Sequence
  Synthetic Construct
gggagacactgaaaagcaagact

SEQ ID NO: 16158 - DNA, 26 bp, Artificial Sequence
  Synthetic Construct
acaggaaacccagagagttgtaatag

SEQ ID NO: 16159 - DNA, 22 bp, Artificial Sequence
  Synthetic Construct
gtgccctgtgtcacaaaagcaa

SEQ ID NO: 16160 - DNA, 23 bp, Artificial Sequence
  Synthetic Construct
gcctgtctctttccaaggcctaa

SEQ ID NO: 16161 - DNA, 21 bp, Artificial Sequence
  Synthetic Construct
tgccccagatctgtccaatga

SEQ ID NO: 16162 - DNA, 23 bp, Artificial Sequence
  Synthetic Construct
ttgagctgagagacaaacgctta

SEQ ID NO: 16163 - DNA, 20 bp, Artificial Sequence
  Synthetic Construct
cccagagccacacgctcaaa

SEQ ID NO: 16164 - DNA, 22 bp, Artificial Sequence
  Synthetic Construct
tggttgccttcccaaattcgta

SEQ ID NO: 16165 - DNA, 22 bp, Artificial Sequence
  Synthetic Construct
tgccttttcgtgcaaagctaac

SEQ ID NO: 16166 - DNA, 21 bp, Artificial Sequence
  Synthetic Construct
gtgaagggaaggggcaactgt

SEQ ID NO: 16167 - DNA, 25 bp, Artificial Sequence
  Synthetic Construct
ctgcaatcacagaaccagtcctaga

SEQ ID NO: 16168 - DNA, 21 bp, Artificial Sequence
  Synthetic Construct
cccagctcctttccctcacat

SEQ ID NO: 16169 - DNA, 23 bp, Artificial Sequence
  Synthetic Construct
gcttgtcaccatggcagatcctt

SEQ ID NO: 16170 - DNA, 20 bp, Artificial Sequence
  Synthetic Construct
ggaatggagccgtgtgtcat

SEQ ID NO: 16171 - DNA, 23 bp, Artificial Sequence
  Synthetic Construct
cccctaactatggagagccagaa

SEQ ID NO: 16172 - DNA, 21 bp, Artificial Sequence
  Synthetic Construct
gcaggacattgccagggcttt

SEQ ID NO: 16173 - DNA, 22 bp, Artificial Sequence
  Synthetic Construct
gtgggtaagctgtgctgtgttg

SEQ ID NO: 16174 - DNA, 21 bp, Artificial Sequence
  Synthetic Construct
aggcaccctgaggtgggttag

SEQ ID NO: 16175 - DNA, 20 bp, Artificial Sequence
  Synthetic Construct
ggagtgttggcacctgttca

SEQ ID NO: 16176 - DNA, 22 bp, Artificial Sequence
  Synthetic Construct
gggtgaaccagcaagctccaaa

SEQ ID NO: 16177 - DNA, 25 bp, Artificial Sequence
  Synthetic Construct
caacaacactggcagaagaaatgta

SEQ ID NO: 16178 - DNA, 23 bp, Artificial Sequence
  Synthetic Construct
gggaatggaactcaaccatggaa

SEQ ID NO: 16179 - DNA, 24 bp, Artificial Sequence
  Synthetic Construct
ggatttcctccgagatgcatgtga

SEQ ID NO: 16180 - DNA, 22 bp, Artificial Sequence
  Synthetic Construct
aactggcatggtgagctgtatt

SEQ ID NO: 16181 - DNA, 24 bp, Artificial Sequence
  Synthetic Construct
ctccgtcacctctgtctgtaaagt

SEQ ID NO: 16182 - DNA, 21 bp, Artificial Sequence
  Synthetic Construct
caggcagtgacaactcagtct

SEQ ID NO: 16183 - DNA, 20 bp, Artificial Sequence
  Synthetic Construct
cctggccttagaggcagcat

SEQ ID NO: 16184 - DNA, 20 bp, Artificial Sequence
  Synthetic Construct
tctccccttagggcgtttgt

SEQ ID NO: 16185 - DNA, 22 bp, Artificial Sequence
  Synthetic Construct
acagacccagactcagtgatga

SEQ ID NO: 16186 - DNA, 21 bp, Artificial Sequence
  Synthetic Construct
tgccatggaagatgtgcgatt

SEQ ID NO: 16187 - DNA, 23 bp, Artificial Sequence
  Synthetic Construct
ccagacactgagttagtcacgtt

SEQ ID NO: 16188 - DNA, 23 bp, Artificial Sequence
  Synthetic Construct
ccagtgcagttatctggcacaca

SEQ ID NO: 16189 - DNA, 20 bp, Artificial Sequence
  Synthetic Construct
tctggaaagccgaccactgt

SEQ ID NO: 16190 - DNA, 21 bp, Artificial Sequence
  Synthetic Construct
tgctccttcatgccacctaga

SEQ ID NO: 16191 - DNA, 21 bp, Artificial Sequence
  Synthetic Construct
agcagctgccaaaccaagtaa

SEQ ID NO: 16192 - DNA, 22 bp, Artificial Sequence
  Synthetic Construct
gggctagtgtccataggctcaa

SEQ ID NO: 16193 - DNA, 20 bp, Artificial Sequence
  Synthetic Construct
ctgggcctgatgggacttga

SEQ ID NO: 16194 - DNA, 25 bp, Artificial Sequence
  Synthetic Construct
actggtgtgttaaaagggagtttgt

SEQ ID NO: 16195 - DNA, 25 bp, Artificial Sequence
  Synthetic Construct
ggtcttgtcaggagtttgagcctat

SEQ ID NO: 16196 - DNA, 25 bp, Artificial Sequence
  Synthetic Construct
cttaaaaccctttgccttcttgcta

SEQ ID NO: 16197 - DNA, 22 bp, Artificial Sequence
  Synthetic Construct
agtgggaaagacctcggtgaca

SEQ ID NO: 16198 - DNA, 23 bp, Artificial Sequence
  Synthetic Construct
ggaggtcaatgtcaggggtcaga

SEQ ID NO: 16199 - DNA, 21 bp, Artificial Sequence
  Synthetic Construct
cccacaggacagggactatgt

SEQ ID NO: 16200 - DNA, 22 bp, Artificial Sequence
  Synthetic Construct
gaccccagaaagagccaagtct

SEQ ID NO: 16201 - DNA, 25 bp, Artificial Sequence
  Synthetic Construct
gagaggttttgatctctcggagttg

SEQ ID NO: 16202 - DNA, 24 bp, Artificial Sequence
  Synthetic Construct
caattaagagggctcctggaaact

SEQ ID NO: 16203 - DNA, 21 bp, Artificial Sequence
  Synthetic Construct
caacagcagggttcacacaac

SEQ ID NO: 16204 - DNA, 24 bp, Artificial Sequence
  Synthetic Construct
attggcatggaagtctatggaaca

SEQ ID NO: 16205 - DNA, 24 bp, Artificial Sequence
  Synthetic Construct
ggcagcagtgataagaacggattg

SEQ ID NO: 16206 - DNA, 24 bp, Artificial Sequence
  Synthetic Construct
cgtgggtctgaaacaggaacattg

SEQ ID NO: 16207 - DNA, 22 bp, Artificial Sequence
  Synthetic Construct
caggcaatgtggttttggctta

SEQ ID NO: 16208 - DNA, 23 bp, Artificial Sequence
  Synthetic Construct
gcccctccttcattcactcaact

SEQ ID NO: 16209 - DNA, 23 bp, Artificial Sequence
  Synthetic Construct
gattgggactgtgcctctcaaag

SEQ ID NO: 16210 - DNA, 26 bp, Artificial Sequence
  Synthetic Construct
catcatctcttgcctgggttattgta

SEQ ID NO: 16211 - DNA, 23 bp, Artificial Sequence
  Synthetic Construct
gcactagaagtgaccttgactgt

SEQ ID NO: 16212 - DNA, 22 bp, Artificial Sequence
  Synthetic Construct
ggcctctttagcagcccttatc

SEQ ID NO: 16213 - DNA, 24 bp, Artificial Sequence
  Synthetic Construct
gccctgcctctaaacaaccacata

SEQ ID NO: 16214 - DNA, 22 bp, Artificial Sequence
  Synthetic Construct
cccactgtgctcagctctgttt

SEQ ID NO: 16215 - DNA, 23 bp, Artificial Sequence
  Synthetic Construct
cttgccagttcacctgactgtat

SEQ ID NO: 16216 - DNA, 22 bp, Artificial Sequence
  Synthetic Construct
cagcccaaacctggtagccaat

SEQ ID NO: 16217 - DNA, 24 bp, Artificial Sequence
  Synthetic Construct
actgtcggtcaggatcattttgaa

SEQ ID NO: 16218 - DNA, 23 bp, Artificial Sequence
  Synthetic Construct
ccactggtctctcactcttcact

SEQ ID NO: 16219 - DNA, 21 bp, Artificial Sequence
  Synthetic Construct
gcatgcaaaggtccacaacat

SEQ ID NO: 16220 - DNA, 22 bp, Artificial Sequence
  Synthetic Construct
ggggcagggagatgaagaaact

SEQ ID NO: 16221 - DNA, 24 bp, Artificial Sequence
  Synthetic Construct
cgatgactgaacctgaaaggtgat

SEQ ID NO: 16222 - DNA, 20 bp, Artificial Sequence
  Synthetic Construct
gggaggactgctggaggaat

SEQ ID NO: 16223 - DNA, 20 bp, Artificial Sequence
  Synthetic Construct
taccccagcgtggagacagt

SEQ ID NO: 16224 - DNA, 22 bp, Artificial Sequence
  Synthetic Construct
taggtagggccacgaggagtag

SEQ ID NO: 16225 - DNA, 20 bp, Artificial Sequence
  Synthetic Construct
gactgtgggactctgtgcaa

SEQ ID NO: 16226 - DNA, 23 bp, Artificial Sequence
  Synthetic Construct
gacaccatcgggagacagattac

SEQ ID NO: 16227 - DNA, 26 bp, Artificial Sequence
  Synthetic Construct
ccagcatacttgtgacctgagagttc

SEQ ID NO: 16228 - DNA, 26 bp, Artificial Sequence
  Synthetic Construct
ctgtatagggctctggggttataaag

SEQ ID NO: 16229 - DNA, 22 bp, Artificial Sequence
  Synthetic Construct
cctgtgcaagttcccagagaga

SEQ ID NO: 16230 - DNA, 24 bp, Artificial Sequence
  Synthetic Construct
cagagcttgtacttggaccgatgt

SEQ ID NO: 16231 - DNA, 23 bp, Artificial Sequence
  Synthetic Construct
gttgattttggtgggcttcagtt

SEQ ID NO: 16232 - DNA, 23 bp, Artificial Sequence
  Synthetic Construct
gcatctgcaactgtgtgatcttg

SEQ ID NO: 16233 - DNA, 22 bp, Artificial Sequence
  Synthetic Construct
cagcctagaagcccagtccatt

SEQ ID NO: 16234 - DNA, 19 bp, Artificial Sequence
  Synthetic Construct
agcacttggcactgtgtgt

SEQ ID NO: 16235 - DNA, 21 bp, Artificial Sequence
  Synthetic Construct
cctgccctttgctgatgaaac

SEQ ID NO: 16236 - DNA, 20 bp, Artificial Sequence
  Synthetic Construct
agcgatgcggggaagacttt

SEQ ID NO: 16237 - DNA, 24 bp, Artificial Sequence
  Synthetic Construct
cctcagagcatttgaggaacagaa

SEQ ID NO: 16238 - DNA, 23 bp, Artificial Sequence
  Synthetic Construct
aacgtcatctccaccaatgaact

SEQ ID NO: 16239 - DNA, 23 bp, Artificial Sequence
  Synthetic Construct
ggttgtcagcactctggacaaaa

SEQ ID NO: 16240 - DNA, 25 bp, Artificial Sequence
  Synthetic Construct
ctggggtgtattttagcttcagagt

SEQ ID NO: 16241 - DNA, 20 bp, Artificial Sequence
  Synthetic Construct
gcccctcaggttgtgtttct

SEQ ID NO: 16242 - DNA, 23 bp, Artificial Sequence
  Synthetic Construct
ctcttctgaactccacactcaca

SEQ ID NO: 16243 - DNA, 22 bp, Artificial Sequence
  Synthetic Construct
gggagaggcgtattctgtgatg

SEQ ID NO: 16244 - DNA, 23 bp, Artificial Sequence
  Synthetic Construct
agtaagccagatgcccaatttgt

SEQ ID NO: 16245 - DNA, 19 bp, Artificial Sequence
  Synthetic Construct
ccttgtccaggccatgtgt

SEQ ID NO: 16246 - DNA, 29 bp, Artificial Sequence
  Synthetic Construct
ggtaatatccagtccatccttacttctgt

SEQ ID NO: 16247 - DNA, 24 bp, Artificial Sequence
  Synthetic Construct
gggattcaggctcctttcatcttg

SEQ ID NO: 16248 - DNA, 19 bp, Artificial Sequence
  Synthetic Construct
ggggaggcagacctggtta

SEQ ID NO: 16249 - DNA, 25 bp, Artificial Sequence
  Synthetic Construct
gctgaacggttccttatctttcatc

SEQ ID NO: 16250 - DNA, 24 bp, Artificial Sequence
  Synthetic Construct
gagagtttggcgcagaggagtaag

SEQ ID NO: 16251 - DNA, 22 bp, Artificial Sequence
  Synthetic Construct
tcctatccctcccctaccactt

SEQ ID NO: 16252 - DNA, 25 bp, Artificial Sequence
  Synthetic Construct
cgtgatctgactctggaatgacctt

SEQ ID NO: 16253 - DNA, 23 bp, Artificial Sequence
  Synthetic Construct
ggtacctcccagatgtccatttc

SEQ ID NO: 16254 - DNA, 25 bp, Artificial Sequence
  Synthetic Construct
gttatggtgggaagagtggagtatg

SEQ ID NO: 16255 - DNA, 22 bp, Artificial Sequence
  Synthetic Construct
ctggctcaagctcccttgtgaa

SEQ ID NO: 16256 - DNA, 22 bp, Artificial Sequence
  Synthetic Construct
gcaagatgtgcccaccacacaa

SEQ ID NO: 16257 - DNA, 23 bp, Artificial Sequence
  Synthetic Construct
ggcagggaggtaccatcttcttg

SEQ ID NO: 16258 - DNA, 22 bp, Artificial Sequence
  Synthetic Construct
cctccactactggtcctaccaa

SEQ ID NO: 16259 - DNA, 24 bp, Artificial Sequence
  Synthetic Construct
gaggagaggacaccagacttgttg

SEQ ID NO: 16260 - DNA, 21 bp, Artificial Sequence
  Synthetic Construct
ggccattgcacttgctacttc

SEQ ID NO: 16261 - DNA, 26 bp, Artificial Sequence
  Synthetic Construct
ggacaccctccactggtaacactaag

SEQ ID NO: 16262 - DNA, 23 bp, Artificial Sequence
  Synthetic Construct
cagcccctggctttatgttcact

SEQ ID NO: 16263 - DNA, 22 bp, Artificial Sequence
  Synthetic Construct
gctcattcctggcatcccttgt

SEQ ID NO: 16264 - DNA, 23 bp, Artificial Sequence
  Synthetic Construct
ctcagagggcctgatctcaatgt

SEQ ID NO: 16265 - DNA, 23 bp, Artificial Sequence
  Synthetic Construct
gtgggatagatccctgcagattc

SEQ ID NO: 16266 - DNA, 24 bp, Artificial Sequence
  Synthetic Construct
tcttctcgaaagcatgcctaatct

SEQ ID NO: 16267 - DNA, 25 bp, Artificial Sequence
  Synthetic Construct
cccgaatcccacctttgagggttta

SEQ ID NO: 16268 - DNA, 22 bp, Artificial Sequence
  Synthetic Construct
tagcaggggactgggcattcaa

SEQ ID NO: 16269 - DNA, 25 bp, Artificial Sequence
  Synthetic Construct
gggatagaggtcagacacagcagtt

SEQ ID NO: 16270 - DNA, 18 bp, Artificial Sequence
  Synthetic Construct
ttgggcggtttgctgtgt

SEQ ID NO: 16271 - DNA, 24 bp, Artificial Sequence
  Synthetic Construct
gcaggaaccataccaactgctctt

SEQ ID NO: 16272 - DNA, 22 bp, Artificial Sequence
  Synthetic Construct
gccctagctccatctgtccaat

SEQ ID NO: 16273 - DNA, 22 bp, Artificial Sequence
  Synthetic Construct
gcagcctttgccttttgctaac

SEQ ID NO: 16274 - DNA, 24 bp, Artificial Sequence
  Synthetic Construct
gatgacactggggtcgtgtgatag

SEQ ID NO: 16275 - DNA, 23 bp, Artificial Sequence
  Synthetic Construct
ctcccctgcatctaggtgtttac

SEQ ID NO: 16276 - DNA, 23 bp, Artificial Sequence
  Synthetic Construct
gtgcaagacaaccactggtgaga

SEQ ID NO: 16277 - DNA, 23 bp, Artificial Sequence
  Synthetic Construct
cctgttgcctctggaaactatct

SEQ ID NO: 16278 - DNA, 20 bp, Artificial Sequence
  Synthetic Construct
tccccagctccagggaagaa

SEQ ID NO: 16279 - DNA, 21 bp, Artificial Sequence
  Synthetic Construct
ttctgggagtgagaccgtttg

SEQ ID NO: 16280 - DNA, 24 bp, Artificial Sequence
  Synthetic Construct
ccggctctaaatcctggcattttc

SEQ ID NO: 16281 - DNA, 24 bp, Artificial Sequence
  Synthetic Construct
ccctgctaggaacagtctgatgaa

SEQ ID NO: 16282 - DNA, 22 bp, Artificial Sequence
  Synthetic Construct
atctgggcctcctaaggtcttc

SEQ ID NO: 16283 - DNA, 22 bp, Artificial Sequence
  Synthetic Construct
attggcagcacgaacccagaca

SEQ ID NO: 16284 - DNA, 22 bp, Artificial Sequence
  Synthetic Construct
agaacaggccctagagctggaa

SEQ ID NO: 16285 - DNA, 24 bp, Artificial Sequence
  Synthetic Construct
gtccagcccttcactagatgttag

SEQ ID NO: 16286 - DNA, 20 bp, Artificial Sequence
  Synthetic Construct
ttgttggagggcgagcagtt

SEQ ID NO: 16287 - DNA, 27 bp, Artificial Sequence
  Synthetic Construct
ggagtttctcattttcttccaggcaat

SEQ ID NO: 16288 - DNA, 23 bp, Artificial Sequence
  Synthetic Construct
gaccttggcaaagtgacctcatc

SEQ ID NO: 16289 - DNA, 21 bp, Artificial Sequence
  Synthetic Construct
gccttctggagtggacaggaa

SEQ ID NO: 16290 - DNA, 24 bp, Artificial Sequence
  Synthetic Construct
gagtaggaggtgaggtgtgctgat

SEQ ID NO: 16291 - DNA, 21 bp, Artificial Sequence
  Synthetic Construct
gggatggaaggctggggaatg

SEQ ID NO: 16292 - DNA, 23 bp, Artificial Sequence
  Synthetic Construct
tctgtagcagcagcaaattgaga

SEQ ID NO: 16293 - DNA, 19 bp, Artificial Sequence
  Synthetic Construct
tgctccctctgggaagcat

SEQ ID NO: 16294 - DNA, 23 bp, Artificial Sequence
  Synthetic Construct
acaaagtggagaatgggctgaac

SEQ ID NO: 16295 - DNA, 18 bp, Artificial Sequence
  Synthetic Construct
tgcccgcagcagcttcat

SEQ ID NO: 16296 - DNA, 23 bp, Artificial Sequence
  Synthetic Construct
ccttcttcctgctacgaccttct

SEQ ID NO: 16297 - DNA, 25 bp, Artificial Sequence
  Synthetic Construct
gcccacactcttaacctctgcacta

SEQ ID NO: 16298 - DNA, 23 bp, Artificial Sequence
  Synthetic Construct
cgttgtgggacaaggtctaaaca

SEQ ID NO: 16299 - DNA, 20 bp, Artificial Sequence
  Synthetic Construct
ccagggttgaagcaggttgt

SEQ ID NO: 16300 - DNA, 21 bp, Artificial Sequence
  Synthetic Construct
ggttgagcactgttccacaca

SEQ ID NO: 16301 - DNA, 22 bp, Artificial Sequence
  Synthetic Construct
ctggactcaggcagtgctttgt

SEQ ID NO: 16302 - DNA, 27 bp, Artificial Sequence
  Synthetic Construct
ctgtgtcccaatttcccatttcagttc

SEQ ID NO: 16303 - DNA, 24 bp, Artificial Sequence
  Synthetic Construct
gtcctctgtagctcagacactgtt

SEQ ID NO: 16304 - DNA, 25 bp, Artificial Sequence
  Synthetic Construct
ggtggtttgctaaagaccacctgta

SEQ ID NO: 16305 - DNA, 21 bp, Artificial Sequence
  Synthetic Construct
tgcccacacctactgccatac

SEQ ID NO: 16306 - DNA, 23 bp, Artificial Sequence
  Synthetic Construct
ctctgtctcccagtggtcagtct

SEQ ID NO: 16307 - DNA, 25 bp, Artificial Sequence
  Synthetic Construct
tttgaaagcaggaaccaagagagta

SEQ ID NO: 16308 - DNA, 22 bp, Artificial Sequence
  Synthetic Construct
ccccaggcaattgggacaaact

SEQ ID NO: 16309 - DNA, 20 bp, Artificial Sequence
  Synthetic Construct
cccctgagtcacaccagttg

SEQ ID NO: 16310 - DNA, 23 bp, Artificial Sequence
  Synthetic Construct
acacacatctgtctgtgtgatga

SEQ ID NO: 16311 - DNA, 22 bp, Artificial Sequence
  Synthetic Construct
cccttggcccctatgacatcaa

SEQ ID NO: 16312 - DNA, 20 bp, Artificial Sequence
  Synthetic Construct
gggcctcccattgccaactt

SEQ ID NO: 16313 - DNA, 24 bp, Artificial Sequence
  Synthetic Construct
ctgttagtggctttgctgtttcaa

SEQ ID NO: 16314 - DNA, 23 bp, Artificial Sequence
  Synthetic Construct
gggaggcaggaattactccaact

SEQ ID NO: 16315 - DNA, 23 bp, Artificial Sequence
  Synthetic Construct
gtcgtttggaaactggcttctga

SEQ ID NO: 16316 - DNA, 26 bp, Artificial Sequence
  Synthetic Construct
cagaaagagagaggtttgtcctcttg

SEQ ID NO: 16317 - DNA, 24 bp, Artificial Sequence
  Synthetic Construct
caacaccacctctccataccttga

SEQ ID NO: 16318 - DNA, 20 bp, Artificial Sequence
  Synthetic Construct
tgcagcaagtgcgtgcattc

SEQ ID NO: 16319 - DNA, 24 bp, Artificial Sequence
  Synthetic Construct
gctgggccatagctctatgttttc

SEQ ID NO: 16320 - DNA, 22 bp, Artificial Sequence
  Synthetic Construct
gttccacctctccctgcaaagt

SEQ ID NO: 16321 - DNA, 26 bp, Artificial Sequence
  Synthetic Construct
gactttgggaacacagagaaatggtt

SEQ ID NO: 16322 - DNA, 23 bp, Artificial Sequence
  Synthetic Construct
ggaagcgggtgaatagactgaag

SEQ ID NO: 16323 - DNA, 22 bp, Artificial Sequence
  Synthetic Construct
gccctgctgtagtgccttagtt

SEQ ID NO: 16324 - DNA, 19 bp, Artificial Sequence
  Synthetic Construct
ttcaggcccggctatctgt

SEQ ID NO: 16325 - DNA, 22 bp, Artificial Sequence
  Synthetic Construct
ggtgtgcttgtgcttggagaga

SEQ ID NO: 16326 - DNA, 20 bp, Artificial Sequence
  Synthetic Construct
ccccagcgcaacctggtaat

SEQ ID NO: 16327 - DNA, 22 bp, Artificial Sequence
  Synthetic Construct
ctcccacttcctgtcctactga

SEQ ID NO: 16328 - DNA, 24 bp, Artificial Sequence
  Synthetic Construct
ctcctctcctccatttagctcttc

SEQ ID NO: 16329 - DNA, 19 bp, Artificial Sequence
  Synthetic Construct
cagttgcctgcaccaccta

SEQ ID NO: 16330 - DNA, 23 bp, Artificial Sequence
  Synthetic Construct
ggttccaagtgattgtggagtca

SEQ ID NO: 16331 - DNA, 21 bp, Artificial Sequence
  Synthetic Construct
ccctggtccaatgctcctcaa

SEQ ID NO: 16332 - DNA, 20 bp, Artificial Sequence
  Synthetic Construct
acgtcacagcacgagaaagt

SEQ ID NO: 16333 - DNA, 26 bp, Artificial Sequence
  Synthetic Construct
cagaatcacacaagtgggagatgaca

SEQ ID NO: 16334 - DNA, 20 bp, Artificial Sequence
  Synthetic Construct
ccctggactcttgggcaaat

SEQ ID NO: 16335 - DNA, 24 bp, Artificial Sequence
  Synthetic Construct
ccagccccaaactaagaaactgta

SEQ ID NO: 16336 - DNA, 26 bp, Artificial Sequence
  Synthetic Construct
gaccacacaccattgacatatgagat

SEQ ID NO: 16337 - DNA, 22 bp, Artificial Sequence
  Synthetic Construct
agtggttagagcccagcactga

SEQ ID NO: 16338 - DNA, 19 bp, Artificial Sequence
  Synthetic Construct
cctccgtgtaggccagcat

SEQ ID NO: 16339 - DNA, 21 bp, Artificial Sequence
  Synthetic Construct
ccacagcatctctgggactca

SEQ ID NO: 16340 - DNA, 23 bp, Artificial Sequence
  Synthetic Construct
ggaagccaagaggccaaaacgta

SEQ ID NO: 16341 - DNA, 24 bp, Artificial Sequence
  Synthetic Construct
acttctcgatctctgggtctttct

SEQ ID NO: 16342 - DNA, 25 bp, Artificial Sequence
  Synthetic Construct
gcacaacatcttgcatcctgcgtat

SEQ ID NO: 16343 - DNA, 22 bp, Artificial Sequence
  Synthetic Construct
gctttgggtgggtcatttcctt

SEQ ID NO: 16344 - DNA, 22 bp, Artificial Sequence
  Synthetic Construct
gcggaaatccgtgaccacaaca

SEQ ID NO: 16345 - DNA, 22 bp, Artificial Sequence
  Synthetic Construct
agtttcaccctccaccccattc

SEQ ID NO: 16346 - DNA, 18 bp, Artificial Sequence
  Synthetic Construct
tgctgagcccgtttgtgt

SEQ ID NO: 16347 - DNA, 20 bp, Artificial Sequence
  Synthetic Construct
aggcagcggaatggctcttg

SEQ ID NO: 16348 - DNA, 21 bp, Artificial Sequence
  Synthetic Construct
tggtcttccactgcacaaaca

SEQ ID NO: 16349 - DNA, 20 bp, Artificial Sequence
  Synthetic Construct
aatcgagcccagcagctaca

SEQ ID NO: 16350 - DNA, 24 bp, Artificial Sequence
  Synthetic Construct
cccgcttgaaacctaagcatgaga

SEQ ID NO: 16351 - DNA, 22 bp, Artificial Sequence
  Synthetic Construct
tccagctctgacacttggtaac

SEQ ID NO: 16352 - DNA, 25 bp, Artificial Sequence
  Synthetic Construct
gaggctggacgacttgaaatactca

SEQ ID NO: 16353 - DNA, 21 bp, Artificial Sequence
  Synthetic Construct
tctgctgagtgtctcctccat

SEQ ID NO: 16354 - DNA, 23 bp, Artificial Sequence
  Synthetic Construct
ggccaagtacctgcttacctaac

SEQ ID NO: 16355 - DNA, 24 bp, Artificial Sequence
  Synthetic Construct
ccaccgtgctttggatagataaga

SEQ ID NO: 16356 - DNA, 20 bp, Artificial Sequence
  Synthetic Construct
cgctgttgtggagtgagtgt

SEQ ID NO: 16357 - DNA, 22 bp, Artificial Sequence
  Synthetic Construct
tccccaaccctttccttctcat

SEQ ID NO: 16358 - DNA, 21 bp, Artificial Sequence
  Synthetic Construct
tggctcatcccactcccaaac

SEQ ID NO: 16359 - DNA, 22 bp, Artificial Sequence
  Synthetic Construct
gcagctgcctcggaataagcaa

SEQ ID NO: 16360 - DNA, 22 bp, Artificial Sequence
  Synthetic Construct
ggtcttcgtctgctccggtatt

SEQ ID NO: 16361 - DNA, 25 bp, Artificial Sequence
  Synthetic Construct
ctccccatgtttgggttaactcctt

SEQ ID NO: 16362 - DNA, 24 bp, Artificial Sequence
  Synthetic Construct
gtcctgctttcatgtcccctttag

SEQ ID NO: 16363 - DNA, 21 bp, Artificial Sequence
  Synthetic Construct
ccagagccgcctgaatctcat

SEQ ID NO: 16364 - DNA, 24 bp, Artificial Sequence
  Synthetic Construct
tgaaggccccaatctagtcttagt

SEQ ID NO: 16365 - DNA, 20 bp, Artificial Sequence
  Synthetic Construct
tcagccccggctccagtctt

SEQ ID NO: 16366 - DNA, 24 bp, Artificial Sequence
  Synthetic Construct
caggtctcaccaatgccatcaagt

SEQ ID NO: 16367 - DNA, 21 bp, Artificial Sequence
  Synthetic Construct
agcctcctcttagtggtggaa

SEQ ID NO: 16368 - DNA, 21 bp, Artificial Sequence
  Synthetic Construct
ggccaaacgaaagaggactga

SEQ ID NO: 16369 - DNA, 20 bp, Artificial Sequence
  Synthetic Construct
tgcttgaggctgcacgtagt

SEQ ID NO: 16370 - DNA, 22 bp, Artificial Sequence
  Synthetic Construct
cagggaaaagcccaccttcgat

SEQ ID NO: 16371 - DNA, 24 bp, Artificial Sequence
  Synthetic Construct
ggatacatccccagggagttgaca

SEQ ID NO: 16372 - DNA, 26 bp, Artificial Sequence
  Synthetic Construct
gaggaaaactgctgacttatgggtaa

SEQ ID NO: 16373 - DNA, 27 bp, Artificial Sequence
  Synthetic Construct
gagtgagacacccacttcttttacttg

SEQ ID NO: 16374 - DNA, 20 bp, Artificial Sequence
  Synthetic Construct
tgccatcagcctcagtgaac

SEQ ID NO: 16375 - DNA, 24 bp, Artificial Sequence
  Synthetic Construct
gagtcgaacacagcgctgaaaaac

SEQ ID NO: 16376 - DNA, 22 bp, Artificial Sequence
  Synthetic Construct
ggccttgacacagtccagatga

SEQ ID NO: 16377 - DNA, 20 bp, Artificial Sequence
  Synthetic Construct
caactgaccgcagacgtgtt

SEQ ID NO: 16378 - DNA, 20 bp, Artificial Sequence
  Synthetic Construct
cgcaacttcccaacctcctt

SEQ ID NO: 16379 - DNA, 20 bp, Artificial Sequence
  Synthetic Construct
aagtggacggctgtgactga

SEQ ID NO: 16380 - DNA, 19 bp, Artificial Sequence
  Synthetic Construct
tcagtgccccttccccaat

SEQ ID NO: 16381 - DNA, 23 bp, Artificial Sequence
  Synthetic Construct
gggtctacacctgcaaggactga

SEQ ID NO: 16382 - DNA, 22 bp, Artificial Sequence
  Synthetic Construct
cacacaacacttccgcccacat

SEQ ID NO: 16383 - DNA, 22 bp, Artificial Sequence
  Synthetic Construct
caagcaatatccccagccactt

SEQ ID NO: 16384 - DNA, 23 bp, Artificial Sequence
  Synthetic Construct
ctctgcactgaggactggtttca

SEQ ID NO: 16385 - DNA, 22 bp, Artificial Sequence
  Synthetic Construct
tgcctgacatgtaggaggttct

SEQ ID NO: 16386 - DNA, 20 bp, Artificial Sequence
  Synthetic Construct
cagagtctgggcacctcgtt

SEQ ID NO: 16387 - DNA, 23 bp, Artificial Sequence
  Synthetic Construct
actccgcagggagccttatctac

SEQ ID NO: 16388 - DNA, 26 bp, Artificial Sequence
  Synthetic Construct
gaaggttccttgacataacaggtttc

SEQ ID NO: 16389 - DNA, 24 bp, Artificial Sequence
  Synthetic Construct
ccctctgtgtctttcgtgctactt

SEQ ID NO: 16390 - DNA, 23 bp, Artificial Sequence
  Synthetic Construct
ccctgaattctcccttgcctaac

SEQ ID NO: 16391 - DNA, 22 bp, Artificial Sequence
  Synthetic Construct
gccccaaagtggcagagttttg

SEQ ID NO: 16392 - DNA, 22 bp, Artificial Sequence
  Synthetic Construct
gccggactgagaaatgcctgaa

SEQ ID NO: 16393 - DNA, 23 bp, Artificial Sequence
  Synthetic Construct
ggatgcctacgtttctggtgaga

SEQ ID NO: 16394 - DNA, 20 bp, Artificial Sequence
  Synthetic Construct
ggcgtcctagagggacgtaa

SEQ ID NO: 16395 - DNA, 23 bp, Artificial Sequence
  Synthetic Construct
gctgctggaattggaccttttac

SEQ ID NO: 16396 - DNA, 21 bp, Artificial Sequence
  Synthetic Construct
tggtggtcatccccactttct

SEQ ID NO: 16397 - DNA, 25 bp, Artificial Sequence
  Synthetic Construct
ctcgatgcttgtggttttactgttc

SEQ ID NO: 16398 - DNA, 26 bp, Artificial Sequence
  Synthetic Construct
tcgggagttaaccccaaatagtaaac

SEQ ID NO: 16399 - DNA, 23 bp, Artificial Sequence
  Synthetic Construct
cctccactgggtgaagtttgaag

SEQ ID NO: 16400 - DNA, 19 bp, Artificial Sequence
  Synthetic Construct
tcggctctcagggcgtatc

SEQ ID NO: 16401 - DNA, 21 bp, Artificial Sequence
  Synthetic Construct
aggaaggaccccatggctcta

SEQ ID NO: 16402 - DNA, 25 bp, Artificial Sequence
  Synthetic Construct
tcgtgtttgattgacccatgttact

SEQ ID NO: 16403 - DNA, 27 bp, Artificial Sequence
  Synthetic Construct
gggaccaagtcaaaccaagagtctttc

SEQ ID NO: 16404 - DNA, 26 bp, Artificial Sequence
  Synthetic Construct
gctatggaaagttttctggtggagtt

SEQ ID NO: 16405 - DNA, 26 bp, Artificial Sequence
  Synthetic Construct
cctcagagacagatgccattgaatta

SEQ ID NO: 16406 - DNA, 23 bp, Artificial Sequence
  Synthetic Construct
cttctggaggacttgggttgaga

SEQ ID NO: 16407 - DNA, 24 bp, Artificial Sequence
  Synthetic Construct
ccctttcttggccagactaacagt

SEQ ID NO: 16408 - DNA, 23 bp, Artificial Sequence
  Synthetic Construct
gcaaggtgctgaagctattcaag

SEQ ID NO: 16409 - DNA, 22 bp, Artificial Sequence
  Synthetic Construct
accagcagcagaggaggatgta

SEQ ID NO: 16410 - DNA, 24 bp, Artificial Sequence
  Synthetic Construct
gccccttgagagtcttgcaggaaa

SEQ ID NO: 16411 - DNA, 23 bp, Artificial Sequence
  Synthetic Construct
tccgtgtgtagtctctccagtag

SEQ ID NO: 16412 - DNA, 21 bp, Artificial Sequence
  Synthetic Construct
cactttgccagtcccgtctaa

SEQ ID NO: 16413 - DNA, 23 bp, Artificial Sequence
  Synthetic Construct
ggtggttgggagtcacctactga

SEQ ID NO: 16414 - DNA, 19 bp, Artificial Sequence
  Synthetic Construct
agccttggccgtgggagat

SEQ ID NO: 16415 - DNA, 21 bp, Artificial Sequence
  Synthetic Construct
acatacctttgcgagctggtt

SEQ ID NO: 16416 - DNA, 23 bp, Artificial Sequence
  Synthetic Construct
ggcttagaccaggagtggaatga

SEQ ID NO: 16417 - DNA, 24 bp, Artificial Sequence
  Synthetic Construct
cgggataggagactttggttggtt

SEQ ID NO: 16418 - DNA, 23 bp, Artificial Sequence
  Synthetic Construct
ctggagccatcactgataccttt

SEQ ID NO: 16419 - DNA, 22 bp, Artificial Sequence
  Synthetic Construct
cctgctgtgaaaggtggtgaga

SEQ ID NO: 16420 - DNA, 25 bp, Artificial Sequence
  Synthetic Construct
ggccttgtaattctacgcaccagat

SEQ ID NO: 16421 - DNA, 25 bp, Artificial Sequence
  Synthetic Construct
ccaacgtgtcaatatgctgttgatt

SEQ ID NO: 16422 - DNA, 18 bp, Artificial Sequence
  Synthetic Construct
ggggcttgcatccccttt

SEQ ID NO: 16423 - DNA, 22 bp, Artificial Sequence
  Synthetic Construct
ggcactacctcacttcctttgt

SEQ ID NO: 16424 - DNA, 23 bp, Artificial Sequence
  Synthetic Construct
gtggtttctggcttttggaggaa

SEQ ID NO: 16425 - DNA, 24 bp, Artificial Sequence
  Synthetic Construct
ctctccctccctcaagtacacaga

SEQ ID NO: 16426 - DNA, 25 bp, Artificial Sequence
  Synthetic Construct
acccaggcatgttagtgtttttcta

SEQ ID NO: 16427 - DNA, 22 bp, Artificial Sequence
  Synthetic Construct
gcctgtgtggtccctcttcttc

SEQ ID NO: 16428 - DNA, 26 bp, Artificial Sequence
  Synthetic Construct
ctgaaaggaccaggctaataatgact

SEQ ID NO: 16429 - DNA, 22 bp, Artificial Sequence
  Synthetic Construct
ttcagagtcgggcactccatag

SEQ ID NO: 16430 - DNA, 24 bp, Artificial Sequence
  Synthetic Construct
gctctcggagaaagacttgagtaa

SEQ ID NO: 16431 - DNA, 19 bp, Artificial Sequence
  Synthetic Construct
ccaggcctcagcctgtgtt

SEQ ID NO: 16432 - DNA, 23 bp, Artificial Sequence
  Synthetic Construct
gggaatgcatcttccccaactgt

SEQ ID NO: 16433 - DNA, 24 bp, Artificial Sequence
  Synthetic Construct
aatctaaagtccagagcagcaagt

SEQ ID NO: 16434 - DNA, 23 bp, Artificial Sequence
  Synthetic Construct
ggagccgaaagaaggcttttaga

SEQ ID NO: 16435 - DNA, 22 bp, Artificial Sequence
  Synthetic Construct
tggggcactggaaagtaagttg

SEQ ID NO: 16436 - DNA, 21 bp, Artificial Sequence
  Synthetic Construct
gggccctttgtgactgtgttc

SEQ ID NO: 16437 - DNA, 23 bp, Artificial Sequence
  Synthetic Construct
gccagacaatgtgaggtgctgat

SEQ ID NO: 16438 - DNA, 19 bp, Artificial Sequence
  Synthetic Construct
tgggtggggatgggtaaca

SEQ ID NO: 16439 - DNA, 24 bp, Artificial Sequence
  Synthetic Construct
gcgagacaaaaggggatattcaag

SEQ ID NO: 16440 - DNA, 23 bp, Artificial Sequence
  Synthetic Construct
cgagtaagtcaggtctccagatg

SEQ ID NO: 16441 - DNA, 21 bp, Artificial Sequence
  Synthetic Construct
ggggatggcatcattgtgaga

SEQ ID NO: 16442 - DNA, 22 bp, Artificial Sequence
  Synthetic Construct
ctgggaacgacagagaatcaca

SEQ ID NO: 16443 - DNA, 25 bp, Artificial Sequence
  Synthetic Construct
ggatcatgcagagagagctgagaca

SEQ ID NO: 16444 - DNA, 19 bp, Artificial Sequence
  Synthetic Construct
gagccgtggctctgtcact

SEQ ID NO: 16445 - DNA, 24 bp, Artificial Sequence
  Synthetic Construct
cactccttctcctgtggggatttg

SEQ ID NO: 16446 - DNA, 25 bp, Artificial Sequence
  Synthetic Construct
cggtagatctgatcctggaacttct

SEQ ID NO: 16447 - DNA, 21 bp, Artificial Sequence
  Synthetic Construct
ccttgctgctcattggcttct

SEQ ID NO: 16448 - DNA, 24 bp, Artificial Sequence
  Synthetic Construct
ctcttcatcttagccagtccactt

SEQ ID NO: 16449 - DNA, 22 bp, Artificial Sequence
  Synthetic Construct
ggcttgtccaaggtccatgata

SEQ ID NO: 16450 - DNA, 20 bp, Artificial Sequence
  Synthetic Construct
tccagggagggctggagact

SEQ ID NO: 16451 - DNA, 22 bp, Artificial Sequence
  Synthetic Construct
gggccacgcaattttcctgtga

SEQ ID NO: 16452 - DNA, 23 bp, Artificial Sequence
  Synthetic Construct
gtagtggggatctgacctaggaa

SEQ ID NO: 16453 - DNA, 19 bp, Artificial Sequence
  Synthetic Construct
ccaccatcggcccatgtca

SEQ ID NO: 16454 - DNA, 19 bp, Artificial Sequence
  Synthetic Construct
acgggagggcagtgagctt

SEQ ID NO: 16455 - DNA, 22 bp, Artificial Sequence
  Synthetic Construct
tggtggtgtgtgcctgtagttc

SEQ ID NO: 16456 - DNA, 22 bp, Artificial Sequence
  Synthetic Construct
cccacacacagaacgtggaaac

SEQ ID NO: 16457 - DNA, 22 bp, Artificial Sequence
  Synthetic Construct
gaagagcaggaggaggcaagaa

SEQ ID NO: 16458 - DNA, 22 bp, Artificial Sequence
  Synthetic Construct
gccaaactggctgggttacatc

SEQ ID NO: 16459 - DNA, 23 bp, Artificial Sequence
  Synthetic Construct
gtgggtaatgacagcaactgaga

SEQ ID NO: 16460 - DNA, 22 bp, Artificial Sequence
  Synthetic Construct
ggccctgggaagacttcaacaa

SEQ ID NO: 16461 - DNA, 22 bp, Artificial Sequence
  Synthetic Construct
ccagaggccttgccagaacatt

SEQ ID NO: 16462 - DNA, 23 bp, Artificial Sequence
  Synthetic Construct
aacccaggagactcagggtctgt

SEQ ID NO: 16463 - DNA, 22 bp, Artificial Sequence
  Synthetic Construct
gcggttgtgagaaacacactga

SEQ ID NO: 16464 - DNA, 22 bp, Artificial Sequence
  Synthetic Construct
actatcatcgctcccgaaggaa

SEQ ID NO: 16465 - DNA, 19 bp, Artificial Sequence
  Synthetic Construct
gctgagcctggacgcttgt

SEQ ID NO: 16466 - DNA, 20 bp, Artificial Sequence
  Synthetic Construct
tccccttgcaagaccgattg

SEQ ID NO: 16467 - DNA, 24 bp, Artificial Sequence
  Synthetic Construct
gttctactcggcttctggaaagat

SEQ ID NO: 16468 - DNA, 22 bp, Artificial Sequence
  Synthetic Construct
cactcccgggttttgtgtgaat

SEQ ID NO: 16469 - DNA, 19 bp, Artificial Sequence
  Synthetic Construct
actgcccacccctcaaaac

SEQ ID NO: 16470 - DNA, 22 bp, Artificial Sequence
  Synthetic Construct
gctagaccctccctcccaatgt

SEQ ID NO: 16471 - DNA, 19 bp, Artificial Sequence
  Synthetic Construct
cagaaccccagcgcgatct

SEQ ID NO: 16472 - DNA, 19 bp, Artificial Sequence
  Synthetic Construct
agcggagcctgggcaatgt

SEQ ID NO: 16473 - DNA, 22 bp, Artificial Sequence
  Synthetic Construct
gccggtgccattcgtatccatt

SEQ ID NO: 16474 - DNA, 23 bp, Artificial Sequence
  Synthetic Construct
cgaagtcccaatggcaactttca

SEQ ID NO: 16475 - DNA, 21 bp, Artificial Sequence
  Synthetic Construct
ggtcgcggattgtgctgtcta

SEQ ID NO: 16476 - DNA, 20 bp, Artificial Sequence
  Synthetic Construct
acggggccaacgaggggaat

SEQ ID NO: 16477 - DNA, 22 bp, Artificial Sequence
  Synthetic Construct
ccaggcccaaacccactacaaa

SEQ ID NO: 16478 - DNA, 22 bp, Artificial Sequence
  Synthetic Construct
ggagttttgcacagggacttct

SEQ ID NO: 16479 - DNA, 21 bp, Artificial Sequence
  Synthetic Construct
cagtgggaaagccacggacat

SEQ ID NO: 16480 - DNA, 23 bp, Artificial Sequence
  Synthetic Construct
ggcataggggaccaggaaagtct

SEQ ID NO: 16481 - DNA, 23 bp, Artificial Sequence
  Synthetic Construct
gggtttgactcatgggagtgtgt

SEQ ID NO: 16482 - DNA, 21 bp, Artificial Sequence
  Synthetic Construct
ccccttcctggatttgcttct

SEQ ID NO: 16483 - DNA, 25 bp, Artificial Sequence
  Synthetic Construct
gagagaactgtagtggcgattttct

SEQ ID NO: 16484 - DNA, 22 bp, Artificial Sequence
  Synthetic Construct
tgccaaggtgtcctgtctgttc

SEQ ID NO: 16485 - DNA, 23 bp, Artificial Sequence
  Synthetic Construct
gcgttgaaactgtgctctcaact

SEQ ID NO: 16486 - DNA, 23 bp, Artificial Sequence
  Synthetic Construct
gcccacatgtgttactggtggat

SEQ ID NO: 16487 - DNA, 19 bp, Artificial Sequence
  Synthetic Construct
gcaggcagccgtgagcata

SEQ ID NO: 16488 - DNA, 21 bp, Artificial Sequence
  Synthetic Construct
ctctgcctcacccattcttgt

SEQ ID NO: 16489 - DNA, 20 bp, Artificial Sequence
  Synthetic Construct
agttgaaggcgctggagaag

SEQ ID NO: 16490 - DNA, 19 bp, Artificial Sequence
  Synthetic Construct
acgcacacaccggcataca

SEQ ID NO: 16491 - DNA, 21 bp, Artificial Sequence
  Synthetic Construct
ccaaatggccagctgtgaagt

SEQ ID NO: 16492 - DNA, 24 bp, Artificial Sequence
  Synthetic Construct
ggctgtccagaattggactttatg

SEQ ID NO: 16493 - DNA, 20 bp, Artificial Sequence
  Synthetic Construct
aggctgcccttaagcacgtt

SEQ ID NO: 16494 - DNA, 23 bp, Artificial Sequence
  Synthetic Construct
caggtcaacgtctcatcttcgtt

SEQ ID NO: 16495 - DNA, 19 bp, Artificial Sequence
  Synthetic Construct
tctgccaaggggtcaccat

SEQ ID NO: 16496 - DNA, 21 bp, Artificial Sequence
  Synthetic Construct
gcatcagtgcccattcacaca

SEQ ID NO: 16497 - DNA, 26 bp, Artificial Sequence
  Synthetic Construct
ccgagttccagccatttgtaaagttc

SEQ ID NO: 16498 - DNA, 22 bp, Artificial Sequence
  Synthetic Construct
gcccttcaggcttctgtgagta

SEQ ID NO: 16499 - DNA, 23 bp, Artificial Sequence
  Synthetic Construct
gctacacttccagctagcacttg

SEQ ID NO: 16500 - DNA, 21 bp, Artificial Sequence
  Synthetic Construct
ggctcacatgctttccagtga

SEQ ID NO: 16501 - DNA, 21 bp, Artificial Sequence
  Synthetic Construct
ctggccagaactgtgtgtcat

SEQ ID NO: 16502 - DNA, 23 bp, Artificial Sequence
  Synthetic Construct
caatcctcccacctccagagtag

SEQ ID NO: 16503 - DNA, 19 bp, Artificial Sequence
  Synthetic Construct
agccatgcccacccactga

SEQ ID NO: 16504 - DNA, 23 bp, Artificial Sequence
  Synthetic Construct
accccacaatttccactcattct

SEQ ID NO: 16505 - DNA, 23 bp, Artificial Sequence
  Synthetic Construct
cggcccttgttacatatccagtt

SEQ ID NO: 16506 - DNA, 20 bp, Artificial Sequence
  Synthetic Construct
caggccagggagagctttgt

SEQ ID NO: 16507 - DNA, 22 bp, Artificial Sequence
  Synthetic Construct
cccagagcatagaagccgatca

SEQ ID NO: 16508 - DNA, 24 bp, Artificial Sequence
  Synthetic Construct
ccacctttacccaggagaaactca

SEQ ID NO: 16509 - DNA, 24 bp, Artificial Sequence
  Synthetic Construct
tgctctgatacacgaaaagcatgt

SEQ ID NO: 16510 - DNA, 22 bp, Artificial Sequence
  Synthetic Construct
ccagaaacagcaggggaattgt

SEQ ID NO: 16511 - DNA, 21 bp, Artificial Sequence
  Synthetic Construct
atgccccagggaagaccattc

SEQ ID NO: 16512 - DNA, 22 bp, Artificial Sequence
  Synthetic Construct
gcgaagcaccaaagggtgatgt

SEQ ID NO: 16513 - DNA, 19 bp, Artificial Sequence
  Synthetic Construct
aggcttggccttgctttca

SEQ ID NO: 16514 - DNA, 20 bp, Artificial Sequence
  Synthetic Construct
ccgggcgtgtttgacttaca

SEQ ID NO: 16515 - DNA, 22 bp, Artificial Sequence
  Synthetic Construct
ccaaaggtgtaagtcgcagtct

SEQ ID NO: 16516 - DNA, 23 bp, Artificial Sequence
  Synthetic Construct
ctggaaggtctgtggggtctgta

SEQ ID NO: 16517 - DNA, 23 bp, Artificial Sequence
  Synthetic Construct
gctctgtgcttcctcatctgctt

SEQ ID NO: 16518 - DNA, 22 bp, Artificial Sequence
  Synthetic Construct
cttcatcagggccagaatcctt

SEQ ID NO: 16519 - DNA, 20 bp, Artificial Sequence
  Synthetic Construct
tccatctcccaccacctgtt

SEQ ID NO: 16520 - DNA, 21 bp, Artificial Sequence
  Synthetic Construct
cgcggtaactccacaatcaca

SEQ ID NO: 16521 - DNA, 21 bp, Artificial Sequence
  Synthetic Construct
gcagttggcaagacagcaaga

SEQ ID NO: 16522 - DNA, 24 bp, Artificial Sequence
  Synthetic Construct
cactggcttggaacatgaggctta

SEQ ID NO: 16523 - DNA, 22 bp, Artificial Sequence
  Synthetic Construct
acagtcctcactccacgtcaca

SEQ ID NO: 16524 - DNA, 25 bp, Artificial Sequence
  Synthetic Construct
ggccatgggatctctgtgataacta

SEQ ID NO: 16525 - DNA, 27 bp, Artificial Sequence
  Synthetic Construct
gttagcctctgactattccttacatca

SEQ ID NO: 16526 - DNA, 22 bp, Artificial Sequence
  Synthetic Construct
tggtgcaatgcctccttaagtt

SEQ ID NO: 16527 - DNA, 21 bp, Artificial Sequence
  Synthetic Construct
aaacgctgcctccctgctcaa

SEQ ID NO: 16528 - DNA, 23 bp, Artificial Sequence
  Synthetic Construct
gttcattctaggaggcagtggaa

SEQ ID NO: 16529 - DNA, 20 bp, Artificial Sequence
  Synthetic Construct
atcccacaggtggggagctt

SEQ ID NO: 16530 - DNA, 21 bp, Artificial Sequence
  Synthetic Construct
acaggagtgcctggctaatga

SEQ ID NO: 16531 - DNA, 20 bp, Artificial Sequence
  Synthetic Construct
tggccacaccaccctagctt

SEQ ID NO: 16532 - DNA, 24 bp, Artificial Sequence
  Synthetic Construct
gctcaaatccacccagaggtcaca

SEQ ID NO: 16533 - DNA, 21 bp, Artificial Sequence
  Synthetic Construct
caaggagaagacggcctgcaa

SEQ ID NO: 16534 - DNA, 22 bp, Artificial Sequence
  Synthetic Construct
acgtgcactgaataccggaaag

SEQ ID NO: 16535 - DNA, 20 bp, Artificial Sequence
  Synthetic Construct
aacccacgaacagcctcact

SEQ ID NO: 16536 - DNA, 22 bp, Artificial Sequence
  Synthetic Construct
cgtctgctgcgctgttagaaac

SEQ ID NO: 16537 - DNA, 22 bp, Artificial Sequence
  Synthetic Construct
tgtgactggaggtggcatcact

SEQ ID NO: 16538 - DNA, 25 bp, Artificial Sequence
  Synthetic Construct
cacgtgtgttctacctgatgctgaa

SEQ ID NO: 16539 - DNA, 21 bp, Artificial Sequence
  Synthetic Construct
ggagagagggtctcaccttgt

SEQ ID NO: 16540 - DNA, 20 bp, Artificial Sequence
  Synthetic Construct
tttcaccgccgcacagagaa

SEQ ID NO: 16541 - DNA, 20 bp, Artificial Sequence
  Synthetic Construct
tcaacgccccgggccaattc

SEQ ID NO: 16542 - DNA, 26 bp, Artificial Sequence
  Synthetic Construct
ccttgaagtccattttcaccagtatg

SEQ ID NO: 16543 - DNA, 22 bp, Artificial Sequence
  Synthetic Construct
acacccaatgagcttggtttga

SEQ ID NO: 16544 - DNA, 21 bp, Artificial Sequence
  Synthetic Construct
atccagccttctgggccattc

SEQ ID NO: 16545 - DNA, 23 bp, Artificial Sequence
  Synthetic Construct
cctcctcccctcttgcacagtta

SEQ ID NO: 16546 - DNA, 26 bp, Artificial Sequence
  Synthetic Construct
ctctctagttcaagctccttgcttgt

SEQ ID NO: 16547 - DNA, 21 bp, Artificial Sequence
  Synthetic Construct
catgctggggacagactctca

SEQ ID NO: 16548 - DNA, 26 bp, Artificial Sequence
  Synthetic Construct
ccagaaatgtggcttagaggaaggaa

SEQ ID NO: 16549 - DNA, 20 bp, Artificial Sequence
  Synthetic Construct
gctggggtgggattgcttga

SEQ ID NO: 16550 - DNA, 22 bp, Artificial Sequence
  Synthetic Construct
cattagcagcggacaggaccaa

SEQ ID NO: 16551 - DNA, 24 bp, Artificial Sequence
  Synthetic Construct
ggagaccggtgttttcttctcttg

SEQ ID NO: 16552 - DNA, 21 bp, Artificial Sequence
  Synthetic Construct
caaaggcactgacaggtgtgt

SEQ ID NO: 16553 - DNA, 22 bp, Artificial Sequence
  Synthetic Construct
tccattcccctactcccagcat

SEQ ID NO: 16554 - DNA, 22 bp, Artificial Sequence
  Synthetic Construct
gggagcaagagtggatcgttct

SEQ ID NO: 16555 - DNA, 22 bp, Artificial Sequence
  Synthetic Construct
gtgagtctaggcttcccagcaa

SEQ ID NO: 16556 - DNA, 21 bp, Artificial Sequence
  Synthetic Construct
cgcgttcacaaatcgctcttc

SEQ ID NO: 16557 - DNA, 25 bp, Artificial Sequence
  Synthetic Construct
cccttgtttctttcctcagggctaa

SEQ ID NO: 16558 - DNA, 20 bp, Artificial Sequence
  Synthetic Construct
aacgcccagctgaggtttga

SEQ ID NO: 16559 - DNA, 20 bp, Artificial Sequence
  Synthetic Construct
cttttcccgcgtgctgtgat

SEQ ID NO: 16560 - DNA, 22 bp, Artificial Sequence
  Synthetic Construct
gttatgtgggaagaccccaaca

SEQ ID NO: 16561 - DNA, 23 bp, Artificial Sequence
  Synthetic Construct
gcctgggaaacttgtgaatggaa

SEQ ID NO: 16562 - DNA, 22 bp, Artificial Sequence
  Synthetic Construct
ccgcttgaaaagccacctgcta

SEQ ID NO: 16563 - DNA, 22 bp, Artificial Sequence
  Synthetic Construct
cttcacctggaacccagaaaca

SEQ ID NO: 16564 - DNA, 21 bp, Artificial Sequence
  Synthetic Construct
ggcacccagcaactggatctt

SEQ ID NO: 16565 - DNA, 20 bp, Artificial Sequence
  Synthetic Construct
gccaacacaggcaggattga

SEQ ID NO: 16566 - DNA, 22 bp, Artificial Sequence
  Synthetic Construct
atcttccttgccctggagtcta

SEQ ID NO: 16567 - DNA, 20 bp, Artificial Sequence
  Synthetic Construct
tgcggatgcggtttccttct

SEQ ID NO: 16568 - DNA, 24 bp, Artificial Sequence
  Synthetic Construct
ggaagttggggaaacaggaggata

SEQ ID NO: 16569 - DNA, 20 bp, Artificial Sequence
  Synthetic Construct
gcgaggttagccagggttag

SEQ ID NO: 16570 - DNA, 23 bp, Artificial Sequence
  Synthetic Construct
ccacttggcagtgagggtatttc

SEQ ID NO: 16571 - DNA, 20 bp, Artificial Sequence
  Synthetic Construct
tgccagccccagtcctgtga

SEQ ID NO: 16572 - DNA, 20 bp, Artificial Sequence
  Synthetic Construct
cactgcagcttgagccaaca

SEQ ID NO: 16573 - DNA, 22 bp, Artificial Sequence
  Synthetic Construct
gggcgctgtgacttagaacaag

SEQ ID NO: 16574 - DNA, 21 bp, Artificial Sequence
  Synthetic Construct
gcaatggcatccttgggaaga

SEQ ID NO: 16575 - DNA, 19 bp, Artificial Sequence
  Synthetic Construct
tggtcccctgttgctcact

SEQ ID NO: 16576 - DNA, 18 bp, Artificial Sequence
  Synthetic Construct
agcggcgcagtgagtaca

SEQ ID NO: 16577 - DNA, 20 bp, Artificial Sequence
  Synthetic Construct
cacactggctccaggacact

SEQ ID NO: 16578 - DNA, 21 bp, Artificial Sequence
  Synthetic Construct
cagtggcaggtccatgttttg

SEQ ID NO: 16579 - DNA, 21 bp, Artificial Sequence
  Synthetic Construct
gcctcagctcctcctgggtaa

SEQ ID NO: 16580 - DNA, 22 bp, Artificial Sequence
  Synthetic Construct
gctgtgggtcttgctctgcttt

SEQ ID NO: 16581 - DNA, 22 bp, Artificial Sequence
  Synthetic Construct
ccccacagcaaggacataggaa

SEQ ID NO: 16582 - DNA, 21 bp, Artificial Sequence
  Synthetic Construct
gttccccaacaaggggcatct

SEQ ID NO: 16583 - DNA, 20 bp, Artificial Sequence
  Synthetic Construct
agctgggtgtgcctttgatg

SEQ ID NO: 16584 - DNA, 20 bp, Artificial Sequence
  Synthetic Construct
gcctttctcgtgacccttgt

SEQ ID NO: 16585 - DNA, 21 bp, Artificial Sequence
  Synthetic Construct
gtggagttggcggtggatgta

SEQ ID NO: 16586 - DNA, 26 bp, Artificial Sequence
  Synthetic Construct
tcctagaaacgtgacgtgtaatgtag

SEQ ID NO: 16587 - DNA, 22 bp, Artificial Sequence
  Synthetic Construct
cccgggctcatttagtgtgtgt

SEQ ID NO: 16588 - DNA, 23 bp, Artificial Sequence
  Synthetic Construct
ccccaggcgtttctaaacaatca

SEQ ID NO: 16589 - DNA, 20 bp, Artificial Sequence
  Synthetic Construct
aatttccagggtgcgtggtt

SEQ ID NO: 16590 - DNA, 21 bp, Artificial Sequence
  Synthetic Construct
ccagcccagcctatgtgctaa

SEQ ID NO: 16591 - DNA, 26 bp, Artificial Sequence
  Synthetic Construct
cctttggtgagtgaattggtctttga

SEQ ID NO: 16592 - DNA, 26 bp, Artificial Sequence
  Synthetic Construct
ccagctccttataggggctattaaac

SEQ ID NO: 16593 - DNA, 22 bp, Artificial Sequence
  Synthetic Construct
ggacaggtggtctagcttggaa

SEQ ID NO: 16594 - DNA, 20 bp, Artificial Sequence
  Synthetic Construct
gcaccacttgcttgctcagt

SEQ ID NO: 16595 - DNA, 25 bp, Artificial Sequence
  Synthetic Construct
ctcaaccaaagctctttaacacagt

SEQ ID NO: 16596 - DNA, 19 bp, Artificial Sequence
  Synthetic Construct
agctctgggacgggcaaac

SEQ ID NO: 16597 - DNA, 22 bp, Artificial Sequence
  Synthetic Construct
tggaacagcccctctgtgtgta

SEQ ID NO: 16598 - DNA, 26 bp, Artificial Sequence
  Synthetic Construct
actttccctgcacctttatacacttc

SEQ ID NO: 16599 - DNA, 23 bp, Artificial Sequence
  Synthetic Construct
cacaacccacccatcagtcattg

SEQ ID NO: 16600 - DNA, 23 bp, Artificial Sequence
  Synthetic Construct
ccagaaaccatgccattatgcaa

SEQ ID NO: 16601 - DNA, 20 bp, Artificial Sequence
  Synthetic Construct
gagcagccaatgcacagtca

SEQ ID NO: 16602 - DNA, 25 bp, Artificial Sequence
  Synthetic Construct
tgttcagacctcttggaaattgcat

SEQ ID NO: 16603 - DNA, 22 bp, Artificial Sequence
  Synthetic Construct
ccctggctttggtttcctttca

SEQ ID NO: 16604 - DNA, 18 bp, Artificial Sequence
  Synthetic Construct
acgcacgggaagctgaaa

SEQ ID NO: 16605 - DNA, 23 bp, Artificial Sequence
  Synthetic Construct
gaaccttgacgctagagctttga

SEQ ID NO: 16606 - DNA, 23 bp, Artificial Sequence
  Synthetic Construct
ctgttggtctgacatgccctgat

SEQ ID NO: 16607 - DNA, 22 bp, Artificial Sequence
  Synthetic Construct
agctagaatagcccctgagtgt

SEQ ID NO: 16608 - DNA, 25 bp, Artificial Sequence
  Synthetic Construct
gctccaaagtgataaggaaggatga

SEQ ID NO: 16609 - DNA, 24 bp, Artificial Sequence
  Synthetic Construct
ggatgcagcaaaggcagatctaag

SEQ ID NO: 16610 - DNA, 21 bp, Artificial Sequence
  Synthetic Construct
cttgctggatgctcagcttgt

SEQ ID NO: 16611 - DNA, 22 bp, Artificial Sequence
  Synthetic Construct
atcagcccagtggtatgtcaag

SEQ ID NO: 16612 - DNA, 26 bp, Artificial Sequence
  Synthetic Construct
ggaaggctgataagagcagtttgtga

SEQ ID NO: 16613 - DNA, 23 bp, Artificial Sequence
  Synthetic Construct
ctgtctggacacggagcagataa

SEQ ID NO: 16614 - DNA, 21 bp, Artificial Sequence
  Synthetic Construct
tggcaccaagccaagggatct

SEQ ID NO: 16615 - DNA, 24 bp, Artificial Sequence
  Synthetic Construct
catagattgccccacttctaggtt

SEQ ID NO: 16616 - DNA, 19 bp, Artificial Sequence
  Synthetic Construct
tctcaccgcagccttccta

SEQ ID NO: 16617 - DNA, 18 bp, Artificial Sequence
  Synthetic Construct
tgggagctagcccacgtt

SEQ ID NO: 16618 - DNA, 22 bp, Artificial Sequence
  Synthetic Construct
tacccagtccacctccaacaca

SEQ ID NO: 16619 - DNA, 25 bp, Artificial Sequence
  Synthetic Construct
gctctgggagaaaagataggcaatg

SEQ ID NO: 16620 - DNA, 22 bp, Artificial Sequence
  Synthetic Construct
ataggccggtctgaaggaggaa

SEQ ID NO: 16621 - DNA, 23 bp, Artificial Sequence
  Synthetic Construct
ctgccatttctttgggactgatg

SEQ ID NO: 16622 - DNA, 27 bp, Artificial Sequence
  Synthetic Construct
cctctcctttgacatatttccttcagt

SEQ ID NO: 16623 - DNA, 24 bp, Artificial Sequence
  Synthetic Construct
cttggtcaaggtccattggttaga

SEQ ID NO: 16624 - DNA, 23 bp, Artificial Sequence
  Synthetic Construct
ctggaggatgaggggagagaact

SEQ ID NO: 16625 - DNA, 20 bp, Artificial Sequence
  Synthetic Construct
accccatctctgccactgtt

SEQ ID NO: 16626 - DNA, 21 bp, Artificial Sequence
  Synthetic Construct
ccttctgcctccccttgaaat

SEQ ID NO: 16627 - DNA, 22 bp, Artificial Sequence
  Synthetic Construct
gtgcctttgagacctcctggat

SEQ ID NO: 16628 - DNA, 25 bp, Artificial Sequence
  Synthetic Construct
cagagagagtcatgtgggtatgttt

SEQ ID NO: 16629 - DNA, 24 bp, Artificial Sequence
  Synthetic Construct
agtgagcccatgcataactgatac

SEQ ID NO: 16630 - DNA, 21 bp, Artificial Sequence
  Synthetic Construct
gtctttgcttggcctgctgta

SEQ ID NO: 16631 - DNA, 25 bp, Artificial Sequence
  Synthetic Construct
ctgctgctgttaaaagatgggaaca

SEQ ID NO: 16632 - DNA, 24 bp, Artificial Sequence
  Synthetic Construct
tctagctaatggagaggctgagat

SEQ ID NO: 16633 - DNA, 24 bp, Artificial Sequence
  Synthetic Construct
ggggcagtgagtattgtctaatga

SEQ ID NO: 16634 - DNA, 20 bp, Artificial Sequence
  Synthetic Construct
gcagctgtgccatgttgtga

SEQ ID NO: 16635 - DNA, 26 bp, Artificial Sequence
  Synthetic Construct
gcttcctcatcatcttccggtctttg

SEQ ID NO: 16636 - DNA, 22 bp, Artificial Sequence
  Synthetic Construct
tcttctggaacaagcccaacaa

SEQ ID NO: 16637 - DNA, 22 bp, Artificial Sequence
  Synthetic Construct
ggttgtgaggggcaaagcttga

SEQ ID NO: 16638 - DNA, 19 bp, Artificial Sequence
  Synthetic Construct
gtcagctccctgggccata

SEQ ID NO: 16639 - DNA, 25 bp, Artificial Sequence
  Synthetic Construct
ccgtaaaccatttgcacagcacatt

SEQ ID NO: 16640 - DNA, 22 bp, Artificial Sequence
  Synthetic Construct
ctcagttggccctgtggtaatg

SEQ ID NO: 16641 - DNA, 20 bp, Artificial Sequence
  Synthetic Construct
aggccacagtgaccgagtct

SEQ ID NO: 16642 - DNA, 20 bp, Artificial Sequence
  Synthetic Construct
tccggagccgggatctttag

SEQ ID NO: 16643 - DNA, 23 bp, Artificial Sequence
  Synthetic Construct
ggcattgcaactaccctgtgtga

SEQ ID NO: 16644 - DNA, 20 bp, Artificial Sequence
  Synthetic Construct
cctgggctttgccttcttca

SEQ ID NO: 16645 - DNA, 22 bp, Artificial Sequence
  Synthetic Construct
ctgctctatgccatgggtctga

SEQ ID NO: 16646 - DNA, 21 bp, Artificial Sequence
  Synthetic Construct
tggcaggcttccctcaacatc

SEQ ID NO: 16647 - DNA, 24 bp, Artificial Sequence
  Synthetic Construct
acctccattcaacggatgagaaaa

SEQ ID NO: 16648 - DNA, 22 bp, Artificial Sequence
  Synthetic Construct
gatagcccagccagtgttctca

SEQ ID NO: 16649 - DNA, 20 bp, Artificial Sequence
  Synthetic Construct
ggaagcctcctgccagattt

SEQ ID NO: 16650 - DNA, 22 bp, Artificial Sequence
  Synthetic Construct
aggacctcagaagggagcaact

SEQ ID NO: 16651 - DNA, 24 bp, Artificial Sequence
  Synthetic Construct
gggagggttgcaaattctaactca

SEQ ID NO: 16652 - DNA, 22 bp, Artificial Sequence
  Synthetic Construct
ggatgaaaggctctgggagaag

SEQ ID NO: 16653 - DNA, 21 bp, Artificial Sequence
  Synthetic Construct
ggatggctgctgccctcttta

SEQ ID NO: 16654 - DNA, 22 bp, Artificial Sequence
  Synthetic Construct
ccatttcatggggcatgacgaa

SEQ ID NO: 16655 - DNA, 24 bp, Artificial Sequence
  Synthetic Construct
caacatagccccaaaagacctcat

SEQ ID NO: 16656 - DNA, 24 bp, Artificial Sequence
  Synthetic Construct
actttgattgtgtcactgctgtct

SEQ ID NO: 16657 - DNA, 20 bp, Artificial Sequence
  Synthetic Construct
tgtgtcccggacgtgtcaac

SEQ ID NO: 16658 - DNA, 20 bp, Artificial Sequence
  Synthetic Construct
gctggctgtagcagaactga

SEQ ID NO: 16659 - DNA, 23 bp, Artificial Sequence
  Synthetic Construct
cccatacaatgtggggaggtgat

SEQ ID NO: 16660 - DNA, 22 bp, Artificial Sequence
  Synthetic Construct
cctccccaaggggaagcatttt

SEQ ID NO: 16661 - DNA, 21 bp, Artificial Sequence
  Synthetic Construct
tctgggagcttctgcctcatc

SEQ ID NO: 16662 - DNA, 22 bp, Artificial Sequence
  Synthetic Construct
ctggttcacacgatgcaagatg

SEQ ID NO: 16663 - DNA, 24 bp, Artificial Sequence
  Synthetic Construct
ctgaaagctatgcgtgtagtgcat

SEQ ID NO: 16664 - DNA, 25 bp, Artificial Sequence
  Synthetic Construct
ggaaagaggttcaggctctatgtga

SEQ ID NO: 16665 - DNA, 23 bp, Artificial Sequence
  Synthetic Construct
ggatgtaccccatgcatcctaac

SEQ ID NO: 16666 - DNA, 23 bp, Artificial Sequence
  Synthetic Construct
cccacctcaaccttgcaagtaac

SEQ ID NO: 16667 - DNA, 20 bp, Artificial Sequence
  Synthetic Construct
cccagcgtgaaggcaaaaag

SEQ ID NO: 16668 - DNA, 25 bp, Artificial Sequence
  Synthetic Construct
cagtcagaaggaacaaaggaaccaa

SEQ ID NO: 16669 - DNA, 23 bp, Artificial Sequence
  Synthetic Construct
tgaaaagtgcatggtcctgttga

SEQ ID NO: 16670 - DNA, 22 bp, Artificial Sequence
  Synthetic Construct
gctggaactcagtcacaagcaa

SEQ ID NO: 16671 - DNA, 22 bp, Artificial Sequence
  Synthetic Construct
tggcctcaattccaggccttac

SEQ ID NO: 16672 - DNA, 25 bp, Artificial Sequence
  Synthetic Construct
gtggttgtagtgacgagttttgact

SEQ ID NO: 16673 - DNA, 26 bp, Artificial Sequence
  Synthetic Construct
caagacagcacaggtatagaggaaca

SEQ ID NO: 16674 - DNA, 25 bp, Artificial Sequence
  Synthetic Construct
gctacttccacaatgaccaggaatc

SEQ ID NO: 16675 - DNA, 21 bp, Artificial Sequence
  Synthetic Construct
gcgaccaggatgacaggtgta

SEQ ID NO: 16676 - DNA, 23 bp, Artificial Sequence
  Synthetic Construct
cactttgcctgcatgaagattgt

SEQ ID NO: 16677 - DNA, 25 bp, Artificial Sequence
  Synthetic Construct
cccagttacatctccttctccattc

SEQ ID NO: 16678 - DNA, 20 bp, Artificial Sequence
  Synthetic Construct
tcctccggggtaagggaaca

SEQ ID NO: 16679 - DNA, 22 bp, Artificial Sequence
  Synthetic Construct
gatccaggagtgctccagattg

SEQ ID NO: 16680 - DNA, 26 bp, Artificial Sequence
  Synthetic Construct
ctgcagggattaaccggtcattatca

SEQ ID NO: 16681 - DNA, 21 bp, Artificial Sequence
  Synthetic Construct
cccaggcagtgttgactacaa

SEQ ID NO: 16682 - DNA, 21 bp, Artificial Sequence
  Synthetic Construct
ggctgctgaaggatgacagat

SEQ ID NO: 16683 - DNA, 27 bp, Artificial Sequence
  Synthetic Construct
ctctctccactgaagtttgtgacatta

SEQ ID NO: 16684 - DNA, 22 bp, Artificial Sequence
  Synthetic Construct
gcctggagctctagcaactgta

SEQ ID NO: 16685 - DNA, 22 bp, Artificial Sequence
  Synthetic Construct
catagagcacgagtccacactt

SEQ ID NO: 16686 - DNA, 20 bp, Artificial Sequence
  Synthetic Construct
aagcgcagcaggaagagtca

SEQ ID NO: 16687 - DNA, 22 bp, Artificial Sequence
  Synthetic Construct
acctttgccagacatgggattg

SEQ ID NO: 16688 - DNA, 22 bp, Artificial Sequence
  Synthetic Construct
atctgggaagccagggaggaaa

SEQ ID NO: 16689 - DNA, 23 bp, Artificial Sequence
  Synthetic Construct
gctgaggacacacccatcctttc

SEQ ID NO: 16690 - DNA, 21 bp, Artificial Sequence
  Synthetic Construct
cctgctccatgaccacaggaa

SEQ ID NO: 16691 - DNA, 20 bp, Artificial Sequence
  Synthetic Construct
tgtccacacgttgggcttac

SEQ ID NO: 16692 - DNA, 21 bp, Artificial Sequence
  Synthetic Construct
gagcctgactcctcccacata

SEQ ID NO: 16693 - DNA, 22 bp, Artificial Sequence
  Synthetic Construct
ggaaaatccacccgtgaacaga

SEQ ID NO: 16694 - DNA, 22 bp, Artificial Sequence
  Synthetic Construct
gcctggtcaccttcatctgctt

SEQ ID NO: 16695 - DNA, 20 bp, Artificial Sequence
  Synthetic Construct
gaagctggaacgtgggtcaa

SEQ ID NO: 16696 - DNA, 21 bp, Artificial Sequence
  Synthetic Construct
cctgaggttaggcacctccaa

SEQ ID NO: 16697 - DNA, 22 bp, Artificial Sequence
  Synthetic Construct
ccatgctgccatctgggtcaaa

SEQ ID NO: 16698 - DNA, 21 bp, Artificial Sequence
  Synthetic Construct
gaaaggtgggctttccacaca

SEQ ID NO: 16699 - DNA, 20 bp, Artificial Sequence
  Synthetic Construct
ctgccttgcattgcgacaga

SEQ ID NO: 16700 - DNA, 20 bp, Artificial Sequence
  Synthetic Construct
agctgtcccgggaacttgaa

SEQ ID NO: 16701 - DNA, 20 bp, Artificial Sequence
  Synthetic Construct
agccttgcctgttgcctttc

SEQ ID NO: 16702 - DNA, 21 bp, Artificial Sequence
  Synthetic Construct
ttgcctctggagggcacagaa

SEQ ID NO: 16703 - DNA, 24 bp, Artificial Sequence
  Synthetic Construct
gccccggggtctttgtgacataat

SEQ ID NO: 16704 - DNA, 22 bp, Artificial Sequence
  Synthetic Construct
ctcggctgcagtgtctcagtat

SEQ ID NO: 16705 - DNA, 21 bp, Artificial Sequence
  Synthetic Construct
ggggaagaagcaagcatcagt

SEQ ID NO: 16706 - DNA, 26 bp, Artificial Sequence
  Synthetic Construct
gcaccaagggtccatggatgctataa

SEQ ID NO: 16707 - DNA, 21 bp, Artificial Sequence
  Synthetic Construct
gccatgacccaagcagctaca

SEQ ID NO: 16708 - DNA, 21 bp, Artificial Sequence
  Synthetic Construct
acacttgtggcccctgagttc

SEQ ID NO: 16709 - DNA, 21 bp, Artificial Sequence
  Synthetic Construct
ttggggctcaggctcagtgtt

SEQ ID NO: 16710 - DNA, 21 bp, Artificial Sequence
  Synthetic Construct
atggcacctgccacgtcagaa

SEQ ID NO: 16711 - DNA, 22 bp, Artificial Sequence
  Synthetic Construct
ggagacaggatggagggttttg

SEQ ID NO: 16712 - DNA, 22 bp, Artificial Sequence
  Synthetic Construct
agccgtggactgaagctgagta

SEQ ID NO: 16713 - DNA, 23 bp, Artificial Sequence
  Synthetic Construct
ctaggacccactgcagccattag

SEQ ID NO: 16714 - DNA, 24 bp, Artificial Sequence
  Synthetic Construct
cccctctggcctctttctttgatg

SEQ ID NO: 16715 - DNA, 22 bp, Artificial Sequence
  Synthetic Construct
gttccccgttcttcccttgtca

SEQ ID NO: 16716 - DNA, 21 bp, Artificial Sequence
  Synthetic Construct
atgcagagctgggtggcagaa

SEQ ID NO: 16717 - DNA, 21 bp, Artificial Sequence
  Synthetic Construct
gaggttgttccaggctgatgt

SEQ ID NO: 16718 - DNA, 23 bp, Artificial Sequence
  Synthetic Construct
ccacctgaagattggcagttaca

SEQ ID NO: 16719 - DNA, 20 bp, Artificial Sequence
  Synthetic Construct
tccacatcgccttgccttga

SEQ ID NO: 16720 - DNA, 21 bp, Artificial Sequence
  Synthetic Construct
tttgcccctttcgggctgaag

SEQ ID NO: 16721 - DNA, 20 bp, Artificial Sequence
  Synthetic Construct
aactgcactgctgcccatgt

SEQ ID NO: 16722 - DNA, 21 bp, Artificial Sequence
  Synthetic Construct
gccaccaccacagtaagaagt

SEQ ID NO: 16723 - DNA, 26 bp, Artificial Sequence
  Synthetic Construct
actgcctcctacttttgactatcttc

SEQ ID NO: 16724 - DNA, 25 bp, Artificial Sequence
  Synthetic Construct
tcttgagacttaagcagctacaaca

SEQ ID NO: 16725 - DNA, 24 bp, Artificial Sequence
  Synthetic Construct
acctcctacttcatacaggggaat

SEQ ID NO: 16726 - DNA, 22 bp, Artificial Sequence
  Synthetic Construct
ccagcaaagccagctgtactca

SEQ ID NO: 16727 - DNA, 20 bp, Artificial Sequence
  Synthetic Construct
aactccaggcagagccaaga

SEQ ID NO: 16728 - DNA, 22 bp, Artificial Sequence
  Synthetic Construct
cccattcccatgtctggtcctt

SEQ ID NO: 16729 - DNA, 25 bp, Artificial Sequence
  Synthetic Construct
gagagacacaatgctttgaacagaa

SEQ ID NO: 16730 - DNA, 23 bp, Artificial Sequence
  Synthetic Construct
cacccctcttcaagactgaggaa

SEQ ID NO: 16731 - DNA, 22 bp, Artificial Sequence
  Synthetic Construct
caggaaacccacaggcagttgt

SEQ ID NO: 16732 - DNA, 24 bp, Artificial Sequence
  Synthetic Construct
gcaaaagatcactctggccacttc

SEQ ID NO: 16733 - DNA, 19 bp, Artificial Sequence
  Synthetic Construct
ttggggctgaagccaggaa

SEQ ID NO: 16734 - DNA, 18 bp, Artificial Sequence
  Synthetic Construct
cagtggcagtggcagtga

SEQ ID NO: 16735 - DNA, 21 bp, Artificial Sequence
  Synthetic Construct
tgaaccccattcaggcaggat

SEQ ID NO: 16736 - DNA, 20 bp, Artificial Sequence
  Synthetic Construct
tgtcactgcctgctccttct

SEQ ID NO: 16737 - DNA, 23 bp, Artificial Sequence
  Synthetic Construct
taccacagggctggtctgaggat

SEQ ID NO: 16738 - DNA, 20 bp, Artificial Sequence
  Synthetic Construct
actgagacactggggtgctt

SEQ ID NO: 16739 - DNA, 22 bp, Artificial Sequence
  Synthetic Construct
acaaatgcatcctccgcttaca

SEQ ID NO: 16740 - DNA, 26 bp, Artificial Sequence
  Synthetic Construct
gactaaattggctagaggggcagaag

SEQ ID NO: 16741 - DNA, 23 bp, Artificial Sequence
  Synthetic Construct
cacagggctgtggccatattttc

SEQ ID NO: 16742 - DNA, 24 bp, Artificial Sequence
  Synthetic Construct
gggtcccttgtataacccaaaact

SEQ ID NO: 16743 - DNA, 25 bp, Artificial Sequence
  Synthetic Construct
acatatgactttgagttcggtgaga

SEQ ID NO: 16744 - DNA, 26 bp, Artificial Sequence
  Synthetic Construct
gcctcaggtaggaacctaaagtctca

SEQ ID NO: 16745 - DNA, 24 bp, Artificial Sequence
  Synthetic Construct
ccttcactgtatctgacgggaaac

SEQ ID NO: 16746 - DNA, 22 bp, Artificial Sequence
  Synthetic Construct
gcgcgcgtaagaaccatagagt

SEQ ID NO: 16747 - DNA, 20 bp, Artificial Sequence
  Synthetic Construct
ggctgactggtcccatcttc

SEQ ID NO: 16748 - DNA, 23 bp, Artificial Sequence
  Synthetic Construct
gctttagtctgcatttgctgtgt

SEQ ID NO: 16749 - DNA, 22 bp, Artificial Sequence
  Synthetic Construct
tgtgtctaccttcggggaaaag

SEQ ID NO: 16750 - DNA, 25 bp, Artificial Sequence
  Synthetic Construct
ggtgggtggagcaacaattttggaa

SEQ ID NO: 16751 - DNA, 25 bp, Artificial Sequence
  Synthetic Construct
gccatccaaaaaggagcttagattt

SEQ ID NO: 16752 - DNA, 21 bp, Artificial Sequence
  Synthetic Construct
ggtcggtgcaaggattgaatg

SEQ ID NO: 16753 - DNA, 20 bp, Artificial Sequence
  Synthetic Construct
tcctggccacttagcacaca

SEQ ID NO: 16754 - DNA, 22 bp, Artificial Sequence
  Synthetic Construct
gcccctggatcagctccatttt

SEQ ID NO: 16755 - DNA, 24 bp, Artificial Sequence
  Synthetic Construct
gagcagaagtgttgtttgtcacat

SEQ ID NO: 16756 - DNA, 20 bp, Artificial Sequence
  Synthetic Construct
ggcagacatcgcttcaggta

SEQ ID NO: 16757 - DNA, 22 bp, Artificial Sequence
  Synthetic Construct
gaccgcctgtggaaatgtgtgt

SEQ ID NO: 16758 - DNA, 20 bp, Artificial Sequence
  Synthetic Construct
tcgccagcgtcaacaccatt

SEQ ID NO: 16759 - DNA, 20 bp, Artificial Sequence
  Synthetic Construct
gacaacacgggcacatctca

SEQ ID NO: 16760 - DNA, 19 bp, Artificial Sequence
  Synthetic Construct
ctggggcctaggctgaaga

SEQ ID NO: 16761 - DNA, 27 bp, Artificial Sequence
  Synthetic Construct
aagaggcttaggaaggttaagaactac

SEQ ID NO: 16762 - DNA, 21 bp, Artificial Sequence
  Synthetic Construct
cgaacttcgagcccacgtgat

SEQ ID NO: 16763 - DNA, 25 bp, Artificial Sequence
  Synthetic Construct
gtcagctctaaagcactctctttca

SEQ ID NO: 16764 - DNA, 23 bp, Artificial Sequence
  Synthetic Construct
ggtgggtacagtgaggtgaaatg

SEQ ID NO: 16765 - DNA, 20 bp, Artificial Sequence
  Synthetic Construct
gggctgccagcaacaacaaa

SEQ ID NO: 16766 - DNA, 23 bp, Artificial Sequence
  Synthetic Construct
gccaccatagcttacccacagta

SEQ ID NO: 16767 - DNA, 22 bp, Artificial Sequence
  Synthetic Construct
ggtcaaggacacacagagatgt

SEQ ID NO: 16768 - DNA, 25 bp, Artificial Sequence
  Synthetic Construct
ggaagctctttcctgtgagagttag

SEQ ID NO: 16769 - DNA, 24 bp, Artificial Sequence
  Synthetic Construct
ggaccccattgatcagggtagatg

SEQ ID NO: 16770 - DNA, 25 bp, Artificial Sequence
  Synthetic Construct
ctccccaccaccttctcaatttttc

SEQ ID NO: 16771 - DNA, 18 bp, Artificial Sequence
  Synthetic Construct
aggcacctggctgtgcaa

SEQ ID NO: 16772 - DNA, 22 bp, Artificial Sequence
  Synthetic Construct
ctcagagtccctgttggtgtgt

SEQ ID NO: 16773 - DNA, 20 bp, Artificial Sequence
  Synthetic Construct
atggggacccatgctgctta

SEQ ID NO: 16774 - DNA, 21 bp, Artificial Sequence
  Synthetic Construct
tgctatggtctgcggggtaag

SEQ ID NO: 16775 - DNA, 28 bp, Artificial Sequence
  Synthetic Construct
ggtctggtaacctttccaaggaagtaag

SEQ ID NO: 16776 - DNA, 22 bp, Artificial Sequence
  Synthetic Construct
ctccgcatgccacagtctgtta

SEQ ID NO: 16777 - DNA, 19 bp, Artificial Sequence
  Synthetic Construct
tgaccggcccattggatga

SEQ ID NO: 16778 - DNA, 26 bp, Artificial Sequence
  Synthetic Construct
gcatccccacttggaagaaatcaaag

SEQ ID NO: 16779 - DNA, 26 bp, Artificial Sequence
  Synthetic Construct
ctcacctcactctgtcaatggtaaac

SEQ ID NO: 16780 - DNA, 20 bp, Artificial Sequence
  Synthetic Construct
actgtccccaacccagttca

SEQ ID NO: 16781 - DNA, 20 bp, Artificial Sequence
  Synthetic Construct
acgcaggtgatgaccacaga

SEQ ID NO: 16782 - DNA, 19 bp, Artificial Sequence
  Synthetic Construct
aaccctaggggcggtgtgt

SEQ ID NO: 16783 - DNA, 22 bp, Artificial Sequence
  Synthetic Construct
aggaccccaaagcccatgaaga

SEQ ID NO: 16784 - DNA, 23 bp, Artificial Sequence
  Synthetic Construct
gggtacctgatggcctctctttg

SEQ ID NO: 16785 - DNA, 24 bp, Artificial Sequence
  Synthetic Construct
cctgtgcgtgggatagataagcaa

SEQ ID NO: 16786 - DNA, 18 bp, Artificial Sequence
  Synthetic Construct
ttgctgccctgggactca

SEQ ID NO: 16787 - DNA, 23 bp, Artificial Sequence
  Synthetic Construct
agagcaggaacactggaaaactt

SEQ ID NO: 16788 - DNA, 22 bp, Artificial Sequence
  Synthetic Construct
caggggagagggagacagtcat

SEQ ID NO: 16789 - DNA, 23 bp, Artificial Sequence
  Synthetic Construct
gcaaccccacactttctctgact

SEQ ID NO: 16790 - DNA, 23 bp, Artificial Sequence
  Synthetic Construct
gcagagggagaaacaaccagaaa

SEQ ID NO: 16791 - DNA, 24 bp, Artificial Sequence
  Synthetic Construct
ctgaatcattggagggctgtggtt

SEQ ID NO: 16792 - DNA, 22 bp, Artificial Sequence
  Synthetic Construct
gctgggcagcaggttgtagtaa

SEQ ID NO: 16793 - DNA, 22 bp, Artificial Sequence
  Synthetic Construct
cccagaggagcggtagtcaaaa

SEQ ID NO: 16794 - DNA, 25 bp, Artificial Sequence
  Synthetic Construct
cccctaccatagcatttgcctcctt

SEQ ID NO: 16795 - DNA, 20 bp, Artificial Sequence
  Synthetic Construct
cagtgcaaaggcctggaaca

SEQ ID NO: 16796 - DNA, 22 bp, Artificial Sequence
  Synthetic Construct
cgttgtagggcaagaccacagt

SEQ ID NO: 16797 - DNA, 26 bp, Artificial Sequence
  Synthetic Construct
cagggtgtttgttatcctctctgact

SEQ ID NO: 16798 - DNA, 23 bp, Artificial Sequence
  Synthetic Construct
cccacctgtcttttgatcgcatt

SEQ ID NO: 16799 - DNA, 22 bp, Artificial Sequence
  Synthetic Construct
gactgggactcgcaagcaaact

SEQ ID NO: 16800 - DNA, 23 bp, Artificial Sequence
  Synthetic Construct
tcgtacagcaaaaacctgacctt

SEQ ID NO: 16801 - DNA, 22 bp, Artificial Sequence
  Synthetic Construct
gcacttttggaacccagccttt

SEQ ID NO: 16802 - DNA, 19 bp, Artificial Sequence
  Synthetic Construct
gctcaggcacccgatcttg

SEQ ID NO: 16803 - DNA, 20 bp, Artificial Sequence
  Synthetic Construct
gcttgggcttcacccaacaa

SEQ ID NO: 16804 - DNA, 21 bp, Artificial Sequence
  Synthetic Construct
cggggccctttcaggaactac

SEQ ID NO: 16805 - DNA, 23 bp, Artificial Sequence
  Synthetic Construct
attcaaggaacaggggaccaaat

SEQ ID NO: 16806 - DNA, 22 bp, Artificial Sequence
  Synthetic Construct
tgtttaggcaaggagcctgtag

SEQ ID NO: 16807 - DNA, 23 bp, Artificial Sequence
  Synthetic Construct
gccacagttcatacctacacgaa

SEQ ID NO: 16808 - DNA, 24 bp, Artificial Sequence
  Synthetic Construct
tctctgccacccaagatctcttta

SEQ ID NO: 16809 - DNA, 22 bp, Artificial Sequence
  Synthetic Construct
ggggaagttgcacggtcaaaaa

SEQ ID NO: 16810 - DNA, 22 bp, Artificial Sequence
  Synthetic Construct
caccccagctgtagcatgatga

SEQ ID NO: 16811 - DNA, 25 bp, Artificial Sequence
  Synthetic Construct
tccctatcccataactcgctattga

SEQ ID NO: 16812 - DNA, 21 bp, Artificial Sequence
  Synthetic Construct
cgaaggccttggaccttcctt

SEQ ID NO: 16813 - DNA, 22 bp, Artificial Sequence
  Synthetic Construct
ctccaggaacaacttgggtcat

SEQ ID NO: 16814 - DNA, 27 bp, Artificial Sequence
  Synthetic Construct
gcatatgcagaaatcacatggcaaaag

SEQ ID NO: 16815 - DNA, 22 bp, Artificial Sequence
  Synthetic Construct
gcgagactggttagcacggtta

SEQ ID NO: 16816 - DNA, 20 bp, Artificial Sequence
  Synthetic Construct
cctcagctgcagccttcaaa

SEQ ID NO: 16817 - DNA, 22 bp, Artificial Sequence
  Synthetic Construct
cgttgtgcattcctctgcttgt

SEQ ID NO: 16818 - DNA, 19 bp, Artificial Sequence
  Synthetic Construct
cgtcatgccgccagtcttg

SEQ ID NO: 16819 - DNA, 22 bp, Artificial Sequence
  Synthetic Construct
ggaggcacagctacttcccaaa

SEQ ID NO: 16820 - DNA, 20 bp, Artificial Sequence
  Synthetic Construct
catgccttgctgtgttgcat

SEQ ID NO: 16821 - DNA, 25 bp, Artificial Sequence
  Synthetic Construct
cccttcctttttctaccttgtgtgt

SEQ ID NO: 16822 - DNA, 23 bp, Artificial Sequence
  Synthetic Construct
cccacctctcccagagtatgtca

SEQ ID NO: 16823 - DNA, 21 bp, Artificial Sequence
  Synthetic Construct
gcctcagtcagcttcctccaa

SEQ ID NO: 16824 - DNA, 21 bp, Artificial Sequence
  Synthetic Construct
atggggaaggaggcccaggaa

SEQ ID NO: 16825 - DNA, 23 bp, Artificial Sequence
  Synthetic Construct
cagccaaacttctgcatgactct

SEQ ID NO: 16826 - DNA, 20 bp, Artificial Sequence
  Synthetic Construct
aggctgaacagctgcagaga

SEQ ID NO: 16827 - DNA, 20 bp, Artificial Sequence
  Synthetic Construct
gccgctgacatgcttccaaa

SEQ ID NO: 16828 - DNA, 21 bp, Artificial Sequence
  Synthetic Construct
tgggcggagtgccaagtaatg

SEQ ID NO: 16829 - DNA, 26 bp, Artificial Sequence
  Synthetic Construct
catgaccttcgtgattacttgcatga

SEQ ID NO: 16830 - DNA, 23 bp, Artificial Sequence
  Synthetic Construct
gccaattggtgcaagagatcaca

SEQ ID NO: 16831 - DNA, 22 bp, Artificial Sequence
  Synthetic Construct
aggtgtgaagtgaccacaaagt

SEQ ID NO: 16832 - DNA, 20 bp, Artificial Sequence
  Synthetic Construct
acccctcattctgcgcactt

SEQ ID NO: 16833 - DNA, 23 bp, Artificial Sequence
  Synthetic Construct
tcctctgtacctgtcccctcttc

SEQ ID NO: 16834 - DNA, 21 bp, Artificial Sequence
  Synthetic Construct
caagcaacactcccacctttg

SEQ ID NO: 16835 - DNA, 19 bp, Artificial Sequence
  Synthetic Construct
agggccgaccgtggttttc

SEQ ID NO: 16836 - DNA, 24 bp, Artificial Sequence
  Synthetic Construct
ctccatccagtgcttaaagctgat

SEQ ID NO: 16837 - DNA, 27 bp, Artificial Sequence
  Synthetic Construct
gaggaagaggctaaatgtctagagaag

SEQ ID NO: 16838 - DNA, 24 bp, Artificial Sequence
  Synthetic Construct
gcactaggactccccagtactctt

SEQ ID NO: 16839 - DNA, 24 bp, Artificial Sequence
  Synthetic Construct
cacataggcagcacagtcatggat

SEQ ID NO: 16840 - DNA, 21 bp, Artificial Sequence
  Synthetic Construct
gtgcctgccaagagaacatct

SEQ ID NO: 16841 - DNA, 22 bp, Artificial Sequence
  Synthetic Construct
tccctttggacaacagggtagt

SEQ ID NO: 16842 - DNA, 18 bp, Artificial Sequence
  Synthetic Construct
acactcgcaggccactga

SEQ ID NO: 16843 - DNA, 23 bp, Artificial Sequence
  Synthetic Construct
ggccccaggaagactagtcagat

SEQ ID NO: 16844 - DNA, 23 bp, Artificial Sequence
  Synthetic Construct
gccacctctcactctcttgatct

SEQ ID NO: 16845 - DNA, 24 bp, Artificial Sequence
  Synthetic Construct
gaacaaccttccaagttggtctca

SEQ ID NO: 16846 - DNA, 27 bp, Artificial Sequence
  Synthetic Construct
gatgatgtcattaaggtggggaatttg

SEQ ID NO: 16847 - DNA, 23 bp, Artificial Sequence
  Synthetic Construct
gcctagaagatgctgccccttag

SEQ ID NO: 16848 - DNA, 22 bp, Artificial Sequence
  Synthetic Construct
tgggcagagatgaggaccaaca

SEQ ID NO: 16849 - DNA, 23 bp, Artificial Sequence
  Synthetic Construct
ggaaaggggcagcaagaatgaga

SEQ ID NO: 16850 - DNA, 22 bp, Artificial Sequence
  Synthetic Construct
gctcttccgccatgggataatg

SEQ ID NO: 16851 - DNA, 23 bp, Artificial Sequence
  Synthetic Construct
ccaacccactgcaacaactgcta

SEQ ID NO: 16852 - DNA, 20 bp, Artificial Sequence
  Synthetic Construct
tcctggccagcaaaggcaat

SEQ ID NO: 16853 - DNA, 20 bp, Artificial Sequence
  Synthetic Construct
tccagctcagtccctcttgt

SEQ ID NO: 16854 - DNA, 22 bp, Artificial Sequence
  Synthetic Construct
ggttaatggctgccctcctact

SEQ ID NO: 16855 - DNA, 20 bp, Artificial Sequence
  Synthetic Construct
tcagctgtgccccactaaca

SEQ ID NO: 16856 - DNA, 22 bp, Artificial Sequence
  Synthetic Construct
caggtgtgtcatctccctggtt

SEQ ID NO: 16857 - DNA, 26 bp, Artificial Sequence
  Synthetic Construct
cttctcgaaggctatcctaactgttt

SEQ ID NO: 16858 - DNA, 19 bp, Artificial Sequence
  Synthetic Construct
tggagggagcggctgattg

SEQ ID NO: 16859 - DNA, 22 bp, Artificial Sequence
  Synthetic Construct
agtagtggggcaatggggagaa

SEQ ID NO: 16860 - DNA, 22 bp, Artificial Sequence
  Synthetic Construct
agcccatagccctgtggttact

SEQ ID NO: 16861 - DNA, 22 bp, Artificial Sequence
  Synthetic Construct
gctgtgcctgttgtcagcaatg

SEQ ID NO: 16862 - DNA, 22 bp, Artificial Sequence
  Synthetic Construct
catgaagtggccaccctgtttg

SEQ ID NO: 16863 - DNA, 20 bp, Artificial Sequence
  Synthetic Construct
gccctcagcttcctgagcta

SEQ ID NO: 16864 - DNA, 21 bp, Artificial Sequence
  Synthetic Construct
ctctgcttgctctctgtgctt

SEQ ID NO: 16865 - DNA, 24 bp, Artificial Sequence
  Synthetic Construct
tggtgaagaggtcccctaaattct

SEQ ID NO: 16866 - DNA, 24 bp, Artificial Sequence
  Synthetic Construct
tggctgtcctccaaattggttatc

SEQ ID NO: 16867 - DNA, 21 bp, Artificial Sequence
  Synthetic Construct
actggaggcagcacctggatt

SEQ ID NO: 16868 - DNA, 27 bp, Artificial Sequence
  Synthetic Construct
ctggagagcttttctctactggagcta

SEQ ID NO: 16869 - DNA, 22 bp, Artificial Sequence
  Synthetic Construct
ccttggcctcttacccttcctt

SEQ ID NO: 16870 - DNA, 20 bp, Artificial Sequence
  Synthetic Construct
ccttctcagcgctcctcctt

SEQ ID NO: 16871 - DNA, 20 bp, Artificial Sequence
  Synthetic Construct
gctccttgcactcccatctt

SEQ ID NO: 16872 - DNA, 19 bp, Artificial Sequence
  Synthetic Construct
gagcccaaagcggccaatg

SEQ ID NO: 16873 - DNA, 22 bp, Artificial Sequence
  Synthetic Construct
gaccaacccaactctccccatt

SEQ ID NO: 16874 - DNA, 20 bp, Artificial Sequence
  Synthetic Construct
tcgcgcagaggccacaatta

SEQ ID NO: 16875 - DNA, 22 bp, Artificial Sequence
  Synthetic Construct
gatgcaggagtgcctgtggaat

SEQ ID NO: 16876 - DNA, 20 bp, Artificial Sequence
  Synthetic Construct
acggtggctgcttctccttt

SEQ ID NO: 16877 - DNA, 18 bp, Artificial Sequence
  Synthetic Construct
aggctcggggacactcaa

SEQ ID NO: 16878 - DNA, 22 bp, Artificial Sequence
  Synthetic Construct
cctctgagagttgcctgcacaa

SEQ ID NO: 16879 - DNA, 20 bp, Artificial Sequence
  Synthetic Construct
tgcccacctccccgctttct

SEQ ID NO: 16880 - DNA, 25 bp, Artificial Sequence
  Synthetic Construct
ccaagccagagggaatttgtctatc

SEQ ID NO: 16881 - DNA, 20 bp, Artificial Sequence
  Synthetic Construct
tcgttgaccctgccatgagt

SEQ ID NO: 16882 - DNA, 23 bp, Artificial Sequence
  Synthetic Construct
aggggaggacacagagtatttca

SEQ ID NO: 16883 - DNA, 24 bp, Artificial Sequence
  Synthetic Construct
gggagacaccagttaagtggctaa

SEQ ID NO: 16884 - DNA, 22 bp, Artificial Sequence
  Synthetic Construct
gacacctagcggtgacttctga

SEQ ID NO: 16885 - DNA, 20 bp, Artificial Sequence
  Synthetic Construct
caaagcaggcagccatctca

SEQ ID NO: 16886 - DNA, 21 bp, Artificial Sequence
  Synthetic Construct
tggacagagtgccccacagat

SEQ ID NO: 16887 - DNA, 24 bp, Artificial Sequence
  Synthetic Construct
gagctcccatgttctttcttggat

SEQ ID NO: 16888 - DNA, 22 bp, Artificial Sequence
  Synthetic Construct
tctgccctgtgaggaggatgaa

SEQ ID NO: 16889 - DNA, 19 bp, Artificial Sequence
  Synthetic Construct
agagctgggagggcagtga

SEQ ID NO: 16890 - DNA, 20 bp, Artificial Sequence
  Synthetic Construct
gcacaggaaggaggtgcaaa

SEQ ID NO: 16891 - DNA, 20 bp, Artificial Sequence
  Synthetic Construct
gcccaaatgggcccctctac

SEQ ID NO: 16892 - DNA, 24 bp, Artificial Sequence
  Synthetic Construct
atctgtgcatgtatggcttcaaac

SEQ ID NO: 16893 - DNA, 22 bp, Artificial Sequence
  Synthetic Construct
acaaagacactgccgttactca

SEQ ID NO: 16894 - DNA, 25 bp, Artificial Sequence
  Synthetic Construct
gcctacatgtatgggaagggagcta

SEQ ID NO: 16895 - DNA, 23 bp, Artificial Sequence
  Synthetic Construct
gggtggatagaaaccaaggcata

SEQ ID NO: 16896 - DNA, 26 bp, Artificial Sequence
  Synthetic Construct
gtgtcataaacccttactggggagaa

SEQ ID NO: 16897 - DNA, 20 bp, Artificial Sequence
  Synthetic Construct
tcccagggagctctgctttg

SEQ ID NO: 16898 - DNA, 21 bp, Artificial Sequence
  Synthetic Construct
cagtgtcccaggcccttgtag

SEQ ID NO: 16899 - DNA, 24 bp, Artificial Sequence
  Synthetic Construct
cctggagcctgagattgtgggatt

SEQ ID NO: 16900 - DNA, 25 bp, Artificial Sequence
  Synthetic Construct
ggcttacgggtaagaacaggacaaa

SEQ ID NO: 16901 - DNA, 22 bp, Artificial Sequence
  Synthetic Construct
gtgagtgcagcttcagcggatt

SEQ ID NO: 16902 - DNA, 21 bp, Artificial Sequence
  Synthetic Construct
ccaccattgccctggttcaga

SEQ ID NO: 16903 - DNA, 24 bp, Artificial Sequence
  Synthetic Construct
gcttccctccagttccagtaagaa

SEQ ID NO: 16904 - DNA, 26 bp, Artificial Sequence
  Synthetic Construct
ccagataaccctcacaataggtttct

SEQ ID NO: 16905 - DNA, 26 bp, Artificial Sequence
  Synthetic Construct
gaagcctatcaggagctttgtgagtt

SEQ ID NO: 16906 - DNA, 23 bp, Artificial Sequence
  Synthetic Construct
gcccctactcaagggtgcactaa

SEQ ID NO: 16907 - DNA, 20 bp, Artificial Sequence
  Synthetic Construct
ggcctgagacgagagcatgt

SEQ ID NO: 16908 - DNA, 22 bp, Artificial Sequence
  Synthetic Construct
ccaaagtggtttggggcatttc

SEQ ID NO: 16909 - DNA, 21 bp, Artificial Sequence
  Synthetic Construct
caggacccctttcgtctccat

SEQ ID NO: 16910 - DNA, 23 bp, Artificial Sequence
  Synthetic Construct
aaaagaggccctgaagggattac

SEQ ID NO: 16911 - DNA, 24 bp, Artificial Sequence
  Synthetic Construct
caccaacatggaccactcagctat

SEQ ID NO: 16912 - DNA, 22 bp, Artificial Sequence
  Synthetic Construct
ggctctagcctcagctcaaagt

SEQ ID NO: 16913 - DNA, 20 bp, Artificial Sequence
  Synthetic Construct
aagccctggatgtggagtca

SEQ ID NO: 16914 - DNA, 19 bp, Artificial Sequence
  Synthetic Construct
gagccccacactggacact

SEQ ID NO: 16915 - DNA, 26 bp, Artificial Sequence
  Synthetic Construct
gcaggtagcaatacaaatccagttca

SEQ ID NO: 16916 - DNA, 22 bp, Artificial Sequence
  Synthetic Construct
ggccattatgtgctggggattg

SEQ ID NO: 16917 - DNA, 20 bp, Artificial Sequence
  Synthetic Construct
ttcagccggtggtcctgaca

SEQ ID NO: 16918 - DNA, 20 bp, Artificial Sequence
  Synthetic Construct
tcaggcgaccatcaggtgaa

SEQ ID NO: 16919 - DNA, 20 bp, Artificial Sequence
  Synthetic Construct
taatggcccacggcgggata

SEQ ID NO: 16920 - DNA, 20 bp, Artificial Sequence
  Synthetic Construct
ctggccaaatcccacccaaa

SEQ ID NO: 16921 - DNA, 23 bp, Artificial Sequence
  Synthetic Construct
ggttttgggaagggcagtggaat

SEQ ID NO: 16922 - DNA, 21 bp, Artificial Sequence
  Synthetic Construct
cgaaggcaccatgccagtgtt

SEQ ID NO: 16923 - DNA, 22 bp, Artificial Sequence
  Synthetic Construct
cctgggaaagacgctaccttgt

SEQ ID NO: 16924 - DNA, 20 bp, Artificial Sequence
  Synthetic Construct
atgggcttgtggtcctctct

SEQ ID NO: 16925 - DNA, 22 bp, Artificial Sequence
  Synthetic Construct
cgagctgtcaacgccgtaattc

SEQ ID NO: 16926 - DNA, 24 bp, Artificial Sequence
  Synthetic Construct
cctcaaatgcaggtctgagcacat

SEQ ID NO: 16927 - DNA, 20 bp, Artificial Sequence
  Synthetic Construct
ggcaagaccgtgccagaaag

SEQ ID NO: 16928 - DNA, 27 bp, Artificial Sequence
  Synthetic Construct
cctccttttgcagtagaagttgacaat

SEQ ID NO: 16929 - DNA, 22 bp, Artificial Sequence
  Synthetic Construct
gaggccatagtgagctgtcatc

SEQ ID NO: 16930 - DNA, 21 bp, Artificial Sequence
  Synthetic Construct
cagagtgagtgtgggcacgtt

SEQ ID NO: 16931 - DNA, 23 bp, Artificial Sequence
  Synthetic Construct
ctccaggaaagggctctggtaag

SEQ ID NO: 16932 - DNA, 24 bp, Artificial Sequence
  Synthetic Construct
ggctcaaacaatccttgtgtctca

SEQ ID NO: 16933 - DNA, 24 bp, Artificial Sequence
  Synthetic Construct
gtgttcccataggtaaggcattca

SEQ ID NO: 16934 - DNA, 24 bp, Artificial Sequence
  Synthetic Construct
cctttatgtctgcaggtgtcaatc

SEQ ID NO: 16935 - DNA, 20 bp, Artificial Sequence
  Synthetic Construct
gtgccttacccgtgtctgaa

SEQ ID NO: 16936 - DNA, 23 bp, Artificial Sequence
  Synthetic Construct
gttggagtgcactgagcttcttg

SEQ ID NO: 16937 - DNA, 26 bp, Artificial Sequence
  Synthetic Construct
ggaaccactacaccaaagttgtccta

SEQ ID NO: 16938 - DNA, 24 bp, Artificial Sequence
  Synthetic Construct
ccaggagtaatgcttccagccaaa

SEQ ID NO: 16939 - DNA, 25 bp, Artificial Sequence
  Synthetic Construct
ttccaaagcaaagagacacctctaa

SEQ ID NO: 16940 - DNA, 25 bp, Artificial Sequence
  Synthetic Construct
gctctgtcaagtacgactccaggtt

SEQ ID NO: 16941 - DNA, 24 bp, Artificial Sequence
  Synthetic Construct
gaccatcacaccagattgctttgt

SEQ ID NO: 16942 - DNA, 27 bp, Artificial Sequence
  Synthetic Construct
gcccagagaagccttttagcatttaca

SEQ ID NO: 16943 - DNA, 24 bp, Artificial Sequence
  Synthetic Construct
cagctttgggccctaatgatcaca

SEQ ID NO: 16944 - DNA, 22 bp, Artificial Sequence
  Synthetic Construct
ctggcaggatgagtgttgttgt

SEQ ID NO: 16945 - DNA, 20 bp, Artificial Sequence
  Synthetic Construct
tgacgcggaatggcttactt

SEQ ID NO: 16946 - DNA, 21 bp, Artificial Sequence
  Synthetic Construct
cagcttttgccaggagctcaa

SEQ ID NO: 16947 - DNA, 23 bp, Artificial Sequence
  Synthetic Construct
gctgtaaggactgtgccatgaga

SEQ ID NO: 16948 - DNA, 23 bp, Artificial Sequence
  Synthetic Construct
gaagacagccccaagaagcattt

SEQ ID NO: 16949 - DNA, 22 bp, Artificial Sequence
  Synthetic Construct
ctgctcttccccatcattcact

SEQ ID NO: 16950 - DNA, 22 bp, Artificial Sequence
  Synthetic Construct
cctgctgcaaacctgtgtgaga

SEQ ID NO: 16951 - DNA, 20 bp, Artificial Sequence
  Synthetic Construct
ttttgggaggcgggttctgt

SEQ ID NO: 16952 - DNA, 20 bp, Artificial Sequence
  Synthetic Construct
actctggacagcagcacaag

SEQ ID NO: 16953 - DNA, 22 bp, Artificial Sequence
  Synthetic Construct
cagggagccagaatctctgaag

SEQ ID NO: 16954 - DNA, 20 bp, Artificial Sequence
  Synthetic Construct
gctgaacggaaggacagaca

SEQ ID NO: 16955 - DNA, 21 bp, Artificial Sequence
  Synthetic Construct
ggaatcccgggactggagagt

SEQ ID NO: 16956 - DNA, 20 bp, Artificial Sequence
  Synthetic Construct
agggcccttctgcccagtga

SEQ ID NO: 16957 - DNA, 24 bp, Artificial Sequence
  Synthetic Construct
gccactttcacttccacaccttga

SEQ ID NO: 16958 - DNA, 22 bp, Artificial Sequence
  Synthetic Construct
ggcaccccagaaaagtctagtt

SEQ ID NO: 16959 - DNA, 25 bp, Artificial Sequence
  Synthetic Construct
ccgcctttttgatggtgtcatattt

SEQ ID NO: 16960 - DNA, 20 bp, Artificial Sequence
  Synthetic Construct
ccagtttctccctcgctgtt

SEQ ID NO: 16961 - DNA, 21 bp, Artificial Sequence
  Synthetic Construct
gtgatgctgggctgtgtttac

SEQ ID NO: 16962 - DNA, 21 bp, Artificial Sequence
  Synthetic Construct
ggcttcttcaggcgtgagatt

SEQ ID NO: 16963 - DNA, 20 bp, Artificial Sequence
  Synthetic Construct
ttcgctgctgctcctggaaa

SEQ ID NO: 16964 - DNA, 26 bp, Artificial Sequence
  Synthetic Construct
gacagttgaagtagaaccttccacaa

SEQ ID NO: 16965 - DNA, 23 bp, Artificial Sequence
  Synthetic Construct
gcccaaaatcatgcgttcagcta

SEQ ID NO: 16966 - DNA, 23 bp, Artificial Sequence
  Synthetic Construct
cagtgatctgaggcaatgtctgt

SEQ ID NO: 16967 - DNA, 21 bp, Artificial Sequence
  Synthetic Construct
ggccagtcgcaatcatgtaga

SEQ ID NO: 16968 - DNA, 21 bp, Artificial Sequence
  Synthetic Construct
cctggtcgggtctgtgttact

SEQ ID NO: 16969 - DNA, 25 bp, Artificial Sequence
  Synthetic Construct
cctgcctaacagctgattgaagtct

SEQ ID NO: 16970 - DNA, 23 bp, Artificial Sequence
  Synthetic Construct
gttcagccacttcatgccatttt

SEQ ID NO: 16971 - DNA, 22 bp, Artificial Sequence
  Synthetic Construct
agaggagtttgcagagccaatc

SEQ ID NO: 16972 - DNA, 23 bp, Artificial Sequence
  Synthetic Construct
gaccaataagggctgtggactca

SEQ ID NO: 16973 - DNA, 23 bp, Artificial Sequence
  Synthetic Construct
ggcaagtcagtcaagtgggaagt

SEQ ID NO: 16974 - DNA, 23 bp, Artificial Sequence
  Synthetic Construct
cacagaacccactgcttgcttgt

SEQ ID NO: 16975 - DNA, 24 bp, Artificial Sequence
  Synthetic Construct
ccacagaaatgaggcagtttgtct

SEQ ID NO: 16976 - DNA, 20 bp, Artificial Sequence
  Synthetic Construct
cgccatttgggtgcttgttg

SEQ ID NO: 16977 - DNA, 26 bp, Artificial Sequence
  Synthetic Construct
ggaagagaagcaggtcactgaagtct

SEQ ID NO: 16978 - DNA, 20 bp, Artificial Sequence
  Synthetic Construct
gctgacacaccctcagcaat

SEQ ID NO: 16979 - DNA, 23 bp, Artificial Sequence
  Synthetic Construct
ccaactctgcctccacaggtaac

SEQ ID NO: 16980 - DNA, 22 bp, Artificial Sequence
  Synthetic Construct
agaggaagccgaaggccagtaa

SEQ ID NO: 16981 - DNA, 25 bp, Artificial Sequence
  Synthetic Construct
ggagaagtgtgaactgctaagacta

SEQ ID NO: 16982 - DNA, 28 bp, Artificial Sequence
  Synthetic Construct
ggagtgtagggtatgaggtagggatcat

SEQ ID NO: 16983 - DNA, 22 bp, Artificial Sequence
  Synthetic Construct
cagccatagttgcaccatcaag

SEQ ID NO: 16984 - DNA, 22 bp, Artificial Sequence
  Synthetic Construct
cagaagctgccacgaattcaga

SEQ ID NO: 16985 - DNA, 22 bp, Artificial Sequence
  Synthetic Construct
gggccattcactctcctctact

SEQ ID NO: 16986 - DNA, 25 bp, Artificial Sequence
  Synthetic Construct
gagtagccctcttccaaaactgaag

SEQ ID NO: 16987 - DNA, 25 bp, Artificial Sequence
  Synthetic Construct
ctggctgtgaacttcttaggagcta

SEQ ID NO: 16988 - DNA, 20 bp, Artificial Sequence
  Synthetic Construct
tgtcagctgtcgcacccata

SEQ ID NO: 16989 - DNA, 25 bp, Artificial Sequence
  Synthetic Construct
ccaagggatcggtgtagtagctttc

SEQ ID NO: 16990 - DNA, 23 bp, Artificial Sequence
  Synthetic Construct
gttctggagagggctgtcttcta

SEQ ID NO: 16991 - DNA, 21 bp, Artificial Sequence
  Synthetic Construct
catggatggggagtgggatgt

SEQ ID NO: 16992 - DNA, 20 bp, Artificial Sequence
  Synthetic Construct
gccacattgctggccacttt

SEQ ID NO: 16993 - DNA, 22 bp, Artificial Sequence
  Synthetic Construct
gcccaagcaactttcgaaacaa

SEQ ID NO: 16994 - DNA, 21 bp, Artificial Sequence
  Synthetic Construct
cacagccaagcatacctctgt

SEQ ID NO: 16995 - DNA, 24 bp, Artificial Sequence
  Synthetic Construct
gaagtcagaactgagagtgtccat

SEQ ID NO: 16996 - DNA, 21 bp, Artificial Sequence
  Synthetic Construct
catcccatcggtcccttccaa

SEQ ID NO: 16997 - DNA, 24 bp, Artificial Sequence
  Synthetic Construct
ccatgagctcacatcactgtcaag

SEQ ID NO: 16998 - DNA, 22 bp, Artificial Sequence
  Synthetic Construct
gggtcttgtgggagagacattc

SEQ ID NO: 16999 - DNA, 24 bp, Artificial Sequence
  Synthetic Construct
acaagggtacctgatagtccaaac

SEQ ID NO: 17000 - DNA, 19 bp, Artificial Sequence
  Synthetic Construct
gccgacacattgcggtttt

SEQ ID NO: 17001 - DNA, 26 bp, Artificial Sequence
  Synthetic Construct
gaagagtcattccagtctgtgcttag

SEQ ID NO: 17002 - DNA, 19 bp, Artificial Sequence
  Synthetic Construct
tgggcagtagccccactca

SEQ ID NO: 17003 - DNA, 22 bp, Artificial Sequence
  Synthetic Construct
ctcagcaccggtctcttctttg

SEQ ID NO: 17004 - DNA, 20 bp, Artificial Sequence
  Synthetic Construct
gcagggttcatgggtccaaa

SEQ ID NO: 17005 - DNA, 24 bp, Artificial Sequence
  Synthetic Construct
cagagaacagcaatgtcccagatg

SEQ ID NO: 17006 - DNA, 22 bp, Artificial Sequence
  Synthetic Construct
cgcccctcaatgggagtagtta

SEQ ID NO: 17007 - DNA, 23 bp, Artificial Sequence
  Synthetic Construct
cgccttacagtccctacttcttc

SEQ ID NO: 17008 - DNA, 21 bp, Artificial Sequence
  Synthetic Construct
agctgagctcttcgccaggta

SEQ ID NO: 17009 - DNA, 24 bp, Artificial Sequence
  Synthetic Construct
gcctcaatgggctcatctttgaga

SEQ ID NO: 17010 - DNA, 21 bp, Artificial Sequence
  Synthetic Construct
gaccaaggcaaggagacaaga

SEQ ID NO: 17011 - DNA, 20 bp, Artificial Sequence
  Synthetic Construct
cctgagggctcagcatttgt

SEQ ID NO: 17012 - DNA, 22 bp, Artificial Sequence
  Synthetic Construct
ccccagcccttctccagttaat

SEQ ID NO: 17013 - DNA, 23 bp, Artificial Sequence
  Synthetic Construct
ggggagtgtagacagcacctgat

SEQ ID NO: 17014 - DNA, 23 bp, Artificial Sequence
  Synthetic Construct
ccatgacaaccaaagagccttct

SEQ ID NO: 17015 - DNA, 22 bp, Artificial Sequence
  Synthetic Construct
gcagccctggattgagttgaca

SEQ ID NO: 17016 - DNA, 22 bp, Artificial Sequence
  Synthetic Construct
acaaatctcagcccagggacta

SEQ ID NO: 17017 - DNA, 22 bp, Artificial Sequence
  Synthetic Construct
ggaagatgaccgtagcggcttt

SEQ ID NO: 17018 - DNA, 23 bp, Artificial Sequence
  Synthetic Construct
gggctgcctgtttgaagttggaa

SEQ ID NO: 17019 - DNA, 22 bp, Artificial Sequence
  Synthetic Construct
cttaaggcagcaggatggtcaa

SEQ ID NO: 17020 - DNA, 24 bp, Artificial Sequence
  Synthetic Construct
gtgaagaagcccttgtgtgactga

SEQ ID NO: 17021 - DNA, 23 bp, Artificial Sequence
  Synthetic Construct
cccggaggcagattaaggaaaag

SEQ ID NO: 17022 - DNA, 20 bp, Artificial Sequence
  Synthetic Construct
ggccaggacaaggtgtgtca

SEQ ID NO: 17023 - DNA, 20 bp, Artificial Sequence
  Synthetic Construct
tgggaggcatcggtgacaag

SEQ ID NO: 17024 - DNA, 19 bp, Artificial Sequence
  Synthetic Construct
ggctcagccaggcttggaa

SEQ ID NO: 17025 - DNA, 22 bp, Artificial Sequence
  Synthetic Construct
ggccaccatctcctgttctaag

SEQ ID NO: 17026 - DNA, 20 bp, Artificial Sequence
  Synthetic Construct
gcaaagcggcagtgtcaact

SEQ ID NO: 17027 - DNA, 21 bp, Artificial Sequence
  Synthetic Construct
agagggtccttccaggcacat

SEQ ID NO: 17028 - DNA, 22 bp, Artificial Sequence
  Synthetic Construct
cttcccatggttccaccagaaa

SEQ ID NO: 17029 - DNA, 22 bp, Artificial Sequence
  Synthetic Construct
accgcccctgaacacttcctat

SEQ ID NO: 17030 - DNA, 22 bp, Artificial Sequence
  Synthetic Construct
cgttccttaccctggccttcaa

SEQ ID NO: 17031 - DNA, 22 bp, Artificial Sequence
  Synthetic Construct
ccctctcctccctatcagcatt

SEQ ID NO: 17032 - DNA, 23 bp, Artificial Sequence
  Synthetic Construct
acaacctgttcagttgtctgtct

SEQ ID NO: 17033 - DNA, 21 bp, Artificial Sequence
  Synthetic Construct
tgctccctctacagcacaaag

SEQ ID NO: 17034 - DNA, 24 bp, Artificial Sequence
  Synthetic Construct
ctgactctttgcattgttgtgcta

SEQ ID NO: 17035 - DNA, 19 bp, Artificial Sequence
  Synthetic Construct
tgtcctgtgccgaggaaga

SEQ ID NO: 17036 - DNA, 24 bp, Artificial Sequence
  Synthetic Construct
gtccttaaccacgttcttgctgtt

SEQ ID NO: 17037 - DNA, 22 bp, Artificial Sequence
  Synthetic Construct
ggccagtcctgccattcttctt

SEQ ID NO: 17038 - DNA, 23 bp, Artificial Sequence
  Synthetic Construct
tcatggagcccctcactctcatc

SEQ ID NO: 17039 - DNA, 27 bp, Artificial Sequence
  Synthetic Construct
cgtgtacttactgaagaaaccaaccta

SEQ ID NO: 17040 - DNA, 26 bp, Artificial Sequence
  Synthetic Construct
gtaggcaggtagaaatgtttggattc

SEQ ID NO: 17041 - DNA, 25 bp, Artificial Sequence
  Synthetic Construct
ggaacttatgggtcagatctggaaa

SEQ ID NO: 17042 - DNA, 23 bp, Artificial Sequence
  Synthetic Construct
acacaaaagacacgcatgtcaac

SEQ ID NO: 17043 - DNA, 22 bp, Artificial Sequence
  Synthetic Construct
catccacctagaccagggatca

SEQ ID NO: 17044 - DNA, 25 bp, Artificial Sequence
  Synthetic Construct
catatacccactgactccctgaaaa

SEQ ID NO: 17045 - DNA, 23 bp, Artificial Sequence
  Synthetic Construct
acccttctcctgtcttgacaatc

SEQ ID NO: 17046 - DNA, 20 bp, Artificial Sequence
  Synthetic Construct
acagaagggacgcctctaca

SEQ ID NO: 17047 - DNA, 23 bp, Artificial Sequence
  Synthetic Construct
ggagggcaccatttaagcagtag

SEQ ID NO: 17048 - DNA, 25 bp, Artificial Sequence
  Synthetic Construct
gggcacctcattcgtaactctttct

SEQ ID NO: 17049 - DNA, 25 bp, Artificial Sequence
  Synthetic Construct
cagggtgttcttgctacaaaccaaa

SEQ ID NO: 17050 - DNA, 19 bp, Artificial Sequence
  Synthetic Construct
aggcctgccttgggtcaca

SEQ ID NO: 17051 - DNA, 21 bp, Artificial Sequence
  Synthetic Construct
gaacaaaccgtgtggggcaat

SEQ ID NO: 17052 - DNA, 20 bp, Artificial Sequence
  Synthetic Construct
aggcaggggaaacgagagaa

SEQ ID NO: 17053 - DNA, 22 bp, Artificial Sequence
  Synthetic Construct
cagccttacaggtgagcctttc

SEQ ID NO: 17054 - DNA, 22 bp, Artificial Sequence
  Synthetic Construct
agctgctaatgtccagtgtcaa

SEQ ID NO: 17055 - DNA, 20 bp, Artificial Sequence
  Synthetic Construct
cgagttaggccaccaagcaa

SEQ ID NO: 17056 - DNA, 25 bp, Artificial Sequence
  Synthetic Construct
ctcagtgactaggtttgggtctgta

SEQ ID NO: 17057 - DNA, 20 bp, Artificial Sequence
  Synthetic Construct
tgggagaggaaggtgcaaga

SEQ ID NO: 17058 - DNA, 22 bp, Artificial Sequence
  Synthetic Construct
agactaactgccacccttgaga

SEQ ID NO: 17059 - DNA, 24 bp, Artificial Sequence
  Synthetic Construct
ggagccatgaaagggaactcaaag

SEQ ID NO: 17060 - DNA, 25 bp, Artificial Sequence
  Synthetic Construct
caccatagctcccttaaatccagaa

SEQ ID NO: 17061 - DNA, 22 bp, Artificial Sequence
  Synthetic Construct
gtgagggaggtagggtttcaag

SEQ ID NO: 17062 - DNA, 23 bp, Artificial Sequence
  Synthetic Construct
ctgactttcttagccaccgtaca

SEQ ID NO: 17063 - DNA, 22 bp, Artificial Sequence
  Synthetic Construct
tcactcccggaggaagacaaag

SEQ ID NO: 17064 - DNA, 24 bp, Artificial Sequence
  Synthetic Construct
ggtgagtggcaagaaggaatcgaa

SEQ ID NO: 17065 - DNA, 20 bp, Artificial Sequence
  Synthetic Construct
actcccctccttcccagctt

SEQ ID NO: 17066 - DNA, 24 bp, Artificial Sequence
  Synthetic Construct
ggtgaggaaagagtggtccctgaa

SEQ ID NO: 17067 - DNA, 21 bp, Artificial Sequence
  Synthetic Construct
ggaatggctgcagagttgtga

SEQ ID NO: 17068 - DNA, 27 bp, Artificial Sequence
  Synthetic Construct
ctcttcaccaggaccatgtacctagaa

SEQ ID NO: 17069 - DNA, 25 bp, Artificial Sequence
  Synthetic Construct
ccagttagtgttcaggcttttgaca

SEQ ID NO: 17070 - DNA, 18 bp, Artificial Sequence
  Synthetic Construct
tcctcccatcggccatca

SEQ ID NO: 17071 - DNA, 22 bp, Artificial Sequence
  Synthetic Construct
tggggatagcatgtccttgact

SEQ ID NO: 17072 - DNA, 23 bp, Artificial Sequence
  Synthetic Construct
cagagctcgtgagtgatgtgctt

SEQ ID NO: 17073 - DNA, 21 bp, Artificial Sequence
  Synthetic Construct
gtgcaaatggccagagacaag

SEQ ID NO: 17074 - DNA, 19 bp, Artificial Sequence
  Synthetic Construct
tcgggccccataggcaaca

SEQ ID NO: 17075 - DNA, 24 bp, Artificial Sequence
  Synthetic Construct
tctgagttcagtaggagacagtga

SEQ ID NO: 17076 - DNA, 22 bp, Artificial Sequence
  Synthetic Construct
gtctcaaaagcctgaggtctga

SEQ ID NO: 17077 - DNA, 22 bp, Artificial Sequence
  Synthetic Construct
gccaagtcttactggcttgaca

SEQ ID NO: 17078 - DNA, 26 bp, Artificial Sequence
  Synthetic Construct
gcattgtcaagaccctgcaattcttc

SEQ ID NO: 17079 - DNA, 24 bp, Artificial Sequence
  Synthetic Construct
ccacagccttagttccacccttgt

SEQ ID NO: 17080 - DNA, 24 bp, Artificial Sequence
  Synthetic Construct
atgagacagccacctctctaattg

SEQ ID NO: 17081 - DNA, 20 bp, Artificial Sequence
  Synthetic Construct
accagcccatccagttcaga

SEQ ID NO: 17082 - DNA, 21 bp, Artificial Sequence
  Synthetic Construct
tctatctgcccctccctcaag

SEQ ID NO: 17083 - DNA, 20 bp, Artificial Sequence
  Synthetic Construct
gctttgcacaggggtaggat

SEQ ID NO: 17084 - DNA, 23 bp, Artificial Sequence
  Synthetic Construct
tggccatccatatttacctgcaa

SEQ ID NO: 17085 - DNA, 22 bp, Artificial Sequence
  Synthetic Construct
gcctccgcctatgctggaatta

SEQ ID NO: 17086 - DNA, 20 bp, Artificial Sequence
  Synthetic Construct
accaacccggaagccctgta

SEQ ID NO: 17087 - DNA, 25 bp, Artificial Sequence
  Synthetic Construct
gaggatgaaaagaaagccaagttgt

SEQ ID NO: 17088 - DNA, 22 bp, Artificial Sequence
  Synthetic Construct
gagatgccttgtgggaagaagt

SEQ ID NO: 17089 - DNA, 20 bp, Artificial Sequence
  Synthetic Construct
tgccccttgtgggacagtga

SEQ ID NO: 17090 - DNA, 20 bp, Artificial Sequence
  Synthetic Construct
gggtgtgagagcgaggtttt

SEQ ID NO: 17091 - DNA, 20 bp, Artificial Sequence
  Synthetic Construct
tcccggggcactttccactt

SEQ ID NO: 17092 - DNA, 24 bp, Artificial Sequence
  Synthetic Construct
ccttggggattatgagcttccatt

SEQ ID NO: 17093 - DNA, 24 bp, Artificial Sequence
  Synthetic Construct
tccctcatctgaaattgtgcatgt

SEQ ID NO: 17094 - DNA, 25 bp, Artificial Sequence
  Synthetic Construct
gaggatgtttcattggccacagtct

SEQ ID NO: 17095 - DNA, 19 bp, Artificial Sequence
  Synthetic Construct
tgcacagcacggtgtggtt

SEQ ID NO: 17096 - DNA, 22 bp, Artificial Sequence
  Synthetic Construct
gcttgtagccccatgtagttca

SEQ ID NO: 17097 - DNA, 22 bp, Artificial Sequence
  Synthetic Construct
aggccgctccttccagatatga

SEQ ID NO: 17098 - DNA, 20 bp, Artificial Sequence
  Synthetic Construct
gaggcagcagtgctttggtt

SEQ ID NO: 17099 - DNA, 24 bp, Artificial Sequence
  Synthetic Construct
ggttcctactggcgagtggataga

SEQ ID NO: 17100 - DNA, 22 bp, Artificial Sequence
  Synthetic Construct
gctgatgggcatgggagatgaa

SEQ ID NO: 17101 - DNA, 19 bp, Artificial Sequence
  Synthetic Construct
tcccaaggagccaggaaca

SEQ ID NO: 17102 - DNA, 26 bp, Artificial Sequence
  Synthetic Construct
ccaagatactgatcgttgtctgaact

SEQ ID NO: 17103 - DNA, 24 bp, Artificial Sequence
  Synthetic Construct
gtaaaaagctgcagggagtacagt

SEQ ID NO: 17104 - DNA, 24 bp, Artificial Sequence
  Synthetic Construct
acacctggcattatcaagacgtaa

SEQ ID NO: 17105 - DNA, 23 bp, Artificial Sequence
  Synthetic Construct
caggtttggttagcggaggactt

SEQ ID NO: 17106 - DNA, 22 bp, Artificial Sequence
  Synthetic Construct
gtgacagtagggcctgaaggat

SEQ ID NO: 17107 - DNA, 20 bp, Artificial Sequence
  Synthetic Construct
tggtgtgggacagtccactt

SEQ ID NO: 17108 - DNA, 21 bp, Artificial Sequence
  Synthetic Construct
tgggacctaggtgctggtgtt

SEQ ID NO: 17109 - DNA, 19 bp, Artificial Sequence
  Synthetic Construct
ccccatctgaggccctgaa

SEQ ID NO: 17110 - DNA, 22 bp, Artificial Sequence
  Synthetic Construct
tctgggcctctacggcttgtta

SEQ ID NO: 17111 - DNA, 22 bp, Artificial Sequence
  Synthetic Construct
gatcgggaaagagggtctgaag

SEQ ID NO: 17112 - DNA, 23 bp, Artificial Sequence
  Synthetic Construct
tgtcaatggtgatcggaggtttc

SEQ ID NO: 17113 - DNA, 22 bp, Artificial Sequence
  Synthetic Construct
cctgccacttgcatccatctct

SEQ ID NO: 17114 - DNA, 24 bp, Artificial Sequence
  Synthetic Construct
cagtgggaatatactctggcatgt

SEQ ID NO: 17115 - DNA, 27 bp, Artificial Sequence
  Synthetic Construct
gtcctgtagtgaaatagccagattcta

SEQ ID NO: 17116 - DNA, 22 bp, Artificial Sequence
  Synthetic Construct
tcaacctgagaggtcccgagat

SEQ ID NO: 17117 - DNA, 24 bp, Artificial Sequence
  Synthetic Construct
gggctgatctgctgatttccttga

SEQ ID NO: 17118 - DNA, 22 bp, Artificial Sequence
  Synthetic Construct
ggagaaggcagcctctacacta

SEQ ID NO: 17119 - DNA, 19 bp, Artificial Sequence
  Synthetic Construct
tggccaggggtctgtcact

SEQ ID NO: 17120 - DNA, 21 bp, Artificial Sequence
  Synthetic Construct
aggcctctgtgccactctttg

SEQ ID NO: 17121 - DNA, 23 bp, Artificial Sequence
  Synthetic Construct
gtctgcccttgacacctcaaaga

SEQ ID NO: 17122 - DNA, 22 bp, Artificial Sequence
  Synthetic Construct
gaaggagaagtggggactggtt

SEQ ID NO: 17123 - DNA, 23 bp, Artificial Sequence
  Synthetic Construct
cacagccagcactagagacaatc

SEQ ID NO: 17124 - DNA, 23 bp, Artificial Sequence
  Synthetic Construct
tccagcctttgagtctttgtcat

SEQ ID NO: 17125 - DNA, 22 bp, Artificial Sequence
  Synthetic Construct
caggcacactgagatgcccata

SEQ ID NO: 17126 - DNA, 25 bp, Artificial Sequence
  Synthetic Construct
ccactttcacatccaagaaaactgt

SEQ ID NO: 17127 - DNA, 21 bp, Artificial Sequence
  Synthetic Construct
gcttcccagcacacactaaga

SEQ ID NO: 17128 - DNA, 27 bp, Artificial Sequence
  Synthetic Construct
catgtggcctttaaatgtctggataag

SEQ ID NO: 17129 - DNA, 22 bp, Artificial Sequence
  Synthetic Construct
ggaaaggctgtgcaatggatac

SEQ ID NO: 17130 - DNA, 21 bp, Artificial Sequence
  Synthetic Construct
gacctcaccaatgcgaaggaa

SEQ ID NO: 17131 - DNA, 21 bp, Artificial Sequence
  Synthetic Construct
cgagcaggctgagggaagtct

SEQ ID NO: 17132 - DNA, 22 bp, Artificial Sequence
  Synthetic Construct
gtgcgaggacataaacccaagt

SEQ ID NO: 17133 - DNA, 26 bp, Artificial Sequence
  Synthetic Construct
cattcacgtttgctagttctctcttc

SEQ ID NO: 17134 - DNA, 24 bp, Artificial Sequence
  Synthetic Construct
gacttccaacctggacttagacat

SEQ ID NO: 17135 - DNA, 25 bp, Artificial Sequence
  Synthetic Construct
ctcgcaaaatcctcagatcctttgt

SEQ ID NO: 17136 - DNA, 23 bp, Artificial Sequence
  Synthetic Construct
gcagaccatggggctctacttac

SEQ ID NO: 17137 - DNA, 23 bp, Artificial Sequence
  Synthetic Construct
ctcccaccacataagcaaagact

SEQ ID NO: 17138 - DNA, 21 bp, Artificial Sequence
  Synthetic Construct
cacttgcagccgactttggta

SEQ ID NO: 17139 - DNA, 25 bp, Artificial Sequence
  Synthetic Construct
acctccctatgtagtgagctgttag

SEQ ID NO: 17140 - DNA, 24 bp, Artificial Sequence
  Synthetic Construct
gcaaaggtcttcatgggcaagtct

SEQ ID NO: 17141 - DNA, 23 bp, Artificial Sequence
  Synthetic Construct
gaccagagctggcaaattctaca

SEQ ID NO: 17142 - DNA, 25 bp, Artificial Sequence
  Synthetic Construct
gcctggaatgtgatccatcaatgtt

SEQ ID NO: 17143 - DNA, 26 bp, Artificial Sequence
  Synthetic Construct
ggggaagagaggttaaggaagtgttt

SEQ ID NO: 17144 - DNA, 23 bp, Artificial Sequence
  Synthetic Construct
ggctactcctcccagtctgttgt

SEQ ID NO: 17145 - DNA, 26 bp, Artificial Sequence
  Synthetic Construct
ccaccctgttggatttactttcttca

SEQ ID NO: 17146 - DNA, 22 bp, Artificial Sequence
  Synthetic Construct
ggaatcatgtggggtggaatct

SEQ ID NO: 17147 - DNA, 21 bp, Artificial Sequence
  Synthetic Construct
agtgagggccttacacagtga

SEQ ID NO: 17148 - DNA, 24 bp, Artificial Sequence
  Synthetic Construct
gaggagagacagcagtgtttgtaa

SEQ ID NO: 17149 - DNA, 21 bp, Artificial Sequence
  Synthetic Construct
gctgctgtgattggggagttg

SEQ ID NO: 17150 - DNA, 23 bp, Artificial Sequence
  Synthetic Construct
ctcccctggtactctggaattga

SEQ ID NO: 17151 - DNA, 26 bp, Artificial Sequence
  Synthetic Construct
gtgcaggtagaagaactgatttctca

SEQ ID NO: 17152 - DNA, 21 bp, Artificial Sequence
  Synthetic Construct
ccgctgtgttgcttgctttct

SEQ ID NO: 17153 - DNA, 20 bp, Artificial Sequence
  Synthetic Construct
actgtcaaacggctgtgctt

SEQ ID NO: 17154 - DNA, 22 bp, Artificial Sequence
  Synthetic Construct
agtcaagcaggaggacttggat

SEQ ID NO: 17155 - DNA, 24 bp, Artificial Sequence
  Synthetic Construct
ggacaagaagcccattttaagcat

SEQ ID NO: 17156 - DNA, 21 bp, Artificial Sequence
  Synthetic Construct
actccgaccaacccagaccaa

SEQ ID NO: 17157 - DNA, 24 bp, Artificial Sequence
  Synthetic Construct
ctccaatgccattagctccagaac

SEQ ID NO: 17158 - DNA, 23 bp, Artificial Sequence
  Synthetic Construct
gctatgtgcctctttggggttac

SEQ ID NO: 17159 - DNA, 23 bp, Artificial Sequence
  Synthetic Construct
agacagtgctgactctgtgagta

SEQ ID NO: 17160 - DNA, 24 bp, Artificial Sequence
  Synthetic Construct
ggtctgctgactcctcatctcttc

SEQ ID NO: 17161 - DNA, 24 bp, Artificial Sequence
  Synthetic Construct
actcgaaatcatggctgattctgt

SEQ ID NO: 17162 - DNA, 22 bp, Artificial Sequence
  Synthetic Construct
caccagcaactacaatggcaaa

SEQ ID NO: 17163 - DNA, 23 bp, Artificial Sequence
  Synthetic Construct
gccctgactcaacttccttctgt

SEQ ID NO: 17164 - DNA, 23 bp, Artificial Sequence
  Synthetic Construct
gccatgggctgtgatctcactta

SEQ ID NO: 17165 - DNA, 23 bp, Artificial Sequence
  Synthetic Construct
cagtgcaggcaggatgtatgtgt

SEQ ID NO: 17166 - DNA, 22 bp, Artificial Sequence
  Synthetic Construct
ctctcctgcctcatggagttgt

SEQ ID NO: 17167 - DNA, 21 bp, Artificial Sequence
  Synthetic Construct
tcctatcagcacccgccagaa

SEQ ID NO: 17168 - DNA, 24 bp, Artificial Sequence
  Synthetic Construct
ggttggaataaaggggcacagctt

SEQ ID NO: 17169 - DNA, 24 bp, Artificial Sequence
  Synthetic Construct
ccctcccacttggtgtgttataga

SEQ ID NO: 17170 - DNA, 25 bp, Artificial Sequence
  Synthetic Construct
ggagattgaacagtccatcgaaaca

SEQ ID NO: 17171 - DNA, 24 bp, Artificial Sequence
  Synthetic Construct
ggggcgttaacatttactgagcat

SEQ ID NO: 17172 - DNA, 25 bp, Artificial Sequence
  Synthetic Construct
gaagtccagtggatattccctcatt

SEQ ID NO: 17173 - DNA, 21 bp, Artificial Sequence
  Synthetic Construct
actcgccagtcccttcctaat

SEQ ID NO: 17174 - DNA, 22 bp, Artificial Sequence
  Synthetic Construct
accacatttgactcagggtgtt

SEQ ID NO: 17175 - DNA, 22 bp, Artificial Sequence
  Synthetic Construct
ggcccagtgatttcctttgaca

SEQ ID NO: 17176 - DNA, 21 bp, Artificial Sequence
  Synthetic Construct
gaaggtccaacgcacatcttg

SEQ ID NO: 17177 - DNA, 20 bp, Artificial Sequence
  Synthetic Construct
agcgccccttcctgtttcta

SEQ ID NO: 17178 - DNA, 24 bp, Artificial Sequence
  Synthetic Construct
ccactccctgtgggtttggttatc

SEQ ID NO: 17179 - DNA, 22 bp, Artificial Sequence
  Synthetic Construct
aggctggtggctggaatcatct

SEQ ID NO: 17180 - DNA, 21 bp, Artificial Sequence
  Synthetic Construct
gtgttgcctctggcccttatc

SEQ ID NO: 17181 - DNA, 21 bp, Artificial Sequence
  Synthetic Construct
caacttgccctttgggtccta

SEQ ID NO: 17182 - DNA, 23 bp, Artificial Sequence
  Synthetic Construct
tggtagcacagcaaaaactgcta

SEQ ID NO: 17183 - DNA, 24 bp, Artificial Sequence
  Synthetic Construct
gtaatccttacagccctccggata

SEQ ID NO: 17184 - DNA, 22 bp, Artificial Sequence
  Synthetic Construct
cctgatggcccaagaggtatga

SEQ ID NO: 17185 - DNA, 21 bp, Artificial Sequence
  Synthetic Construct
ttccccataacccggccacat

SEQ ID NO: 17186 - DNA, 25 bp, Artificial Sequence
  Synthetic Construct
gtctgtcttagtgacccaggtattc

SEQ ID NO: 17187 - DNA, 22 bp, Artificial Sequence
  Synthetic Construct
ctgcccaatgtggaactcttct

SEQ ID NO: 17188 - DNA, 25 bp, Artificial Sequence
  Synthetic Construct
ggctaaaggcttactggcataggat

SEQ ID NO: 17189 - DNA, 22 bp, Artificial Sequence
  Synthetic Construct
ggctgcttcaaggcaattggaa

SEQ ID NO: 17190 - DNA, 21 bp, Artificial Sequence
  Synthetic Construct
tctccagggcagacacagttg

SEQ ID NO: 17191 - DNA, 21 bp, Artificial Sequence
  Synthetic Construct
ggagcggcttgatgacataga

SEQ ID NO: 17192 - DNA, 27 bp, Artificial Sequence
  Synthetic Construct
cccaactgtgatattaaaccaccttct

SEQ ID NO: 17193 - DNA, 20 bp, Artificial Sequence
  Synthetic Construct
ttctctggcatcgcctgtgt

SEQ ID NO: 17194 - DNA, 26 bp, Artificial Sequence
  Synthetic Construct
actgaccagctgcctatttatgtaag

SEQ ID NO: 17195 - DNA, 20 bp, Artificial Sequence
  Synthetic Construct
ccaaggcggcatcaaccaaa

SEQ ID NO: 17196 - DNA, 22 bp, Artificial Sequence
  Synthetic Construct
ctgaggctggagcgaagaaaag

SEQ ID NO: 17197 - DNA, 22 bp, Artificial Sequence
  Synthetic Construct
tcactgggacacagacatggta

SEQ ID NO: 17198 - DNA, 23 bp, Artificial Sequence
  Synthetic Construct
tgcttgaaccccatcctttatgt

SEQ ID NO: 17199 - DNA, 22 bp, Artificial Sequence
  Synthetic Construct
acctcattgtccctccatcagt

SEQ ID NO: 17200 - DNA, 26 bp, Artificial Sequence
  Synthetic Construct
gctgaggagtttaaacctgccagtaa

SEQ ID NO: 17201 - DNA, 24 bp, Artificial Sequence
  Synthetic Construct
tgggaggttcctctcactaataca

SEQ ID NO: 17202 - DNA, 20 bp, Artificial Sequence
  Synthetic Construct
tgcacctagcccagtgtgtt

SEQ ID NO: 17203 - DNA, 22 bp, Artificial Sequence
  Synthetic Construct
gtctccatgtccaggctgttgt

SEQ ID NO: 17204 - DNA, 25 bp, Artificial Sequence
  Synthetic Construct
cctcaggggtttgcaatctaataca

SEQ ID NO: 17205 - DNA, 26 bp, Artificial Sequence
  Synthetic Construct
gctttgggagaacaaactctcattac

SEQ ID NO: 17206 - DNA, 21 bp, Artificial Sequence
  Synthetic Construct
tgggaaccaatgggctttcat

SEQ ID NO: 17207 - DNA, 23 bp, Artificial Sequence
  Synthetic Construct
cacctgaagggttgctctcacaa

SEQ ID NO: 17208 - DNA, 21 bp, Artificial Sequence
  Synthetic Construct
ggaactggcagcttggttttc

SEQ ID NO: 17209 - DNA, 24 bp, Artificial Sequence
  Synthetic Construct
cacctaacaagagtccgaggatac

SEQ ID NO: 17210 - DNA, 22 bp, Artificial Sequence
  Synthetic Construct
cagagccaaagggaccatgaag

SEQ ID NO: 17211 - DNA, 22 bp, Artificial Sequence
  Synthetic Construct
gcttggaaaccagggtgggaat

SEQ ID NO: 17212 - DNA, 22 bp, Artificial Sequence
  Synthetic Construct
gcattgtactcagggtggagaa

SEQ ID NO: 17213 - DNA, 21 bp, Artificial Sequence
  Synthetic Construct
cgattcccaccccaggaatga

SEQ ID NO: 17214 - DNA, 24 bp, Artificial Sequence
  Synthetic Construct
cacaggagccacctacttctgtga

SEQ ID NO: 17215 - DNA, 25 bp, Artificial Sequence
  Synthetic Construct
gtcggcagaattggtacttaacctt

SEQ ID NO: 17216 - DNA, 24 bp, Artificial Sequence
  Synthetic Construct
ggtggggatgatagcatgaaggaa

SEQ ID NO: 17217 - DNA, 25 bp, Artificial Sequence
  Synthetic Construct
cctgagcagtgatccctttagtaag

SEQ ID NO: 17218 - DNA, 22 bp, Artificial Sequence
  Synthetic Construct
ctccatgctgcctctctgaaac

SEQ ID NO: 17219 - DNA, 21 bp, Artificial Sequence
  Synthetic Construct
ggcaggatgactgctgtccaa

SEQ ID NO: 17220 - DNA, 24 bp, Artificial Sequence
  Synthetic Construct
gagtgatgccacagctcaaacaac

SEQ ID NO: 17221 - DNA, 19 bp, Artificial Sequence
  Synthetic Construct
ccctggctgcttccacagt

SEQ ID NO: 17222 - DNA, 20 bp, Artificial Sequence
  Synthetic Construct
tcagcgtgctcagtgaaaca

SEQ ID NO: 17223 - DNA, 21 bp, Artificial Sequence
  Synthetic Construct
cacatccttgggcatcactgt

SEQ ID NO: 17224 - DNA, 22 bp, Artificial Sequence
  Synthetic Construct
tctgtaggctgtgtggtcaatg

SEQ ID NO: 17225 - DNA, 25 bp, Artificial Sequence
  Synthetic Construct
ccacagccctatactccaagcatct

SEQ ID NO: 17226 - DNA, 22 bp, Artificial Sequence
  Synthetic Construct
agtgtggctctgcttaaaggtt

SEQ ID NO: 17227 - DNA, 22 bp, Artificial Sequence
  Synthetic Construct
caggcaggtctttcccctcttt

SEQ ID NO: 17228 - DNA, 25 bp, Artificial Sequence
  Synthetic Construct
accagatgcttttaatccctgtgaa

SEQ ID NO: 17229 - DNA, 25 bp, Artificial Sequence
  Synthetic Construct
ccacccaagggttttcactccttct

SEQ ID NO: 17230 - DNA, 27 bp, Artificial Sequence
  Synthetic Construct
ggcatgaggataaaactactgctgctt

SEQ ID NO: 17231 - DNA, 19 bp, Artificial Sequence
  Synthetic Construct
agcactggcaagggagcaa

SEQ ID NO: 17232 - DNA, 21 bp, Artificial Sequence
  Synthetic Construct
tgcttcagccctctgcctaca

SEQ ID NO: 17233 - DNA, 24 bp, Artificial Sequence
  Synthetic Construct
cagcctccttcttacccgttcata

SEQ ID NO: 17234 - DNA, 21 bp, Artificial Sequence
  Synthetic Construct
ccagagccccaagtggatgta

SEQ ID NO: 17235 - DNA, 23 bp, Artificial Sequence
  Synthetic Construct
agggccaaattgtccttcagaaa

SEQ ID NO: 17236 - DNA, 21 bp, Artificial Sequence
  Synthetic Construct
ggcgactcgatgggaaaattg

SEQ ID NO: 17237 - DNA, 25 bp, Artificial Sequence
  Synthetic Construct
ggagcagctaagagaagtagaaaca

SEQ ID NO: 17238 - DNA, 23 bp, Artificial Sequence
  Synthetic Construct
gcactgtgtaggacactggcaat

SEQ ID NO: 17239 - DNA, 22 bp, Artificial Sequence
  Synthetic Construct
ggcccattccttcccgagaaaa

SEQ ID NO: 17240 - DNA, 23 bp, Artificial Sequence
  Synthetic Construct
ggcattggtgagagtgccatttg

SEQ ID NO: 17241 - DNA, 22 bp, Artificial Sequence
  Synthetic Construct
tctggcctgcctgtcaacaaac

SEQ ID NO: 17242 - DNA, 21 bp, Artificial Sequence
  Synthetic Construct
tccttgccctcccaagcgtat

SEQ ID NO: 17243 - DNA, 25 bp, Artificial Sequence
  Synthetic Construct
gcagctactaacatgtgacacacaa

SEQ ID NO: 17244 - DNA, 28 bp, Artificial Sequence
  Synthetic Construct
gctataacctttggtttcctgtcagttc

SEQ ID NO: 17245 - DNA, 26 bp, Artificial Sequence
  Synthetic Construct
gttcctaaggagtgatgtgtggatca

SEQ ID NO: 17246 - DNA, 24 bp, Artificial Sequence
  Synthetic Construct
tccaagcaggagacaaaattcact

SEQ ID NO: 17247 - DNA, 20 bp, Artificial Sequence
  Synthetic Construct
ggcgaagagcccagtcatca

SEQ ID NO: 17248 - DNA, 24 bp, Artificial Sequence
  Synthetic Construct
ggtgcttggagcatccttcagaaa

SEQ ID NO: 17249 - DNA, 23 bp, Artificial Sequence
  Synthetic Construct
gcaccagaagccctgaaatcaac

SEQ ID NO: 17250 - DNA, 23 bp, Artificial Sequence
  Synthetic Construct
ggaatttccagctgtcctgatct

SEQ ID NO: 17251 - DNA, 24 bp, Artificial Sequence
  Synthetic Construct
cagcattcatcccctctaaacgat

SEQ ID NO: 17252 - DNA, 24 bp, Artificial Sequence
  Synthetic Construct
ctccaaatccaataccccatggaa

SEQ ID NO: 17253 - DNA, 27 bp, Artificial Sequence
  Synthetic Construct
gctcagacagcatgagagtaatacagt

SEQ ID NO: 17254 - DNA, 23 bp, Artificial Sequence
  Synthetic Construct
gccctttcctcttttggcagtag

SEQ ID NO: 17255 - DNA, 25 bp, Artificial Sequence
  Synthetic Construct
cccctcacacatggaaagagatttg

SEQ ID NO: 17256 - DNA, 24 bp, Artificial Sequence
  Synthetic Construct
caaatgcaaaggttctgaggcaaa

SEQ ID NO: 17257 - DNA, 22 bp, Artificial Sequence
  Synthetic Construct
gcacaaccccggaactgaaaga

SEQ ID NO: 17258 - DNA, 23 bp, Artificial Sequence
  Synthetic Construct
ccctgaaaccccacacattgcat

SEQ ID NO: 17259 - DNA, 22 bp, Artificial Sequence
  Synthetic Construct
gggagacaaggaggcaacacaa

SEQ ID NO: 17260 - DNA, 25 bp, Artificial Sequence
  Synthetic Construct
gggaacaaaatgtttcccagtcaag

SEQ ID NO: 17261 - DNA, 25 bp, Artificial Sequence
  Synthetic Construct
cagcctaaaagcaaagccaagtaag

SEQ ID NO: 17262 - DNA, 20 bp, Artificial Sequence
  Synthetic Construct
gccacctacccacccactca

SEQ ID NO: 17263 - DNA, 23 bp, Artificial Sequence
  Synthetic Construct
ggcaatgcgaatgagttcctaca

SEQ ID NO: 17264 - DNA, 26 bp, Artificial Sequence
  Synthetic Construct
caccaccaaaaggctgataaagtgaa

SEQ ID NO: 17265 - DNA, 26 bp, Artificial Sequence
  Synthetic Construct
cctgaggctccatgcttttaataact

SEQ ID NO: 17266 - DNA, 26 bp, Artificial Sequence
  Synthetic Construct
cactttgatctccttatgctgctagt

SEQ ID NO: 17267 - DNA, 30 bp, Artificial Sequence
  Synthetic Construct
cctttggaaacttatagtagccagagtttg

SEQ ID NO: 17268 - DNA, 26 bp, Artificial Sequence
  Synthetic Construct
cttcccactctggtttatagggaaga

SEQ ID NO: 17269 - DNA, 26 bp, Artificial Sequence
  Synthetic Construct
cctgggtaataactgagatggagtca

SEQ ID NO: 17270 - DNA, 24 bp, Artificial Sequence
  Synthetic Construct
cccttcataagtagcgtcactcaa

SEQ ID NO: 17271 - DNA, 24 bp, Artificial Sequence
  Synthetic Construct
ggaggttattcacagggcttcaga

SEQ ID NO: 17272 - DNA, 24 bp, Artificial Sequence
  Synthetic Construct
tcagaccctagctgtttcactact

SEQ ID NO: 17273 - DNA, 26 bp, Artificial Sequence
  Synthetic Construct
ctcacctgtactttctactcttgcat

SEQ ID NO: 17274 - DNA, 28 bp, Artificial Sequence
  Synthetic Construct
gctgctcaagtctaagttgcgaatttct

SEQ ID NO: 17275 - DNA, 23 bp, Artificial Sequence
  Synthetic Construct
atgcactaggattgccttctgtt

SEQ ID NO: 17276 - DNA, 27 bp, Artificial Sequence
  Synthetic Construct
ccacagttaggatcctttaagcttttc

SEQ ID NO: 17277 - DNA, 24 bp, Artificial Sequence
  Synthetic Construct
ccctgtctcactgaagagctgtag

SEQ ID NO: 17278 - DNA, 22 bp, Artificial Sequence
  Synthetic Construct
cccggctcatcagtttgtgcta

SEQ ID NO: 17279 - DNA, 24 bp, Artificial Sequence
  Synthetic Construct
gggccacttactcaaagcttcttg

SEQ ID NO: 17280 - DNA, 26 bp, Artificial Sequence
  Synthetic Construct
cctgttcacatagatcccaggtcaag

SEQ ID NO: 17281 - DNA, 24 bp, Artificial Sequence
  Synthetic Construct
agggtaaaaagtccaagtgtgagt

SEQ ID NO: 17282 - DNA, 21 bp, Artificial Sequence
  Synthetic Construct
gcccttagacgaggtgagttc

SEQ ID NO: 17283 - DNA, 26 bp, Artificial Sequence
  Synthetic Construct
gttgcactacaaggtagattgggtta

SEQ ID NO: 17284 - DNA, 23 bp, Artificial Sequence
  Synthetic Construct
agcacaggaaggggatttctttg

SEQ ID NO: 17285 - DNA, 25 bp, Artificial Sequence
  Synthetic Construct
ggctaacctgacaattacctcaatg

SEQ ID NO: 17286 - DNA, 24 bp, Artificial Sequence
  Synthetic Construct
ccttagcggggaaccataattttc

SEQ ID NO: 17287 - DNA, 22 bp, Artificial Sequence
  Synthetic Construct
ctgcctgctatttcccaactgt

SEQ ID NO: 17288 - DNA, 21 bp, Artificial Sequence
  Synthetic Construct
cctggccacatgtgtctgaac

SEQ ID NO: 17289 - DNA, 23 bp, Artificial Sequence
  Synthetic Construct
cccgtcctacctctaaacacaga

SEQ ID NO: 17290 - DNA, 25 bp, Artificial Sequence
  Synthetic Construct
ccttctgcttttccaccatgttaag

SEQ ID NO: 17291 - DNA, 22 bp, Artificial Sequence
  Synthetic Construct
ctctgtagtgctccccacattg

SEQ ID NO: 17292 - DNA, 22 bp, Artificial Sequence
  Synthetic Construct
acgccccgtgatactgttccta

SEQ ID NO: 17293 - DNA, 21 bp, Artificial Sequence
  Synthetic Construct
tctgcgagcacttgaggtttc

SEQ ID NO: 17294 - DNA, 20 bp, Artificial Sequence
  Synthetic Construct
ggctgggttgagaagcatga

SEQ ID NO: 17295 - DNA, 21 bp, Artificial Sequence
  Synthetic Construct
catggctgaagaggaccatgt

SEQ ID NO: 17296 - DNA, 22 bp, Artificial Sequence
  Synthetic Construct
gggcacaacactgaagctctga

SEQ ID NO: 17297 - DNA, 25 bp, Artificial Sequence
  Synthetic Construct
gggtagattcagaaagcagctatga

SEQ ID NO: 17298 - DNA, 23 bp, Artificial Sequence
  Synthetic Construct
gcaggtgagtgtactgtgagcta

SEQ ID NO: 17299 - DNA, 22 bp, Artificial Sequence
  Synthetic Construct
caggcaagatgtacgccttcaa

SEQ ID NO: 17300 - DNA, 25 bp, Artificial Sequence
  Synthetic Construct
gcaacaggaaccatgaagagcagaa

SEQ ID NO: 17301 - DNA, 22 bp, Artificial Sequence
  Synthetic Construct
gggacatgctgacaaggactgt

SEQ ID NO: 17302 - DNA, 24 bp, Artificial Sequence
  Synthetic Construct
gggccctgtaaaggagagaaattg

SEQ ID NO: 17303 - DNA, 20 bp, Artificial Sequence
  Synthetic Construct
gtggccgaatcccaccaaaa

SEQ ID NO: 17304 - DNA, 20 bp, Artificial Sequence
  Synthetic Construct
atacacagagccgcccatca

SEQ ID NO: 17305 - DNA, 23 bp, Artificial Sequence
  Synthetic Construct
gccatacctgaaaccacgtttac

SEQ ID NO: 17306 - DNA, 19 bp, Artificial Sequence
  Synthetic Construct
aggtgtagctccggtcgaa

SEQ ID NO: 17307 - DNA, 23 bp, Artificial Sequence
  Synthetic Construct
cctgcctcccaaactccagtaga

SEQ ID NO: 17308 - DNA, 24 bp, Artificial Sequence
  Synthetic Construct
cttaaggcctggatgtctgtttga

SEQ ID NO: 17309 - DNA, 23 bp, Artificial Sequence
  Synthetic Construct
cccattgtccaacagggcttttc

SEQ ID NO: 17310 - DNA, 24 bp, Artificial Sequence
  Synthetic Construct
caaggcttccttttcagtcctagt

SEQ ID NO: 17311 - DNA, 22 bp, Artificial Sequence
  Synthetic Construct
ccgtctcactgctgtcttctgt

SEQ ID NO: 17312 - DNA, 23 bp, Artificial Sequence
  Synthetic Construct
aagccgaacgaaataggaaggaa

SEQ ID NO: 17313 - DNA, 21 bp, Artificial Sequence
  Synthetic Construct
gggcagcagcaaagaaacttg

SEQ ID NO: 17314 - DNA, 28 bp, Artificial Sequence
  Synthetic Construct
gcctaatgagatttaaggcagggactca

SEQ ID NO: 17315 - DNA, 23 bp, Artificial Sequence
  Synthetic Construct
ggggatatcctgtgtgtggttga

SEQ ID NO: 17316 - DNA, 23 bp, Artificial Sequence
  Synthetic Construct
gtgggataacacctttccccaaa

SEQ ID NO: 17317 - DNA, 19 bp, Artificial Sequence
  Synthetic Construct
gcccatggatggcagcaaa

SEQ ID NO: 17318 - DNA, 21 bp, Artificial Sequence
  Synthetic Construct
gcaagattcatgccgcagaca

SEQ ID NO: 17319 - DNA, 23 bp, Artificial Sequence
  Synthetic Construct
gtcgttgctgtctctgctttagt

SEQ ID NO: 17320 - DNA, 24 bp, Artificial Sequence
  Synthetic Construct
gcagtgattctcacaccctactgt

SEQ ID NO: 17321 - DNA, 27 bp, Artificial Sequence
  Synthetic Construct
ggaaacgtaggaagttctctagtgtga

SEQ ID NO: 17322 - DNA, 22 bp, Artificial Sequence
  Synthetic Construct
cccatcactgcctcatgtgttc

SEQ ID NO: 17323 - DNA, 24 bp, Artificial Sequence
  Synthetic Construct
gccattccaatttatgggcagtca

SEQ ID NO: 17324 - DNA, 23 bp, Artificial Sequence
  Synthetic Construct
aggagctggcataaagttgaaca

SEQ ID NO: 17325 - DNA, 26 bp, Artificial Sequence
  Synthetic Construct
gcgagggaggatgagaaataggttgt

SEQ ID NO: 17326 - DNA, 22 bp, Artificial Sequence
  Synthetic Construct
ggtcagcctgtgttcaggatct

SEQ ID NO: 17327 - DNA, 25 bp, Artificial Sequence
  Synthetic Construct
gtgggtgccagacatgtagatcaag

SEQ ID NO: 17328 - DNA, 23 bp, Artificial Sequence
  Synthetic Construct
gcaaacttcaggggaagatcact

SEQ ID NO: 17329 - DNA, 24 bp, Artificial Sequence
  Synthetic Construct
ctggtacttaccctgtgccagaag

SEQ ID NO: 17330 - DNA, 27 bp, Artificial Sequence
  Synthetic Construct
ctgtaacacctgggaaacctgatgtat

SEQ ID NO: 17331 - DNA, 26 bp, Artificial Sequence
  Synthetic Construct
agtgctttctcagtatctcccaaaag

SEQ ID NO: 17332 - DNA, 22 bp, Artificial Sequence
  Synthetic Construct
ccccatttgtaagccgggaaca

SEQ ID NO: 17333 - DNA, 22 bp, Artificial Sequence
  Synthetic Construct
gaagtcagaacgctgcttgttc

SEQ ID NO: 17334 - DNA, 21 bp, Artificial Sequence
  Synthetic Construct
acctgtctttgagctgtgcat

SEQ ID NO: 17335 - DNA, 23 bp, Artificial Sequence
  Synthetic Construct
gtctgctttgaaccgagtctttg

SEQ ID NO: 17336 - DNA, 25 bp, Artificial Sequence
  Synthetic Construct
ggctcaaacaatcccactgccttac

SEQ ID NO: 17337 - DNA, 24 bp, Artificial Sequence
  Synthetic Construct
gcttgaatctcccactgacatcaa

SEQ ID NO: 17338 - DNA, 22 bp, Artificial Sequence
  Synthetic Construct
ctccccgcatgtgcatgactaa

SEQ ID NO: 17339 - DNA, 22 bp, Artificial Sequence
  Synthetic Construct
cacactgacccttgcttcttca

SEQ ID NO: 17340 - DNA, 25 bp, Artificial Sequence
  Synthetic Construct
gtcaccatgtaatttcccaatggtt

SEQ ID NO: 17341 - DNA, 24 bp, Artificial Sequence
  Synthetic Construct
gcagcacaggcttatttcttgaca

SEQ ID NO: 17342 - DNA, 23 bp, Artificial Sequence
  Synthetic Construct
gagtggatgaacccagcaagttc

SEQ ID NO: 17343 - DNA, 25 bp, Artificial Sequence
  Synthetic Construct
gaaaagctctcactttccctgatct

SEQ ID NO: 17344 - DNA, 25 bp, Artificial Sequence
  Synthetic Construct
gctgatgcctgatcttgagccctaa

SEQ ID NO: 17345 - DNA, 23 bp, Artificial Sequence
  Synthetic Construct
gttgtgtgatgctcacagactga

SEQ ID NO: 17346 - DNA, 22 bp, Artificial Sequence
  Synthetic Construct
tggggaaagaaccacccaaaag

SEQ ID NO: 17347 - DNA, 24 bp, Artificial Sequence
  Synthetic Construct
cctttatgggcaccaactgatttc

SEQ ID NO: 17348 - DNA, 27 bp, Artificial Sequence
  Synthetic Construct
ctgaggttctatgcctaaagaaaccaa

SEQ ID NO: 17349 - DNA, 24 bp, Artificial Sequence
  Synthetic Construct
gctaccaaaatggggctaggaaga

SEQ ID NO: 17350 - DNA, 24 bp, Artificial Sequence
  Synthetic Construct
gcaactgtgaactcaggagcaagt

SEQ ID NO: 17351 - DNA, 24 bp, Artificial Sequence
  Synthetic Construct
ggggattgctgattggttggattg

SEQ ID NO: 17352 - DNA, 25 bp, Artificial Sequence
  Synthetic Construct
cagccagcactaaacgtagagaaag

SEQ ID NO: 17353 - DNA, 30 bp, Artificial Sequence
  Synthetic Construct
ggaaagagaaataatggggaagcatgtgat

SEQ ID NO: 17354 - DNA, 22 bp, Artificial Sequence
  Synthetic Construct
agggaagcgtactgagtgctat

SEQ ID NO: 17355 - DNA, 23 bp, Artificial Sequence
  Synthetic Construct
tggaaacagaggcagctaaatca

SEQ ID NO: 17356 - DNA, 20 bp, Artificial Sequence
  Synthetic Construct
cctctctcccctcggctcta

SEQ ID NO: 17357 - DNA, 24 bp, Artificial Sequence
  Synthetic Construct
gctcgtagtgtgaacttgggaact

SEQ ID NO: 17358 - DNA, 25 bp, Artificial Sequence
  Synthetic Construct
caggcttggactagaagtacaccat

SEQ ID NO: 17359 - DNA, 20 bp, Artificial Sequence
  Synthetic Construct
gcaggttgcttgggttgaca

SEQ ID NO: 17360 - DNA, 29 bp, Artificial Sequence
  Synthetic Construct
ctgagttttcaaaggctacacgttacttc

SEQ ID NO: 17361 - DNA, 24 bp, Artificial Sequence
  Synthetic Construct
gctgtccccatactagtgactcat

SEQ ID NO: 17362 - DNA, 21 bp, Artificial Sequence
  Synthetic Construct
agctacgtggaccccactgtt

SEQ ID NO: 17363 - DNA, 22 bp, Artificial Sequence
  Synthetic Construct
gcctttctcggcctttggaatc

SEQ ID NO: 17364 - DNA, 28 bp, Artificial Sequence
  Synthetic Construct
ccatggactaaagggttatagggttcta

SEQ ID NO: 17365 - DNA, 26 bp, Artificial Sequence
  Synthetic Construct
ctggtaacctactaaggcttgttttg

SEQ ID NO: 17366 - DNA, 19 bp, Artificial Sequence
  Synthetic Construct
ccctgcacaccctctcagt

SEQ ID NO: 17367 - DNA, 20 bp, Artificial Sequence
  Synthetic Construct
tcccttaagtcccggagcat

SEQ ID NO: 17368 - DNA, 22 bp, Artificial Sequence
  Synthetic Construct
ttgctactgggctctggtgaga

SEQ ID NO: 17369 - DNA, 24 bp, Artificial Sequence
  Synthetic Construct
tgatgtccagacagagtgttcaga

SEQ ID NO: 17370 - DNA, 26 bp, Artificial Sequence
  Synthetic Construct
ccctgtgtttttggaagacaccatgt

SEQ ID NO: 17371 - DNA, 25 bp, Artificial Sequence
  Synthetic Construct
ggcctgagttctagctttggtgttg

SEQ ID NO: 17372 - DNA, 24 bp, Artificial Sequence
  Synthetic Construct
ggtgggatggaggattctctttgt

SEQ ID NO: 17373 - DNA, 20 bp, Artificial Sequence
  Synthetic Construct
gtgtcccagaacgagcactt

SEQ ID NO: 17374 - DNA, 30 bp, Artificial Sequence
  Synthetic Construct
cgggaccagtagtcttgttttaatcacata

SEQ ID NO: 17375 - DNA, 23 bp, Artificial Sequence
  Synthetic Construct
gctctccctagacatggcgacta

SEQ ID NO: 17376 - DNA, 23 bp, Artificial Sequence
  Synthetic Construct
ggggatgtagggtggaaagaaac

SEQ ID NO: 17377 - DNA, 28 bp, Artificial Sequence
  Synthetic Construct
ctgtgctggtaagagaattagctggaat

SEQ ID NO: 17378 - DNA, 21 bp, Artificial Sequence
  Synthetic Construct
gttgcctcctttgaccctgaa

SEQ ID NO: 17379 - DNA, 21 bp, Artificial Sequence
  Synthetic Construct
tctgggccattcggtaacatc

SEQ ID NO: 17380 - DNA, 25 bp, Artificial Sequence
  Synthetic Construct
gcataattgggcctagtgggttatg

SEQ ID NO: 17381 - DNA, 25 bp, Artificial Sequence
  Synthetic Construct
cctgaggaaagaatccctgagcttt

SEQ ID NO: 17382 - DNA, 21 bp, Artificial Sequence
  Synthetic Construct
gagggagatgacctccactga

SEQ ID NO: 17383 - DNA, 25 bp, Artificial Sequence
  Synthetic Construct
gcagttttgcaccaacctaatgctt

SEQ ID NO: 17384 - DNA, 24 bp, Artificial Sequence
  Synthetic Construct
ctggctctgcagtttggagaaaag

SEQ ID NO: 17385 - DNA, 22 bp, Artificial Sequence
  Synthetic Construct
ccagatgggctgacacagtcat

SEQ ID NO: 17386 - DNA, 26 bp, Artificial Sequence
  Synthetic Construct
cactgtggagtttttcctggttgtaa

SEQ ID NO: 17387 - DNA, 21 bp, Artificial Sequence
  Synthetic Construct
tgggaagtcctggcatgtaac

SEQ ID NO: 17388 - DNA, 23 bp, Artificial Sequence
  Synthetic Construct
gcagcgacaatgaaacccagttc

SEQ ID NO: 17389 - DNA, 24 bp, Artificial Sequence
  Synthetic Construct
tgcagtgttgatgtcacatgctat

SEQ ID NO: 17390 - DNA, 23 bp, Artificial Sequence
  Synthetic Construct
cagggttctgcaatgtaccacaa

SEQ ID NO: 17391 - DNA, 20 bp, Artificial Sequence
  Synthetic Construct
tccacttccactggctgaca

SEQ ID NO: 17392 - DNA, 26 bp, Artificial Sequence
  Synthetic Construct
cactgcattcccactcatatgcttct

SEQ ID NO: 17393 - DNA, 24 bp, Artificial Sequence
  Synthetic Construct
tgtggggaaatttgcctatacact

SEQ ID NO: 17394 - DNA, 25 bp, Artificial Sequence
  Synthetic Construct
gggtaaacaaggctaagaagcaaag

SEQ ID NO: 17395 - DNA, 21 bp, Artificial Sequence
  Synthetic Construct
ggaaacacctcaacccgcatt

SEQ ID NO: 17396 - DNA, 23 bp, Artificial Sequence
  Synthetic Construct
catcctcagactgggacttctgt

SEQ ID NO: 17397 - DNA, 24 bp, Artificial Sequence
  Synthetic Construct
tggtgcttaagagtaggctgattc

SEQ ID NO: 17398 - DNA, 24 bp, Artificial Sequence
  Synthetic Construct
tggttctgagcaaattgtggtact

SEQ ID NO: 17399 - DNA, 24 bp, Artificial Sequence
  Synthetic Construct
gctagagtgctaagctttctgtca

SEQ ID NO: 17400 - DNA, 27 bp, Artificial Sequence
  Synthetic Construct
ggcattaccagctactgagattttaga

SEQ ID NO: 17401 - DNA, 28 bp, Artificial Sequence
  Synthetic Construct
ccacaccaagaatggttatcagtgtgaa

SEQ ID NO: 17402 - DNA, 24 bp, Artificial Sequence
  Synthetic Construct
aacccagcatatgagtcgaatgaa

SEQ ID NO: 17403 - DNA, 20 bp, Artificial Sequence
  Synthetic Construct
aggggatgaccaaccctgat

SEQ ID NO: 17404 - DNA, 26 bp, Artificial Sequence
  Synthetic Construct
ggctgttcttcaacaagaagtgaatg

SEQ ID NO: 17405 - DNA, 26 bp, Artificial Sequence
  Synthetic Construct
ccaggattagaaagttcaacccaagt

SEQ ID NO: 17406 - DNA, 22 bp, Artificial Sequence
  Synthetic Construct
ccgccaagtcagttcagacaga

SEQ ID NO: 17407 - DNA, 22 bp, Artificial Sequence
  Synthetic Construct
gctcctctctttgtgaggcaaa

SEQ ID NO: 17408 - DNA, 21 bp, Artificial Sequence
  Synthetic Construct
cgtgtctgcattctcccttca

SEQ ID NO: 17409 - DNA, 22 bp, Artificial Sequence
  Synthetic Construct
cccacatgcaacccagttcttc

SEQ ID NO: 17410 - DNA, 24 bp, Artificial Sequence
  Synthetic Construct
gcctttctgacaaactcccagata

SEQ ID NO: 17411 - DNA, 26 bp, Artificial Sequence
  Synthetic Construct
agagataccgatactctgtccatcaa

SEQ ID NO: 17412 - DNA, 22 bp, Artificial Sequence
  Synthetic Construct
tctgtgttgctcactactgctt

SEQ ID NO: 17413 - DNA, 24 bp, Artificial Sequence
  Synthetic Construct
ctcttcagctcaaccctccctttt

SEQ ID NO: 17414 - DNA, 28 bp, Artificial Sequence
  Synthetic Construct
ccaaagtgaacctaaagccttactccaa

SEQ ID NO: 17415 - DNA, 23 bp, Artificial Sequence
  Synthetic Construct
ggcccttcctttagagcttttca

SEQ ID NO: 17416 - DNA, 23 bp, Artificial Sequence
  Synthetic Construct
ggctgcagcataactggcttttg

SEQ ID NO: 17417 - DNA, 25 bp, Artificial Sequence
  Synthetic Construct
ggctgaggtcattaagagctagtgt

SEQ ID NO: 17418 - DNA, 22 bp, Artificial Sequence
  Synthetic Construct
cggagataggagcacactcttg

SEQ ID NO: 17419 - DNA, 26 bp, Artificial Sequence
  Synthetic Construct
ccctctcttcttcatcagcactcttt

SEQ ID NO: 17420 - DNA, 24 bp, Artificial Sequence
  Synthetic Construct
cagagaactctgaagctggctagt

SEQ ID NO: 17421 - DNA, 23 bp, Artificial Sequence
  Synthetic Construct
tccaggtcttctcaaggcatcta

SEQ ID NO: 17422 - DNA, 19 bp, Artificial Sequence
  Synthetic Construct
gccaagtcggtggcgagaa

SEQ ID NO: 17423 - DNA, 23 bp, Artificial Sequence
  Synthetic Construct
gtgtgtgggcttcgctacagaaa

SEQ ID NO: 17424 - DNA, 23 bp, Artificial Sequence
  Synthetic Construct
cctctgtttgcgcagagatcaca

SEQ ID NO: 17425 - DNA, 27 bp, Artificial Sequence
  Synthetic Construct
gacaggagtgttaaaggttccaaatag

SEQ ID NO: 17426 - DNA, 26 bp, Artificial Sequence
  Synthetic Construct
cactggctctctgagactcttaaatc

SEQ ID NO: 17427 - DNA, 23 bp, Artificial Sequence
  Synthetic Construct
gtggctctcaaaccagagaccaa

SEQ ID NO: 17428 - DNA, 23 bp, Artificial Sequence
  Synthetic Construct
ctgcctactccccacatctttac

SEQ ID NO: 17429 - DNA, 21 bp, Artificial Sequence
  Synthetic Construct
gcttgttccactcccgtcaca

SEQ ID NO: 17430 - DNA, 24 bp, Artificial Sequence
  Synthetic Construct
cattgcaaagagttccagtgaaca

SEQ ID NO: 17431 - DNA, 22 bp, Artificial Sequence
  Synthetic Construct
ggcatgggacttcactctgaca

SEQ ID NO: 17432 - DNA, 26 bp, Artificial Sequence
  Synthetic Construct
gctcttccaaaacattgccacatatc

SEQ ID NO: 17433 - DNA, 23 bp, Artificial Sequence
  Synthetic Construct
ggactgcaggatacctgttgctt

SEQ ID NO: 17434 - DNA, 26 bp, Artificial Sequence
  Synthetic Construct
ccactagaaattggattgacccaaca

SEQ ID NO: 17435 - DNA, 24 bp, Artificial Sequence
  Synthetic Construct
tcgatgccaactctatccatgaaa

SEQ ID NO: 17436 - DNA, 25 bp, Artificial Sequence
  Synthetic Construct
ggactggctacaaagactgcctaat

SEQ ID NO: 17437 - DNA, 30 bp, Artificial Sequence
  Synthetic Construct
gagatggatggattctacccctaaagtaag

SEQ ID NO: 17438 - DNA, 22 bp, Artificial Sequence
  Synthetic Construct
gcctctagactcactggtccaa

SEQ ID NO: 17439 - DNA, 26 bp, Artificial Sequence
  Synthetic Construct
ccggacttgatgtcagattcaagcta

SEQ ID NO: 17440 - DNA, 24 bp, Artificial Sequence
  Synthetic Construct
gacttcgcacaagttttccttcat

SEQ ID NO: 17441 - DNA, 27 bp, Artificial Sequence
  Synthetic Construct
gcacagaggaaatgggtataggactta

SEQ ID NO: 17442 - DNA, 23 bp, Artificial Sequence
  Synthetic Construct
gccagtgggaacaatctggagaa

SEQ ID NO: 17443 - DNA, 24 bp, Artificial Sequence
  Synthetic Construct
ggctggagcatgttccttcaatct

SEQ ID NO: 17444 - DNA, 26 bp, Artificial Sequence
  Synthetic Construct
cacccaacttttgtttggagagcatt

SEQ ID NO: 17445 - DNA, 22 bp, Artificial Sequence
  Synthetic Construct
ctgtccaccgtacaggatcgtt

SEQ ID NO: 17446 - DNA, 22 bp, Artificial Sequence
  Synthetic Construct
gtgctagtgagagtgctggttt

SEQ ID NO: 17447 - DNA, 23 bp, Artificial Sequence
  Synthetic Construct
cctggcccaaggtgagaatgtag

SEQ ID NO: 17448 - DNA, 24 bp, Artificial Sequence
  Synthetic Construct
ctggggctttagtcttttgccata

SEQ ID NO: 17449 - DNA, 30 bp, Artificial Sequence
  Synthetic Construct
cccaaacacctacagaaaaagaatcgaact

SEQ ID NO: 17450 - DNA, 20 bp, Artificial Sequence
  Synthetic Construct
agctgctagagtgccgatgt

SEQ ID NO: 17451 - DNA, 23 bp, Artificial Sequence
  Synthetic Construct
accataccccagcaaaagaaaca

SEQ ID NO: 17452 - DNA, 26 bp, Artificial Sequence
  Synthetic Construct
ctcggcccacttaattctagatgttc

SEQ ID NO: 17453 - DNA, 27 bp, Artificial Sequence
  Synthetic Construct
gggaatttctactcctccttcagcaaa

SEQ ID NO: 17454 - DNA, 23 bp, Artificial Sequence
  Synthetic Construct
tggggattccacaaactttggtt

SEQ ID NO: 17455 - DNA, 24 bp, Artificial Sequence
  Synthetic Construct
acaccatctcctggaagtaacagt

SEQ ID NO: 17456 - DNA, 20 bp, Artificial Sequence
  Synthetic Construct
gccctttgctggctgacaca

SEQ ID NO: 17457 - DNA, 25 bp, Artificial Sequence
  Synthetic Construct
ctgcttttgtggattcagggtgact

SEQ ID NO: 17458 - DNA, 27 bp, Artificial Sequence
  Synthetic Construct
gccatctgccatatctcagagagtcaa

SEQ ID NO: 17459 - DNA, 25 bp, Artificial Sequence
  Synthetic Construct
aagggaattcctagatgccaaactt

SEQ ID NO: 17460 - DNA, 26 bp, Artificial Sequence
  Synthetic Construct
cgccgagtgatcttaaaagcagacaa

SEQ ID NO: 17461 - DNA, 26 bp, Artificial Sequence
  Synthetic Construct
agaatcctggggtatgttagtgattg

SEQ ID NO: 17462 - DNA, 25 bp, Artificial Sequence
  Synthetic Construct
cgaggctaaccaaggtcagataata

SEQ ID NO: 17463 - DNA, 23 bp, Artificial Sequence
  Synthetic Construct
ccagcttgcatcaagaggactga

SEQ ID NO: 17464 - DNA, 23 bp, Artificial Sequence
  Synthetic Construct
cctgatgatggcagagtctgaag

SEQ ID NO: 17465 - DNA, 29 bp, Artificial Sequence
  Synthetic Construct
ccatcctctactttagggtgactttaaca

SEQ ID NO: 17466 - DNA, 21 bp, Artificial Sequence
  Synthetic Construct
gaactgctctctggcttcctt

SEQ ID NO: 17467 - DNA, 26 bp, Artificial Sequence
  Synthetic Construct
gaagcagttctggtctcaagatgata

SEQ ID NO: 17468 - DNA, 24 bp, Artificial Sequence
  Synthetic Construct
cggcgaagcactaaaaatgcacta

SEQ ID NO: 17469 - DNA, 29 bp, Artificial Sequence
  Synthetic Construct
ccttagcttagatattacgctccagcatt

SEQ ID NO: 17470 - DNA, 23 bp, Artificial Sequence
  Synthetic Construct
cacagagtcctgaaaagcaggaa

SEQ ID NO: 17471 - DNA, 23 bp, Artificial Sequence
  Synthetic Construct
gagtccaagcagatcatgtgtgt

SEQ ID NO: 17472 - DNA, 23 bp, Artificial Sequence
  Synthetic Construct
gcgagaacgaccattcaaaatca

SEQ ID NO: 17473 - DNA, 26 bp, Artificial Sequence
  Synthetic Construct
gcctatgtcacttctctcccttgaac

SEQ ID NO: 17474 - DNA, 23 bp, Artificial Sequence
  Synthetic Construct
ggccagaaatggtcttgcagctt

SEQ ID NO: 17475 - DNA, 23 bp, Artificial Sequence
  Synthetic Construct
gcattagagttgctaccgctttc

SEQ ID NO: 17476 - DNA, 21 bp, Artificial Sequence
  Synthetic Construct
ggcaatagggcactcacaaac

SEQ ID NO: 17477 - DNA, 20 bp, Artificial Sequence
  Synthetic Construct
tgtcacttgcccacaaggtt

SEQ ID NO: 17478 - DNA, 23 bp, Artificial Sequence
  Synthetic Construct
cagtgtgctggttctggttgagt

SEQ ID NO: 17479 - DNA, 23 bp, Artificial Sequence
  Synthetic Construct
gcaaacacagcttgtctcaggat

SEQ ID NO: 17480 - DNA, 29 bp, Artificial Sequence
  Synthetic Construct
gtgtgaagtcagtgttctaggaagtattg

SEQ ID NO: 17481 - DNA, 24 bp, Artificial Sequence
  Synthetic Construct
acagggacctctctaaaactcaga

SEQ ID NO: 17482 - DNA, 30 bp, Artificial Sequence
  Synthetic Construct
gccagatcctgcttatagtttagatgttac

SEQ ID NO: 17483 - DNA, 22 bp, Artificial Sequence
  Synthetic Construct
ccccaggcttcatggttcatca

SEQ ID NO: 17484 - DNA, 20 bp, Artificial Sequence
  Synthetic Construct
ggttcccaccatgagccttt

SEQ ID NO: 17485 - DNA, 23 bp, Artificial Sequence
  Synthetic Construct
gccttagtccaagtgctccaatg

SEQ ID NO: 17486 - DNA, 26 bp, Artificial Sequence
  Synthetic Construct
gcaggtagcgaatctaagacaaaaag

SEQ ID NO: 17487 - DNA, 24 bp, Artificial Sequence
  Synthetic Construct
gtccctttgggcctaattttcctt

SEQ ID NO: 17488 - DNA, 24 bp, Artificial Sequence
  Synthetic Construct
cccacagcaacactaactcttcat

SEQ ID NO: 17489 - DNA, 22 bp, Artificial Sequence
  Synthetic Construct
ccacccaacactgcacatcaag

SEQ ID NO: 17490 - DNA, 22 bp, Artificial Sequence
  Synthetic Construct
cttgccttctttgcctgtcgaa

SEQ ID NO: 17491 - DNA, 23 bp, Artificial Sequence
  Synthetic Construct
tgtgtcagacagataagcgtgtt

SEQ ID NO: 17492 - DNA, 22 bp, Artificial Sequence
  Synthetic Construct
gggcgggactaatagagcttac

SEQ ID NO: 17493 - DNA, 20 bp, Artificial Sequence
  Synthetic Construct
cgcgttttccaccacggtaa

SEQ ID NO: 17494 - DNA, 26 bp, Artificial Sequence
  Synthetic Construct
cgacattccttaacattccacagttg

SEQ ID NO: 17495 - DNA, 27 bp, Artificial Sequence
  Synthetic Construct
gaactgtccattacagagctagaaaag

SEQ ID NO: 17496 - DNA, 27 bp, Artificial Sequence
  Synthetic Construct
gtgtcttacttatccctctgacctcat

SEQ ID NO: 17497 - DNA, 24 bp, Artificial Sequence
  Synthetic Construct
acctagagagaaagtggaggaact

SEQ ID NO: 17498 - DNA, 21 bp, Artificial Sequence
  Synthetic Construct
gagagcaactcagctcgcatt

SEQ ID NO: 17499 - DNA, 22 bp, Artificial Sequence
  Synthetic Construct
agcggttgccatggactaatac

SEQ ID NO: 17500 - DNA, 26 bp, Artificial Sequence
  Synthetic Construct
catctgatttgcaaccactacccttt

SEQ ID NO: 17501 - DNA, 24 bp, Artificial Sequence
  Synthetic Construct
cagttgcctctttcagtcactgtt

SEQ ID NO: 17502 - DNA, 21 bp, Artificial Sequence
  Synthetic Construct
cctgacaatgcagcacactct

SEQ ID NO: 17503 - DNA, 21 bp, Artificial Sequence
  Synthetic Construct
aggggacacagtccacaaaac

SEQ ID NO: 17504 - DNA, 23 bp, Artificial Sequence
  Synthetic Construct
cctccatttctgccaagctcgtt

SEQ ID NO: 17505 - DNA, 29 bp, Artificial Sequence
  Synthetic Construct
gctaagtccctaagagaaaagctttgtga

SEQ ID NO: 17506 - DNA, 24 bp, Artificial Sequence
  Synthetic Construct
gtgttcactccagggcctcttatc

SEQ ID NO: 17507 - DNA, 23 bp, Artificial Sequence
  Synthetic Construct
gctggccctggatttacttcaca

SEQ ID NO: 17508 - DNA, 26 bp, Artificial Sequence
  Synthetic Construct
gctcagttgtatggtttggaacaaga

SEQ ID NO: 17509 - DNA, 25 bp, Artificial Sequence
  Synthetic Construct
tttctcacattgcctgagacagata

SEQ ID NO: 17510 - DNA, 23 bp, Artificial Sequence
  Synthetic Construct
ggcctataactgccactcagtca

SEQ ID NO: 17511 - DNA, 25 bp, Artificial Sequence
  Synthetic Construct
ctgccttttgaagcaacatgctttt

SEQ ID NO: 17512 - DNA, 22 bp, Artificial Sequence
  Synthetic Construct
gtggctgccatcagaagctaag

SEQ ID NO: 17513 - DNA, 24 bp, Artificial Sequence
  Synthetic Construct
ctctgccgatcaacacatgatttc

SEQ ID NO: 17514 - DNA, 24 bp, Artificial Sequence
  Synthetic Construct
ggacatgttacacctgggccaaat

SEQ ID NO: 17515 - DNA, 24 bp, Artificial Sequence
  Synthetic Construct
gggtacaccatgaaccaggacctt

SEQ ID NO: 17516 - DNA, 25 bp, Artificial Sequence
  Synthetic Construct
ggctgattccagagtcagaacttca

SEQ ID NO: 17517 - DNA, 23 bp, Artificial Sequence
  Synthetic Construct
ggtgacagcaatgtcaggtgcta

SEQ ID NO: 17518 - DNA, 28 bp, Artificial Sequence
  Synthetic Construct
ccaccgtagaccatattgacttcatttc

SEQ ID NO: 17519 - DNA, 27 bp, Artificial Sequence
  Synthetic Construct
ggatggggtcatttagggacttaaaac

SEQ ID NO: 17520 - DNA, 25 bp, Artificial Sequence
  Synthetic Construct
acatgtagtttccagaggcaaagaa

SEQ ID NO: 17521 - DNA, 22 bp, Artificial Sequence
  Synthetic Construct
gactaaggggaggccatgaaag

SEQ ID NO: 17522 - DNA, 23 bp, Artificial Sequence
  Synthetic Construct
tccctggtttcatgagtgacaag

SEQ ID NO: 17523 - DNA, 25 bp, Artificial Sequence
  Synthetic Construct
tcttactgattctttgccgtcagta

SEQ ID NO: 17524 - DNA, 21 bp, Artificial Sequence
  Synthetic Construct
gcgatgccttctgcctgagta

SEQ ID NO: 17525 - DNA, 22 bp, Artificial Sequence
  Synthetic Construct
aggggaaagccacagaaaatgt

SEQ ID NO: 17526 - DNA, 25 bp, Artificial Sequence
  Synthetic Construct
cagcttgtgtcagcttctagccata

SEQ ID NO: 17527 - DNA, 24 bp, Artificial Sequence
  Synthetic Construct
agaaactccagctgtcttgacttc

SEQ ID NO: 17528 - DNA, 24 bp, Artificial Sequence
  Synthetic Construct
gtctctgggaaccaagtccatatc

SEQ ID NO: 17529 - DNA, 21 bp, Artificial Sequence
  Synthetic Construct
agtcagtcccggatctctgaa

SEQ ID NO: 17530 - DNA, 24 bp, Artificial Sequence
  Synthetic Construct
cgcttagtcaatcctcacccattc

SEQ ID NO: 17531 - DNA, 26 bp, Artificial Sequence
  Synthetic Construct
gcccctcttatagcaagccgtaaatc

SEQ ID NO: 17532 - DNA, 23 bp, Artificial Sequence
  Synthetic Construct
ggtcaatctggaaacagggtgat

SEQ ID NO: 17533 - DNA, 24 bp, Artificial Sequence
  Synthetic Construct
gctcgtgttctgtcagtgacttat

SEQ ID NO: 17534 - DNA, 25 bp, Artificial Sequence
  Synthetic Construct
cccaagcaaggaggatgattactgt

SEQ ID NO: 17535 - DNA, 22 bp, Artificial Sequence
  Synthetic Construct
caccccaaagtgcaaaggattc

SEQ ID NO: 17536 - DNA, 24 bp, Artificial Sequence
  Synthetic Construct
gagtacacagtcatgggctagagt

SEQ ID NO: 17537 - DNA, 25 bp, Artificial Sequence
  Synthetic Construct
gagaaggcttttcaagcagaagatt

SEQ ID NO: 17538 - DNA, 25 bp, Artificial Sequence
  Synthetic Construct
ccctttaggttgctggactcatttg

SEQ ID NO: 17539 - DNA, 25 bp, Artificial Sequence
  Synthetic Construct
gttctttctctgtcttccagaccaa

SEQ ID NO: 17540 - DNA, 27 bp, Artificial Sequence
  Synthetic Construct
ccgcaattatcatagcagttcccatct

SEQ ID NO: 17541 - DNA, 26 bp, Artificial Sequence
  Synthetic Construct
gagatgcatggattggactagaggaa

SEQ ID NO: 17542 - DNA, 23 bp, Artificial Sequence
  Synthetic Construct
ggacacactccctacacatttga

SEQ ID NO: 17543 - DNA, 26 bp, Artificial Sequence
  Synthetic Construct
gcacaatagaacaagctaagcctaca

SEQ ID NO: 17544 - DNA, 23 bp, Artificial Sequence
  Synthetic Construct
ccttactgtcccgagaagcaatc

SEQ ID NO: 17545 - DNA, 22 bp, Artificial Sequence
  Synthetic Construct
cagagccatggaaccacagaca

SEQ ID NO: 17546 - DNA, 25 bp, Artificial Sequence
  Synthetic Construct
gcacgtttatgcatgacatctctgt

SEQ ID NO: 17547 - DNA, 26 bp, Artificial Sequence
  Synthetic Construct
cctctgttggaaccactccactctac

SEQ ID NO: 17548 - DNA, 25 bp, Artificial Sequence
  Synthetic Construct
ccctcacatgaatagcctacactct

SEQ ID NO: 17549 - DNA, 23 bp, Artificial Sequence
  Synthetic Construct
ggaacgctgtcagtcgagaattt

SEQ ID NO: 17550 - DNA, 26 bp, Artificial Sequence
  Synthetic Construct
cagagacttgatgagactcaggtttg

SEQ ID NO: 17551 - DNA, 28 bp, Artificial Sequence
  Synthetic Construct
ggcggattagtggctgtctacattattc

SEQ ID NO: 17552 - DNA, 23 bp, Artificial Sequence
  Synthetic Construct
gcaagtcaacagagccgttcatc

SEQ ID NO: 17553 - DNA, 23 bp, Artificial Sequence
  Synthetic Construct
gcatcagcttctgagttgccttt

SEQ ID NO: 17554 - DNA, 23 bp, Artificial Sequence
  Synthetic Construct
gacttgtcattgctccgttcttc

SEQ ID NO: 17555 - DNA, 21 bp, Artificial Sequence
  Synthetic Construct
ccagttgtggatgtggcattg

SEQ ID NO: 17556 - DNA, 19 bp, Artificial Sequence
  Synthetic Construct
gcagacgtctcggctgtgt

SEQ ID NO: 17557 - DNA, 23 bp, Artificial Sequence
  Synthetic Construct
gtgggtctaactggcttgatctt

SEQ ID NO: 17558 - DNA, 24 bp, Artificial Sequence
  Synthetic Construct
agaccactgagcaatgacacaaat

SEQ ID NO: 17559 - DNA, 25 bp, Artificial Sequence
  Synthetic Construct
actccagagtgtatttggttcactt

SEQ ID NO: 17560 - DNA, 26 bp, Artificial Sequence
  Synthetic Construct
ggctctcaggagactttatggtcaga

SEQ ID NO: 17561 - DNA, 23 bp, Artificial Sequence
  Synthetic Construct
tggggcttagggcaagttttaat

SEQ ID NO: 17562 - DNA, 26 bp, Artificial Sequence
  Synthetic Construct
ccacacctggttcctagctctatttg

SEQ ID NO: 17563 - DNA, 24 bp, Artificial Sequence
  Synthetic Construct
atgctgggaatatgacttgtgact

SEQ ID NO: 17564 - DNA, 24 bp, Artificial Sequence
  Synthetic Construct
gaggaaaggttcattccctcttca

SEQ ID NO: 17565 - DNA, 23 bp, Artificial Sequence
  Synthetic Construct
ccagaacgctaaagtaggcagaa

SEQ ID NO: 17566 - DNA, 25 bp, Artificial Sequence
  Synthetic Construct
cccctctactggaagagctaagttg

SEQ ID NO: 17567 - DNA, 19 bp, Artificial Sequence
  Synthetic Construct
tccgcaaaaacccctgtgt

SEQ ID NO: 17568 - DNA, 22 bp, Artificial Sequence
  Synthetic Construct
tgctaagaggggagtctgttct

SEQ ID NO: 17569 - DNA, 23 bp, Artificial Sequence
  Synthetic Construct
acaacacactaggtctccacaga

SEQ ID NO: 17570 - DNA, 25 bp, Artificial Sequence
  Synthetic Construct
ccctctggacctcagtctcatcttt

SEQ ID NO: 17571 - DNA, 20 bp, Artificial Sequence
  Synthetic Construct
aggggaaagacctgccttgt

SEQ ID NO: 17572 - DNA, 25 bp, Artificial Sequence
  Synthetic Construct
tggatacctctgagaagctgatgat

SEQ ID NO: 17573 - DNA, 23 bp, Artificial Sequence
  Synthetic Construct
caggactggaagtgagggtattc

SEQ ID NO: 17574 - DNA, 23 bp, Artificial Sequence
  Synthetic Construct
ggggcgtgtcaaggtattagttg

SEQ ID NO: 17575 - DNA, 24 bp, Artificial Sequence
  Synthetic Construct
ccagtaggtcacagcagaagaaaa

SEQ ID NO: 17576 - DNA, 24 bp, Artificial Sequence
  Synthetic Construct
gtgggtatgtcaccttaggcaaga

SEQ ID NO: 17577 - DNA, 19 bp, Artificial Sequence
  Synthetic Construct
acatgcccgatgccaggta

SEQ ID NO: 17578 - DNA, 26 bp, Artificial Sequence
  Synthetic Construct
gctacaattaggcactggatctggtt

SEQ ID NO: 17579 - DNA, 30 bp, Artificial Sequence
  Synthetic Construct
ccttaccatcagttcagtagaagcatagat

SEQ ID NO: 17580 - DNA, 21 bp, Artificial Sequence
  Synthetic Construct
ggcgggaggaaatgtggaatg

SEQ ID NO: 17581 - DNA, 29 bp, Artificial Sequence
  Synthetic Construct
gagccctagtttaaaaatgtccctgtaag

SEQ ID NO: 17582 - DNA, 29 bp, Artificial Sequence
  Synthetic Construct
ctgagcccagaagacttattttccagttt

SEQ ID NO: 17583 - DNA, 30 bp, Artificial Sequence
  Synthetic Construct
gggtcttcatattaggctgtgagatagtgt

SEQ ID NO: 17584 - DNA, 24 bp, Artificial Sequence
  Synthetic Construct
ggcttaaacctccgtttcttgttc

SEQ ID NO: 17585 - DNA, 28 bp, Artificial Sequence
  Synthetic Construct
ctgaaagcctggatctttcatgggatag

SEQ ID NO: 17586 - DNA, 24 bp, Artificial Sequence
  Synthetic Construct
ccgtgcaggttgatatggttcctt

SEQ ID NO: 17587 - DNA, 24 bp, Artificial Sequence
  Synthetic Construct
ccagccagaagtgttagtgagaag

SEQ ID NO: 17588 - DNA, 22 bp, Artificial Sequence
  Synthetic Construct
cggcatttggttgagcacaaag

SEQ ID NO: 17589 - DNA, 23 bp, Artificial Sequence
  Synthetic Construct
gcagaacctatggcagctaaaac

SEQ ID NO: 17590 - DNA, 25 bp, Artificial Sequence
  Synthetic Construct
ggatcagagagaaccagactcactt

SEQ ID NO: 17591 - DNA, 25 bp, Artificial Sequence
  Synthetic Construct
ctgagttatgtacagggcagagatg

SEQ ID NO: 17592 - DNA, 24 bp, Artificial Sequence
  Synthetic Construct
aggagggcacctgtagattaaaac

SEQ ID NO: 17593 - DNA, 30 bp, Artificial Sequence
  Synthetic Construct
ggcaaaaacattatcattgagcctggattc

SEQ ID NO: 17594 - DNA, 25 bp, Artificial Sequence
  Synthetic Construct
actgtagactccatccaccattaca

SEQ ID NO: 17595 - DNA, 21 bp, Artificial Sequence
  Synthetic Construct
ttgttgggttgatggctgtct

SEQ ID NO: 17596 - DNA, 25 bp, Artificial Sequence
  Synthetic Construct
ggtgtggcttggtttctttttgaag

SEQ ID NO: 17597 - DNA, 25 bp, Artificial Sequence
  Synthetic Construct
ccatgggctaagaaccaggtgaaag

SEQ ID NO: 17598 - DNA, 24 bp, Artificial Sequence
  Synthetic Construct
aaaactgctgctgtaacctgaatc

SEQ ID NO: 17599 - DNA, 25 bp, Artificial Sequence
  Synthetic Construct
ccccagcaatctaactcacccagaa

SEQ ID NO: 17600 - DNA, 24 bp, Artificial Sequence
  Synthetic Construct
gagccgtgtaagaaggaaggatct

SEQ ID NO: 17601 - DNA, 22 bp, Artificial Sequence
  Synthetic Construct
gtggggcttaacagccagtaga

SEQ ID NO: 17602 - DNA, 24 bp, Artificial Sequence
  Synthetic Construct
ggaaccagagatcccagttagctt

SEQ ID NO: 17603 - DNA, 25 bp, Artificial Sequence
  Synthetic Construct
cagtaagatgtgtgcctttggatct

SEQ ID NO: 17604 - DNA, 23 bp, Artificial Sequence
  Synthetic Construct
tgtgtctgttgtccctaggttga

SEQ ID NO: 17605 - DNA, 23 bp, Artificial Sequence
  Synthetic Construct
cctcctgccactaggctttgaac

SEQ ID NO: 17606 - DNA, 26 bp, Artificial Sequence
  Synthetic Construct
ggctgacaagatgtaaaaagctcaac

SEQ ID NO: 17607 - DNA, 23 bp, Artificial Sequence
  Synthetic Construct
gcaagggagtctgacctacatga

SEQ ID NO: 17608 - DNA, 24 bp, Artificial Sequence
  Synthetic Construct
ggttccttcttaccttggagtgaa

SEQ ID NO: 17609 - DNA, 22 bp, Artificial Sequence
  Synthetic Construct
cagcctgcttaagatggtgaga

SEQ ID NO: 17610 - DNA, 29 bp, Artificial Sequence
  Synthetic Construct
ctccaacatcaactcctacaattctcttc

SEQ ID NO: 17611 - DNA, 24 bp, Artificial Sequence
  Synthetic Construct
cccaccagctacacaaggagattc

SEQ ID NO: 17612 - DNA, 22 bp, Artificial Sequence
  Synthetic Construct
cagcagctctttcccctctttc

SEQ ID NO: 17613 - DNA, 25 bp, Artificial Sequence
  Synthetic Construct
gcagaaaatcaaaactggctaccaa

SEQ ID NO: 17614 - DNA, 25 bp, Artificial Sequence
  Synthetic Construct
cagctaaaaagaggctgggaaagaa

SEQ ID NO: 17615 - DNA, 24 bp, Artificial Sequence
  Synthetic Construct
ggaaacagggaatgagggtagaag

SEQ ID NO: 17616 - DNA, 25 bp, Artificial Sequence
  Synthetic Construct
gctaaatggcaagtgaatccctaga

SEQ ID NO: 17617 - DNA, 26 bp, Artificial Sequence
  Synthetic Construct
ggggaagagtgcacttatctgtgttt

SEQ ID NO: 17618 - DNA, 25 bp, Artificial Sequence
  Synthetic Construct
gggtgaagctgggaatatcataagt

SEQ ID NO: 17619 - DNA, 24 bp, Artificial Sequence
  Synthetic Construct
cccgtcttgtgggtaaactgtcat

SEQ ID NO: 17620 - DNA, 24 bp, Artificial Sequence
  Synthetic Construct
caacatggagagacactgttccta

SEQ ID NO: 17621 - DNA, 26 bp, Artificial Sequence
  Synthetic Construct
ccagttgtgtggtctcagggacataa

SEQ ID NO: 17622 - DNA, 25 bp, Artificial Sequence
  Synthetic Construct
ggggaacttgaactaccagcgaaag

SEQ ID NO: 17623 - DNA, 25 bp, Artificial Sequence
  Synthetic Construct
catcagccatatgtatgacgactgt

SEQ ID NO: 17624 - DNA, 25 bp, Artificial Sequence
  Synthetic Construct
ctgtccacttcatctcctttctgtt

SEQ ID NO: 17625 - DNA, 24 bp, Artificial Sequence
  Synthetic Construct
ggatgggaccagatatgcctgaga

SEQ ID NO: 17626 - DNA, 22 bp, Artificial Sequence
  Synthetic Construct
actgcccttgtgactgaaaaca

SEQ ID NO: 17627 - DNA, 24 bp, Artificial Sequence
  Synthetic Construct
ggactgtctcctctctggatgtag

SEQ ID NO: 17628 - DNA, 24 bp, Artificial Sequence
  Synthetic Construct
tctcttctttccaccaaagtgaca

SEQ ID NO: 17629 - DNA, 22 bp, Artificial Sequence
  Synthetic Construct
ctgctccttcctttgggtctga

SEQ ID NO: 17630 - DNA, 22 bp, Artificial Sequence
  Synthetic Construct
aggggaggagtgagcaagaagt

SEQ ID NO: 17631 - DNA, 22 bp, Artificial Sequence
  Synthetic Construct
gtccaaacagagccctggaaaa

SEQ ID NO: 17632 - DNA, 21 bp, Artificial Sequence
  Synthetic Construct
ccctcaatccccttcctgctt

SEQ ID NO: 17633 - DNA, 25 bp, Artificial Sequence
  Synthetic Construct
cccctgaaccaaattctgagatact

SEQ ID NO: 17634 - DNA, 23 bp, Artificial Sequence
  Synthetic Construct
cccaatgaagaagatgccagtca

SEQ ID NO: 17635 - DNA, 23 bp, Artificial Sequence
  Synthetic Construct
cgtgctttgtgagaatggtggaa

SEQ ID NO: 17636 - DNA, 23 bp, Artificial Sequence
  Synthetic Construct
agggtatcacacagtggagacat

SEQ ID NO: 17637 - DNA, 24 bp, Artificial Sequence
  Synthetic Construct
gtcggggaaagtgaaaagaagttg

SEQ ID NO: 17638 - DNA, 23 bp, Artificial Sequence
  Synthetic Construct
ggctccaataaaaccccaacagt

SEQ ID NO: 17639 - DNA, 22 bp, Artificial Sequence
  Synthetic Construct
atggtgaaagctgacccttgaa

SEQ ID NO: 17640 - DNA, 24 bp, Artificial Sequence
  Synthetic Construct
gctgtttgtcttgcccacttccta

SEQ ID NO: 17641 - DNA, 25 bp, Artificial Sequence
  Synthetic Construct
tgtatcgtagttccccattgttcat

SEQ ID NO: 17642 - DNA, 22 bp, Artificial Sequence
  Synthetic Construct
ggccattcaggccagtcataca

SEQ ID NO: 17643 - DNA, 26 bp, Artificial Sequence
  Synthetic Construct
cctcttctagatacaagccccaatca

SEQ ID NO: 17644 - DNA, 21 bp, Artificial Sequence
  Synthetic Construct
aagtgggtgtctggtctctct

SEQ ID NO: 17645 - DNA, 24 bp, Artificial Sequence
  Synthetic Construct
gcaaggggtgaagatactcactgt

SEQ ID NO: 17646 - DNA, 25 bp, Artificial Sequence
  Synthetic Construct
ggggtgagaagggagtatgtagtag

SEQ ID NO: 17647 - DNA, 25 bp, Artificial Sequence
  Synthetic Construct
tctcaatcttccagcttctcattgt

SEQ ID NO: 17648 - DNA, 22 bp, Artificial Sequence
  Synthetic Construct
ccaaccccaaagccagttcagt

SEQ ID NO: 17649 - DNA, 27 bp, Artificial Sequence
  Synthetic Construct
ctgcattctgtctcaaggaagaaatag

SEQ ID NO: 17650 - DNA, 24 bp, Artificial Sequence
  Synthetic Construct
agtgggtacttggatactccatca

SEQ ID NO: 17651 - DNA, 24 bp, Artificial Sequence
  Synthetic Construct
gccactgtttctggtccaatgaag

SEQ ID NO: 17652 - DNA, 30 bp, Artificial Sequence
  Synthetic Construct
gtcagtagttcctctgaagggattatttgt

SEQ ID NO: 17653 - DNA, 25 bp, Artificial Sequence
  Synthetic Construct
tgagtgaaagatggcactgatctac

SEQ ID NO: 17654 - DNA, 22 bp, Artificial Sequence
  Synthetic Construct
ccacctaagcagtcctgcatgt

SEQ ID NO: 17655 - DNA, 21 bp, Artificial Sequence
  Synthetic Construct
ttctgtggggctcagttttgt

SEQ ID NO: 17656 - DNA, 29 bp, Artificial Sequence
  Synthetic Construct
gcaaagctaggcaaatgtctaatggattg

SEQ ID NO: 17657 - DNA, 22 bp, Artificial Sequence
  Synthetic Construct
gcaccgtgagtctaccagaaac

SEQ ID NO: 17658 - DNA, 23 bp, Artificial Sequence
  Synthetic Construct
tgaacatggggtcatcacacttg

SEQ ID NO: 17659 - DNA, 24 bp, Artificial Sequence
  Synthetic Construct
cttcaaggcagtattctggcaagt

SEQ ID NO: 17660 - DNA, 22 bp, Artificial Sequence
  Synthetic Construct
gcaactagctaactggccacaa

SEQ ID NO: 17661 - DNA, 23 bp, Artificial Sequence
  Synthetic Construct
caactccaatcagggtggtctct

SEQ ID NO: 17662 - DNA, 23 bp, Artificial Sequence
  Synthetic Construct
ccactgtaatcaccaaccacgtt

SEQ ID NO: 17663 - DNA, 25 bp, Artificial Sequence
  Synthetic Construct
gcttcttaagcacattctggcaaac

SEQ ID NO: 17664 - DNA, 30 bp, Artificial Sequence
  Synthetic Construct
cagtaggtaaaagaagggatttgtggatag

SEQ ID NO: 17665 - DNA, 24 bp, Artificial Sequence
  Synthetic Construct
gcttttgcagtgttggtgctaaaa

SEQ ID NO: 17666 - DNA, 22 bp, Artificial Sequence
  Synthetic Construct
gggagttgatctgtgtggacaa

SEQ ID NO: 17667 - DNA, 21 bp, Artificial Sequence
  Synthetic Construct
cccaggcagttctgaggtaca

SEQ ID NO: 17668 - DNA, 23 bp, Artificial Sequence
  Synthetic Construct
gcaatgtctaagcctcagtggtt

SEQ ID NO: 17669 - DNA, 23 bp, Artificial Sequence
  Synthetic Construct
accacaactggcttgatttcctt

SEQ ID NO: 17670 - DNA, 25 bp, Artificial Sequence
  Synthetic Construct
agaaactgtagaaggaggagagtca

SEQ ID NO: 17671 - DNA, 24 bp, Artificial Sequence
  Synthetic Construct
gggtgtgattctgacctccctaag

SEQ ID NO: 17672 - DNA, 24 bp, Artificial Sequence
  Synthetic Construct
ggagtgtcttataggggcaagaag

SEQ ID NO: 17673 - DNA, 27 bp, Artificial Sequence
  Synthetic Construct
ccaccagtaagcagagaaatacagtct

SEQ ID NO: 17674 - DNA, 26 bp, Artificial Sequence
  Synthetic Construct
gcctctcttccctgattcttcctttc

SEQ ID NO: 17675 - DNA, 22 bp, Artificial Sequence
  Synthetic Construct
agcatcagacactcggtgttac

SEQ ID NO: 17676 - DNA, 24 bp, Artificial Sequence
  Synthetic Construct
gtcccttcctccatcatgaactgt

SEQ ID NO: 17677 - DNA, 26 bp, Artificial Sequence
  Synthetic Construct
ggagtttgtgttagaagcaggtaaga

SEQ ID NO: 17678 - DNA, 25 bp, Artificial Sequence
  Synthetic Construct
gtggatgcttttgaaggtttggttt

SEQ ID NO: 17679 - DNA, 26 bp, Artificial Sequence
  Synthetic Construct
cacagagttctcatcctcagtgttag

SEQ ID NO: 17680 - DNA, 24 bp, Artificial Sequence
  Synthetic Construct
ctgcatgatcgtattggagtggtt

SEQ ID NO: 17681 - DNA, 27 bp, Artificial Sequence
  Synthetic Construct
gctcagaatccaaacaccatagctttc

SEQ ID NO: 17682 - DNA, 22 bp, Artificial Sequence
  Synthetic Construct
ctgactgcctaactgggtctca

SEQ ID NO: 17683 - DNA, 24 bp, Artificial Sequence
  Synthetic Construct
ggggctgacttaccagtgactcta

SEQ ID NO: 17684 - DNA, 26 bp, Artificial Sequence
  Synthetic Construct
gccagggactaaagtcaaaagcctta

SEQ ID NO: 17685 - DNA, 22 bp, Artificial Sequence
  Synthetic Construct
gggagccaggatttggaactct

SEQ ID NO: 17686 - DNA, 21 bp, Artificial Sequence
  Synthetic Construct
taataccgcccgcagcctctt

SEQ ID NO: 17687 - DNA, 22 bp, Artificial Sequence
  Synthetic Construct
cccaggcaactttctggactgt

SEQ ID NO: 17688 - DNA, 24 bp, Artificial Sequence
  Synthetic Construct
cattttgatgcataccacccttgt

SEQ ID NO: 17689 - DNA, 22 bp, Artificial Sequence
  Synthetic Construct
cgaggtgctaagggaagacaat

SEQ ID NO: 17690 - DNA, 30 bp, Artificial Sequence
  Synthetic Construct
cccatcccagaattgagagaataaggtgta

SEQ ID NO: 17691 - DNA, 23 bp, Artificial Sequence
  Synthetic Construct
gcccatgcctatacagtgctttc

SEQ ID NO: 17692 - DNA, 25 bp, Artificial Sequence
  Synthetic Construct
gcccacaaaccacacatctttcatc

SEQ ID NO: 17693 - DNA, 25 bp, Artificial Sequence
  Synthetic Construct
gaaacccagtgaacatgaaggaaga

SEQ ID NO: 17694 - DNA, 25 bp, Artificial Sequence
  Synthetic Construct
cgagttccatggttttgttccaatc

SEQ ID NO: 17695 - DNA, 26 bp, Artificial Sequence
  Synthetic Construct
cagttgcctttgtggttaagacatac

SEQ ID NO: 17696 - DNA, 24 bp, Artificial Sequence
  Synthetic Construct
ccgattcctttgcagtgtgacttg

SEQ ID NO: 17697 - DNA, 22 bp, Artificial Sequence
  Synthetic Construct
gttgcctgtttgggagatcact

SEQ ID NO: 17698 - DNA, 22 bp, Artificial Sequence
  Synthetic Construct
tgccattagtcatgctgtcact

SEQ ID NO: 17699 - DNA, 27 bp, Artificial Sequence
  Synthetic Construct
ctgcaggtgaacagacaaaaatcatgt

SEQ ID NO: 17700 - DNA, 24 bp, Artificial Sequence
  Synthetic Construct
gggaggagctgacacagttctcta

SEQ ID NO: 17701 - DNA, 24 bp, Artificial Sequence
  Synthetic Construct
aaacgcttcctccttcaagtatca

SEQ ID NO: 17702 - DNA, 22 bp, Artificial Sequence
  Synthetic Construct
ccactgtcaccttcacacaagt

SEQ ID NO: 17703 - DNA, 30 bp, Artificial Sequence
  Synthetic Construct
cagagcacttctataagatggaggcaaaaa

SEQ ID NO: 17704 - DNA, 22 bp, Artificial Sequence
  Synthetic Construct
ctggggcctcttcaagcactaa

SEQ ID NO: 17705 - DNA, 24 bp, Artificial Sequence
  Synthetic Construct
actggatggattcccaatgaactt

SEQ ID NO: 17706 - DNA, 25 bp, Artificial Sequence
  Synthetic Construct
gggcagctcaaactaagcagtgtag

SEQ ID NO: 17707 - DNA, 26 bp, Artificial Sequence
  Synthetic Construct
cctcactcctaacagctgctctttca

SEQ ID NO: 17708 - DNA, 25 bp, Artificial Sequence
  Synthetic Construct
gtccaagcccaatcactagttcctt

SEQ ID NO: 17709 - DNA, 22 bp, Artificial Sequence
  Synthetic Construct
acggaagcatctccgactcctt

SEQ ID NO: 17710 - DNA, 23 bp, Artificial Sequence
  Synthetic Construct
gctctgcttccagtagggcttat

SEQ ID NO: 17711 - DNA, 28 bp, Artificial Sequence
  Synthetic Construct
gcaagcactggattcaacaatgtgtttc

SEQ ID NO: 17712 - DNA, 25 bp, Artificial Sequence
  Synthetic Construct
ctaacataggaaactgccaggagat

SEQ ID NO: 17713 - DNA, 24 bp, Artificial Sequence
  Synthetic Construct
ggtgtggacagagaagggtgaaaa

SEQ ID NO: 17714 - DNA, 27 bp, Artificial Sequence
  Synthetic Construct
tgtcagatgtttcttggttaggacatc

SEQ ID NO: 17715 - DNA, 26 bp, Artificial Sequence
  Synthetic Construct
ggaaccaaagccttcataacatcttc

SEQ ID NO: 17716 - DNA, 24 bp, Artificial Sequence
  Synthetic Construct
gcttaggggtagtgcaggaataag

SEQ ID NO: 17717 - DNA, 22 bp, Artificial Sequence
  Synthetic Construct
ttttggaactgcacacctgttg

SEQ ID NO: 17718 - DNA, 27 bp, Artificial Sequence
  Synthetic Construct
tcctcctccatttacagtgacatttag

SEQ ID NO: 17719 - DNA, 24 bp, Artificial Sequence
  Synthetic Construct
ccaggaaacccaatgacaccttgt

SEQ ID NO: 17720 - DNA, 25 bp, Artificial Sequence
  Synthetic Construct
caagaataaggacaggctggtgaac

SEQ ID NO: 17721 - DNA, 24 bp, Artificial Sequence
  Synthetic Construct
ccccaccttggatttgcctctaac

SEQ ID NO: 17722 - DNA, 26 bp, Artificial Sequence
  Synthetic Construct
tgggagtggaatatacaggaacatca

SEQ ID NO: 17723 - DNA, 26 bp, Artificial Sequence
  Synthetic Construct
acactgatactgagagagaggtcata

SEQ ID NO: 17724 - DNA, 29 bp, Artificial Sequence
  Synthetic Construct
gctgaaattctacatggggttcctaggtt

SEQ ID NO: 17725 - DNA, 22 bp, Artificial Sequence
  Synthetic Construct
tgctgcttcagctggggtaatg

SEQ ID NO: 17726 - DNA, 22 bp, Artificial Sequence
  Synthetic Construct
gcccactggaaacacaccatgt

SEQ ID NO: 17727 - DNA, 28 bp, Artificial Sequence
  Synthetic Construct
ctgtttctgccatggatactggtaattg

SEQ ID NO: 17728 - DNA, 25 bp, Artificial Sequence
  Synthetic Construct
cacgtgtcttcatgtagagctgctt

SEQ ID NO: 17729 - DNA, 24 bp, Artificial Sequence
  Synthetic Construct
cctgtttgtacaggaactgtgtgt

SEQ ID NO: 17730 - DNA, 21 bp, Artificial Sequence
  Synthetic Construct
ccagcctgcatcgtccttact

SEQ ID NO: 17731 - DNA, 27 bp, Artificial Sequence
  Synthetic Construct
cccacatttattaaaccgtgtgcttct

SEQ ID NO: 17732 - DNA, 29 bp, Artificial Sequence
  Synthetic Construct
ctgtagcttaaaagtaggggagtcctaga

SEQ ID NO: 17733 - DNA, 26 bp, Artificial Sequence
  Synthetic Construct
cagagatagccctcttacagatcaag

SEQ ID NO: 17734 - DNA, 22 bp, Artificial Sequence
  Synthetic Construct
gctctacaggcatggtgacaag

SEQ ID NO: 17735 - DNA, 26 bp, Artificial Sequence
  Synthetic Construct
gcactgcaatatcatcatcctagctt

SEQ ID NO: 17736 - DNA, 20 bp, Artificial Sequence
  Synthetic Construct
cgcacatggaccatcacaca

SEQ ID NO: 17737 - DNA, 22 bp, Artificial Sequence
  Synthetic Construct
gacaaaaggccaattgcaggaa

SEQ ID NO: 17738 - DNA, 24 bp, Artificial Sequence
  Synthetic Construct
ttgggtaataccaggactcccata

SEQ ID NO: 17739 - DNA, 24 bp, Artificial Sequence
  Synthetic Construct
tgcctaaaaccagtcatggacttc

SEQ ID NO: 17740 - DNA, 27 bp, Artificial Sequence
  Synthetic Construct
ccacacgtcaagcactttctaactttc

SEQ ID NO: 17741 - DNA, 22 bp, Artificial Sequence
  Synthetic Construct
gatgcatggcagaaccctaaac

SEQ ID NO: 17742 - DNA, 24 bp, Artificial Sequence
  Synthetic Construct
cgggctggatgaagagaaggtaca

SEQ ID NO: 17743 - DNA, 24 bp, Artificial Sequence
  Synthetic Construct
ctcaagtgaaactgccttttggat

SEQ ID NO: 17744 - DNA, 29 bp, Artificial Sequence
  Synthetic Construct
gccaaagaacctactcctcatgatgtttt

SEQ ID NO: 17745 - DNA, 23 bp, Artificial Sequence
  Synthetic Construct
ggctatggcacagacagtaggtt

SEQ ID NO: 17746 - DNA, 21 bp, Artificial Sequence
  Synthetic Construct
cgcccacaaagacgattcgat

SEQ ID NO: 17747 - DNA, 24 bp, Artificial Sequence
  Synthetic Construct
cttctctcccaggtaaggctaact

SEQ ID NO: 17748 - DNA, 25 bp, Artificial Sequence
  Synthetic Construct
tcccttgtttgtcctccaacttaaa

SEQ ID NO: 17749 - DNA, 28 bp, Artificial Sequence
  Synthetic Construct
gggtgacagagtcttaaacatccacatt

SEQ ID NO: 17750 - DNA, 24 bp, Artificial Sequence
  Synthetic Construct
ccttgccagtttccccatattttc

SEQ ID NO: 17751 - DNA, 27 bp, Artificial Sequence
  Synthetic Construct
ggagtaatcaagtgccattgggttttc

SEQ ID NO: 17752 - DNA, 21 bp, Artificial Sequence
  Synthetic Construct
cgcccctttacccttttctct

SEQ ID NO: 17753 - DNA, 23 bp, Artificial Sequence
  Synthetic Construct
ccatggccacattctgggtctaa

SEQ ID NO: 17754 - DNA, 26 bp, Artificial Sequence
  Synthetic Construct
aggtttggggtaggttctttctttag

SEQ ID NO: 17755 - DNA, 21 bp, Artificial Sequence
  Synthetic Construct
cccagaagtccccagagacaa

SEQ ID NO: 17756 - DNA, 25 bp, Artificial Sequence
  Synthetic Construct
acttccctccaagttaaagtgtgaa

SEQ ID NO: 17757 - DNA, 24 bp, Artificial Sequence
  Synthetic Construct
ctggtttggggttgctcctttagt

SEQ ID NO: 17758 - DNA, 23 bp, Artificial Sequence
  Synthetic Construct
gctgttggtgttgttgcctctta

SEQ ID NO: 17759 - DNA, 20 bp, Artificial Sequence
  Synthetic Construct
aagctctgccaccctgtagt

SEQ ID NO: 17760 - DNA, 23 bp, Artificial Sequence
  Synthetic Construct
ccctgtcctaagccactcttttc

SEQ ID NO: 17761 - DNA, 24 bp, Artificial Sequence
  Synthetic Construct
tggatggatatttgttggctgtca

SEQ ID NO: 17762 - DNA, 23 bp, Artificial Sequence
  Synthetic Construct
ctgtgcaaggttagaggcaaaag

SEQ ID NO: 17763 - DNA, 26 bp, Artificial Sequence
  Synthetic Construct
gaggccatcagctttttctctctttg

SEQ ID NO: 17764 - DNA, 24 bp, Artificial Sequence
  Synthetic Construct
tgccctggcatacctctctcatag

SEQ ID NO: 17765 - DNA, 24 bp, Artificial Sequence
  Synthetic Construct
cgacaacaacattgcgaggtctct

SEQ ID NO: 17766 - DNA, 25 bp, Artificial Sequence
  Synthetic Construct
gacaccagtaactgagacaatgcta

SEQ ID NO: 17767 - DNA, 24 bp, Artificial Sequence
  Synthetic Construct
gtcctggacactgatgttttgtga

SEQ ID NO: 17768 - DNA, 26 bp, Artificial Sequence
  Synthetic Construct
aggaggaggatagccttatttcttct

SEQ ID NO: 17769 - DNA, 24 bp, Artificial Sequence
  Synthetic Construct
cttcaggccacagagtaaaacctt

SEQ ID NO: 17770 - DNA, 25 bp, Artificial Sequence
  Synthetic Construct
ggggtgctgttaatatcctccgttt

SEQ ID NO: 17771 - DNA, 23 bp, Artificial Sequence
  Synthetic Construct
ggacaagcgacactggagataag

SEQ ID NO: 17772 - DNA, 22 bp, Artificial Sequence
  Synthetic Construct
ttgactaacacgtcacgacact

SEQ ID NO: 17773 - DNA, 23 bp, Artificial Sequence
  Synthetic Construct
tcatggggtaagagaggttctca

SEQ ID NO: 17774 - DNA, 20 bp, Artificial Sequence
  Synthetic Construct
agggcttttggtgccacgat

SEQ ID NO: 17775 - DNA, 26 bp, Artificial Sequence
  Synthetic Construct
gctcttcctgctgtttatcccagaga

SEQ ID NO: 17776 - DNA, 21 bp, Artificial Sequence
  Synthetic Construct
tttcactcgcaatcccacaga

SEQ ID NO: 17777 - DNA, 22 bp, Artificial Sequence
  Synthetic Construct
ctgccaatccatcagtccttct

SEQ ID NO: 17778 - DNA, 29 bp, Artificial Sequence
  Synthetic Construct
ggggagaagaagttgagttctagatgctt

SEQ ID NO: 17779 - DNA, 22 bp, Artificial Sequence
  Synthetic Construct
ggatgcattgcactaagcatgt

SEQ ID NO: 17780 - DNA, 24 bp, Artificial Sequence
  Synthetic Construct
cagcttgcagaggctagtctttct

SEQ ID NO: 17781 - DNA, 22 bp, Artificial Sequence
  Synthetic Construct
cgaggtactgtgggtctggaaa

SEQ ID NO: 17782 - DNA, 22 bp, Artificial Sequence
  Synthetic Construct
ctgtatgggctctgtgcaggat

SEQ ID NO: 17783 - DNA, 27 bp, Artificial Sequence
  Synthetic Construct
ccctgtaagcaagaacaatgccttcat

SEQ ID NO: 17784 - DNA, 25 bp, Artificial Sequence
  Synthetic Construct
gagtctctcacaaatggtggtctca

SEQ ID NO: 17785 - DNA, 24 bp, Artificial Sequence
  Synthetic Construct
gccaccatgcccttattctgtttg

SEQ ID NO: 17786 - DNA, 30 bp, Artificial Sequence
  Synthetic Construct
ctgtctggcctaaaatgtttacttggctat

SEQ ID NO: 17787 - DNA, 24 bp, Artificial Sequence
  Synthetic Construct
ggaacaacagtcctgagtgcagat

SEQ ID NO: 17788 - DNA, 26 bp, Artificial Sequence
  Synthetic Construct
cgttagcatgtataagagcagtcttc

SEQ ID NO: 17789 - DNA, 25 bp, Artificial Sequence
  Synthetic Construct
gttgatgacacctcaactgtgactt

SEQ ID NO: 17790 - DNA, 26 bp, Artificial Sequence
  Synthetic Construct
ccatccagatcttaggagaaacaaga

SEQ ID NO: 17791 - DNA, 24 bp, Artificial Sequence
  Synthetic Construct
ggcacatctcaatagccccagaca

SEQ ID NO: 17792 - DNA, 22 bp, Artificial Sequence
  Synthetic Construct
ggagggccatcaacaatgtgaa

SEQ ID NO: 17793 - DNA, 21 bp, Artificial Sequence
  Synthetic Construct
agggcccttccttgtggagaa

SEQ ID NO: 17794 - DNA, 22 bp, Artificial Sequence
  Synthetic Construct
ctcaggcccttgtagtccagtt

SEQ ID NO: 17795 - DNA, 20 bp, Artificial Sequence
  Synthetic Construct
gccaggcacatgatggcatt

SEQ ID NO: 17796 - DNA, 22 bp, Artificial Sequence
  Synthetic Construct
ccctttcacgacactggcatct

SEQ ID NO: 17797 - DNA, 24 bp, Artificial Sequence
  Synthetic Construct
ggcttggcagtttcagctatgtgt

SEQ ID NO: 17798 - DNA, 24 bp, Artificial Sequence
  Synthetic Construct
acaggtacttagagcactccctta

SEQ ID NO: 17799 - DNA, 23 bp, Artificial Sequence
  Synthetic Construct
ggggagtgaatggggtgtagaag

SEQ ID NO: 17800 - DNA, 27 bp, Artificial Sequence
  Synthetic Construct
ggttccctgagaattccattgaagata

SEQ ID NO: 17801 - DNA, 22 bp, Artificial Sequence
  Synthetic Construct
cagccctggataaggcaagaga

SEQ ID NO: 17802 - DNA, 26 bp, Artificial Sequence
  Synthetic Construct
ggctagaagttccttcaaggcagata

SEQ ID NO: 17803 - DNA, 24 bp, Artificial Sequence
  Synthetic Construct
ggtaacgattacagctgccaacta

SEQ ID NO: 17804 - DNA, 22 bp, Artificial Sequence
  Synthetic Construct
ccttgggttgcttctccctgaa

SEQ ID NO: 17805 - DNA, 23 bp, Artificial Sequence
  Synthetic Construct
ggtagcataatccccgccttatc

SEQ ID NO: 17806 - DNA, 22 bp, Artificial Sequence
  Synthetic Construct
aggaatgggatgggagaaggat

SEQ ID NO: 17807 - DNA, 24 bp, Artificial Sequence
  Synthetic Construct
ctgccttgtctttgctctcactct

SEQ ID NO: 17808 - DNA, 24 bp, Artificial Sequence
  Synthetic Construct
gggctggactaaaaggtaaacagt

SEQ ID NO: 17809 - DNA, 27 bp, Artificial Sequence
  Synthetic Construct
cctgcagctgatacagtagatggctaa

SEQ ID NO: 17810 - DNA, 26 bp, Artificial Sequence
  Synthetic Construct
gcctgtcttagggaattgtgttggtt

SEQ ID NO: 17811 - DNA, 21 bp, Artificial Sequence
  Synthetic Construct
ggccacggtttaccaggaaca

SEQ ID NO: 17812 - DNA, 23 bp, Artificial Sequence
  Synthetic Construct
ctcccaacacacaaacccatcta

SEQ ID NO: 17813 - DNA, 27 bp, Artificial Sequence
  Synthetic Construct
ctcatcatgggtgatttccttgtggat

SEQ ID NO: 17814 - DNA, 22 bp, Artificial Sequence
  Synthetic Construct
gcacagtcaatatgggcaggaa

SEQ ID NO: 17815 - DNA, 24 bp, Artificial Sequence
  Synthetic Construct
gccatttccactgatcccttgttg

SEQ ID NO: 17816 - DNA, 23 bp, Artificial Sequence
  Synthetic Construct
cagcacctggatccaagacactt

SEQ ID NO: 17817 - DNA, 21 bp, Artificial Sequence
  Synthetic Construct
gacgaagcagaacccactcat

SEQ ID NO: 17818 - DNA, 24 bp, Artificial Sequence
  Synthetic Construct
cctgtgagacacaactatccaaca

SEQ ID NO: 17819 - DNA, 23 bp, Artificial Sequence
  Synthetic Construct
aggcagtgacagaatcgagacta

SEQ ID NO: 17820 - DNA, 22 bp, Artificial Sequence
  Synthetic Construct
gagggtgaggaaaacgctgtga

SEQ ID NO: 17821 - DNA, 20 bp, Artificial Sequence
  Synthetic Construct
tgaccccttgggcatcttga

SEQ ID NO: 17822 - DNA, 23 bp, Artificial Sequence
  Synthetic Construct
cccttagcttcccattgttgtgt

SEQ ID NO: 17823 - DNA, 26 bp, Artificial Sequence
  Synthetic Construct
cacaagaaggctttcccagtatcaac

SEQ ID NO: 17824 - DNA, 24 bp, Artificial Sequence
  Synthetic Construct
cctgctgttagttttccaccacaa

SEQ ID NO: 17825 - DNA, 21 bp, Artificial Sequence
  Synthetic Construct
gggctttggaagacactgcaa

SEQ ID NO: 17826 - DNA, 24 bp, Artificial Sequence
  Synthetic Construct
agtgctgtgctacctaattgcttt

SEQ ID NO: 17827 - DNA, 22 bp, Artificial Sequence
  Synthetic Construct
gtgccgatctaatcgcaagtga

SEQ ID NO: 17828 - DNA, 25 bp, Artificial Sequence
  Synthetic Construct
ggattttggttgccttttcccacta

SEQ ID NO: 17829 - DNA, 23 bp, Artificial Sequence
  Synthetic Construct
ccagcagcaacagcacacatttt

SEQ ID NO: 17830 - DNA, 24 bp, Artificial Sequence
  Synthetic Construct
gtggcaacatacaaacagcactaa

SEQ ID NO: 17831 - DNA, 23 bp, Artificial Sequence
  Synthetic Construct
gctgtcatcagacccaagccaaa

SEQ ID NO: 17832 - DNA, 23 bp, Artificial Sequence
  Synthetic Construct
tggcaagagctgacatttaccaa

SEQ ID NO: 17833 - DNA, 26 bp, Artificial Sequence
  Synthetic Construct
ccacctatactgaacttaggggaaga

SEQ ID NO: 17834 - DNA, 22 bp, Artificial Sequence
  Synthetic Construct
accaggaaccttcttgggcata

SEQ ID NO: 17835 - DNA, 24 bp, Artificial Sequence
  Synthetic Construct
caccatgcaggggtttattactga

SEQ ID NO: 17836 - DNA, 22 bp, Artificial Sequence
  Synthetic Construct
gttagcgttttggggaggtagt

SEQ ID NO: 17837 - DNA, 27 bp, Artificial Sequence
  Synthetic Construct
ccttgcttgaaatttcccgtatagatg

SEQ ID NO: 17838 - DNA, 26 bp, Artificial Sequence
  Synthetic Construct
caggccagagttaatcagatttggaa

SEQ ID NO: 17839 - DNA, 20 bp, Artificial Sequence
  Synthetic Construct
gggctggaagaggctgcaaa

SEQ ID NO: 17840 - DNA, 25 bp, Artificial Sequence
  Synthetic Construct
ggttcctgtgtgtagctgatcattc

SEQ ID NO: 17841 - DNA, 22 bp, Artificial Sequence
  Synthetic Construct
gcctcaagtgcaggaaaagaca

SEQ ID NO: 17842 - DNA, 26 bp, Artificial Sequence
  Synthetic Construct
gtgcctgctagtacatctggtgttag

SEQ ID NO: 17843 - DNA, 22 bp, Artificial Sequence
  Synthetic Construct
ggtgccactgactccaaggaaa

SEQ ID NO: 17844 - DNA, 24 bp, Artificial Sequence
  Synthetic Construct
tcttcttctgcaactctgttccaa

SEQ ID NO: 17845 - DNA, 22 bp, Artificial Sequence
  Synthetic Construct
gatggtgccttgttgctgaatc

SEQ ID NO: 17846 - DNA, 23 bp, Artificial Sequence
  Synthetic Construct
ctctctgcttgtgagtggtgaca

SEQ ID NO: 17847 - DNA, 25 bp, Artificial Sequence
  Synthetic Construct
ccccacaccaagtatttttgctctt

SEQ ID NO: 17848 - DNA, 27 bp, Artificial Sequence
  Synthetic Construct
ggataggtcagttaattgggattcaga

SEQ ID NO: 17849 - DNA, 20 bp, Artificial Sequence
  Synthetic Construct
ttgcaggagccccttccaat

SEQ ID NO: 17850 - DNA, 20 bp, Artificial Sequence
  Synthetic Construct
gggtgccagttctgctgcat

SEQ ID NO: 17851 - DNA, 30 bp, Artificial Sequence
  Synthetic Construct
gtgagaaggggtctagtatttagggaaaaa

SEQ ID NO: 17852 - DNA, 23 bp, Artificial Sequence
  Synthetic Construct
caccaagctcattctctgccaat

SEQ ID NO: 17853 - DNA, 22 bp, Artificial Sequence
  Synthetic Construct
ggtggccaagtgcagaagaaca

SEQ ID NO: 17854 - DNA, 26 bp, Artificial Sequence
  Synthetic Construct
cctgaacaaatttcagtggcagacaa

SEQ ID NO: 17855 - DNA, 25 bp, Artificial Sequence
  Synthetic Construct
ccctttcctttcttctgctccaagt

SEQ ID NO: 17856 - DNA, 26 bp, Artificial Sequence
  Synthetic Construct
gagatagcaagtacaaaccacacgta

SEQ ID NO: 17857 - DNA, 20 bp, Artificial Sequence
  Synthetic Construct
ttgacacgcaaccccacaca

SEQ ID NO: 17858 - DNA, 27 bp, Artificial Sequence
  Synthetic Construct
gctccttttcctcagcacataaacata

SEQ ID NO: 17859 - DNA, 21 bp, Artificial Sequence
  Synthetic Construct
cggcatgagcgaagaggatct

SEQ ID NO: 17860 - DNA, 25 bp, Artificial Sequence
  Synthetic Construct
gcaatctccaggacccctaaaattc

SEQ ID NO: 17861 - DNA, 21 bp, Artificial Sequence
  Synthetic Construct
tggagaagggccaacatcagt

SEQ ID NO: 17862 - DNA, 21 bp, Artificial Sequence
  Synthetic Construct
gcaggtttttggttgccttga

SEQ ID NO: 17863 - DNA, 22 bp, Artificial Sequence
  Synthetic Construct
gggtctctgtcgccatctttct

SEQ ID NO: 17864 - DNA, 26 bp, Artificial Sequence
  Synthetic Construct
tcgtgagtgggtcatttatgtcttag

SEQ ID NO: 17865 - DNA, 23 bp, Artificial Sequence
  Synthetic Construct
gtcctgacaaagcaggacataca

SEQ ID NO: 17866 - DNA, 25 bp, Artificial Sequence
  Synthetic Construct
ggaatcaattgtttgccagcacagt

SEQ ID NO: 17867 - DNA, 23 bp, Artificial Sequence
  Synthetic Construct
ttgctcctccttttctcctcttc

SEQ ID NO: 17868 - DNA, 24 bp, Artificial Sequence
  Synthetic Construct
tctctcgggcaaacttacatttca

SEQ ID NO: 17869 - DNA, 23 bp, Artificial Sequence
  Synthetic Construct
cccacagtttgacaagcagactt

SEQ ID NO: 17870 - DNA, 22 bp, Artificial Sequence
  Synthetic Construct
agggagcctcttcctcagatgt

SEQ ID NO: 17871 - DNA, 22 bp, Artificial Sequence
  Synthetic Construct
gctggggagtgtcaatgagcaa

SEQ ID NO: 17872 - DNA, 21 bp, Artificial Sequence
  Synthetic Construct
ggagtgcgttcatgagtcagt

SEQ ID NO: 17873 - DNA, 21 bp, Artificial Sequence
  Synthetic Construct
gggctaaaagggcacactgta

SEQ ID NO: 17874 - DNA, 27 bp, Artificial Sequence
  Synthetic Construct
gaaccaaagactggtaagaccattaac

SEQ ID NO: 17875 - DNA, 22 bp, Artificial Sequence
  Synthetic Construct
tgggtgaaacagggcagtcttg

SEQ ID NO: 17876 - DNA, 24 bp, Artificial Sequence
  Synthetic Construct
gctcacaggggtttggggttattg

SEQ ID NO: 17877 - DNA, 27 bp, Artificial Sequence
  Synthetic Construct
gatcctagtgattctttgggacctaac

SEQ ID NO: 17878 - DNA, 22 bp, Artificial Sequence
  Synthetic Construct
ccctggaggaaaacggtacaca

SEQ ID NO: 17879 - DNA, 23 bp, Artificial Sequence
  Synthetic Construct
catgacaccagttgccacaaatc

SEQ ID NO: 17880 - DNA, 23 bp, Artificial Sequence
  Synthetic Construct
gctccaccacttctttgagtttc

SEQ ID NO: 17881 - DNA, 22 bp, Artificial Sequence
  Synthetic Construct
gaggtcagttggacccttcaga

SEQ ID NO: 17882 - DNA, 22 bp, Artificial Sequence
  Synthetic Construct
actcatctgatgcccctctagt

SEQ ID NO: 17883 - DNA, 25 bp, Artificial Sequence
  Synthetic Construct
gaaatgtcctttcctttctgcactt

SEQ ID NO: 17884 - DNA, 25 bp, Artificial Sequence
  Synthetic Construct
ggattcctgggctactccatttttc

SEQ ID NO: 17885 - DNA, 23 bp, Artificial Sequence
  Synthetic Construct
gccctgccactcagctttctatc

SEQ ID NO: 17886 - DNA, 20 bp, Artificial Sequence
  Synthetic Construct
tgcactcaccagacccaagt

SEQ ID NO: 17887 - DNA, 24 bp, Artificial Sequence
  Synthetic Construct
tgttcaatcagttggcagactttc

SEQ ID NO: 17888 - DNA, 29 bp, Artificial Sequence
  Synthetic Construct
ggtggagagtgtctactactgttgagaag

SEQ ID NO: 17889 - DNA, 28 bp, Artificial Sequence
  Synthetic Construct
gcctctttcctttcctaacagtctcttc

SEQ ID NO: 17890 - DNA, 22 bp, Artificial Sequence
  Synthetic Construct
gtggccaggtcagggatacatt

SEQ ID NO: 17891 - DNA, 22 bp, Artificial Sequence
  Synthetic Construct
gctctctgggaagacagagttc

SEQ ID NO: 17892 - DNA, 24 bp, Artificial Sequence
  Synthetic Construct
gggtgctgtattggaatccttagt

SEQ ID NO: 17893 - DNA, 27 bp, Artificial Sequence
  Synthetic Construct
ggggttgaagagaaaggttaggacaag

SEQ ID NO: 17894 - DNA, 22 bp, Artificial Sequence
  Synthetic Construct
ccctcggcataaaccctactca

SEQ ID NO: 17895 - DNA, 24 bp, Artificial Sequence
  Synthetic Construct
gcaaatgtgaccctaggcagaaac

SEQ ID NO: 17896 - DNA, 24 bp, Artificial Sequence
  Synthetic Construct
gcgctcaatcttgagttgttgaag

SEQ ID NO: 17897 - DNA, 25 bp, Artificial Sequence
  Synthetic Construct
gctgtcttgacaactttgtgcttca

SEQ ID NO: 17898 - DNA, 24 bp, Artificial Sequence
  Synthetic Construct
gccaatcctttctcacgataccta

SEQ ID NO: 17899 - DNA, 24 bp, Artificial Sequence
  Synthetic Construct
cgctttggagagctattgcttaaa

SEQ ID NO: 17900 - DNA, 19 bp, Artificial Sequence
  Synthetic Construct
ttctgggcgagggatggta

SEQ ID NO: 17901 - DNA, 24 bp, Artificial Sequence
  Synthetic Construct
ggaacatcaaggtagtgtggatca

SEQ ID NO: 17902 - DNA, 27 bp, Artificial Sequence
  Synthetic Construct
ctcttgacacttgtggccaagttaatc

SEQ ID NO: 17903 - DNA, 24 bp, Artificial Sequence
  Synthetic Construct
ggggtgtaggagcaagataagcaa

SEQ ID NO: 17904 - DNA, 26 bp, Artificial Sequence
  Synthetic Construct
cttctcagcaagtgggaaagaatgtt

SEQ ID NO: 17905 - DNA, 23 bp, Artificial Sequence
  Synthetic Construct
cccagtgtctaacaaggcactct

SEQ ID NO: 17906 - DNA, 24 bp, Artificial Sequence
  Synthetic Construct
gggaggagcacattaaaagtggaa

SEQ ID NO: 17907 - DNA, 21 bp, Artificial Sequence
  Synthetic Construct
cctcccatacagggccaaact

SEQ ID NO: 17908 - DNA, 27 bp, Artificial Sequence
  Synthetic Construct
gctgctgatgaaagaatcacatcatct

SEQ ID NO: 17909 - DNA, 25 bp, Artificial Sequence
  Synthetic Construct
ccaagaaccaagacctcaacctgaa

SEQ ID NO: 17910 - DNA, 22 bp, Artificial Sequence
  Synthetic Construct
ctggctggcactaaggaagcaa

SEQ ID NO: 17911 - DNA, 22 bp, Artificial Sequence
  Synthetic Construct
gcatcctgcaatgctgggaaag

SEQ ID NO: 17912 - DNA, 26 bp, Artificial Sequence
  Synthetic Construct
ccaactcacttagcattgcattgtgt

SEQ ID NO: 17913 - DNA, 25 bp, Artificial Sequence
  Synthetic Construct
ggacgtatagagagctgagactttg

SEQ ID NO: 17914 - DNA, 27 bp, Artificial Sequence
  Synthetic Construct
gggcttacacactttactgtcacactt

SEQ ID NO: 17915 - DNA, 25 bp, Artificial Sequence
  Synthetic Construct
ggcagtgtaaaatgcctcacagatg

SEQ ID NO: 17916 - DNA, 24 bp, Artificial Sequence
  Synthetic Construct
tcaggcttttaacccaccagtatt

SEQ ID NO: 17917 - DNA, 25 bp, Artificial Sequence
  Synthetic Construct
ctgctcacaacctagcaacctcttt

SEQ ID NO: 17918 - DNA, 23 bp, Artificial Sequence
  Synthetic Construct
cagcagccaaaccgtttaaccat

SEQ ID NO: 17919 - DNA, 25 bp, Artificial Sequence
  Synthetic Construct
cctgaacctactccatctgttccta

SEQ ID NO: 17920 - DNA, 25 bp, Artificial Sequence
  Synthetic Construct
ccaactgcctgaaggtctgtttttg

SEQ ID NO: 17921 - DNA, 25 bp, Artificial Sequence
  Synthetic Construct
gcaccttactctctagccccaagtt

SEQ ID NO: 17922 - DNA, 25 bp, Artificial Sequence
  Synthetic Construct
cagattcctaactcaccttcagcaa

SEQ ID NO: 17923 - DNA, 22 bp, Artificial Sequence
  Synthetic Construct
cccgtcacacgactaggaaaga

SEQ ID NO: 17924 - DNA, 23 bp, Artificial Sequence
  Synthetic Construct
gcagttactcctcttccccactt

SEQ ID NO: 17925 - DNA, 22 bp, Artificial Sequence
  Synthetic Construct
gcctggttcagcagtctcagtt

SEQ ID NO: 17926 - DNA, 24 bp, Artificial Sequence
  Synthetic Construct
gactgccctttttcacttggtgat

SEQ ID NO: 17927 - DNA, 21 bp, Artificial Sequence
  Synthetic Construct
gctgacacccgtacccagaga

SEQ ID NO: 17928 - DNA, 23 bp, Artificial Sequence
  Synthetic Construct
gaaccccaggacatctattggtt

SEQ ID NO: 17929 - DNA, 24 bp, Artificial Sequence
  Synthetic Construct
ccaggtttcccttgcagtttcagt

SEQ ID NO: 17930 - DNA, 22 bp, Artificial Sequence
  Synthetic Construct
agacaccatgtctcctcacaga

SEQ ID NO: 17931 - DNA, 28 bp, Artificial Sequence
  Synthetic Construct
gggctgaccattaacttaggtttacact

SEQ ID NO: 17932 - DNA, 26 bp, Artificial Sequence
  Synthetic Construct
ccatgtcaggaaagtcctcatgtttc

SEQ ID NO: 17933 - DNA, 25 bp, Artificial Sequence
  Synthetic Construct
gggtcctccatgtcatctaacaaac

SEQ ID NO: 17934 - DNA, 23 bp, Artificial Sequence
  Synthetic Construct
tgggatagagtggggaaatggat

SEQ ID NO: 17935 - DNA, 23 bp, Artificial Sequence
  Synthetic Construct
gggcacatttaagaagccctgat

SEQ ID NO: 17936 - DNA, 27 bp, Artificial Sequence
  Synthetic Construct
ggcataaaaatagggatgggaccatta

SEQ ID NO: 17937 - DNA, 22 bp, Artificial Sequence
  Synthetic Construct
tgcggtcagaagagtagtcaga

SEQ ID NO: 17938 - DNA, 27 bp, Artificial Sequence
  Synthetic Construct
cccctagttactacagagctaagacaa

SEQ ID NO: 17939 - DNA, 21 bp, Artificial Sequence
  Synthetic Construct
gcctggcaaaggagctgtcat

SEQ ID NO: 17940 - DNA, 25 bp, Artificial Sequence
  Synthetic Construct
ccagttgctctcaagtttgcctttg

SEQ ID NO: 17941 - DNA, 24 bp, Artificial Sequence
  Synthetic Construct
gactaaccaacgaaaacagcaagt

SEQ ID NO: 17942 - DNA, 22 bp, Artificial Sequence
  Synthetic Construct
gtctgtgtccaccaggctatga

SEQ ID NO: 17943 - DNA, 20 bp, Artificial Sequence
  Synthetic Construct
acgaccttgcgggtgattct

SEQ ID NO: 17944 - DNA, 21 bp, Artificial Sequence
  Synthetic Construct
gccaccaccatgctggctaaa

SEQ ID NO: 17945 - DNA, 24 bp, Artificial Sequence
  Synthetic Construct
ccctgaagcgttccaaacatctca

SEQ ID NO: 17946 - DNA, 25 bp, Artificial Sequence
  Synthetic Construct
gcaacttgacgtagatagaggagat

SEQ ID NO: 17947 - DNA, 22 bp, Artificial Sequence
  Synthetic Construct
gggcccactttctggttcatag

SEQ ID NO: 17948 - DNA, 27 bp, Artificial Sequence
  Synthetic Construct
ggtaagaacagtggatgagaaatggat

SEQ ID NO: 17949 - DNA, 23 bp, Artificial Sequence
  Synthetic Construct
tggaagtcccatagccttactga

SEQ ID NO: 17950 - DNA, 24 bp, Artificial Sequence
  Synthetic Construct
ctgtctcttctggcaaatccttca

SEQ ID NO: 17951 - DNA, 26 bp, Artificial Sequence
  Synthetic Construct
cctgattcctcacttcacatggaatc

SEQ ID NO: 17952 - DNA, 20 bp, Artificial Sequence
  Synthetic Construct
gtcactcatgggctcggaaa

SEQ ID NO: 17953 - DNA, 21 bp, Artificial Sequence
  Synthetic Construct
ggcctcctagaccacttcaga

SEQ ID NO: 17954 - DNA, 22 bp, Artificial Sequence
  Synthetic Construct
ctgacatcgcactggccaaaac

SEQ ID NO: 17955 - DNA, 22 bp, Artificial Sequence
  Synthetic Construct
ccaaatgagggtcccactgctt

SEQ ID NO: 17956 - DNA, 28 bp, Artificial Sequence
  Synthetic Construct
gacatgcttcaccaaacttcagactcta

SEQ ID NO: 17957 - DNA, 22 bp, Artificial Sequence
  Synthetic Construct
ggcacaaagaggctgtcctgaa

SEQ ID NO: 17958 - DNA, 22 bp, Artificial Sequence
  Synthetic Construct
tcaccgaagtcctcctccatca

SEQ ID NO: 17959 - DNA, 22 bp, Artificial Sequence
  Synthetic Construct
gtgggcagaggaaaaacacttc

SEQ ID NO: 17960 - DNA, 27 bp, Artificial Sequence
  Synthetic Construct
ctcattgccagttacataaacctgtga

SEQ ID NO: 17961 - DNA, 24 bp, Artificial Sequence
  Synthetic Construct
cccctttccctctcaactggaaga

SEQ ID NO: 17962 - DNA, 23 bp, Artificial Sequence
  Synthetic Construct
cctccaggctaagaacccttttg

SEQ ID NO: 17963 - DNA, 21 bp, Artificial Sequence
  Synthetic Construct
actttgcctggggaagtcagt

SEQ ID NO: 17964 - DNA, 22 bp, Artificial Sequence
  Synthetic Construct
tccccagctgtctagtggttct

SEQ ID NO: 17965 - DNA, 22 bp, Artificial Sequence
  Synthetic Construct
gggccttggtgaacatcgtctt

SEQ ID NO: 17966 - DNA, 24 bp, Artificial Sequence
  Synthetic Construct
ctcggtggctttttaagttcatgt

SEQ ID NO: 17967 - DNA, 22 bp, Artificial Sequence
  Synthetic Construct
ggtgagttgctggaggctcatt

SEQ ID NO: 17968 - DNA, 25 bp, Artificial Sequence
  Synthetic Construct
gagcaagcaagaagtcattgaaact

SEQ ID NO: 17969 - DNA, 27 bp, Artificial Sequence
  Synthetic Construct
gcaagaagtacagttgagacacaaaca

SEQ ID NO: 17970 - DNA, 24 bp, Artificial Sequence
  Synthetic Construct
agccaaaaccatttggaaccattg

SEQ ID NO: 17971 - DNA, 26 bp, Artificial Sequence
  Synthetic Construct
cctgacttattgcctcaaacctctac

SEQ ID NO: 17972 - DNA, 24 bp, Artificial Sequence
  Synthetic Construct
ggggcatgctaagagtcaggagta

SEQ ID NO: 17973 - DNA, 21 bp, Artificial Sequence
  Synthetic Construct
gtgaatcatgggcaggacctt

SEQ ID NO: 17974 - DNA, 26 bp, Artificial Sequence
  Synthetic Construct
gttcagactggtatggacagtaaaca

SEQ ID NO: 17975 - DNA, 26 bp, Artificial Sequence
  Synthetic Construct
gccttggataagcggtaatcctgaca

SEQ ID NO: 17976 - DNA, 22 bp, Artificial Sequence
  Synthetic Construct
cacatggcctgggttggaatca

SEQ ID NO: 17977 - DNA, 25 bp, Artificial Sequence
  Synthetic Construct
gacatatcataggtgtccagcacat

SEQ ID NO: 17978 - DNA, 24 bp, Artificial Sequence
  Synthetic Construct
ggttatcctcttccggtggagttg

SEQ ID NO: 17979 - DNA, 23 bp, Artificial Sequence
  Synthetic Construct
ctcatcacacagagggagagctt

SEQ ID NO: 17980 - DNA, 24 bp, Artificial Sequence
  Synthetic Construct
cccttcatggctcaatctggcatt

SEQ ID NO: 17981 - DNA, 24 bp, Artificial Sequence
  Synthetic Construct
ggtaactggaccagaacaggttag

SEQ ID NO: 17982 - DNA, 25 bp, Artificial Sequence
  Synthetic Construct
tgatcaccggcagattcaattaaga

SEQ ID NO: 17983 - DNA, 22 bp, Artificial Sequence
  Synthetic Construct
tgtcacccagaaaaagctcagt

SEQ ID NO: 17984 - DNA, 23 bp, Artificial Sequence
  Synthetic Construct
cactcccttgtttaggcatccaa

SEQ ID NO: 17985 - DNA, 23 bp, Artificial Sequence
  Synthetic Construct
gccagggcccataatttcactct

SEQ ID NO: 17986 - DNA, 24 bp, Artificial Sequence
  Synthetic Construct
ctacttgcctgtgtggacaatact

SEQ ID NO: 17987 - DNA, 23 bp, Artificial Sequence
  Synthetic Construct
aagcagcggatcaacttcttttc

SEQ ID NO: 17988 - DNA, 28 bp, Artificial Sequence
  Synthetic Construct
gctgagtgagtgataaaggacagttgta

SEQ ID NO: 17989 - DNA, 24 bp, Artificial Sequence
  Synthetic Construct
tcttatcctgtacctcccatgctt

SEQ ID NO: 17990 - DNA, 20 bp, Artificial Sequence
  Synthetic Construct
gggtgatgcgctcttccaaa

SEQ ID NO: 17991 - DNA, 20 bp, Artificial Sequence
  Synthetic Construct
tgccacctattccccagtgt

SEQ ID NO: 17992 - DNA, 27 bp, Artificial Sequence
  Synthetic Construct
cgttgtgtacaacaagaaggagagaag

SEQ ID NO: 17993 - DNA, 22 bp, Artificial Sequence
  Synthetic Construct
cctacacctgcttcctgtcctt

SEQ ID NO: 17994 - DNA, 25 bp, Artificial Sequence
  Synthetic Construct
ctgtcactgaccatttggagttttg

SEQ ID NO: 17995 - DNA, 25 bp, Artificial Sequence
  Synthetic Construct
ggtggggaggtgagattttgtgatg

SEQ ID NO: 17996 - DNA, 21 bp, Artificial Sequence
  Synthetic Construct
tccgtttgggctcacctcagt

SEQ ID NO: 17997 - DNA, 24 bp, Artificial Sequence
  Synthetic Construct
ggctggttttctcaggggaataag

SEQ ID NO: 17998 - DNA, 24 bp, Artificial Sequence
  Synthetic Construct
cgcatccattacacctgggacatt

SEQ ID NO: 17999 - DNA, 25 bp, Artificial Sequence
  Synthetic Construct
ttcaggtcttggcttaaatgtcaac

SEQ ID NO: 18000 - DNA, 23 bp, Artificial Sequence
  Synthetic Construct
gttgggcagtgacttgctttttc

SEQ ID NO: 18001 - DNA, 24 bp, Artificial Sequence
  Synthetic Construct
gtgtccgaaagagagcaaggagtt

SEQ ID NO: 18002 - DNA, 22 bp, Artificial Sequence
  Synthetic Construct
gcagggaacaggcgaatgtgta

SEQ ID NO: 18003 - DNA, 20 bp, Artificial Sequence
  Synthetic Construct
cagcaattcagccccagtgt

SEQ ID NO: 18004 - DNA, 24 bp, Artificial Sequence
  Synthetic Construct
ggctagctctctgtggagttgaag

SEQ ID NO: 18005 - DNA, 24 bp, Artificial Sequence
  Synthetic Construct
gctggggtttgaactcaggtctgt

SEQ ID NO: 18006 - DNA, 26 bp, Artificial Sequence
  Synthetic Construct
gtgctgaatgctgttctcagagtttg

SEQ ID NO: 18007 - DNA, 25 bp, Artificial Sequence
  Synthetic Construct
cgaggaccatccagtttttccaaag

SEQ ID NO: 18008 - DNA, 28 bp, Artificial Sequence
  Synthetic Construct
ggaatgcctgggatgatttactaagaga

SEQ ID NO: 18009 - DNA, 25 bp, Artificial Sequence
  Synthetic Construct
gtccctcctaatccagatactcaca

SEQ ID NO: 18010 - DNA, 23 bp, Artificial Sequence
  Synthetic Construct
ggtgctctgaggatccaatggta

SEQ ID NO: 18011 - DNA, 22 bp, Artificial Sequence
  Synthetic Construct
ctcccaggaaacacagcaatga

SEQ ID NO: 18012 - DNA, 23 bp, Artificial Sequence
  Synthetic Construct
gcaaaaggatgtgagcagagcat

SEQ ID NO: 18013 - DNA, 23 bp, Artificial Sequence
  Synthetic Construct
tctctgactcccaatcccctaac

SEQ ID NO: 18014 - DNA, 22 bp, Artificial Sequence
  Synthetic Construct
gtggtgggttgatgaggacaag

SEQ ID NO: 18015 - DNA, 22 bp, Artificial Sequence
  Synthetic Construct
cacccagccgatttagggtaat

SEQ ID NO: 18016 - DNA, 28 bp, Artificial Sequence
  Synthetic Construct
cccaatgtcagttaagcaagtgttccta

SEQ ID NO: 18017 - DNA, 26 bp, Artificial Sequence
  Synthetic Construct
ccatacaaccttgtgggatacaatct

SEQ ID NO: 18018 - DNA, 25 bp, Artificial Sequence
  Synthetic Construct
cacatgcaaatgcaaactgcagaag

SEQ ID NO: 18019 - DNA, 23 bp, Artificial Sequence
  Synthetic Construct
gcatcatttccctgtggcgagtt

SEQ ID NO: 18020 - DNA, 26 bp, Artificial Sequence
  Synthetic Construct
gcacattataaggatcctggctttga

SEQ ID NO: 18021 - DNA, 23 bp, Artificial Sequence
  Synthetic Construct
cagtgggaaggaaatgggacaga

SEQ ID NO: 18022 - DNA, 24 bp, Artificial Sequence
  Synthetic Construct
tgtggaagaaggatcctcatggta

SEQ ID NO: 18023 - DNA, 22 bp, Artificial Sequence
  Synthetic Construct
gcctgtagatccattggccttt

SEQ ID NO: 18024 - DNA, 24 bp, Artificial Sequence
  Synthetic Construct
cctccaaacttcctgagagagatg

SEQ ID NO: 18025 - DNA, 23 bp, Artificial Sequence
  Synthetic Construct
gagctggggagacttagtcagat

SEQ ID NO: 18026 - DNA, 25 bp, Artificial Sequence
  Synthetic Construct
gttagagactggaagatgccataca

SEQ ID NO: 18027 - DNA, 24 bp, Artificial Sequence
  Synthetic Construct
cctcttgagtctttacctgtgtgt

SEQ ID NO: 18028 - DNA, 20 bp, Artificial Sequence
  Synthetic Construct
gcattgggtgcacgttgaga

SEQ ID NO: 18029 - DNA, 22 bp, Artificial Sequence
  Synthetic Construct
ccgaagatggcaatgacgttga

SEQ ID NO: 18030 - DNA, 23 bp, Artificial Sequence
  Synthetic Construct
cgcaggctctggaattctttact

SEQ ID NO: 18031 - DNA, 26 bp, Artificial Sequence
  Synthetic Construct
gaccttgcccacaaaagtcaatgttc

SEQ ID NO: 18032 - DNA, 20 bp, Artificial Sequence
  Synthetic Construct
tgggtctcaagtggcccaaa

SEQ ID NO: 18033 - DNA, 23 bp, Artificial Sequence
  Synthetic Construct
gtggggattatctgggagtgtga

SEQ ID NO: 18034 - DNA, 25 bp, Artificial Sequence
  Synthetic Construct
gggcaaatagctcctttcgatccta

SEQ ID NO: 18035 - DNA, 20 bp, Artificial Sequence
  Synthetic Construct
gggcaggtatgaggctgaca

SEQ ID NO: 18036 - DNA, 24 bp, Artificial Sequence
  Synthetic Construct
ggctatggcttcactccatctttc

SEQ ID NO: 18037 - DNA, 23 bp, Artificial Sequence
  Synthetic Construct
gttgaagttccctgcatttcaca

SEQ ID NO: 18038 - DNA, 25 bp, Artificial Sequence
  Synthetic Construct
gaccctgcagtagtacttttgttct

SEQ ID NO: 18039 - DNA, 25 bp, Artificial Sequence
  Synthetic Construct
gcctcatgtaactctctgggtatga

SEQ ID NO: 18040 - DNA, 26 bp, Artificial Sequence
  Synthetic Construct
ccaatgcctcaatttctccaggaaac

SEQ ID NO: 18041 - DNA, 25 bp, Artificial Sequence
  Synthetic Construct
tgatgcttctagtccacagactttc

SEQ ID NO: 18042 - DNA, 23 bp, Artificial Sequence
  Synthetic Construct
ggtggctggaagtttgttgaaga

SEQ ID NO: 18043 - DNA, 25 bp, Artificial Sequence
  Synthetic Construct
tgtttgtcatcagtctggaatgctt

SEQ ID NO: 18044 - DNA, 23 bp, Artificial Sequence
  Synthetic Construct
ggaaccgcatttaggtcgtgttg

SEQ ID NO: 18045 - DNA, 28 bp, Artificial Sequence
  Synthetic Construct
ctgaaccaactaaaaacaggtggtgttg

SEQ ID NO: 18046 - DNA, 20 bp, Artificial Sequence
  Synthetic Construct
gggccccatagcttgcaaat

SEQ ID NO: 18047 - DNA, 25 bp, Artificial Sequence
  Synthetic Construct
ccctgcttttcctaagggcagattt

SEQ ID NO: 18048 - DNA, 24 bp, Artificial Sequence
  Synthetic Construct
gcccggtgctttgttttactgtga

SEQ ID NO: 18049 - DNA, 27 bp, Artificial Sequence
  Synthetic Construct
gggtcatggtttcaaggaaatggattg

SEQ ID NO: 18050 - DNA, 25 bp, Artificial Sequence
  Synthetic Construct
ggctatgggagaaacagtaccatgt

SEQ ID NO: 18051 - DNA, 23 bp, Artificial Sequence
  Synthetic Construct
cctgccctgtagtcttcctgtct

SEQ ID NO: 18052 - DNA, 24 bp, Artificial Sequence
  Synthetic Construct
ctggcctgtgtttttaggccattt

SEQ ID NO: 18053 - DNA, 25 bp, Artificial Sequence
  Synthetic Construct
ggaaagacagttaaggctggctcta

SEQ ID NO: 18054 - DNA, 23 bp, Artificial Sequence
  Synthetic Construct
gggagtaggttgccttcttgcta

SEQ ID NO: 18055 - DNA, 24 bp, Artificial Sequence
  Synthetic Construct
cctgaagaacgcgattgacccatt

SEQ ID NO: 18056 - DNA, 26 bp, Artificial Sequence
  Synthetic Construct
ctcacctgcttgtttgattctcctta

SEQ ID NO: 18057 - DNA, 24 bp, Artificial Sequence
  Synthetic Construct
gcggaattcagtcagacagtgaac

SEQ ID NO: 18058 - DNA, 23 bp, Artificial Sequence
  Synthetic Construct
acacaggctgaaggaaatgatgt

SEQ ID NO: 18059 - DNA, 23 bp, Artificial Sequence
  Synthetic Construct
cggttatcagccagaaggggttt

SEQ ID NO: 18060 - DNA, 21 bp, Artificial Sequence
  Synthetic Construct
gggtggatggaagggatgtga

SEQ ID NO: 18061 - DNA, 25 bp, Artificial Sequence
  Synthetic Construct
gtaccaaccctcgtaagttccttag

SEQ ID NO: 18062 - DNA, 19 bp, Artificial Sequence
  Synthetic Construct
gcaccaagaccacgaccaa

SEQ ID NO: 18063 - DNA, 24 bp, Artificial Sequence
  Synthetic Construct
gcccttggcttattttcccctttc

SEQ ID NO: 18064 - DNA, 26 bp, Artificial Sequence
  Synthetic Construct
gggctccctattttccaaagatcaga

SEQ ID NO: 18065 - DNA, 22 bp, Artificial Sequence
  Synthetic Construct
gttgccctgagatgttcactgt

SEQ ID NO: 18066 - DNA, 24 bp, Artificial Sequence
  Synthetic Construct
ggcacaagtgagctgagtttcaga

SEQ ID NO: 18067 - DNA, 26 bp, Artificial Sequence
  Synthetic Construct
gctaggaggtccgaattcttttgaac

SEQ ID NO: 18068 - DNA, 21 bp, Artificial Sequence
  Synthetic Construct
tgcccctggaaagactacaga

SEQ ID NO: 18069 - DNA, 27 bp, Artificial Sequence
  Synthetic Construct
gggaagttcaaattgctgagcttgtag

SEQ ID NO: 18070 - DNA, 26 bp, Artificial Sequence
  Synthetic Construct
ccaaccagctatgctaccatttctac

SEQ ID NO: 18071 - DNA, 25 bp, Artificial Sequence
  Synthetic Construct
gcaacaggagatttttggttgtttg

SEQ ID NO: 18072 - DNA, 22 bp, Artificial Sequence
  Synthetic Construct
tgtgtcaggttttaggctgctt

SEQ ID NO: 18073 - DNA, 20 bp, Artificial Sequence
  Synthetic Construct
aggccacaaagcctcacatc

SEQ ID NO: 18074 - DNA, 23 bp, Artificial Sequence
  Synthetic Construct
aacaggagtagcagaaaggcaaa

SEQ ID NO: 18075 - DNA, 26 bp, Artificial Sequence
  Synthetic Construct
cagcagcttaaacaaccatgagaagt

SEQ ID NO: 18076 - DNA, 26 bp, Artificial Sequence
  Synthetic Construct
ccttcatcattggtagcctagctgta

SEQ ID NO: 18077 - DNA, 23 bp, Artificial Sequence
  Synthetic Construct
gtcaacccgaatagctcctttct

SEQ ID NO: 18078 - DNA, 22 bp, Artificial Sequence
  Synthetic Construct
ccccacatcacagggctttaga

SEQ ID NO: 18079 - DNA, 19 bp, Artificial Sequence
  Synthetic Construct
tccgctcaagcgtccaagt

SEQ ID NO: 18080 - DNA, 26 bp, Artificial Sequence
  Synthetic Construct
cctggaatggttttatctgacaggtt

SEQ ID NO: 18081 - DNA, 22 bp, Artificial Sequence
  Synthetic Construct
ggccctgactttgctccaagat

SEQ ID NO: 18082 - DNA, 24 bp, Artificial Sequence
  Synthetic Construct
caggcgttatcaactttcccactt

SEQ ID NO: 18083 - DNA, 26 bp, Artificial Sequence
  Synthetic Construct
ccctctgaatcactctctgctcttca

SEQ ID NO: 18084 - DNA, 24 bp, Artificial Sequence
  Synthetic Construct
gctgtcttctctaacacccagtct

SEQ ID NO: 18085 - DNA, 23 bp, Artificial Sequence
  Synthetic Construct
caggcatggtcagaagggttaag

SEQ ID NO: 18086 - DNA, 22 bp, Artificial Sequence
  Synthetic Construct
gatgctcttaggcatgggaagt

SEQ ID NO: 18087 - DNA, 22 bp, Artificial Sequence
  Synthetic Construct
tgtgtgtttctgctccttcctt

SEQ ID NO: 18088 - DNA, 24 bp, Artificial Sequence
  Synthetic Construct
gttttcctgttgccttgactcaca

SEQ ID NO: 18089 - DNA, 29 bp, Artificial Sequence
  Synthetic Construct
ggggctgttaaatagaatccactcctttg

SEQ ID NO: 18090 - DNA, 21 bp, Artificial Sequence
  Synthetic Construct
ggcttctgtgagggcgatgtt

SEQ ID NO: 18091 - DNA, 22 bp, Artificial Sequence
  Synthetic Construct
ggggtggaaacgttggaagcta

SEQ ID NO: 18092 - DNA, 24 bp, Artificial Sequence
  Synthetic Construct
ggacactgtcaggttactgaggtt

SEQ ID NO: 18093 - DNA, 24 bp, Artificial Sequence
  Synthetic Construct
ccgcctccttcacatttccactac

SEQ ID NO: 18094 - DNA, 23 bp, Artificial Sequence
  Synthetic Construct
gtcacaggctaagggttctgaag

SEQ ID NO: 18095 - DNA, 26 bp, Artificial Sequence
  Synthetic Construct
gtcgagctaagaaggttgtggaaaag

SEQ ID NO: 18096 - DNA, 24 bp, Artificial Sequence
  Synthetic Construct
ctgcgtctgaatggagatgtgcta

SEQ ID NO: 18097 - DNA, 25 bp, Artificial Sequence
  Synthetic Construct
tttgatacaatctgtgtggggatga

SEQ ID NO: 18098 - DNA, 25 bp, Artificial Sequence
  Synthetic Construct
ggaagggatctgaagaaggggtcta

SEQ ID NO: 18099 - DNA, 25 bp, Artificial Sequence
  Synthetic Construct
ccagtctcactcacacccagatagt

SEQ ID NO: 18100 - DNA, 24 bp, Artificial Sequence
  Synthetic Construct
gggcatctgaattgctctgggaat

SEQ ID NO: 18101 - DNA, 27 bp, Artificial Sequence
  Synthetic Construct
ggtctcattaattccatcctcccatca

SEQ ID NO: 18102 - DNA, 23 bp, Artificial Sequence
  Synthetic Construct
ggggtggcataaatttgctcttc

SEQ ID NO: 18103 - DNA, 26 bp, Artificial Sequence
  Synthetic Construct
cctccagttaccattttgaacctctt

SEQ ID NO: 18104 - DNA, 24 bp, Artificial Sequence
  Synthetic Construct
ggtgactggcagctcttagtggaa

SEQ ID NO: 18105 - DNA, 21 bp, Artificial Sequence
  Synthetic Construct
gcacctcacttgccttacctt

SEQ ID NO: 18106 - DNA, 22 bp, Artificial Sequence
  Synthetic Construct
gcttctgagagggctacagttg

SEQ ID NO: 18107 - DNA, 21 bp, Artificial Sequence
  Synthetic Construct
cacactctgggcaatggtgtt

SEQ ID NO: 18108 - DNA, 25 bp, Artificial Sequence
  Synthetic Construct
cactcctgaatcctcctccctaaca

SEQ ID NO: 18109 - DNA, 24 bp, Artificial Sequence
  Synthetic Construct
gcacttcaattcagcatgtccaaa

SEQ ID NO: 18110 - DNA, 26 bp, Artificial Sequence
  Synthetic Construct
catgcagattcatagccactcctaga

SEQ ID NO: 18111 - DNA, 27 bp, Artificial Sequence
  Synthetic Construct
gggcagatttttgatgtaggttcttag

SEQ ID NO: 18112 - DNA, 26 bp, Artificial Sequence
  Synthetic Construct
caagcatctacatccctttccagaga

SEQ ID NO: 18113 - DNA, 25 bp, Artificial Sequence
  Synthetic Construct
acagacagaagcatggtcttaggta

SEQ ID NO: 18114 - DNA, 23 bp, Artificial Sequence
  Synthetic Construct
ccacgaaccttgtctttgccatt

SEQ ID NO: 18115 - DNA, 24 bp, Artificial Sequence
  Synthetic Construct
ggagcagtggaaaaatcccacatc

SEQ ID NO: 18116 - DNA, 21 bp, Artificial Sequence
  Synthetic Construct
gcacagcttttcctcggtgtt

SEQ ID NO: 18117 - DNA, 25 bp, Artificial Sequence
  Synthetic Construct
ggtaccccaggatatgcaagtcttc

SEQ ID NO: 18118 - DNA, 30 bp, Artificial Sequence
  Synthetic Construct
ggtcaccacattatttccgtcttatctctt

SEQ ID NO: 18119 - DNA, 22 bp, Artificial Sequence
  Synthetic Construct
ggggagctttgccatcacatct

SEQ ID NO: 18120 - DNA, 22 bp, Artificial Sequence
  Synthetic Construct
agccaagacacacatagagcaa

SEQ ID NO: 18121 - DNA, 22 bp, Artificial Sequence
  Synthetic Construct
ccaggttccctgctggaagtat

SEQ ID NO: 18122 - DNA, 23 bp, Artificial Sequence
  Synthetic Construct
gcattgtgtgggttctggtttct

SEQ ID NO: 18123 - DNA, 23 bp, Artificial Sequence
  Synthetic Construct
cctccgaccagattgagaacttg

SEQ ID NO: 18124 - DNA, 20 bp, Artificial Sequence
  Synthetic Construct
ggaacacctctgggcacttg

SEQ ID NO: 18125 - DNA, 23 bp, Artificial Sequence
  Synthetic Construct
gcaaactggcaggagttggaatg

SEQ ID NO: 18126 - DNA, 27 bp, Artificial Sequence
  Synthetic Construct
gggtttcgctgttaagaaaggaccaaa

SEQ ID NO: 18127 - DNA, 25 bp, Artificial Sequence
  Synthetic Construct
gggaagctatctctcaagcattact

SEQ ID NO: 18128 - DNA, 26 bp, Artificial Sequence
  Synthetic Construct
gccacataaacatagccacagaggat

SEQ ID NO: 18129 - DNA, 23 bp, Artificial Sequence
  Synthetic Construct
gtgtggggtcttcatgattcact

SEQ ID NO: 18130 - DNA, 22 bp, Artificial Sequence
  Synthetic Construct
acctgaccttcctgcttgtttg

SEQ ID NO: 18131 - DNA, 24 bp, Artificial Sequence
  Synthetic Construct
gagggaggacttgatcatgaggtt

SEQ ID NO: 18132 - DNA, 22 bp, Artificial Sequence
  Synthetic Construct
tcatctgtgagcaatcctgctt

SEQ ID NO: 18133 - DNA, 22 bp, Artificial Sequence
  Synthetic Construct
gcgtgaacacgttagggacctt

SEQ ID NO: 18134 - DNA, 22 bp, Artificial Sequence
  Synthetic Construct
ccaggtgcgctcaatcccattt

SEQ ID NO: 18135 - DNA, 25 bp, Artificial Sequence
  Synthetic Construct
gcattcacaggacaaagaccattag

SEQ ID NO: 18136 - DNA, 25 bp, Artificial Sequence
  Synthetic Construct
tgacagctccaccataattacttga

SEQ ID NO: 18137 - DNA, 25 bp, Artificial Sequence
  Synthetic Construct
cctgttgataaggcccaggacaaaa

SEQ ID NO: 18138 - DNA, 21 bp, Artificial Sequence
  Synthetic Construct
gtggcagccatagctgaaagt

SEQ ID NO: 18139 - DNA, 22 bp, Artificial Sequence
  Synthetic Construct
cagctcgttcacgtctcagtca

SEQ ID NO: 18140 - DNA, 21 bp, Artificial Sequence
  Synthetic Construct
ccctgcttctctggtgcattg

SEQ ID NO: 18141 - DNA, 22 bp, Artificial Sequence
  Synthetic Construct
tcccactttggtgagacaggaa

SEQ ID NO: 18142 - DNA, 22 bp, Artificial Sequence
  Synthetic Construct
ggcagtagtagggtgctgattc

SEQ ID NO: 18143 - DNA, 23 bp, Artificial Sequence
  Synthetic Construct
ggttgccatagctgcttcctcaa

SEQ ID NO: 18144 - DNA, 25 bp, Artificial Sequence
  Synthetic Construct
cacagtgtctgtcctaagaatgtgt

SEQ ID NO: 18145 - DNA, 19 bp, Artificial Sequence
  Synthetic Construct
gtgggccacttgcctcttt

SEQ ID NO: 18146 - DNA, 27 bp, Artificial Sequence
  Synthetic Construct
gctcctgatctgagagagaaagtgtgt

SEQ ID NO: 18147 - DNA, 25 bp, Artificial Sequence
  Synthetic Construct
gtggtgaagtggattcctctctgat

SEQ ID NO: 18148 - DNA, 24 bp, Artificial Sequence
  Synthetic Construct
gcctcaaggcctaagaatatcagt

SEQ ID NO: 18149 - DNA, 24 bp, Artificial Sequence
  Synthetic Construct
gcccctcctccttacatggataac

SEQ ID NO: 18150 - DNA, 28 bp, Artificial Sequence
  Synthetic Construct
cgcaaccaaacacccttattactagaga

SEQ ID NO: 18151 - DNA, 30 bp, Artificial Sequence
  Synthetic Construct
ggaagtctatgtttgaaaggaagccaacat

SEQ ID NO: 18152 - DNA, 27 bp, Artificial Sequence
  Synthetic Construct
caggttgtaggtaaaaatggggtcaga

SEQ ID NO: 18153 - DNA, 23 bp, Artificial Sequence
  Synthetic Construct
gccccatcccatttaggatcaca

SEQ ID NO: 18154 - DNA, 28 bp, Artificial Sequence
  Synthetic Construct
gctaatcttacaggagagtatgggaaac

SEQ ID NO: 18155 - DNA, 24 bp, Artificial Sequence
  Synthetic Construct
gtgagccatttgagactggaaaaa

SEQ ID NO: 18156 - DNA, 24 bp, Artificial Sequence
  Synthetic Construct
ggtccgtcctatgtcctattccaa

SEQ ID NO: 18157 - DNA, 21 bp, Artificial Sequence
  Synthetic Construct
ggtgaggcttagccgtgttct

SEQ ID NO: 18158 - DNA, 24 bp, Artificial Sequence
  Synthetic Construct
gcagccctctactggtttatggaa

SEQ ID NO: 18159 - DNA, 21 bp, Artificial Sequence
  Synthetic Construct
actgccgtggaaacatcaagt

SEQ ID NO: 18160 - DNA, 22 bp, Artificial Sequence
  Synthetic Construct
gaccacctaggggatcaaggaa

SEQ ID NO: 18161 - DNA, 25 bp, Artificial Sequence
  Synthetic Construct
tttcactactgctgtaggtatgctt

SEQ ID NO: 18162 - DNA, 26 bp, Artificial Sequence
  Synthetic Construct
ccacactctcaagatcctgttggtta

SEQ ID NO: 18163 - DNA, 21 bp, Artificial Sequence
  Synthetic Construct
gtgtcagacatggcggcaaat

SEQ ID NO: 18164 - DNA, 25 bp, Artificial Sequence
  Synthetic Construct
gtgagtgcctctatctggaaaggat

SEQ ID NO: 18165 - DNA, 26 bp, Artificial Sequence
  Synthetic Construct
gttggatgcctaatgatttcccttca

SEQ ID NO: 18166 - DNA, 22 bp, Artificial Sequence
  Synthetic Construct
ggtgggatgctttacgcagaga

SEQ ID NO: 18167 - DNA, 25 bp, Artificial Sequence
  Synthetic Construct
ggggttctgttttctcccattcttc

SEQ ID NO: 18168 - DNA, 23 bp, Artificial Sequence
  Synthetic Construct
cctggccatcaaagtgggacttc

SEQ ID NO: 18169 - DNA, 25 bp, Artificial Sequence
  Synthetic Construct
gaagaacaccattggatcacagaac

SEQ ID NO: 18170 - DNA, 23 bp, Artificial Sequence
  Synthetic Construct
gccactcttgggcctgatacatt

SEQ ID NO: 18171 - DNA, 26 bp, Artificial Sequence
  Synthetic Construct
ctccatcctctctcagaacctcagtt

SEQ ID NO: 18172 - DNA, 25 bp, Artificial Sequence
  Synthetic Construct
gagacgctctcccatatccagtcta

SEQ ID NO: 18173 - DNA, 22 bp, Artificial Sequence
  Synthetic Construct
ccgtggcacagaaaggagatgt

SEQ ID NO: 18174 - DNA, 26 bp, Artificial Sequence
  Synthetic Construct
gccaagactaatcctgatggagtgat

SEQ ID NO: 18175 - DNA, 30 bp, Artificial Sequence; identical to SEQ ID NO: 4777
  Synthetic Construct

SEQ ID NO: 18176 - DNA, 25 bp, Artificial Sequence
  Synthetic Construct
gtttcacgaacctaaatgtggtgat

SEQ ID NO: 18177 - DNA, 20 bp, Artificial Sequence
  Synthetic Construct
cccagctccatggcaaacat

SEQ ID NO: 18178 - DNA, 22 bp, Artificial Sequence
  Synthetic Construct
agggccaggtagcttactgaag

SEQ ID NO: 18179 - DNA, 19 bp, Artificial Sequence
  Synthetic Construct
ccgcagtgtccacctcagt

SEQ ID NO: 18180 - DNA, 27 bp, Artificial Sequence
  Synthetic Construct
acaggtacagccatactcaaaaagtag

SEQ ID NO: 18181 - DNA, 24 bp, Artificial Sequence
  Synthetic Construct
gccactgggagatgtgtcataaac

SEQ ID NO: 18182 - DNA, 24 bp, Artificial Sequence
  Synthetic Construct
aagagagcttgggtagacagtttc

SEQ ID NO: 18183 - DNA, 20 bp, Artificial Sequence
  Synthetic Construct
ggcctttgcacgtggagttt

SEQ ID NO: 18184 - DNA, 22 bp, Artificial Sequence
  Synthetic Construct
tctcagctcccaggatttctgt

SEQ ID NO: 18185 - DNA, 23 bp, Artificial Sequence
  Synthetic Construct
ggtcgggagtgatgggttagtga

SEQ ID NO: 18186 - DNA, 21 bp, Artificial Sequence
  Synthetic Construct
gcccaggactgatgacaggta

SEQ ID NO: 18187 - DNA, 23 bp, Artificial Sequence
  Synthetic Construct
ctctgcacttctacccaggcaat

SEQ ID NO: 18188 - DNA, 25 bp, Artificial Sequence
  Synthetic Construct
gaggactatatgtgggagtgcttga

SEQ ID NO: 18189 - DNA, 25 bp, Artificial Sequence
  Synthetic Construct
gttgcctctttaatgctctgcaaat

SEQ ID NO: 18190 - DNA, 25 bp, Artificial Sequence
  Synthetic Construct
ccttttcagtgtacccaggattcat

SEQ ID NO: 18191 - DNA, 24 bp, Artificial Sequence
  Synthetic Construct
tcatgtgcctcagaaagtcattgt

SEQ ID NO: 18192 - DNA, 22 bp, Artificial Sequence
  Synthetic Construct
cagatccctctgctggtacaga

SEQ ID NO: 18193 - DNA, 22 bp, Artificial Sequence
  Synthetic Construct
ggctttagttgggtggcgtagt

SEQ ID NO: 18194 - DNA, 25 bp, Artificial Sequence
  Synthetic Construct
cccatagcacagaccagttggatga

SEQ ID NO: 18195 - DNA, 24 bp, Artificial Sequence
  Synthetic Construct
gcaggggttggtttcattttggat

SEQ ID NO: 18196 - DNA, 24 bp, Artificial Sequence
  Synthetic Construct
catcactctgtcctcgagtaggtt

SEQ ID NO: 18197 - DNA, 26 bp, Artificial Sequence
  Synthetic Construct
cgagaagaagtaagctgggatacaga

SEQ ID NO: 18198 - DNA, 24 bp, Artificial Sequence
  Synthetic Construct
ctcctggtggtttgactcatccta

SEQ ID NO: 18199 - DNA, 23 bp, Artificial Sequence
  Synthetic Construct
gtctcatcaacagtcacctgtca

SEQ ID NO: 18200 - DNA, 27 bp, Artificial Sequence
  Synthetic Construct
gttttaagaacccagtgagtgacaaga

SEQ ID NO: 18201 - DNA, 23 bp, Artificial Sequence
  Synthetic Construct
ctcacaccccttgtaagccattg

SEQ ID NO: 18202 - DNA, 28 bp, Artificial Sequence
  Synthetic Construct
ggggctaagattctaacccagagtttgt

SEQ ID NO: 18203 - DNA, 26 bp, Artificial Sequence
  Synthetic Construct
ggcaatagacagcatctagaatccat

SEQ ID NO: 18204 - DNA, 26 bp, Artificial Sequence
  Synthetic Construct
ccagcaggaatgttagcactcaccta

SEQ ID NO: 18205 - DNA, 24 bp, Artificial Sequence
  Synthetic Construct
ggtctgcagcagttctagctctca

SEQ ID NO: 18206 - DNA, 26 bp, Artificial Sequence
  Synthetic Construct
gaccctcctgaagatgtttctactct

SEQ ID NO: 18207 - DNA, 24 bp, Artificial Sequence
  Synthetic Construct
ttacattgacagcagggaacagat

SEQ ID NO: 18208 - DNA, 24 bp, Artificial Sequence
  Synthetic Construct
ctggtgttcccagttcagaagcat

SEQ ID NO: 18209 - DNA, 22 bp, Artificial Sequence
  Synthetic Construct
cctgcctgaaggtcccttctta

SEQ ID NO: 18210 - DNA, 21 bp, Artificial Sequence
  Synthetic Construct
agaccccagacactgaaggaa

SEQ ID NO: 18211 - DNA, 20 bp, Artificial Sequence
  Synthetic Construct
ggctcaagtctggaggcatt

SEQ ID NO: 18212 - DNA, 24 bp, Artificial Sequence
  Synthetic Construct
ctctggccctggtagtaaatgagt

SEQ ID NO: 18213 - DNA, 26 bp, Artificial Sequence
  Synthetic Construct
ggactttctttaccctcatcccttgt

SEQ ID NO: 18214 - DNA, 23 bp, Artificial Sequence
  Synthetic Construct
gcacctaccagttgtcagaaaca

SEQ ID NO: 18215 - DNA, 23 bp, Artificial Sequence
  Synthetic Construct
gaccagttcacttgtccactgta

SEQ ID NO: 18216 - DNA, 22 bp, Artificial Sequence
  Synthetic Construct
cctgctcatggaatgtggttga

SEQ ID NO: 18217 - DNA, 26 bp, Artificial Sequence
  Synthetic Construct
cagcgtcttttacgtacgttttgttc

SEQ ID NO: 18218 - DNA, 23 bp, Artificial Sequence
  Synthetic Construct
ggtgtcagacatttctgggtact

SEQ ID NO: 18219 - DNA, 27 bp, Artificial Sequence
  Synthetic Construct
gtcagatcaacccatttatgcctgaga

SEQ ID NO: 18220 - DNA, 24 bp, Artificial Sequence
  Synthetic Construct
ggagaaatgctgttgcagactcta

SEQ ID NO: 18221 - DNA, 20 bp, Artificial Sequence
  Synthetic Construct
ggggctgttaggtggcacaa

SEQ ID NO: 18222 - DNA, 25 bp, Artificial Sequence
  Synthetic Construct
gagaataaccatgatggaggggaaa

SEQ ID NO: 18223 - DNA, 26 bp, Artificial Sequence
  Synthetic Construct
ggttccccagatcaaagaatcgaaga

SEQ ID NO: 18224 - DNA, 24 bp, Artificial Sequence
  Synthetic Construct
ctcttatgcccttggccatactct

SEQ ID NO: 18225 - DNA, 20 bp, Artificial Sequence
  Synthetic Construct
cctgtattggctgcgtgagt

SEQ ID NO: 18226 - DNA, 24 bp, Artificial Sequence
  Synthetic Construct
gggtagagggactggtctaccaaa

SEQ ID NO: 18227 - DNA, 25 bp, Artificial Sequence
  Synthetic Construct
ccactgttttctcagagcttcactt

SEQ ID NO: 18228 - DNA, 26 bp, Artificial Sequence
  Synthetic Construct
gagttgatccaggattcggtattttg

SEQ ID NO: 18229 - DNA, 22 bp, Artificial Sequence
  Synthetic Construct
gcttctccagcatcacgtctct

SEQ ID NO: 18230 - DNA, 30 bp, Artificial Sequence
  Synthetic Construct
gacgaggtttaatcaactagctgtgacatt

SEQ ID NO: 18231 - DNA, 24 bp, Artificial Sequence
  Synthetic Construct
accaggggaactaaagatgacaag

SEQ ID NO: 18232 - DNA, 25 bp, Artificial Sequence
  Synthetic Construct
ggggaaggcctaacactaaggtgat

SEQ ID NO: 18233 - DNA, 22 bp, Artificial Sequence
  Synthetic Construct
ttccttggtcctccgaggcata

SEQ ID NO: 18234 - DNA, 27 bp, Artificial Sequence
  Synthetic Construct
agattatctctgcttggataccgattc

SEQ ID NO: 18235 - DNA, 21 bp, Artificial Sequence
  Synthetic Construct
ggtggtgttcggcctgatctt

SEQ ID NO: 18236 - DNA, 23 bp, Artificial Sequence
  Synthetic Construct
cgactctgagccaaaacccatag

SEQ ID NO: 18237 - DNA, 25 bp, Artificial Sequence
  Synthetic Construct
gtgggaggatgactttggagctatg

SEQ ID NO: 18238 - DNA, 24 bp, Artificial Sequence
  Synthetic Construct
tgataagtgccttctgcaggtttt

SEQ ID NO: 18239 - DNA, 23 bp, Artificial Sequence
  Synthetic Construct
ggactgagtaggggatggcttga

SEQ ID NO: 18240 - DNA, 26 bp, Artificial Sequence
  Synthetic Construct
gaccccgtttagtcctaacctcaatc

SEQ ID NO: 18241 - DNA, 23 bp, Artificial Sequence
  Synthetic Construct
gcccctactttgggacaagaaca

SEQ ID NO: 18242 - DNA, 24 bp, Artificial Sequence
  Synthetic Construct
ggatacagaagatgggaggcatag

SEQ ID NO: 18243 - DNA, 25 bp, Artificial Sequence
  Synthetic Construct
tgtactggcgaagaaacagaaaagt

SEQ ID NO: 18244 - DNA, 24 bp, Artificial Sequence
  Synthetic Construct
ccggactaacagggcttggtatct

SEQ ID NO: 18245 - DNA, 23 bp, Artificial Sequence
  Synthetic Construct
ggcctccttgtgtttacttgttg

SEQ ID NO: 18246 - DNA, 23 bp, Artificial Sequence
  Synthetic Construct
cagcccagtgattgtccatcttc

SEQ ID NO: 18247 - DNA, 25 bp, Artificial Sequence
  Synthetic Construct
ctcacctgtctttgcaactttggtt

SEQ ID NO: 18248 - DNA, 22 bp, Artificial Sequence
  Synthetic Construct
cagtgtgggtagagggcaagaa

SEQ ID NO: 18249 - DNA, 22 bp, Artificial Sequence
  Synthetic Construct
tccactggtctatggcctgaca

SEQ ID NO: 18250 - DNA, 26 bp, Artificial Sequence
  Synthetic Construct
ccagggaagctactgatgtggaatta

SEQ ID NO: 18251 - DNA, 26 bp, Artificial Sequence
  Synthetic Construct
gccaaggacagatgtgatctgatgta

SEQ ID NO: 18252 - DNA, 22 bp, Artificial Sequence
  Synthetic Construct
acctctgcaaacaagggattga

SEQ ID NO: 18253 - DNA, 22 bp, Artificial Sequence
  Synthetic Construct
ctcctaacccacagaggagtct

SEQ ID NO: 18254 - DNA, 22 bp, Artificial Sequence
  Synthetic Construct
gctggttcgtcccctattcatc

SEQ ID NO: 18255 - DNA, 23 bp, Artificial Sequence
  Synthetic Construct
gaaagagccagaagactcagcat

SEQ ID NO: 18256 - DNA, 21 bp, Artificial Sequence
  Synthetic Construct
ggcccaataggtgctgacctt

SEQ ID NO: 18257 - DNA, 27 bp, Artificial Sequence
  Synthetic Construct
agttgagaactgggacattaaggtatg

SEQ ID NO: 18258 - DNA, 24 bp, Artificial Sequence
  Synthetic Construct
ccagttttgaggatcacagtgaca

SEQ ID NO: 18259 - DNA, 25 bp, Artificial Sequence
  Synthetic Construct
gcaccaggatgtatgatgggaggta

SEQ ID NO: 18260 - DNA, 22 bp, Artificial Sequence
  Synthetic Construct
ctggagacatccacgccattca

SEQ ID NO: 18261 - DNA, 24 bp, Artificial Sequence
  Synthetic Construct
cccttgaacttgagccctttccaa

SEQ ID NO: 18262 - DNA, 21 bp, Artificial Sequence
  Synthetic Construct
accttcctggtgcctgtgatg

SEQ ID NO: 18263 - DNA, 22 bp, Artificial Sequence
  Synthetic Construct
gcgtggagatctgggcattaag

SEQ ID NO: 18264 - DNA, 24 bp, Artificial Sequence
  Synthetic Construct
gcatccacccatcttgaaaacttc

SEQ ID NO: 18265 - DNA, 23 bp, Artificial Sequence
  Synthetic Construct
gccaccagatggatggctattct

SEQ ID NO: 18266 - DNA, 23 bp, Artificial Sequence
  Synthetic Construct
agcttctgtgatgagaggacact

SEQ ID NO: 18267 - DNA, 22 bp, Artificial Sequence
  Synthetic Construct
tgaggaagaaccaggagactca

SEQ ID NO: 18268 - DNA, 25 bp, Artificial Sequence
  Synthetic Construct
cccatgtcactccttttcgttccta

SEQ ID NO: 18269 - DNA, 26 bp, Artificial Sequence
  Synthetic Construct
gagtcccttgtgtaagaaccatcttc

SEQ ID NO: 18270 - DNA, 24 bp, Artificial Sequence
  Synthetic Construct
gagtcatgaggtcctgtttcatct

SEQ ID NO: 18271 - DNA, 29 bp, Artificial Sequence
  Synthetic Construct
ccctctgattatgacatctctagggaaca

SEQ ID NO: 18272 - DNA, 26 bp, Artificial Sequence
  Synthetic Construct
gctcttcgagtcatttctggtcattc

SEQ ID NO: 18273 - DNA, 20 bp, Artificial Sequence
  Synthetic Construct
ggccacaaggctggtgtctt

SEQ ID NO: 18274 - DNA, 22 bp, Artificial Sequence
  Synthetic Construct
tgggacctgaacaaaccaggta

SEQ ID NO: 18275 - DNA, 25 bp, Artificial Sequence
  Synthetic Construct
cctgagcgagttgaaggaattgtgt

SEQ ID NO: 18276 - DNA, 25 bp, Artificial Sequence
  Synthetic Construct
cccagcagctttgctttagtaggta

SEQ ID NO: 18277 - DNA, 21 bp, Artificial Sequence
  Synthetic Construct
ggctagtccactgcagactga

SEQ ID NO: 18278 - DNA, 23 bp, Artificial Sequence
  Synthetic Construct
gtgcccaaccttggagatggtta

SEQ ID NO: 18279 - DNA, 22 bp, Artificial Sequence
  Synthetic Construct
ctgggtctgtgaccttgctgta

SEQ ID NO: 18280 - DNA, 22 bp, Artificial Sequence
  Synthetic Construct
caaaccccaagtcctcgttttc

SEQ ID NO: 18281 - DNA, 24 bp, Artificial Sequence
  Synthetic Construct
ccctcctaatttgggttgcctgaa

SEQ ID NO: 18282 - DNA, 26 bp, Artificial Sequence
  Synthetic Construct
ccacttctcagagctaacctgctgta

SEQ ID NO: 18283 - DNA, 20 bp, Artificial Sequence
  Synthetic Construct
ctgcagatcggaccggatac

SEQ ID NO: 18284 - DNA, 23 bp, Artificial Sequence
  Synthetic Construct
caaggtctgcttgctgtgtgatg

SEQ ID NO: 18285 - DNA, 26 bp, Artificial Sequence
  Synthetic Construct
ggactggagtttcttcagagtagttg

SEQ ID NO: 18286 - DNA, 22 bp, Artificial Sequence
  Synthetic Construct
tgtgcgtggatttcagtcatgt

SEQ ID NO: 18287 - DNA, 22 bp, Artificial Sequence
  Synthetic Construct
ccgtttgccttcaaccctgaga

SEQ ID NO: 18288 - DNA, 23 bp, Artificial Sequence
  Synthetic Construct
ggcatcagcagtatccgttcctt

SEQ ID NO: 18289 - DNA, 20 bp, Artificial Sequence
  Synthetic Construct
ccccacatccagccaccatt

SEQ ID NO: 18290 - DNA, 24 bp, Artificial Sequence
  Synthetic Construct
gctgcatttgggtcgttttgtttc

SEQ ID NO: 18291 - DNA, 22 bp, Artificial Sequence
  Synthetic Construct
ggactctgtgctttggcctgaa

SEQ ID NO: 18292 - DNA, 19 bp, Artificial Sequence
  Synthetic Construct
ggcctcacacgcacgtttc

SEQ ID NO: 18293 - DNA, 27 bp, Artificial Sequence
  Synthetic Construct
cctgaccacgttatttattggttggaa

SEQ ID NO: 18294 - DNA, 25 bp, Artificial Sequence
  Synthetic Construct
gctggaacagaccttaaaggcaatg

SEQ ID NO: 18295 - DNA, 22 bp, Artificial Sequence
  Synthetic Construct
ctggctttggaatcggtctttg

SEQ ID NO: 18296 - DNA, 24 bp, Artificial Sequence
  Synthetic Construct
acagcgaggaaaggaaggaaatag

SEQ ID NO: 18297 - DNA, 26 bp, Artificial Sequence
  Synthetic Construct
ggaaacaaagcttgcctagagtttct

SEQ ID NO: 18298 - DNA, 20 bp, Artificial Sequence
  Synthetic Construct
gtccgtgtcagtgtgtgact

SEQ ID NO: 18299 - DNA, 26 bp, Artificial Sequence
  Synthetic Construct
ggcaaaagccacgtatttctctccaa

SEQ ID NO: 18300 - DNA, 25 bp, Artificial Sequence
  Synthetic Construct
actgtgtggagagtaaatgggattc

SEQ ID NO: 18301 - DNA, 21 bp, Artificial Sequence
  Synthetic Construct
agccattgcgagaccctgatg

SEQ ID NO: 18302 - DNA, 22 bp, Artificial Sequence
  Synthetic Construct
gaggccctgaagctgagaacaa

SEQ ID NO: 18303 - DNA, 23 bp, Artificial Sequence
  Synthetic Construct
gtgacccctcttaaccgcaaatg

SEQ ID NO: 18304 - DNA, 25 bp, Artificial Sequence
  Synthetic Construct
ggtttcacctgtactagaggcattc

SEQ ID NO: 18305 - DNA, 23 bp, Artificial Sequence
  Synthetic Construct
ctacccactgtggacacatgtaa

SEQ ID NO: 18306 - DNA, 24 bp, Artificial Sequence
  Synthetic Construct
actcaggggcctttagttatgatg

SEQ ID NO: 18307 - DNA, 23 bp, Artificial Sequence
  Synthetic Construct
gcctctgtacctctctctgcatt

SEQ ID NO: 18308 - DNA, 21 bp, Artificial Sequence
  Synthetic Construct
ggcccagccttaagttcatca

SEQ ID NO: 18309 - DNA, 22 bp, Artificial Sequence
  Synthetic Construct
ctctgtcgctgacactggatgt

SEQ ID NO: 18310 - DNA, 25 bp, Artificial Sequence
  Synthetic Construct
gtcagaatgatcccgagagtgagtt

SEQ ID NO: 18311 - DNA, 24 bp, Artificial Sequence
  Synthetic Construct
gctcacacactgtctcatttcaac

SEQ ID NO: 18312 - DNA, 23 bp, Artificial Sequence
  Synthetic Construct
ctcccttttcctccacgaggatt

SEQ ID NO: 18313 - DNA, 24 bp, Artificial Sequence
  Synthetic Construct
ctatgggccatttacccattgaac

SEQ ID NO: 18314 - DNA, 22 bp, Artificial Sequence
  Synthetic Construct
cagggagtgtgtgggtttggtt

SEQ ID NO: 18315 - DNA, 22 bp, Artificial Sequence
  Synthetic Construct
ggggtcacaccaaagggattga

SEQ ID NO: 18316 - DNA, 24 bp, Artificial Sequence
  Synthetic Construct
ccctacattcaaggaccaggttga

SEQ ID NO: 18317 - DNA, 22 bp, Artificial Sequence
  Synthetic Construct
cgcttgctgactgcttcctttg

SEQ ID NO: 18318 - DNA, 20 bp, Artificial Sequence
  Synthetic Construct
ggcttcacagctgcagcaaa

SEQ ID NO: 18319 - DNA, 26 bp, Artificial Sequence
  Synthetic Construct
ccagcactggaaagagtaagtcattg

SEQ ID NO: 18320 - DNA, 25 bp, Artificial Sequence
  Synthetic Construct
gcagctgaacagtacaataccatgt

SEQ ID NO: 18321 - DNA, 20 bp, Artificial Sequence
  Synthetic Construct
cacgtggctttgcacacagt

SEQ ID NO: 18322 - DNA, 24 bp, Artificial Sequence
  Synthetic Construct
gggaagttcatcttcatgggtttg

SEQ ID NO: 18323 - DNA, 21 bp, Artificial Sequence
  Synthetic Construct
ggaggccaaatgcagatgagt

SEQ ID NO: 18324 - DNA, 24 bp, Artificial Sequence
  Synthetic Construct
gctggcaactggaaatgggaaatg

SEQ ID NO: 18325 - DNA, 22 bp, Artificial Sequence
  Synthetic Construct
cctgagaagcactctcccttgt

SEQ ID NO: 18326 - DNA, 22 bp, Artificial Sequence
  Synthetic Construct
tgaaggagcacaattgcaggat

SEQ ID NO: 18327 - DNA, 23 bp, Artificial Sequence
  Synthetic Construct
cacgtgataccaacagtggatgt

SEQ ID NO: 18328 - DNA, 25 bp, Artificial Sequence
  Synthetic Construct
gagctcaccaggaagtatagcatct

SEQ ID NO: 18329 - DNA, 21 bp, Artificial Sequence
  Synthetic Construct
ccctgtactctgcgtctgtct

SEQ ID NO: 18330 - DNA, 23 bp, Artificial Sequence
  Synthetic Construct
gtcatccctcatcaagggcagaa

SEQ ID NO: 18331 - DNA, 24 bp, Artificial Sequence
  Synthetic Construct
gcgaggggtatgggctaatagttg

SEQ ID NO: 18332 - DNA, 22 bp, Artificial Sequence
  Synthetic Construct
tgtcctgtgtcccagctctagt

SEQ ID NO: 18333 - DNA, 24 bp, Artificial Sequence
  Synthetic Construct
ccaaagtgtcaccagcagagacat

SEQ ID NO: 18334 - DNA, 24 bp, Artificial Sequence
  Synthetic Construct
ctggggatgaatctgctttaccat

SEQ ID NO: 18335 - DNA, 24 bp, Artificial Sequence
  Synthetic Construct
cagcgataacttccttccactcaa

SEQ ID NO: 18336 - DNA, 24 bp, Artificial Sequence
  Synthetic Construct
ggaccagcctctacttgctactgt

SEQ ID NO: 18337 - DNA, 24 bp, Artificial Sequence
  Synthetic Construct
tgtaacctagatgaccatgcgttt

SEQ ID NO: 18338 - DNA, 26 bp, Artificial Sequence
  Synthetic Construct
gccagctttttgctatttccttccat

SEQ ID NO: 18339 - DNA, 23 bp, Artificial Sequence
  Synthetic Construct
aggggttaggcggaaaaagtatg

SEQ ID NO: 18340 - DNA, 29 bp, Artificial Sequence
  Synthetic Construct
ggagagacaatcaactatgtctcttgtga

SEQ ID NO: 18341 - DNA, 24 bp, Artificial Sequence
  Synthetic Construct
cctcttttccctacttcccacttc

SEQ ID NO: 18342 - DNA, 26 bp, Artificial Sequence
  Synthetic Construct
cacttggccataaagcaattctcaac

SEQ ID NO: 18343 - DNA, 21 bp, Artificial Sequence
  Synthetic Construct
gacggcagcagaggattttga

SEQ ID NO: 18344 - DNA, 22 bp, Artificial Sequence
  Synthetic Construct
gaatgctgccaaagggaactga

SEQ ID NO: 18345 - DNA, 26 bp, Artificial Sequence
  Synthetic Construct
gcagaggaagttagaggtgggatatt

SEQ ID NO: 18346 - DNA, 20 bp, Artificial Sequence
  Synthetic Construct
gtggactttcagcgccaact

SEQ ID NO: 18347 - DNA, 22 bp, Artificial Sequence
  Synthetic Construct
ctcctaactcacgtccgggtat

SEQ ID NO: 18348 - DNA, 24 bp, Artificial Sequence
  Synthetic Construct
ccaaggggacatttaacgctgtga

SEQ ID NO: 18349 - DNA, 27 bp, Artificial Sequence
  Synthetic Construct
gactttagaactcctgctaccaacatt

SEQ ID NO: 18350 - DNA, 25 bp, Artificial Sequence
  Synthetic Construct
gggagtggtaaaaggcttggacttc

SEQ ID NO: 18351 - DNA, 21 bp, Artificial Sequence
  Synthetic Construct
caaggtgtcagtctgccttgt

SEQ ID NO: 18352 - DNA, 21 bp, Artificial Sequence
  Synthetic Construct
tgcctgcagaaggggatgtga

SEQ ID NO: 18353 - DNA, 22 bp, Artificial Sequence
  Synthetic Construct
aggggaggaacatgaggctgaa

SEQ ID NO: 18354 - DNA, 24 bp, Artificial Sequence
  Synthetic Construct
ggtggcttcaggaataggggacaa

SEQ ID NO: 18355 - DNA, 27 bp, Artificial Sequence
  Synthetic Construct
ggttctaggatctgtctgggagatcaa

SEQ ID NO: 18356 - DNA, 24 bp, Artificial Sequence
  Synthetic Construct
actgctcctaagataggcgatttc

SEQ ID NO: 18357 - DNA, 26 bp, Artificial Sequence
  Synthetic Construct
caccaagcatacctgagtcataccta

SEQ ID NO: 18358 - DNA, 22 bp, Artificial Sequence
  Synthetic Construct
agcttccatccgtcccatctat

SEQ ID NO: 18359 - DNA, 27 bp, Artificial Sequence
  Synthetic Construct
cgatagctacccttgctttttcctctt

SEQ ID NO: 18360 - DNA, 22 bp, Artificial Sequence
  Synthetic Construct
cctgctctaggctgcaagtgtt

SEQ ID NO: 18361 - DNA, 25 bp, Artificial Sequence
  Synthetic Construct
ctggactcctgctgatagagtcttg

SEQ ID NO: 18362 - DNA, 24 bp, Artificial Sequence
  Synthetic Construct
gcccttgatcctcctaggctattg

SEQ ID NO: 18363 - DNA, 23 bp, Artificial Sequence
  Synthetic Construct
agtggctgagaatgagacctcta

SEQ ID NO: 18364 - DNA, 24 bp, Artificial Sequence
  Synthetic Construct
cctgttggtccaaatccttactga

SEQ ID NO: 18365 - DNA, 27 bp, Artificial Sequence
  Synthetic Construct
gactgtggtttcaacaccttataccta

SEQ ID NO: 18366 - DNA, 27 bp, Artificial Sequence
  Synthetic Construct
ccttctggctaaatctacctgctcttc

SEQ ID NO: 18367 - DNA, 30 bp, Artificial Sequence
  Synthetic Construct
ccatgtgaggtagataggatttgctctagt

SEQ ID NO: 18368 - DNA, 22 bp, Artificial Sequence
  Synthetic Construct
ctcacaggccagggatttcaga

SEQ ID NO: 18369 - DNA, 27 bp, Artificial Sequence
  Synthetic Construct
gagcttgagatcctttctgaagaagtt

SEQ ID NO: 18370 - DNA, 24 bp, Artificial Sequence
  Synthetic Construct
tgtatttgggtgcatgagttggtt

SEQ ID NO: 18371 - DNA, 24 bp, Artificial Sequence
  Synthetic Construct
gggtccctaattttggtgatgact

SEQ ID NO: 18372 - DNA, 25 bp, Artificial Sequence
  Synthetic Construct
gcagccattgtctgtaggacttgat

SEQ ID NO: 18373 - DNA, 26 bp, Artificial Sequence
  Synthetic Construct
gcaagctcatttgcaaggtagagaac

SEQ ID NO: 18374 - DNA, 24 bp, Artificial Sequence
  Synthetic Construct
ccttcttgagtctgatcactcgtt

SEQ ID NO: 18375 - DNA, 24 bp, Artificial Sequence
  Synthetic Construct
gggatttcccacacttctcctctt

SEQ ID NO: 18376 - DNA, 26 bp, Artificial Sequence
  Synthetic Construct
ccacctcgaagctttagtaccctaag

SEQ ID NO: 18377 - DNA, 25 bp, Artificial Sequence
  Synthetic Construct
gaccatccacagacttaaagaggaa

SEQ ID NO: 18378 - DNA, 24 bp, Artificial Sequence
  Synthetic Construct
gctccagcctagatacaacacttg

SEQ ID NO: 18379 - DNA, 23 bp, Artificial Sequence
  Synthetic Construct
gacagccagctaacactgtggaa

SEQ ID NO: 18380 - DNA, 21 bp, Artificial Sequence
  Synthetic Construct
ccacgaaacaggaccatgaca

SEQ ID NO: 18381 - DNA, 21 bp, Artificial Sequence
  Synthetic Construct
acccagacacggcttgactct

SEQ ID NO: 18382 - DNA, 23 bp, Artificial Sequence
  Synthetic Construct
ccaccgtctatgtcaacgccatt

SEQ ID NO: 18383 - DNA, 23 bp, Artificial Sequence
  Synthetic Construct
tggaggcagaggtttagagagaa

SEQ ID NO: 18384 - DNA, 24 bp, Artificial Sequence
  Synthetic Construct
ctgtcacctctttcgtggtacagt

SEQ ID NO: 18385 - DNA, 28 bp, Artificial Sequence
  Synthetic Construct
gaggcgagatagaaaagtagttggtgaa

SEQ ID NO: 18386 - DNA, 26 bp, Artificial Sequence
  Synthetic Construct
gtggtactgaaaccccagtttagctt

SEQ ID NO: 18387 - DNA, 21 bp, Artificial Sequence
  Synthetic Construct
tgccttagtgctggcctctct

SEQ ID NO: 18388 - DNA, 25 bp, Artificial Sequence
  Synthetic Construct
accaaagccgtgtattcgtttattc

SEQ ID NO: 18389 - DNA, 23 bp, Artificial Sequence
  Synthetic Construct
ggaccaggtttctagcagtgaga

SEQ ID NO: 18390 - DNA, 22 bp, Artificial Sequence
  Synthetic Construct
cacacagccatggacattcaga

SEQ ID NO: 18391 - DNA, 24 bp, Artificial Sequence
  Synthetic Construct
gatgtaatgctcaagaggctgaga

SEQ ID NO: 18392 - DNA, 24 bp, Artificial Sequence
  Synthetic Construct
caccagaagcagtttgtcttcagt

SEQ ID NO: 18393 - DNA, 22 bp, Artificial Sequence
  Synthetic Construct
gcagtcacaccaggctcaaatc

SEQ ID NO: 18394 - DNA, 25 bp, Artificial Sequence
  Synthetic Construct
ctggctgcaaatatgtgcctgttac

SEQ ID NO: 18395 - DNA, 26 bp, Artificial Sequence
  Synthetic Construct
cccaaagtcatcaattcttcctgaga

SEQ ID NO: 18396 - DNA, 22 bp, Artificial Sequence
  Synthetic Construct
ccctacctgcatctcctcaaac

SEQ ID NO: 18397 - DNA, 22 bp, Artificial Sequence
  Synthetic Construct
agagtggcagcagtgggaatag

SEQ ID NO: 18398 - DNA, 27 bp, Artificial Sequence
  Synthetic Construct
cggttttaccctgaaaagaaaccaaac

SEQ ID NO: 18399 - DNA, 25 bp, Artificial Sequence
  Synthetic Construct
atctgagaagtagcactagggagaa

SEQ ID NO: 18400 - DNA, 24 bp, Artificial Sequence
  Synthetic Construct
gccttgacaaacaatgtgagcaat

SEQ ID NO: 18401 - DNA, 21 bp, Artificial Sequence
  Synthetic Construct
gtttgcctcttgggctcattg

SEQ ID NO: 18402 - DNA, 24 bp, Artificial Sequence
  Synthetic Construct
cagagggtctggtaaactctggta

SEQ ID NO: 18403 - DNA, 26 bp, Artificial Sequence
  Synthetic Construct
cctgtctttgaatggctctcctcaga

SEQ ID NO: 18404 - DNA, 25 bp, Artificial Sequence
  Synthetic Construct
gtgggagaatagtggttctgcctat

SEQ ID NO: 18405 - DNA, 22 bp, Artificial Sequence
  Synthetic Construct
cacccatgctagggactcttga

SEQ ID NO: 18406 - DNA, 23 bp, Artificial Sequence
  Synthetic Construct
cagcagaaacagtgggatgtagt

SEQ ID NO: 18407 - DNA, 22 bp, Artificial Sequence
  Synthetic Construct
acctgtgcatctgcctctgttg

SEQ ID NO: 18408 - DNA, 24 bp, Artificial Sequence
  Synthetic Construct
gcctgcttacatcccactcaaaag

SEQ ID NO: 18409 - DNA, 24 bp, Artificial Sequence
  Synthetic Construct
tctgagtctctcctttcaggacaa

SEQ ID NO: 18410 - DNA, 24 bp, Artificial Sequence
  Synthetic Construct
cccttcactcattcctggggttag

SEQ ID NO: 18411 - DNA, 22 bp, Artificial Sequence
  Synthetic Construct
gcatggcaaagaccacttcctt

SEQ ID NO: 18412 - DNA, 21 bp, Artificial Sequence
  Synthetic Construct
ggcagggtgtagggagaaaag

SEQ ID NO: 18413 - DNA, 26 bp, Artificial Sequence
  Synthetic Construct
ctggctgttgatgaggaaaagggtat

SEQ ID NO: 18414 - DNA, 26 bp, Artificial Sequence
  Synthetic Construct
cacagggtgtcagactttagggagta

SEQ ID NO: 18415 - DNA, 26 bp, Artificial Sequence
  Synthetic Construct
gtgaaaggaggtgctgttagtaattg

SEQ ID NO: 18416 - DNA, 27 bp, Artificial Sequence
  Synthetic Construct
gtgccatattgaccatcttccttttac

SEQ ID NO: 18417 - DNA, 22 bp, Artificial Sequence
  Synthetic Construct
cccaccttcagggtgtgtgatg

SEQ ID NO: 18418 - DNA, 22 bp, Artificial Sequence
  Synthetic Construct
ggtggtggaaatgttccgatga

SEQ ID NO: 18419 - DNA, 20 bp, Artificial Sequence
  Synthetic Construct
gtcctggaccatgggcagat

SEQ ID NO: 18420 - DNA, 22 bp, Artificial Sequence
  Synthetic Construct
ctgtttcacttgcactgtgtgt

SEQ ID NO: 18421 - DNA, 25 bp, Artificial Sequence
  Synthetic Construct
ccgtagactgtccagagagatgaca

SEQ ID NO: 18422 - DNA, 21 bp, Artificial Sequence
  Synthetic Construct
ccaaagcacgaaacgccttgt

SEQ ID NO: 18423 - DNA, 21 bp, Artificial Sequence
  Synthetic Construct
tccatgctacaagggcagagt

SEQ ID NO: 18424 - DNA, 25 bp, Artificial Sequence
  Synthetic Construct
ggacacagaatgaaccactgactga

SEQ ID NO: 18425 - DNA, 26 bp, Artificial Sequence
  Synthetic Construct
gacagcttagacagaaacctcttttg

SEQ ID NO: 18426 - DNA, 23 bp, Artificial Sequence
  Synthetic Construct
gccgaagatctctgcatttcaca

SEQ ID NO: 18427 - DNA, 20 bp, Artificial Sequence
  Synthetic Construct
tgccgtggaacggtctgttt

SEQ ID NO: 18428 - DNA, 26 bp, Artificial Sequence
  Synthetic Construct
gcagagacagaaggcagggtaagaaa

SEQ ID NO: 18429 - DNA, 25 bp, Artificial Sequence
  Synthetic Construct
gggatgcaactatctccttcccatt

SEQ ID NO: 18430 - DNA, 28 bp, Artificial Sequence
  Synthetic Construct
gtgtgtggatgaaaactctggtctctta

SEQ ID NO: 18431 - DNA, 26 bp, Artificial Sequence
  Synthetic Construct
gcatctggcatgcactcttcacttag

SEQ ID NO: 18432 - DNA, 24 bp, Artificial Sequence
  Synthetic Construct
ctccagacctcttgaattgactga

SEQ ID NO: 18433 - DNA, 26 bp, Artificial Sequence
  Synthetic Construct
gttccagtagagctggatacatacaa

SEQ ID NO: 18434 - DNA, 26 bp, Artificial Sequence
  Synthetic Construct
ctgggccatttaccatatgtcaggaa

SEQ ID NO: 18435 - DNA, 21 bp, Artificial Sequence
  Synthetic Construct
ccatgtggcaggtgaggatgt

SEQ ID NO: 18436 - DNA, 24 bp, Artificial Sequence
  Synthetic Construct
aggaagagcgtatgtagagagcat

SEQ ID NO: 18437 - DNA, 22 bp, Artificial Sequence
  Synthetic Construct
cccagaattcccctgctgaaga

SEQ ID NO: 18438 - DNA, 26 bp, Artificial Sequence
  Synthetic Construct
gctgtggtttcagagtctcaccctaa

SEQ ID NO: 18439 - DNA, 22 bp, Artificial Sequence
  Synthetic Construct
cactccaatgcctcctgtggtt

SEQ ID NO: 18440 - DNA, 24 bp, Artificial Sequence
  Synthetic Construct
ccctgtgagacttcatccccttca

SEQ ID NO: 18441 - DNA, 25 bp, Artificial Sequence
  Synthetic Construct
ggggaagtttttgaaggcaaaacaa

SEQ ID NO: 18442 - DNA, 24 bp, Artificial Sequence
  Synthetic Construct
aggggattaagaggcaaaggaatg

SEQ ID NO: 18443 - DNA, 23 bp, Artificial Sequence
  Synthetic Construct
ctgggttcaagttttggctcttc

SEQ ID NO: 18444 - DNA, 21 bp, Artificial Sequence
  Synthetic Construct
agtgccttcgtaagcgattca

SEQ ID NO: 18445 - DNA, 26 bp, Artificial Sequence
  Synthetic Construct
ctgtagactttggcttattcgacctt

SEQ ID NO: 18446 - DNA, 28 bp, Artificial Sequence
  Synthetic Construct
gctggtcctctggttttgtaaccctatt

SEQ ID NO: 18447 - DNA, 24 bp, Artificial Sequence
  Synthetic Construct
ccatggtcagcatgatatcctcaa

SEQ ID NO: 18448 - DNA, 19 bp, Artificial Sequence
  Synthetic Construct
aggctcgccctctcctctt

SEQ ID NO: 18449 - DNA, 24 bp, Artificial Sequence
  Synthetic Construct
gctctctagaagcgctttcccaaa

SEQ ID NO: 18450 - DNA, 26 bp, Artificial Sequence
  Synthetic Construct
ctttcaattccagagcttgtcccata

SEQ ID NO: 18451 - DNA, 28 bp, Artificial Sequence
  Synthetic Construct
cgagaactacggtttcaaaggaaagaag

SEQ ID NO: 18452 - DNA, 21 bp, Artificial Sequence
  Synthetic Construct
cggcaaatgcagcacaaaatc

SEQ ID NO: 18453 - DNA, 22 bp, Artificial Sequence
  Synthetic Construct
cctggttcaaacgggagcgtat

SEQ ID NO: 18454 - DNA, 21 bp, Artificial Sequence
  Synthetic Construct
ggatgctgtcgatgtcactct

SEQ ID NO: 18455 - DNA, 23 bp, Artificial Sequence
  Synthetic Construct
ctccaccatagggagtgactttg

SEQ ID NO: 18456 - DNA, 20 bp, Artificial Sequence
  Synthetic Construct
tgttcccacctcgccacaaa

SEQ ID NO: 18457 - DNA, 26 bp, Artificial Sequence
  Synthetic Construct
ggagtctttttcaaagcgtgggtaac

SEQ ID NO: 18458 - DNA, 27 bp, Artificial Sequence
  Synthetic Construct
gcagtaagcaccagtgaatatctgatt

SEQ ID NO: 18459 - DNA, 26 bp, Artificial Sequence
  Synthetic Construct
ccagagatacttgagatggtcacact

SEQ ID NO: 18460 - DNA, 20 bp, Artificial Sequence
  Synthetic Construct
ttgccagagtgctgtcatgt

SEQ ID NO: 18461 - DNA, 24 bp, Artificial Sequence
  Synthetic Construct
aggattggcataggaacaagtgat

SEQ ID NO: 18462 - DNA, 21 bp, Artificial Sequence
  Synthetic Construct
ccgtctttgtgccacctgttg

SEQ ID NO: 18463 - DNA, 24 bp, Artificial Sequence
  Synthetic Construct
ggcacagattaactgcgtctgact

SEQ ID NO: 18464 - DNA, 25 bp, Artificial Sequence
  Synthetic Construct
gcgtatcttctgcatacactagctt

SEQ ID NO: 18465 - DNA, 20 bp, Artificial Sequence
  Synthetic Construct
aaggcgatgggaacctcaga

SEQ ID NO: 18466 - DNA, 24 bp, Artificial Sequence
  Synthetic Construct
gccagaacctggtctgaactccaa

SEQ ID NO: 18467 - DNA, 22 bp, Artificial Sequence
  Synthetic Construct
ggggaaaccatgaaggcttgaa

SEQ ID NO: 18468 - DNA, 22 bp, Artificial Sequence
  Synthetic Construct
ggccaccattggcagtatcatc

SEQ ID NO: 18469 - DNA, 20 bp, Artificial Sequence
  Synthetic Construct
cgtgggtgaagcgcagagta

SEQ ID NO: 18470 - DNA, 21 bp, Artificial Sequence
  Synthetic Construct
tcagggcatagggcctagaag

SEQ ID NO: 18471 - DNA, 21 bp, Artificial Sequence
  Synthetic Construct
gcccacagagaccatccatct

SEQ ID NO: 18472 - DNA, 23 bp, Artificial Sequence
  Synthetic Construct
gtgggattcagccattcctgcta

SEQ ID NO: 18473 - DNA, 27 bp, Artificial Sequence
  Synthetic Construct
cctcagacagagctgggtttaaattct

SEQ ID NO: 18474 - DNA, 19 bp, Artificial Sequence
  Synthetic Construct
ggggacagcagcgttcctt

SEQ ID NO: 18475 - DNA, 19 bp, Artificial Sequence
  Synthetic Construct
tgctactgggtgccaggaa

SEQ ID NO: 18476 - DNA, 25 bp, Artificial Sequence
  Synthetic Construct
cctgccacatgttctatctgtgtct

SEQ ID NO: 18477 - DNA, 24 bp, Artificial Sequence
  Synthetic Construct
cagtgattgtcctaaggccaggtt

SEQ ID NO: 18478 - DNA, 30 bp, Artificial Sequence
  Synthetic Construct
gggattctctaggaggagataactttctga

SEQ ID NO: 18479 - DNA, 22 bp, Artificial Sequence
  Synthetic Construct
ggagcaggttggaggttagcat

SEQ ID NO: 18480 - DNA, 28 bp, Artificial Sequence
  Synthetic Construct
gctgtggaatgcagttgaatgactttct

SEQ ID NO: 18481 - DNA, 21 bp, Artificial Sequence
  Synthetic Construct
tgctgaacgtcacacagtgat

SEQ ID NO: 18482 - DNA, 25 bp, Artificial Sequence
  Synthetic Construct
gcaatcttggctaatgagaccattt

SEQ ID NO: 18483 - DNA, 26 bp, Artificial Sequence
  Synthetic Construct
gcccttctattctacactgacgtaaa

SEQ ID NO: 18484 - DNA, 25 bp, Artificial Sequence
  Synthetic Construct
ggagaaacaaccaccatgggaatga

SEQ ID NO: 18485 - DNA, 24 bp, Artificial Sequence
  Synthetic Construct
cacagtgctgacttcctttctact

SEQ ID NO: 18486 - DNA, 24 bp, Artificial Sequence
  Synthetic Construct
gggccacctggatgtagacttttg

SEQ ID NO: 18487 - DNA, 24 bp, Artificial Sequence
  Synthetic Construct
gggacaaatcttcctaccccattc

SEQ ID NO: 18488 - DNA, 25 bp, Artificial Sequence
  Synthetic Construct
agtactgggatttgctacagagaag

SEQ ID NO: 18489 - DNA, 26 bp, Artificial Sequence
  Synthetic Construct
ggggaggtatcagagcctttttctga

SEQ ID NO: 18490 - DNA, 30 bp, Artificial Sequence
  Synthetic Construct
ccatgaaactcaatgacactgtttctgtca

SEQ ID NO: 18491 - DNA, 27 bp, Artificial Sequence
  Synthetic Construct
ctgatcttgtactgctagcccttatag

SEQ ID NO: 18492 - DNA, 23 bp, Artificial Sequence
  Synthetic Construct
aatggcaatgacccaacatgaag

SEQ ID NO: 18493 - DNA, 22 bp, Artificial Sequence
  Synthetic Construct
ggaggaaagcagggatgcatgt

SEQ ID NO: 18494 - DNA, 22 bp, Artificial Sequence
  Synthetic Construct
ctgtgcctcaaggagacagtga

SEQ ID NO: 18495 - DNA, 22 bp, Artificial Sequence
  Synthetic Construct
ctgctgtcaacaggcagtgaaa

SEQ ID NO: 18496 - DNA, 21 bp, Artificial Sequence
  Synthetic Construct
acttcgggagccacagtccaa

SEQ ID NO: 18497 - DNA, 27 bp, Artificial Sequence
  Synthetic Construct
ccaccttgttttagattttggctctga

SEQ ID NO: 18498 - DNA, 26 bp, Artificial Sequence
  Synthetic Construct
cagacaggcacctttcaaactcttct

SEQ ID NO: 18499 - DNA, 23 bp, Artificial Sequence
  Synthetic Construct
tgctgatacactgactcggtact

SEQ ID NO: 18500 - DNA, 25 bp, Artificial Sequence
  Synthetic Construct
gggagccagtcattaatcgaaatgt

SEQ ID NO: 18501 - DNA, 24 bp, Artificial Sequence
  Synthetic Construct
gtgccttacctttgccagttctgt

SEQ ID NO: 18502 - DNA, 27 bp, Artificial Sequence
  Synthetic Construct
ctgagactggattgggataaggagatg

SEQ ID NO: 18503 - DNA, 22 bp, Artificial Sequence
  Synthetic Construct
ccccagcttcatctccttggaa

SEQ ID NO: 18504 - DNA, 25 bp, Artificial Sequence
  Synthetic Construct
gcatgataggaagtgtgcgtgatag

SEQ ID NO: 18505 - DNA, 22 bp, Artificial Sequence
  Synthetic Construct
cacctcctggttagaggcattc

SEQ ID NO: 18506 - DNA, 23 bp, Artificial Sequence
  Synthetic Construct
acactgaggacaggaactactga

SEQ ID NO: 18507 - DNA, 28 bp, Artificial Sequence
  Synthetic Construct
gtgagtgtggttagtacctcctaatctt

SEQ ID NO: 18508 - DNA, 22 bp, Artificial Sequence
  Synthetic Construct
gtctggccattccagggagatt

SEQ ID NO: 18509 - DNA, 22 bp, Artificial Sequence
  Synthetic Construct
cagccttgttgctggagggaat

SEQ ID NO: 18510 - DNA, 30 bp, Artificial Sequence
  Synthetic Construct
cgaaattaacagagttctctctggttccaa

SEQ ID NO: 18511 - DNA, 22 bp, Artificial Sequence
  Synthetic Construct
ctggagcaggaaggcttgttac

SEQ ID NO: 18512 - DNA, 28 bp, Artificial Sequence
  Synthetic Construct
gtgttcctggacatgtgtttgataccta

SEQ ID NO: 18513 - DNA, 20 bp, Artificial Sequence
  Synthetic Construct
atggcccagcctctgagtga

SEQ ID NO: 18514 - DNA, 22 bp, Artificial Sequence
  Synthetic Construct
gcaccacgagcttggactttca

SEQ ID NO: 18515 - DNA, 21 bp, Artificial Sequence
  Synthetic Construct
gcgatgcttctggatctgcaa

SEQ ID NO: 18516 - DNA, 26 bp, Artificial Sequence
  Synthetic Construct
ccagcctctgaaggaattggtctatg

SEQ ID NO: 18517 - DNA, 21 bp, Artificial Sequence
  Synthetic Construct
tcccctgatggagagttgcat

SEQ ID NO: 18518 - DNA, 24 bp, Artificial Sequence
  Synthetic Construct
gcagtggaagataggcaagaggaa

SEQ ID NO: 18519 - DNA, 23 bp, Artificial Sequence
  Synthetic Construct
ccaacaggattgtcggtgaattg

SEQ ID NO: 18520 - DNA, 26 bp, Artificial Sequence
  Synthetic Construct
ccaccctgaattttctaggtgtgaac

SEQ ID NO: 18521 - DNA, 23 bp, Artificial Sequence
  Synthetic Construct
gctcactacgaacctgagaccta

SEQ ID NO: 18522 - DNA, 27 bp, Artificial Sequence
  Synthetic Construct
gaccaggaacacatcttgagagttaag

SEQ ID NO: 18523 - DNA, 25 bp, Artificial Sequence
  Synthetic Construct
cctgcaactagcaaattcggctttt

SEQ ID NO: 18524 - DNA, 24 bp, Artificial Sequence
  Synthetic Construct
tgagattcaccactcttcctgaac

SEQ ID NO: 18525 - DNA, 25 bp, Artificial Sequence
  Synthetic Construct
ggtgcaacagactgagagcaatcta

SEQ ID NO: 18526 - DNA, 27 bp, Artificial Sequence
  Synthetic Construct
gaagcagtgggtgagatataggatgat

SEQ ID NO: 18527 - DNA, 22 bp, Artificial Sequence
  Synthetic Construct
agtgaggctcagtgccatcttg

SEQ ID NO: 18528 - DNA, 23 bp, Artificial Sequence
  Synthetic Construct
ggcctttccaacccgattgagta

SEQ ID NO: 18529 - DNA, 23 bp, Artificial Sequence
  Synthetic Construct
ggtcccatgtagggaagtctctt

SEQ ID NO: 18530 - DNA, 19 bp, Artificial Sequence
  Synthetic Construct
acgcagacagggaccagat

SEQ ID NO: 18531 - DNA, 25 bp, Artificial Sequence
  Synthetic Construct
caagtttcaaggaacaggcactaag

SEQ ID NO: 18532 - DNA, 23 bp, Artificial Sequence
  Synthetic Construct
caatgctgggatctttcctccaa

SEQ ID NO: 18533 - DNA, 23 bp, Artificial Sequence
  Synthetic Construct
ccgttcggtcaaaggacatgcaa

SEQ ID NO: 18534 - DNA, 26 bp, Artificial Sequence
  Synthetic Construct
gctactctgggtggttctaactgttg

SEQ ID NO: 18535 - DNA, 22 bp, Artificial Sequence
  Synthetic Construct
ctgccaatagctaggggagcat

SEQ ID NO: 18536 - DNA, 25 bp, Artificial Sequence
  Synthetic Construct
ccaggttagcatacagaaggccaat

SEQ ID NO: 18537 - DNA, 22 bp, Artificial Sequence
  Synthetic Construct
ctccctagtgcttggtgctact

SEQ ID NO: 18538 - DNA, 23 bp, Artificial Sequence
  Synthetic Construct
cggatttggagtagtgggcaatg

SEQ ID NO: 18539 - DNA, 22 bp, Artificial Sequence
  Synthetic Construct
cccatcgggagaatcacacact

SEQ ID NO: 18540 - DNA, 24 bp, Artificial Sequence
  Synthetic Construct
ggctctggaagagagtaggcaaat

SEQ ID NO: 18541 - DNA, 26 bp, Artificial Sequence
  Synthetic Construct
ccgtatctcctccagtccattactgt

SEQ ID NO: 18542 - DNA, 25 bp, Artificial Sequence
  Synthetic Construct
acacctttgctgatctctgctatac

SEQ ID NO: 18543 - DNA, 27 bp, Artificial Sequence
  Synthetic Construct
ctgttcctgcagattacttgctactgt

SEQ ID NO: 18544 - DNA, 21 bp, Artificial Sequence
  Synthetic Construct
cctgtggttcaagcctccaat

SEQ ID NO: 18545 - DNA, 26 bp, Artificial Sequence
  Synthetic Construct
agatcaggttctaagggtcataccaa

SEQ ID NO: 18546 - DNA, 30 bp, Artificial Sequence
  Synthetic Construct
ggagagaggctaactgacatatactggtaa

SEQ ID NO: 18547 - DNA, 24 bp, Artificial Sequence
  Synthetic Construct
gcccagtgtctgatgtgtagaaag

SEQ ID NO: 18548 - DNA, 24 bp, Artificial Sequence
  Synthetic Construct
gaacaagggatgtctcctcttcaa

SEQ ID NO: 18549 - DNA, 23 bp, Artificial Sequence
  Synthetic Construct
gcaaggacacaagcgaagagact

SEQ ID NO: 18550 - DNA, 22 bp, Artificial Sequence
  Synthetic Construct
gcaccatgggtttgcctctact

SEQ ID NO: 18551 - DNA, 23 bp, Artificial Sequence
  Synthetic Construct
agcctcctatgattcccagaact

SEQ ID NO: 18552 - DNA, 26 bp, Artificial Sequence
  Synthetic Construct
gcagaggttcagagggaaagatgttc

SEQ ID NO: 18553 - DNA, 24 bp, Artificial Sequence
  Synthetic Construct
gtcatcatgtgacaacctgtgact

SEQ ID NO: 18554 - DNA, 21 bp, Artificial Sequence
  Synthetic Construct
ggcacgagtaagtgtgtctga

SEQ ID NO: 18555 - DNA, 20 bp, Artificial Sequence
  Synthetic Construct
ggcctgcatgggtcactatt

SEQ ID NO: 18556 - DNA, 25 bp, Artificial Sequence
  Synthetic Construct
ccagtctgtccttgaaaacaacaca

SEQ ID NO: 18557 - DNA, 25 bp, Artificial Sequence
  Synthetic Construct
gcatccgccttagataaacaaagaa

SEQ ID NO: 18558 - DNA, 26 bp, Artificial Sequence
  Synthetic Construct
cacattgacttctttccatgccctat

SEQ ID NO: 18559 - DNA, 24 bp, Artificial Sequence
  Synthetic Construct
ccctgaagtgagtcaggagctgta

SEQ ID NO: 18560 - DNA, 21 bp, Artificial Sequence
  Synthetic Construct
tgccatcccattgaggagtga

SEQ ID NO: 18561 - DNA, 27 bp, Artificial Sequence
  Synthetic Construct
ccatcttttctagagtgggaattgtct

SEQ ID NO: 18562 - DNA, 24 bp, Artificial Sequence
  Synthetic Construct
cctggcctctgattccatccaaac

SEQ ID NO: 18563 - DNA, 24 bp, Artificial Sequence
  Synthetic Construct
gggttttgctttgtggtggtgttg

SEQ ID NO: 18564 - DNA, 22 bp, Artificial Sequence
  Synthetic Construct
aggcacccattcctgtcacttg

SEQ ID NO: 18565 - DNA, 23 bp, Artificial Sequence
  Synthetic Construct
cgaatgggtatcgatgtccttga

SEQ ID NO: 18566 - DNA, 24 bp, Artificial Sequence
  Synthetic Construct
tgactgcgttgagcttagaagtta

SEQ ID NO: 18567 - DNA, 20 bp, Artificial Sequence
  Synthetic Construct
gtccaagtccagccttcaca

SEQ ID NO: 18568 - DNA, 24 bp, Artificial Sequence
  Synthetic Construct
gctgggaaccttggcctgtatatc

SEQ ID NO: 18569 - DNA, 24 bp, Artificial Sequence
  Synthetic Construct
gcttcctgtttccacgtaggtttc

SEQ ID NO: 18570 - DNA, 21 bp, Artificial Sequence
  Synthetic Construct
ggctggaaaggatggtgctat

SEQ ID NO: 18571 - DNA, 27 bp, Artificial Sequence
  Synthetic Construct
gagtggctaactggtcctaaattcaaa

SEQ ID NO: 18572 - DNA, 21 bp, Artificial Sequence
  Synthetic Construct
gcctcaaactcctgggctcaa

SEQ ID NO: 18573 - DNA, 24 bp, Artificial Sequence
  Synthetic Construct
ccctctggcagtgtgttagcagat

SEQ ID NO: 18574 - DNA, 24 bp, Artificial Sequence
  Synthetic Construct
ggcttacactgccctctgagatac

SEQ ID NO: 18575 - DNA, 26 bp, Artificial Sequence
  Synthetic Construct
ccagagttccctctttgggaatcaga

SEQ ID NO: 18576 - DNA, 24 bp, Artificial Sequence
  Synthetic Construct
caggacttgtgtctgtggctaaac

SEQ ID NO: 18577 - DNA, 24 bp, Artificial Sequence
  Synthetic Construct
gcttctcgtgactcattcatgttt

SEQ ID NO: 18578 - DNA, 24 bp, Artificial Sequence
  Synthetic Construct
cccttgtctccaagtgagctattc

SEQ ID NO: 18579 - DNA, 26 bp, Artificial Sequence
  Synthetic Construct
cgtggcctaaacttttccaaagacat

SEQ ID NO: 18580 - DNA, 21 bp, Artificial Sequence
  Synthetic Construct
ggtgatggctgatgagtggtt

SEQ ID NO: 18581 - DNA, 21 bp, Artificial Sequence
  Synthetic Construct
gtcacttgctcaccccaatga

SEQ ID NO: 18582 - DNA, 26 bp, Artificial Sequence
  Synthetic Construct
cctgtgtgggacagtaaatgtaggta

SEQ ID NO: 18583 - DNA, 24 bp, Artificial Sequence
  Synthetic Construct
ccttcaggtactgagggtgtctct

SEQ ID NO: 18584 - DNA, 26 bp, Artificial Sequence
  Synthetic Construct
gtgaagggactactgaaaactgaaga

SEQ ID NO: 18585 - DNA, 27 bp, Artificial Sequence
  Synthetic Construct
ggctccatctaagattttcaggagtca

SEQ ID NO: 18586 - DNA, 25 bp, Artificial Sequence
  Synthetic Construct
gtgttccccaaaacaattcccagtt

SEQ ID NO: 18587 - DNA, 25 bp, Artificial Sequence
  Synthetic Construct
gcaagtctcctagttacgcaagtca

SEQ ID NO: 18588 - DNA, 30 bp, Artificial Sequence
  Synthetic Construct
ggtgaaatctcagctcagttctttcagatt

SEQ ID NO: 18589 - DNA, 23 bp, Artificial Sequence
  Synthetic Construct
agacgtaagagctatgtggcaaa

SEQ ID NO: 18590 - DNA, 25 bp, Artificial Sequence
  Synthetic Construct
gctttctgtgattgccaataccatt

SEQ ID NO: 18591 - DNA, 26 bp, Artificial Sequence
  Synthetic Construct
gcacacaatatgccatttcctctgaa

SEQ ID NO: 18592 - DNA, 23 bp, Artificial Sequence
  Synthetic Construct
tgggaaatggtgttgcctcatag

SEQ ID NO: 18593 - DNA, 22 bp, Artificial Sequence
  Synthetic Construct
ctgacatgccaagtgcccagaa

SEQ ID NO: 18594 - DNA, 24 bp, Artificial Sequence
  Synthetic Construct
ggcaaagacctgaagaatgacgat

SEQ ID NO: 18595 - DNA, 22 bp, Artificial Sequence
  Synthetic Construct
cgcagctacaacataagccaaa

SEQ ID NO: 18596 - DNA, 22 bp, Artificial Sequence
  Synthetic Construct
cgcacatgcatcctctggtact

SEQ ID NO: 18597 - DNA, 24 bp, Artificial Sequence
  Synthetic Construct
ggaaactgtgcatcctagttctga

SEQ ID NO: 18598 - DNA, 20 bp, Artificial Sequence
  Synthetic Construct
agctgaagctgcaggaggat

SEQ ID NO: 18599 - DNA, 26 bp, Artificial Sequence
  Synthetic Construct
tgcctccagatctagtaatactgctt

SEQ ID NO: 18600 - DNA, 24 bp, Artificial Sequence
  Synthetic Construct
ccacaacctttagactgaggtctt

SEQ ID NO: 18601 - DNA, 20 bp, Artificial Sequence
  Synthetic Construct
gcaaagcactggccacattg

SEQ ID NO: 18602 - DNA, 27 bp, Artificial Sequence
  Synthetic Construct
cacactggttaaaagtggcatgtatga

SEQ ID NO: 18603 - DNA, 22 bp, Artificial Sequence
  Synthetic Construct
ggaaagcagctggcactgatga

SEQ ID NO: 18604 - DNA, 29 bp, Artificial Sequence
  Synthetic Construct
ctcccttctataataccactcacagatag

SEQ ID NO: 18605 - DNA, 21 bp, Artificial Sequence
  Synthetic Construct
gccgtgtttacgctcttcttg

SEQ ID NO: 18606 - DNA, 23 bp, Artificial Sequence
  Synthetic Construct
gccatttacacccgttccacagt

SEQ ID NO: 18607 - DNA, 24 bp, Artificial Sequence
  Synthetic Construct
ccgagaggcacagaccaatgaaga

SEQ ID NO: 18608 - DNA, 24 bp, Artificial Sequence
  Synthetic Construct
ggatagtgagttcctcgtggatga

SEQ ID NO: 18609 - DNA, 24 bp, Artificial Sequence
  Synthetic Construct
cctccccattctgaggcactctta

SEQ ID NO: 18610 - DNA, 22 bp, Artificial Sequence
  Synthetic Construct
gcccaggagttgacctttcaat

SEQ ID NO: 18611 - DNA, 27 bp, Artificial Sequence
  Synthetic Construct
aggagtatagtaagttctcggtagcat

SEQ ID NO: 18612 - DNA, 25 bp, Artificial Sequence
  Synthetic Construct
tgagcttgttctggtccttatcttt

SEQ ID NO: 18613 - DNA, 21 bp, Artificial Sequence
  Synthetic Construct
cgggtagtaagcacacagcaa

SEQ ID NO: 18614 - DNA, 28 bp, Artificial Sequence
  Synthetic Construct
ggagagtaaagccaccatctaagggtta

SEQ ID NO: 18615 - DNA, 25 bp, Artificial Sequence
  Synthetic Construct
aggggcacttccaaaaacataatct

SEQ ID NO: 18616 - DNA, 26 bp, Artificial Sequence
  Synthetic Construct
ctgggaaacagtcattaccaacatac

SEQ ID NO: 18617 - DNA, 28 bp, Artificial Sequence
  Synthetic Construct
gcagtgacaagaaattaggccaagtcta

SEQ ID NO: 18618 - DNA, 24 bp, Artificial Sequence
  Synthetic Construct
gcacacagtgagttcatggcaaag

SEQ ID NO: 18619 - DNA, 24 bp, Artificial Sequence
  Synthetic Construct
ttcctcctgaaacggaaagaatga

SEQ ID NO: 18620 - DNA, 24 bp, Artificial Sequence
  Synthetic Construct
tggaaccctaatcctgttcagcta

SEQ ID NO: 18621 - DNA, 28 bp, Artificial Sequence
  Synthetic Construct
ctgtcttagctgtcagaataccaactgt

SEQ ID NO: 18622 - DNA, 20 bp, Artificial Sequence
  Synthetic Construct
cagtgccacagcacttctca

SEQ ID NO: 18623 - DNA, 23 bp, Artificial Sequence
  Synthetic Construct
gctactctcacggccctcttcta

SEQ ID NO: 18624 - DNA, 24 bp, Artificial Sequence
  Synthetic Construct
cctctcaacgaaggcataatgcta

SEQ ID NO: 18625 - DNA, 27 bp, Artificial Sequence
  Synthetic Construct
gtcaccatttctggatagtctgaggaa

SEQ ID NO: 18626 - DNA, 23 bp, Artificial Sequence
  Synthetic Construct
tgacccagaagagtttggagttg

SEQ ID NO: 18627 - DNA, 24 bp, Artificial Sequence
  Synthetic Construct
agtgaattgaagagggcaggaaat

SEQ ID NO: 18628 - DNA, 23 bp, Artificial Sequence
  Synthetic Construct
gtggcagtggcaaaagaacacaa

SEQ ID NO: 18629 - DNA, 20 bp, Artificial Sequence
  Synthetic Construct
ggtctgtgctcgcttggtta

SEQ ID NO: 18630 - DNA, 27 bp, Artificial Sequence
  Synthetic Construct
gagtagtccaggttatcctcagagtca

SEQ ID NO: 18631 - DNA, 21 bp, Artificial Sequence
  Synthetic Construct
gcttcacttggcagctgtttc

SEQ ID NO: 18632 - DNA, 25 bp, Artificial Sequence
  Synthetic Construct
gctggggagatgtctttggattttg

SEQ ID NO: 18633 - DNA, 27 bp, Artificial Sequence
  Synthetic Construct
gcatggcagaagctagaaagaaaggat

SEQ ID NO: 18634 - DNA, 26 bp, Artificial Sequence
  Synthetic Construct
cctaagtggttggttcagaattcact

SEQ ID NO: 18635 - DNA, 21 bp, Artificial Sequence
  Synthetic Construct
tcagcatgtagccttgccaaa

SEQ ID NO: 18636 - DNA, 25 bp, Artificial Sequence
  Synthetic Construct
gcccattatttccccactactctct

SEQ ID NO: 18637 - DNA, 25 bp, Artificial Sequence
  Synthetic Construct
ccagctagaccggaaagtacaggat

SEQ ID NO: 18638 - DNA, 22 bp, Artificial Sequence
  Synthetic Construct
tgctgctcaagtgtttccttct

SEQ ID NO: 18639 - DNA, 27 bp, Artificial Sequence
  Synthetic Construct
cctttctagagtggtgccattatctca

SEQ ID NO: 18640 - DNA, 22 bp, Artificial Sequence
  Synthetic Construct
ggaggcctttctgaaccatctt

SEQ ID NO: 18641 - DNA, 22 bp, Artificial Sequence
  Synthetic Construct
ctgttgtaggcctgaggcattg

SEQ ID NO: 18642 - DNA, 22 bp, Artificial Sequence
  Synthetic Construct
gggctacactggatgacagctt

SEQ ID NO: 18643 - DNA, 25 bp, Artificial Sequence
  Synthetic Construct
gctttggaatttggggtgacctttc

SEQ ID NO: 18644 - DNA, 28 bp, Artificial Sequence
  Synthetic Construct
gcccttgttcatggataaagagcatttg

SEQ ID NO: 18645 - DNA, 25 bp, Artificial Sequence
  Synthetic Construct
ccagatgcccatgatagtccttttc

SEQ ID NO: 18646 - DNA, 25 bp, Artificial Sequence
  Synthetic Construct
gaggctgatggaaatggtaaagcaa

SEQ ID NO: 18647 - DNA, 22 bp, Artificial Sequence
  Synthetic Construct
ccctcggttacagcaacagttc

SEQ ID NO: 18648 - DNA, 23 bp, Artificial Sequence
  Synthetic Construct
ggggatcaacgagagcctagagt

SEQ ID NO: 18649 - DNA, 27 bp, Artificial Sequence
  Synthetic Construct
cccagagatagttcctactgaccactt

SEQ ID NO: 18650 - DNA, 22 bp, Artificial Sequence
  Synthetic Construct
cgccaacagggtttggagtagt

SEQ ID NO: 18651 - DNA, 28 bp, Artificial Sequence
  Synthetic Construct
cctgaccatctttgcaaatcaggcttta

SEQ ID NO: 18652 - DNA, 23 bp, Artificial Sequence
  Synthetic Construct
gggtaccagtccttccacttttg

SEQ ID NO: 18653 - DNA, 22 bp, Artificial Sequence
  Synthetic Construct
gcttggggcaagagttgtttac

SEQ ID NO: 18654 - DNA, 21 bp, Artificial Sequence
  Synthetic Construct
cagggtgactgacatgggttt

SEQ ID NO: 18655 - DNA, 22 bp, Artificial Sequence
  Synthetic Construct
aggagttgcctctgggtcagtt

SEQ ID NO: 18656 - DNA, 29 bp, Artificial Sequence
  Synthetic Construct
gaagattgggcatggttacatccatatac

SEQ ID NO: 18657 - DNA, 20 bp, Artificial Sequence
  Synthetic Construct
cctgcctcactgctccttct

SEQ ID NO: 18658 - DNA, 22 bp, Artificial Sequence
  Synthetic Construct
gggaggaaccaagttcccattg

SEQ ID NO: 18659 - DNA, 27 bp, Artificial Sequence
  Synthetic Construct
cagtatcacaagcctcactttggtttc

SEQ ID NO: 18660 - DNA, 25 bp, Artificial Sequence
  Synthetic Construct
cagaagtggtattctgggcatgaac

SEQ ID NO: 18661 - DNA, 29 bp, Artificial Sequence
  Synthetic Construct
gctgctacttcttcttttggctaactttc

SEQ ID NO: 18662 - DNA, 22 bp, Artificial Sequence
  Synthetic Construct
ctcacacagccttctgggatca

SEQ ID NO: 18663 - DNA, 23 bp, Artificial Sequence
  Synthetic Construct
ccatgtaaggtgggtggaaggaa

SEQ ID NO: 18664 - DNA, 22 bp, Artificial Sequence
  Synthetic Construct
gggatctctcactccacacagt

SEQ ID NO: 18665 - DNA, 22 bp, Artificial Sequence
  Synthetic Construct
ggccaggtttaggaaggcttta

SEQ ID NO: 18666 - DNA, 26 bp, Artificial Sequence
  Synthetic Construct
ggaggctgtagttgctctcatatcta

SEQ ID NO: 18667 - DNA, 29 bp, Artificial Sequence
  Synthetic Construct
cagcttggtaacccacataaatactcaac

SEQ ID NO: 18668 - DNA, 25 bp, Artificial Sequence
  Synthetic Construct
ccataaccacacaggaagtctgatg

SEQ ID NO: 18669 - DNA, 22 bp, Artificial Sequence
  Synthetic Construct
gaggagcctggaactgaccaaa

SEQ ID NO: 18670 - DNA, 27 bp, Artificial Sequence
  Synthetic Construct
gggaggaatgtttactttgccttgaca

SEQ ID NO: 18671 - DNA, 25 bp, Artificial Sequence
  Synthetic Construct
actcgctatccttttcatgttggat

SEQ ID NO: 18672 - DNA, 25 bp, Artificial Sequence
  Synthetic Construct
gcaagaggaatggacagtagagaag

SEQ ID NO: 18673 - DNA, 21 bp, Artificial Sequence
  Synthetic Construct
cttagcgtcacacagcagaca

SEQ ID NO: 18674 - DNA, 24 bp, Artificial Sequence
  Synthetic Construct
gacctcaccatcatccatgtgttc

SEQ ID NO: 18675 - DNA, 21 bp, Artificial Sequence
  Synthetic Construct
tgctcccctgagatggagact

SEQ ID NO: 18676 - DNA, 25 bp, Artificial Sequence
  Synthetic Construct
agccatctaccactgttctttcaat

SEQ ID NO: 18677 - DNA, 22 bp, Artificial Sequence
  Synthetic Construct
gggcaaattccccgacatcaga

SEQ ID NO: 18678 - DNA, 26 bp, Artificial Sequence
  Synthetic Construct
ggtatccgaatggaggaccaagtaat

SEQ ID NO: 18679 - DNA, 23 bp, Artificial Sequence
  Synthetic Construct
ggcccgcctcaaaaatctaccaa

SEQ ID NO: 18680 - DNA, 24 bp, Artificial Sequence
  Synthetic Construct
tggccaatagaatgtgtgaggaat

SEQ ID NO: 18681 - DNA, 24 bp, Artificial Sequence
  Synthetic Construct
gggcggaaaagatacaccccataa

SEQ ID NO: 18682 - DNA, 23 bp, Artificial Sequence
  Synthetic Construct
cagcatcgcagtcctgttatttc

SEQ ID NO: 18683 - DNA, 25 bp, Artificial Sequence
  Synthetic Construct
cacgcttagatttcagtgagcaaga

SEQ ID NO: 18684 - DNA, 27 bp, Artificial Sequence
  Synthetic Construct
cactggtttctaggaccatgttaaaag

SEQ ID NO: 18685 - DNA, 24 bp, Artificial Sequence
  Synthetic Construct
gtgaagatccacagctcggaatac

SEQ ID NO: 18686 - DNA, 27 bp, Artificial Sequence
  Synthetic Construct
gctaggtggttactttaggttggatag

SEQ ID NO: 18687 - DNA, 23 bp, Artificial Sequence
  Synthetic Construct
aggtaacgcactgacttttgagt

SEQ ID NO: 18688 - DNA, 20 bp, Artificial Sequence
  Synthetic Construct
aactcgccagggctgttgat

SEQ ID NO: 18689 - DNA, 24 bp, Artificial Sequence
  Synthetic Construct
cctcctcagatgaccagagaaatc

SEQ ID NO: 18690 - DNA, 26 bp, Artificial Sequence
  Synthetic Construct
cctcagtcaggtttccagaaggtact

SEQ ID NO: 18691 - DNA, 20 bp, Artificial Sequence
  Synthetic Construct
gcaaccggtgccaccataga

SEQ ID NO: 18692 - DNA, 24 bp, Artificial Sequence
  Synthetic Construct
cccctaactcgattgccaacagaa

SEQ ID NO: 18693 - DNA, 24 bp, Artificial Sequence
  Synthetic Construct
cctgggaggtaagcccattgtaag

SEQ ID NO: 18694 - DNA, 24 bp, Artificial Sequence
  Synthetic Construct
ccagacctcagaaatgtcctgttc

SEQ ID NO: 18695 - DNA, 22 bp, Artificial Sequence
  Synthetic Construct
ggagactggctttggcaacaca

SEQ ID NO: 18696 - DNA, 20 bp, Artificial Sequence
  Synthetic Construct
tgccacacaacctggtgctt

SEQ ID NO: 18697 - DNA, 21 bp, Artificial Sequence
  Synthetic Construct
ggatcttgcgtccaggccttt

SEQ ID NO: 18698 - DNA, 20 bp, Artificial Sequence
  Synthetic Construct
tgggtttaggcggcatcctt

SEQ ID NO: 18699 - DNA, 21 bp, Artificial Sequence
  Synthetic Construct
ggcctgcatcaaacagggaat

SEQ ID NO: 18700 - DNA, 22 bp, Artificial Sequence
  Synthetic Construct
gctggatggtatgtagccaact

SEQ ID NO: 18701 - DNA, 25 bp, Artificial Sequence
  Synthetic Construct
ccccaaagtctgtgcttttcctact

SEQ ID NO: 18702 - DNA, 21 bp, Artificial Sequence
  Synthetic Construct
cctctggagcattgcagatca

SEQ ID NO: 18703 - DNA, 25 bp, Artificial Sequence
  Synthetic Construct
ggattccagcaactttcagcaggta

SEQ ID NO: 18704 - DNA, 23 bp, Artificial Sequence
  Synthetic Construct
cgcttgtcccaggatggacttag

SEQ ID NO: 18705 - DNA, 20 bp, Artificial Sequence
  Synthetic Construct
agggcatgtccactgcattc

SEQ ID NO: 18706 - DNA, 24 bp, Artificial Sequence
  Synthetic Construct
agtgggtctgttcctcagtaattc

SEQ ID NO: 18707 - DNA, 23 bp, Artificial Sequence
  Synthetic Construct
gcaaatggcctggctagaaggaa

SEQ ID NO: 18708 - DNA, 27 bp, Artificial Sequence
  Synthetic Construct
gctgtgtaccagaatcttctgttttgt

SEQ ID NO: 18709 - DNA, 23 bp, Artificial Sequence
  Synthetic Construct
gtcctgagagctgtccctttatg

SEQ ID NO: 18710 - DNA, 24 bp, Artificial Sequence
  Synthetic Construct
ccagacttgccttcaagcatgtta

SEQ ID NO: 18711 - DNA, 23 bp, Artificial Sequence
  Synthetic Construct
gtccatctcactgcggagaagtt

SEQ ID NO: 18712 - DNA, 24 bp, Artificial Sequence
  Synthetic Construct
ggccgagtcaaacaaacgatgttg

SEQ ID NO: 18713 - DNA, 25 bp, Artificial Sequence
  Synthetic Construct
gcagtttatccttgggacagacagt

SEQ ID NO: 18714 - DNA, 22 bp, Artificial Sequence
  Synthetic Construct
ccaaaggccaggaagagggtat

SEQ ID NO: 18715 - DNA, 25 bp, Artificial Sequence
  Synthetic Construct
ctgaggaagtccatgtttcccctta

SEQ ID NO: 18716 - DNA, 22 bp, Artificial Sequence
  Synthetic Construct
tcgccccttgagtgagagaaga

SEQ ID NO: 18717 - DNA, 23 bp, Artificial Sequence
  Synthetic Construct
gcacttccagttgcagatacctt

SEQ ID NO: 18718 - DNA, 23 bp, Artificial Sequence
  Synthetic Construct
ccaccctgatttcggctttgtga

SEQ ID NO: 18719 - DNA, 26 bp, Artificial Sequence
  Synthetic Construct
catccctgaattgtcagttgttccat

SEQ ID NO: 18720 - DNA, 23 bp, Artificial Sequence
  Synthetic Construct
cggctccatcagttcctgagagt

SEQ ID NO: 18721 - DNA, 24 bp, Artificial Sequence
  Synthetic Construct
gcctctggctcaagatgtctcaca

SEQ ID NO: 18722 - DNA, 19 bp, Artificial Sequence
  Synthetic Construct
accgggagaacgcacttca

SEQ ID NO: 18723 - DNA, 22 bp, Artificial Sequence
  Synthetic Construct
acctcctttccccagcatgaag

SEQ ID NO: 18724 - DNA, 26 bp, Artificial Sequence
  Synthetic Construct
ccttccagaagccaaacacaatctca

SEQ ID NO: 18725 - DNA, 25 bp, Artificial Sequence
  Synthetic Construct
gtctcgatgtaaagttgaggactct

SEQ ID NO: 18726 - DNA, 24 bp, Artificial Sequence
  Synthetic Construct
gaggctagttagcaccaagtctga

SEQ ID NO: 18727 - DNA, 26 bp, Artificial Sequence
  Synthetic Construct
aaggatgtacctgcagggttatctac

SEQ ID NO: 18728 - DNA, 23 bp, Artificial Sequence
  Synthetic Construct
caccaagatgggtgatgatggtt

SEQ ID NO: 18729 - DNA, 24 bp, Artificial Sequence
  Synthetic Construct
cgtctcagtgactttggcagtgat

SEQ ID NO: 18730 - DNA, 21 bp, Artificial Sequence
  Synthetic Construct
gactgttgtggtgcagcttgt

SEQ ID NO: 18731 - DNA, 23 bp, Artificial Sequence
  Synthetic Construct
gcttcaggaagcctttaggaact

SEQ ID NO: 18732 - DNA, 29 bp, Artificial Sequence
  Synthetic Construct
gataatcaggtagataggatgacctgttc

SEQ ID NO: 18733 - DNA, 22 bp, Artificial Sequence
  Synthetic Construct
gggcagctctgaactgtcattg

SEQ ID NO: 18734 - DNA, 26 bp, Artificial Sequence
  Synthetic Construct
gccagagaaaccttaagctgaacata

SEQ ID NO: 18735 - DNA, 26 bp, Artificial Sequence
  Synthetic Construct
gcaagcacttgtgtgaagtattccaa

SEQ ID NO: 18736 - DNA, 27 bp, Artificial Sequence
  Synthetic Construct
cctttattcctgaaggatctgggttgt

SEQ ID NO: 18737 - DNA, 27 bp, Artificial Sequence
  Synthetic Construct
gacaggtgtctaaaacttcttcctgta

SEQ ID NO: 18738 - DNA, 25 bp, Artificial Sequence
  Synthetic Construct
gctggccctttaaatatcccagaga

SEQ ID NO: 18739 - DNA, 22 bp, Artificial Sequence
  Synthetic Construct
tggccctcagagtcacagtgta

SEQ ID NO: 18740 - DNA, 22 bp, Artificial Sequence
  Synthetic Construct
tgactgaaagcacctagcaaca

SEQ ID NO: 18741 - DNA, 23 bp, Artificial Sequence
  Synthetic Construct
agcaactgtgcttttgagaggat

SEQ ID NO: 18742 - DNA, 25 bp, Artificial Sequence
  Synthetic Construct
ccaaacctcagtaaatggggagatt

SEQ ID NO: 18743 - DNA, 24 bp, Artificial Sequence
  Synthetic Construct
ggaagcccaaacctcaaggtaaga

SEQ ID NO: 18744 - DNA, 20 bp, Artificial Sequence
  Synthetic Construct
gtgcttgcggcttgcaatga

SEQ ID NO: 18745 - DNA, 25 bp, Artificial Sequence
  Synthetic Construct
cccgttttgaacagtgagtcaattc

SEQ ID NO: 18746 - DNA, 26 bp, Artificial Sequence
  Synthetic Construct
ccaattctctggtgatactgcgaaca

SEQ ID NO: 18747 - DNA, 24 bp, Artificial Sequence
  Synthetic Construct
tctgggcagagttaagaaggaaga

SEQ ID NO: 18748 - DNA, 22 bp, Artificial Sequence
  Synthetic Construct
cagttcccatgtgtgctgtaga

SEQ ID NO: 18749 - DNA, 22 bp, Artificial Sequence
  Synthetic Construct
ccaggtaccgattgggcagttt

SEQ ID NO: 18750 - DNA, 23 bp, Artificial Sequence
  Synthetic Construct
ccttccaaggagactctggtact

SEQ ID NO: 18751 - DNA, 24 bp, Artificial Sequence
  Synthetic Construct
cagagtcaggttagaagggctgaa

SEQ ID NO: 18752 - DNA, 24 bp, Artificial Sequence
  Synthetic Construct
ggggttgggactatgaggaagtgt

SEQ ID NO: 18753 - DNA, 23 bp, Artificial Sequence
  Synthetic Construct
tccaaacacacatgcctttctct

SEQ ID NO: 18754 - DNA, 24 bp, Artificial Sequence
  Synthetic Construct
ccacctggccctgtagacatttga

SEQ ID NO: 18755 - DNA, 22 bp, Artificial Sequence
  Synthetic Construct
ggctgccaactgtactggaact

SEQ ID NO: 18756 - DNA, 23 bp, Artificial Sequence
  Synthetic Construct
ctgtgacaaagctggcacaaact

SEQ ID NO: 18757 - DNA, 25 bp, Artificial Sequence
  Synthetic Construct
gacaccaccatgaattccagcctaa

SEQ ID NO: 18758 - DNA, 20 bp, Artificial Sequence
  Synthetic Construct
tcccagtggctctcctttca

SEQ ID NO: 18759 - DNA, 27 bp, Artificial Sequence
  Synthetic Construct
aggtggactaagtagaagtagggtatc

SEQ ID NO: 18760 - DNA, 20 bp, Artificial Sequence
  Synthetic Construct
aggtgtcaggctccatgtct

SEQ ID NO: 18761 - DNA, 26 bp, Artificial Sequence
  Synthetic Construct
cctcctaacttgacccagagagctaa

SEQ ID NO: 18762 - DNA, 29 bp, Artificial Sequence
  Synthetic Construct
gcaatgaggtgaaaagcttctgttcatac

SEQ ID NO: 18763 - DNA, 23 bp, Artificial Sequence
  Synthetic Construct
gcgtgtagcttttcagtcactct

SEQ ID NO: 18764 - DNA, 22 bp, Artificial Sequence
  Synthetic Construct
gctggctgtaatgaaggaggat

SEQ ID NO: 18765 - DNA, 22 bp, Artificial Sequence
  Synthetic Construct
ccgtgagtgccgtcatcttgta

SEQ ID NO: 18766 - DNA, 27 bp, Artificial Sequence
  Synthetic Construct
cctgtctgtcaaaagtctcttgctttg

SEQ ID NO: 18767 - DNA, 24 bp, Artificial Sequence
  Synthetic Construct
ggattttcggacgcatcattgaga

SEQ ID NO: 18768 - DNA, 24 bp, Artificial Sequence
  Synthetic Construct
cccatttgtgcttccacatactct

SEQ ID NO: 18769 - DNA, 24 bp, Artificial Sequence
  Synthetic Construct
cccttacctggagcatggtgaatc

SEQ ID NO: 18770 - DNA, 20 bp, Artificial Sequence
  Synthetic Construct
tgggcctgtgtgcctgattc

SEQ ID NO: 18771 - DNA, 24 bp, Artificial Sequence
  Synthetic Construct
ggctgatgcatatttgggagtaca

SEQ ID NO: 18772 - DNA, 20 bp, Artificial Sequence
  Synthetic Construct
ggccagtcaccccaaagaca

SEQ ID NO: 18773 - DNA, 23 bp, Artificial Sequence
  Synthetic Construct
gggaaaaggccattcaggcaagt

SEQ ID NO: 18774 - DNA, 23 bp, Artificial Sequence
  Synthetic Construct
ccaggagaagaaggccagtgatg

SEQ ID NO: 18775 - DNA, 23 bp, Artificial Sequence
  Synthetic Construct
gggccatgaacagtgaaaggatt

SEQ ID NO: 18776 - DNA, 26 bp, Artificial Sequence
  Synthetic Construct
ccacactgtagtccagttgaaggaaa

SEQ ID NO: 18777 - DNA, 23 bp, Artificial Sequence
  Synthetic Construct
gcaagtgtacctggttggaccat

SEQ ID NO: 18778 - DNA, 22 bp, Artificial Sequence
  Synthetic Construct
ggtggaatccgtgagcacaaac

SEQ ID NO: 18779 - DNA, 27 bp, Artificial Sequence
  Synthetic Construct
ctcacatagagaagaaacagagcaaga

SEQ ID NO: 18780 - DNA, 22 bp, Artificial Sequence
  Synthetic Construct
ggctaaacctcctgctgcaatc

SEQ ID NO: 18781 - DNA, 24 bp, Artificial Sequence
  Synthetic Construct
ctcctatgcaggtctcaactggta

SEQ ID NO: 18782 - DNA, 23 bp, Artificial Sequence
  Synthetic Construct
gccatcctggtgtagctggtaag

SEQ ID NO: 18783 - DNA, 23 bp, Artificial Sequence
  Synthetic Construct
gcactcatgccattcagcaggta

SEQ ID NO: 18784 - DNA, 21 bp, Artificial Sequence
  Synthetic Construct
ccgtctgtggtgtcattgtga

SEQ ID NO: 18785 - DNA, 22 bp, Artificial Sequence
  Synthetic Construct
cactggggcaaacagatcatca

SEQ ID NO: 18786 - DNA, 22 bp, Artificial Sequence
  Synthetic Construct
gggatccttccttgccttcact

SEQ ID NO: 18787 - DNA, 26 bp, Artificial Sequence
  Synthetic Construct
gcagagagatggagagagatggtctt

SEQ ID NO: 18788 - DNA, 23 bp, Artificial Sequence
  Synthetic Construct
caccctccctatagagcttcaga

SEQ ID NO: 18789 - DNA, 25 bp, Artificial Sequence
  Synthetic Construct
tgagggcaatgtcttagaaagcata

SEQ ID NO: 18790 - DNA, 23 bp, Artificial Sequence
  Synthetic Construct
tctggaacacagcaagactcaag

SEQ ID NO: 18791 - DNA, 27 bp, Artificial Sequence
  Synthetic Construct
gaaaggtgttgcatttactctcgtatg

SEQ ID NO: 18792 - DNA, 24 bp, Artificial Sequence
  Synthetic Construct
gactagaggagggtaggaggaagt

SEQ ID NO: 18793 - DNA, 27 bp, Artificial Sequence
  Synthetic Construct
gcgtcatccctagcacaattttagact

SEQ ID NO: 18794 - DNA, 27 bp, Artificial Sequence
  Synthetic Construct
ggctgtgaggttttagatacacccttt

SEQ ID NO: 18795 - DNA, 24 bp, Artificial Sequence
  Synthetic Construct
ggcagccagacatcttctctaaat

SEQ ID NO: 18796 - DNA, 24 bp, Artificial Sequence
  Synthetic Construct
gcatcagctaaatgcatggtcctt

SEQ ID NO: 18797 - DNA, 26 bp, Artificial Sequence
  Synthetic Construct
tctgacttaggttttcttggctgtag

SEQ ID NO: 18798 - DNA, 25 bp, Artificial Sequence
  Synthetic Construct
gcctgcagttcaataaggctactgt

SEQ ID NO: 18799 - DNA, 23 bp, Artificial Sequence
  Synthetic Construct
actgagcatgcttttgctctcaa

SEQ ID NO: 18800 - DNA, 26 bp, Artificial Sequence
  Synthetic Construct
cggtcaaacatgaggatgagaaaact

SEQ ID NO: 18801 - DNA, 24 bp, Artificial Sequence
  Synthetic Construct
caccgtataattagcgggaagtgt

SEQ ID NO: 18802 - DNA, 22 bp, Artificial Sequence
  Synthetic Construct
tggaggtgagtgctgagacaga

SEQ ID NO: 18803 - DNA, 25 bp, Artificial Sequence
  Synthetic Construct
ggggaggaaagatgatgagggaagt

SEQ ID NO: 18804 - DNA, 25 bp, Artificial Sequence
  Synthetic Construct
gggtggcctagtttgaaagagtgat

SEQ ID NO: 18805 - DNA, 20 bp, Artificial Sequence
  Synthetic Construct
gagcaagcaagcagcacact

SEQ ID NO: 18806 - DNA, 28 bp, Artificial Sequence
  Synthetic Construct
cctgtagtgatttccaagacctcaccat

SEQ ID NO: 18807 - DNA, 26 bp, Artificial Sequence
  Synthetic Construct
gcatgttattctctccaggtccagaa

SEQ ID NO: 18808 - DNA, 23 bp, Artificial Sequence
  Synthetic Construct
gcagtgtctagcacacaatgtca

SEQ ID NO: 18809 - DNA, 25 bp, Artificial Sequence
  Synthetic Construct
cttgcacagtgtagaatctgaggat

SEQ ID NO: 18810 - DNA, 27 bp, Artificial Sequence
  Synthetic Construct
ccaaccctgattcattccagtaatgtt

SEQ ID NO: 18811 - DNA, 24 bp, Artificial Sequence
  Synthetic Construct
cccttcctgtttctcaacctgtgt

SEQ ID NO: 18812 - DNA, 25 bp, Artificial Sequence
  Synthetic Construct
ggcttatgaaccaaaccacttgtct

SEQ ID NO: 18813 - DNA, 28 bp, Artificial Sequence
  Synthetic Construct
cactgttctgttactgacagggaaaaag

SEQ ID NO: 18814 - DNA, 19 bp, Artificial Sequence
  Synthetic Construct
gggccagcttgtggagagt

SEQ ID NO: 18815 - DNA, 24 bp, Artificial Sequence
  Synthetic Construct
gctgatgagtcaagtgctatctgt

SEQ ID NO: 18816 - DNA, 26 bp, Artificial Sequence
  Synthetic Construct
ctcttgtctactgagccattgcagtt

SEQ ID NO: 18817 - DNA, 22 bp, Artificial Sequence
  Synthetic Construct
aggaagcaccaggaacccatct

SEQ ID NO: 18818 - DNA, 23 bp, Artificial Sequence
  Synthetic Construct
cactttgggctcctccttccttt

SEQ ID NO: 18819 - DNA, 25 bp, Artificial Sequence
  Synthetic Construct
tggggatgactacttttgctattgt

SEQ ID NO: 18820 - DNA, 22 bp, Artificial Sequence
  Synthetic Construct
gggaaggattccagtggtcgat

SEQ ID NO: 18821 - DNA, 25 bp, Artificial Sequence
  Synthetic Construct
ctcttggaaaagtgagagcgttttg

SEQ ID NO: 18822 - DNA, 25 bp, Artificial Sequence
  Synthetic Construct
ctggggtagtatgtttgcccttcta

SEQ ID NO: 18823 - DNA, 24 bp, Artificial Sequence
  Synthetic Construct
ggtacccgaagaaggctattccaa

SEQ ID NO: 18824 - DNA, 23 bp, Artificial Sequence
  Synthetic Construct
gggcagaagagtggaaacagcta

SEQ ID NO: 18825 - DNA, 21 bp, Artificial Sequence
  Synthetic Construct
ggtggtgccttattgctgcat

SEQ ID NO: 18826 - DNA, 20 bp, Artificial Sequence
  Synthetic Construct
tggagtggcaggagtcttca

SEQ ID NO: 18827 - DNA, 22 bp, Artificial Sequence
  Synthetic Construct
tcctgctaggagggtgatctct

SEQ ID NO: 18828 - DNA, 20 bp, Artificial Sequence
  Synthetic Construct
ggtggtactggccctgaaca

SEQ ID NO: 18829 - DNA, 22 bp, Artificial Sequence
  Synthetic Construct
gattccagctaccccagctttc

SEQ ID NO: 18830 - DNA, 24 bp, Artificial Sequence
  Synthetic Construct
gatgaagatggcactggatgtttc

SEQ ID NO: 18831 - DNA, 21 bp, Artificial Sequence
  Synthetic Construct
gtccagcatagccagtcactt

SEQ ID NO: 18832 - DNA, 25 bp, Artificial Sequence
  Synthetic Construct
cagcaaagctgcaatttgtctatct

SEQ ID NO: 18833 - DNA, 29 bp, Artificial Sequence
  Synthetic Construct
ccttgtattcattccatacctgctctttg

SEQ ID NO: 18834 - DNA, 23 bp, Artificial Sequence
  Synthetic Construct
cccagacccaccttacaggttct

SEQ ID NO: 18835 - DNA, 25 bp, Artificial Sequence
  Synthetic Construct
tcttgaatcagacaaagagcaccat

SEQ ID NO: 18836 - DNA, 22 bp, Artificial Sequence
  Synthetic Construct
catggactcaagactccacaca

SEQ ID NO: 18837 - DNA, 21 bp, Artificial Sequence
  Synthetic Construct
ggtcagagcaggcattgttgt

SEQ ID NO: 18838 - DNA, 23 bp, Artificial Sequence
  Synthetic Construct
tgggtttgaggcacagttagatg

SEQ ID NO: 18839 - DNA, 21 bp, Artificial Sequence
  Synthetic Construct
tgtggaccagagcctcatgta

SEQ ID NO: 18840 - DNA, 22 bp, Artificial Sequence
  Synthetic Construct
ggggtgccatttcagctaccat

SEQ ID NO: 18841 - DNA, 26 bp, Artificial Sequence
  Synthetic Construct
tctcagctcttaggcagaaatcttac

SEQ ID NO: 18842 - DNA, 22 bp, Artificial Sequence
  Synthetic Construct
tctgcccttacctccttcttct

SEQ ID NO: 18843 - DNA, 23 bp, Artificial Sequence
  Synthetic Construct
accgagttagagccttgactttc

SEQ ID NO: 18844 - DNA, 26 bp, Artificial Sequence
  Synthetic Construct
gtcccaggttaatgagtctagaggaa

SEQ ID NO: 18845 - DNA, 22 bp, Artificial Sequence
  Synthetic Construct
cccctgatgatccacacccatt

SEQ ID NO: 18846 - DNA, 26 bp, Artificial Sequence
  Synthetic Construct
ccattgaatgtagaacatgcctctct

SEQ ID NO: 18847 - DNA, 25 bp, Artificial Sequence
  Synthetic Construct
gccagcacttctggatgttacattg

SEQ ID NO: 18848 - DNA, 22 bp, Artificial Sequence
  Synthetic Construct
aggtttcaggccatccctctct

SEQ ID NO: 18849 - DNA, 26 bp, Artificial Sequence
  Synthetic Construct
gagactttcgcaaggttttcagcaat

SEQ ID NO: 18850 - DNA, 27 bp, Artificial Sequence
  Synthetic Construct
ggaagggctgtttacagaacaagtaca

SEQ ID NO: 18851 - DNA, 28 bp, Artificial Sequence
  Synthetic Construct
ggtgccatagaattactccaagggtctt

SEQ ID NO: 18852 - DNA, 23 bp, Artificial Sequence
  Synthetic Construct
gcaagagtccatgataggcatgt

SEQ ID NO: 18853 - DNA, 28 bp, Artificial Sequence
  Synthetic Construct
gcctacactatttcatcccatggtaaac

SEQ ID NO: 18854 - DNA, 25 bp, Artificial Sequence
  Synthetic Construct
actttgtgatgtgttcctacctctt

SEQ ID NO: 18855 - DNA, 27 bp, Artificial Sequence
  Synthetic Construct
gacagaaacctgtttgaactcatggta

SEQ ID NO: 18856 - DNA, 24 bp, Artificial Sequence
  Synthetic Construct
gctctagagtatgacggggacaca

SEQ ID NO: 18857 - DNA, 25 bp, Artificial Sequence
  Synthetic Construct
gagtgctcaaaagctattcccagtt

SEQ ID NO: 18858 - DNA, 22 bp, Artificial Sequence
  Synthetic Construct
ccttggcctgaatcctcctaca

SEQ ID NO: 18859 - DNA, 20 bp, Artificial Sequence
  Synthetic Construct
gcagcagcctgtgctttcat

SEQ ID NO: 18860 - DNA, 24 bp, Artificial Sequence
  Synthetic Construct
atgtgaggtcacacttcctttgat

SEQ ID NO: 18861 - DNA, 26 bp, Artificial Sequence
  Synthetic Construct
gcctgctttaagactttttgcagttc

SEQ ID NO: 18862 - DNA, 23 bp, Artificial Sequence
  Synthetic Construct
aggtgcaaaggtagaggaacaac

SEQ ID NO: 18863 - DNA, 22 bp, Artificial Sequence
  Synthetic Construct
ccaggactctctcggttgagtt

SEQ ID NO: 18864 - DNA, 24 bp, Artificial Sequence
  Synthetic Construct
cttgtcttctcaggttgcttgttt

SEQ ID NO: 18865 - DNA, 25 bp, Artificial Sequence
  Synthetic Construct
gtgactgtagcattcccagttctct

SEQ ID NO: 18866 - DNA, 27 bp, Artificial Sequence
  Synthetic Construct
ccctgatcaaatcatacctgaagtcaa

SEQ ID NO: 18867 - DNA, 23 bp, Artificial Sequence
  Synthetic Construct
gggactttgggaacacacagcat

SEQ ID NO: 18868 - DNA, 25 bp, Artificial Sequence
  Synthetic Construct
ccaacactaaaagcaaccgtttgaa

SEQ ID NO: 18869 - DNA, 26 bp, Artificial Sequence
  Synthetic Construct
ggggctgtattgcaaaagatgctact

SEQ ID NO: 18870 - DNA, 28 bp, Artificial Sequence
  Synthetic Construct
ggatgggaaagaaattggtctggaaaga

SEQ ID NO: 18871 - DNA, 24 bp, Artificial Sequence
  Synthetic Construct
ctccaaaggaaccttcccagtaaa

SEQ ID NO: 18872 - DNA, 22 bp, Artificial Sequence
  Synthetic Construct
ccttcagccttgtcacgcttct

SEQ ID NO: 18873 - DNA, 23 bp, Artificial Sequence
  Synthetic Construct
acactatgtgcttttgccacaga

SEQ ID NO: 18874 - DNA, 20 bp, Artificial Sequence
  Synthetic Construct
tggactgtgcaggtgtctga

SEQ ID NO: 18875 - DNA, 22 bp, Artificial Sequence
  Synthetic Construct
agtccccattattgtgctcgtt

SEQ ID NO: 18876 - DNA, 24 bp, Artificial Sequence
  Synthetic Construct
cagggtctccactctgtaactttt

SEQ ID NO: 18877 - DNA, 25 bp, Artificial Sequence
  Synthetic Construct
gtgggctagaattttggctctgaca

SEQ ID NO: 18878 - DNA, 24 bp, Artificial Sequence
  Synthetic Construct
acagtagtgtgaaaccagggaaat

SEQ ID NO: 18879 - DNA, 25 bp, Artificial Sequence
  Synthetic Construct
cctccgattgctttttgtgttccta

SEQ ID NO: 18880 - DNA, 25 bp, Artificial Sequence
  Synthetic Construct
ctggcttcagaactttctcctctat

SEQ ID NO: 18881 - DNA, 26 bp, Artificial Sequence
  Synthetic Construct
caggcagggagcttattcagatctac

SEQ ID NO: 18882 - DNA, 26 bp, Artificial Sequence
  Synthetic Construct
ccctcaataaactgggagacccattg

SEQ ID NO: 18883 - DNA, 24 bp, Artificial Sequence
  Synthetic Construct
gaaggctgaggagctctgatttta

SEQ ID NO: 18884 - DNA, 24 bp, Artificial Sequence
  Synthetic Construct
gtaggtgcaaacaaactgggtttt

SEQ ID NO: 18885 - DNA, 20 bp, Artificial Sequence
  Synthetic Construct
tcactcccaagctccgttct

SEQ ID NO: 18886 - DNA, 22 bp, Artificial Sequence
  Synthetic Construct
gcctgggtccaaaggtagaaga

SEQ ID NO: 18887 - DNA, 27 bp, Artificial Sequence
  Synthetic Construct
ctgaggtgaatttgtaaagggtcattg

SEQ ID NO: 18888 - DNA, 28 bp, Artificial Sequence
  Synthetic Construct
ggggctataaaagtgattacagctccta

SEQ ID NO: 18889 - DNA, 22 bp, Artificial Sequence
  Synthetic Construct
cccagcagatgggatggaaact

SEQ ID NO: 18890 - DNA, 24 bp, Artificial Sequence
  Synthetic Construct
caatagcatggtggagtgcacata

SEQ ID NO: 18891 - DNA, 22 bp, Artificial Sequence
  Synthetic Construct
gcatatcctgccaactgtgtca

SEQ ID NO: 18892 - DNA, 24 bp, Artificial Sequence
  Synthetic Construct
tgccaacaaggtgaaatagcagat

SEQ ID NO: 18893 - DNA, 25 bp, Artificial Sequence
  Synthetic Construct
gcagaagggagagttttgagagact

SEQ ID NO: 18894 - DNA, 22 bp, Artificial Sequence
  Synthetic Construct
ggctaagctgttgccaggttct

SEQ ID NO: 18895 - DNA, 20 bp, Artificial Sequence
  Synthetic Construct
acctgcatttccgtggtgaa

SEQ ID NO: 18896 - DNA, 25 bp, Artificial Sequence
  Synthetic Construct
caagaaagaggagccggaatgattt

SEQ ID NO: 18897 - DNA, 26 bp, Artificial Sequence
  Synthetic Construct
gcatggaatctcaatatggcttggaa

SEQ ID NO: 18898 - DNA, 20 bp, Artificial Sequence
  Synthetic Construct
gcggggctgtaccacctaga

SEQ ID NO: 18899 - DNA, 22 bp, Artificial Sequence
  Synthetic Construct
agccccagagatgttaggatgt

SEQ ID NO: 18900 - DNA, 23 bp, Artificial Sequence
  Synthetic Construct
ggtaaacaggaggcagaaactgt

SEQ ID NO: 18901 - DNA, 22 bp, Artificial Sequence
  Synthetic Construct
gcaggccagagtaagagcttca

SEQ ID NO: 18902 - DNA, 22 bp, Artificial Sequence
  Synthetic Construct
ccctctgtggaatgagggtaga

SEQ ID NO: 18903 - DNA, 27 bp, Artificial Sequence
  Synthetic Construct
gacagtgacctgctccattttattaag

SEQ ID NO: 18904 - DNA, 24 bp, Artificial Sequence
  Synthetic Construct
cccaccaatgagtcacaagcatca

SEQ ID NO: 18905 - DNA, 26 bp, Artificial Sequence
  Synthetic Construct
ccctaacatgccagtttctaccatct

SEQ ID NO: 18906 - DNA, 21 bp, Artificial Sequence
  Synthetic Construct
acccagatgttcccagacaga

SEQ ID NO: 18907 - DNA, 22 bp, Artificial Sequence
  Synthetic Construct
ctgcccaggttttgcaggaaga

SEQ ID NO: 18908 - DNA, 24 bp, Artificial Sequence
  Synthetic Construct
gctggattttgggagagacaggtt

SEQ ID NO: 18909 - DNA, 22 bp, Artificial Sequence
  Synthetic Construct
tgtcccagagaacccgatctga

SEQ ID NO: 18910 - DNA, 24 bp, Artificial Sequence
  Synthetic Construct
gctccatccctttctagggcaaca

SEQ ID NO: 18911 - DNA, 22 bp, Artificial Sequence
  Synthetic Construct
ggactggacacaggagcatctt

SEQ ID NO: 18912 - DNA, 22 bp, Artificial Sequence
  Synthetic Construct
gggttctttcccttggctgatt

SEQ ID NO: 18913 - DNA, 24 bp, Artificial Sequence
  Synthetic Construct
cctctgaggcaataccgtggaatc

SEQ ID NO: 18914 - DNA, 26 bp, Artificial Sequence
  Synthetic Construct
gctgctacatgtctcagatgagttta

SEQ ID NO: 18915 - DNA, 25 bp, Artificial Sequence
  Synthetic Construct
ggactacagccaccaagtgatgatg

SEQ ID NO: 18916 - DNA, 23 bp, Artificial Sequence
  Synthetic Construct
caggctggtagctgtctttggta

SEQ ID NO: 18917 - DNA, 24 bp, Artificial Sequence
  Synthetic Construct
gcactgtcttactgcaaggaaaat

SEQ ID NO: 18918 - DNA, 23 bp, Artificial Sequence
  Synthetic Construct
gtgcttcagctgtttccgtctca

SEQ ID NO: 18919 - DNA, 25 bp, Artificial Sequence
  Synthetic Construct
gggtacggtaaatgatgatgtgctt

SEQ ID NO: 18920 - DNA, 25 bp, Artificial Sequence
  Synthetic Construct
agagcatccctaatcatggtacaga

SEQ ID NO: 18921 - DNA, 24 bp, Artificial Sequence
  Synthetic Construct
gtgcaagccagacatgatgaaaca

SEQ ID NO: 18922 - DNA, 22 bp, Artificial Sequence
  Synthetic Construct
cgaccgtccacatgttcctttc

SEQ ID NO: 18923 - DNA, 22 bp, Artificial Sequence
  Synthetic Construct
acctccagcctttagcacttac

SEQ ID NO: 18924 - DNA, 24 bp, Artificial Sequence
  Synthetic Construct
gtggaaacttcagtgggagagtat

SEQ ID NO: 18925 - DNA, 22 bp, Artificial Sequence
  Synthetic Construct
tggaaccctgagccacctgtat

SEQ ID NO: 18926 - DNA, 23 bp, Artificial Sequence
  Synthetic Construct
gctgctggaagagctacaacctt

SEQ ID NO: 18927 - DNA, 22 bp, Artificial Sequence
  Synthetic Construct
gtcccatcacaccacaaaggtt

SEQ ID NO: 18928 - DNA, 24 bp, Artificial Sequence
  Synthetic Construct
ggggcatcatccagtttttctgta

SEQ ID NO: 18929 - DNA, 23 bp, Artificial Sequence
  Synthetic Construct
gtttggactgtcttcccctgttg

SEQ ID NO: 18930 - DNA, 22 bp, Artificial Sequence
  Synthetic Construct
gggaaagaggtgcttcttctga

SEQ ID NO: 18931 - DNA, 23 bp, Artificial Sequence
  Synthetic Construct
gacccaccaaaaactagcactgt

SEQ ID NO: 18932 - DNA, 23 bp, Artificial Sequence
  Synthetic Construct
gctgagattttgcccagtacgtt

SEQ ID NO: 18933 - DNA, 23 bp, Artificial Sequence
  Synthetic Construct
cctgtgacacttctcctgaaaca

SEQ ID NO: 18934 - DNA, 23 bp, Artificial Sequence
  Synthetic Construct
gtcattgctgagagactctgtgt

SEQ ID NO: 18935 - DNA, 25 bp, Artificial Sequence
  Synthetic Construct
ctggaaggtgtgcaaaatagtctct

SEQ ID NO: 18936 - DNA, 23 bp, Artificial Sequence
  Synthetic Construct
ggtcctcacttcacatgggtgtt

SEQ ID NO: 18937 - DNA, 24 bp, Artificial Sequence
  Synthetic Construct
gggatggtgagtggtggaagttac

SEQ ID NO: 18938 - DNA, 25 bp, Artificial Sequence
  Synthetic Construct
atcgcccagaaggtgataaataagt

SEQ ID NO: 18939 - DNA, 26 bp, Artificial Sequence
  Synthetic Construct
ccttggaaaacactttgtggcaatac

SEQ ID NO: 18940 - DNA, 25 bp, Artificial Sequence
  Synthetic Construct
gctgtcctttataacagcgtggaaa

SEQ ID NO: 18941 - DNA, 22 bp, Artificial Sequence
  Synthetic Construct
gcctgtttcaggagttgcattc

SEQ ID NO: 18942 - DNA, 22 bp, Artificial Sequence
  Synthetic Construct
gctccgcagtgatgtggaagat

SEQ ID NO: 18943 - DNA, 27 bp, Artificial Sequence
  Synthetic Construct
ccagaccctgttgcagcaatatgttta

SEQ ID NO: 18944 - DNA, 25 bp, Artificial Sequence
  Synthetic Construct
gcctggaagaagcctgaattgtttc

SEQ ID NO: 18945 - DNA, 23 bp, Artificial Sequence
  Synthetic Construct
tgtgggcagaatgtgagaagatg

SEQ ID NO: 18946 - DNA, 23 bp, Artificial Sequence
  Synthetic Construct
ggcagatacacacactgcagaca

SEQ ID NO: 18947 - DNA, 26 bp, Artificial Sequence
  Synthetic Construct
cacaggtgcaaaccattaatcacaga

SEQ ID NO: 18948 - DNA, 26 bp, Artificial Sequence
  Synthetic Construct
ctgaactcctcacagtctcagataca

SEQ ID NO: 18949 - DNA, 23 bp, Artificial Sequence
  Synthetic Construct
ccttgcatgcatactcacctcta

SEQ ID NO: 18950 - DNA, 27 bp, Artificial Sequence
  Synthetic Construct
gtgatcctcccaagtggctattactac

SEQ ID NO: 18951 - DNA, 27 bp, Artificial Sequence
  Synthetic Construct
gagaaaccttttgctaggcataagtag

SEQ ID NO: 18952 - DNA, 22 bp, Artificial Sequence
  Synthetic Construct
gcttcctccgactatcggaatc

SEQ ID NO: 18953 - DNA, 26 bp, Artificial Sequence
  Synthetic Construct
caccagggttccataaacactgagat

SEQ ID NO: 18954 - DNA, 25 bp, Artificial Sequence
  Synthetic Construct
ccacctgaggaatgagtagctggaa

SEQ ID NO: 18955 - DNA, 24 bp, Artificial Sequence
  Synthetic Construct
gctctgctatccttgggttctttt

SEQ ID NO: 18956 - DNA, 26 bp, Artificial Sequence
  Synthetic Construct
gtgagtttcctgtgacctaaccatgt

SEQ ID NO: 18957 - DNA, 23 bp, Artificial Sequence
  Synthetic Construct
gccacatgcacactgagcttttc

SEQ ID NO: 18958 - DNA, 22 bp, Artificial Sequence
  Synthetic Construct
cttgccttggttaggcttgctt

SEQ ID NO: 18959 - DNA, 24 bp, Artificial Sequence
  Synthetic Construct
gtcccaagagggtatgtggctaga

SEQ ID NO: 18960 - DNA, 23 bp, Artificial Sequence
  Synthetic Construct
cccggtcttattgactggacttc

SEQ ID NO: 18961 - DNA, 25 bp, Artificial Sequence
  Synthetic Construct
tcaacctagttgggtagtgttttca

SEQ ID NO: 18962 - DNA, 22 bp, Artificial Sequence
  Synthetic Construct
gggtggtctcttcaaactgcaa

SEQ ID NO: 18963 - DNA, 21 bp, Artificial Sequence
  Synthetic Construct
cgagggccaaatgggcagaat

SEQ ID NO: 18964 - DNA, 20 bp, Artificial Sequence
  Synthetic Construct
ttgcctcagaggagcacaca

SEQ ID NO: 18965 - DNA, 24 bp, Artificial Sequence
  Synthetic Construct
gctccatccaaaaggcatggaaga

SEQ ID NO: 18966 - DNA, 23 bp, Artificial Sequence
  Synthetic Construct
gctgctgcataagctgcaaggta

SEQ ID NO: 18967 - DNA, 22 bp, Artificial Sequence
  Synthetic Construct
agcctcccttcatctcctctgt

SEQ ID NO: 18968 - DNA, 24 bp, Artificial Sequence
  Synthetic Construct
gccacaccatcttaactggcatca

SEQ ID NO: 18969 - DNA, 22 bp, Artificial Sequence
  Synthetic Construct
gctcaaagagcttccagagagt

SEQ ID NO: 18970 - DNA, 24 bp, Artificial Sequence
  Synthetic Construct
gcggtccacaaaatgaatggcttt

SEQ ID NO: 18971 - DNA, 22 bp, Artificial Sequence
  Synthetic Construct
cacagaggcctccaatgctgta

SEQ ID NO: 18972 - DNA, 27 bp, Artificial Sequence
  Synthetic Construct
ggtaggaactttggagtcacccttttc

SEQ ID NO: 18973 - DNA, 24 bp, Artificial Sequence
  Synthetic Construct
gaacaagtgtggaagagtgtggta

SEQ ID NO: 18974 - DNA, 24 bp, Artificial Sequence
  Synthetic Construct
gaggacaacacagtgaaccagaga

SEQ ID NO: 18975 - DNA, 24 bp, Artificial Sequence
  Synthetic Construct
cctctgagtacctgtgggagtgaa

SEQ ID NO: 18976 - DNA, 25 bp, Artificial Sequence
  Synthetic Construct
ccagaccttgtggtaggtacagttg

SEQ ID NO: 18977 - DNA, 23 bp, Artificial Sequence
  Synthetic Construct
gtcggctatggcagtatgctaac

SEQ ID NO: 18978 - DNA, 27 bp, Artificial Sequence
  Synthetic Construct
gatgctaaggttgttcggctagaattt

SEQ ID NO: 18979 - DNA, 26 bp, Artificial Sequence
  Synthetic Construct
ggattccgtctatcatccagtgaata

SEQ ID NO: 18980 - DNA, 22 bp, Artificial Sequence
  Synthetic Construct
aggctggggtaacccttggaat

SEQ ID NO: 18981 - DNA, 26 bp, Artificial Sequence
  Synthetic Construct
agaccccatatttctccctattgaac

SEQ ID NO: 18982 - DNA, 22 bp, Artificial Sequence
  Synthetic Construct
ggtcaggaccaagagtggacat

SEQ ID NO: 18983 - DNA, 24 bp, Artificial Sequence
  Synthetic Construct
tgcaagtgtccatacagtcttgat

SEQ ID NO: 18984 - DNA, 25 bp, Artificial Sequence
  Synthetic Construct
agtgttaactcacaagggctcatac

SEQ ID NO: 18985 - DNA, 22 bp, Artificial Sequence
  Synthetic Construct
gtctcatgcagagttggtgact

SEQ ID NO: 18986 - DNA, 22 bp, Artificial Sequence
  Synthetic Construct
ggggcaagtggaatggaagtca

SEQ ID NO: 18987 - DNA, 27 bp, Artificial Sequence
  Synthetic Construct
ggtgcagattagcagaacattctaaag

SEQ ID NO: 18988 - DNA, 21 bp, Artificial Sequence
  Synthetic Construct
gaaactgaagcccgctactca

SEQ ID NO: 18989 - DNA, 25 bp, Artificial Sequence
  Synthetic Construct
gagcctcatgtctttgaagcctttc

SEQ ID NO: 18990 - DNA, 27 bp, Artificial Sequence
  Synthetic Construct
gacaggttttgttctggacaataggaa

SEQ ID NO: 18991 - DNA, 25 bp, Artificial Sequence
  Synthetic Construct
ccactcccaacacacttttcttcat

SEQ ID NO: 18992 - DNA, 26 bp, Artificial Sequence
  Synthetic Construct
gacctaagctcttcctgactttgact

SEQ ID NO: 18993 - DNA, 26 bp, Artificial Sequence
  Synthetic Construct
cgcatccataaagagggatccagagt

SEQ ID NO: 18994 - DNA, 25 bp, Artificial Sequence
  Synthetic Construct
tgttggttggtagagcttattgcta

SEQ ID NO: 18995 - DNA, 23 bp, Artificial Sequence
  Synthetic Construct
tcagggcctcaaaattccctaga

SEQ ID NO: 18996 - DNA, 26 bp, Artificial Sequence
  Synthetic Construct
ctcttagctatatcccctcccctctt

SEQ ID NO: 18997 - DNA, 25 bp, Artificial Sequence
  Synthetic Construct
gacagacaaaactcctgcgagatac

SEQ ID NO: 18998 - DNA, 21 bp, Artificial Sequence
  Synthetic Construct
gaggctcctcatgtgcttgaa

SEQ ID NO: 18999 - DNA, 25 bp, Artificial Sequence
  Synthetic Construct
gcaataagccaggtaggattgttca

SEQ ID NO: 19000 - DNA, 24 bp, Artificial Sequence
  Synthetic Construct
ccatttctggtaggtcctgagcaa

SEQ ID NO: 19001 - DNA, 24 bp, Artificial Sequence
  Synthetic Construct
gggcagcaacttacactcttaatc

SEQ ID NO: 19002 - DNA, 21 bp, Artificial Sequence
  Synthetic Construct
ggtgtgacaagcacaccttca

SEQ ID NO: 19003 - DNA, 23 bp, Artificial Sequence
  Synthetic Construct
ggaggaaacctttggtagggaaa

SEQ ID NO: 19004 - DNA, 26 bp, Artificial Sequence
  Synthetic Construct
gtcaccttttgtccacttgattgatg

SEQ ID NO: 19005 - DNA, 24 bp, Artificial Sequence
  Synthetic Construct
ccacctctgtaaacatgcaaggaa

SEQ ID NO: 19006 - DNA, 24 bp, Artificial Sequence
  Synthetic Construct
ctcagtcacatgtagttgctgttg

SEQ ID NO: 19007 - DNA, 22 bp, Artificial Sequence
  Synthetic Construct
tgtctctgcctgacccacaatc

SEQ ID NO: 19008 - DNA, 22 bp, Artificial Sequence
  Synthetic Construct
ggcacttggcaacattccactt

SEQ ID NO: 19009 - DNA, 22 bp, Artificial Sequence
  Synthetic Construct
tcaagacatctgtgcccgatac

SEQ ID NO: 19010 - DNA, 23 bp, Artificial Sequence
  Synthetic Construct
gtgaggaagactactgccagaaa

SEQ ID NO: 19011 - DNA, 25 bp, Artificial Sequence
  Synthetic Construct
ctgggagtcttcagacctgtctttg

SEQ ID NO: 19012 - DNA, 22 bp, Artificial Sequence
  Synthetic Construct
cactgtgcctttgctgtgaaac

SEQ ID NO: 19013 - DNA, 25 bp, Artificial Sequence
  Synthetic Construct
ggctagtaggttttgctggttcaga

SEQ ID NO: 19014 - DNA, 23 bp, Artificial Sequence
  Synthetic Construct
ggagtaggactccagctcaggta

SEQ ID NO: 19015 - DNA, 23 bp, Artificial Sequence
  Synthetic Construct
gtggaggctaaaacctggctgtt

SEQ ID NO: 19016 - DNA, 22 bp, Artificial Sequence
  Synthetic Construct
ctcaggtccacagtggcattct

SEQ ID NO: 19017 - DNA, 22 bp, Artificial Sequence
  Synthetic Construct
cggttcttcccagagcccatag

SEQ ID NO: 19018 - DNA, 22 bp, Artificial Sequence
  Synthetic Construct
tgtctcgcttctctctggatgt

SEQ ID NO: 19019 - DNA, 26 bp, Artificial Sequence
  Synthetic Construct
gtgagaacaggtgtctaggagagcta

SEQ ID NO: 19020 - DNA, 21 bp, Artificial Sequence
  Synthetic Construct
gctcactttgcccacggtttg

SEQ ID NO: 19021 - DNA, 25 bp, Artificial Sequence
  Synthetic Construct
gctgggattgaacctagctctgagt

SEQ ID NO: 19022 - DNA, 24 bp, Artificial Sequence
  Synthetic Construct
ggcagcctttcttctccttgactt

SEQ ID NO: 19023 - DNA, 25 bp, Artificial Sequence
  Synthetic Construct
ccttcacttccaagggtatgctaag

SEQ ID NO: 19024 - DNA, 25 bp, Artificial Sequence
  Synthetic Construct
gatggggtttttatggttgggcttt

SEQ ID NO: 19025 - DNA, 24 bp, Artificial Sequence
  Synthetic Construct
acatacagccttgcacatttctga

SEQ ID NO: 19026 - DNA, 20 bp, Artificial Sequence
  Synthetic Construct
ggggagaacagatgccaaca

SEQ ID NO: 19027 - DNA, 27 bp, Artificial Sequence
  Synthetic Construct
cctggtcaaggatcttatcccagaagt

SEQ ID NO: 19028 - DNA, 24 bp, Artificial Sequence
  Synthetic Construct
gggcctgaagatacaggcttcctt

SEQ ID NO: 19029 - DNA, 26 bp, Artificial Sequence
  Synthetic Construct
cgagctgatctgagtacaatcacaga

SEQ ID NO: 19030 - DNA, 22 bp, Artificial Sequence
  Synthetic Construct
ggccagattggacaaggactgt

SEQ ID NO: 19031 - DNA, 22 bp, Artificial Sequence
  Synthetic Construct
gcttgcctctatcctcctcttc

SEQ ID NO: 19032 - DNA, 21 bp, Artificial Sequence
  Synthetic Construct
gccatgaaagccagcatctgt

SEQ ID NO: 19033 - DNA, 23 bp, Artificial Sequence
  Synthetic Construct
agtgtgcttcccacatcaaagat

SEQ ID NO: 19034 - DNA, 25 bp, Artificial Sequence
  Synthetic Construct
ggacagacactgattaagggcaact

SEQ ID NO: 19035 - DNA, 24 bp, Artificial Sequence
  Synthetic Construct
cgcaaacattcacagcttaacaca

SEQ ID NO: 19036 - DNA, 27 bp, Artificial Sequence
  Synthetic Construct
caggtatcactagattgttctcccaat

SEQ ID NO: 19037 - DNA, 22 bp, Artificial Sequence
  Synthetic Construct
acttggccagctctctcacttc

SEQ ID NO: 19038 - DNA, 23 bp, Artificial Sequence
  Synthetic Construct
gctgtcccaaatgattcctgctt

SEQ ID NO: 19039 - DNA, 22 bp, Artificial Sequence
  Synthetic Construct
ggatcagcggagttttggtcat

SEQ ID NO: 19040 - DNA, 27 bp, Artificial Sequence
  Synthetic Construct
ggtttcttggtttcaagggaaggaatg

SEQ ID NO: 19041 - DNA, 23 bp, Artificial Sequence
  Synthetic Construct
cggcttgtgaaaaacacaaggaa

SEQ ID NO: 19042 - DNA, 21 bp, Artificial Sequence
  Synthetic Construct
ggatgtgctgcatcccaaaca

SEQ ID NO: 19043 - DNA, 25 bp, Artificial Sequence
  Synthetic Construct
ggcatgtacaaaacaagcccttgaa

SEQ ID NO: 19044 - DNA, 26 bp, Artificial Sequence
  Synthetic Construct
cccaagagtttcaggtaagagtttgt

SEQ ID NO: 19045 - DNA, 26 bp, Artificial Sequence
  Synthetic Construct
gccagttctgaaaacttccactaaca

SEQ ID NO: 19046 - DNA, 23 bp, Artificial Sequence
  Synthetic Construct
gcgtggtaagtacgatgggaagt

SEQ ID NO: 19047 - DNA, 26 bp, Artificial Sequence
  Synthetic Construct
cagcttcattcagtacattccctttg

SEQ ID NO: 19048 - DNA, 27 bp, Artificial Sequence
  Synthetic Construct
caaactgcaggggaaattatgatctga

SEQ ID NO: 19049 - DNA, 20 bp, Artificial Sequence
  Synthetic Construct
tgactcctgcctgggtcaaa

SEQ ID NO: 19050 - DNA, 24 bp, Artificial Sequence
  Synthetic Construct
aacagtggagagtgtgctaaagtt

SEQ ID NO: 19051 - DNA, 20 bp, Artificial Sequence
  Synthetic Construct
tccctggagttgtcctccaa

SEQ ID NO: 19052 - DNA, 20 bp, Artificial Sequence
  Synthetic Construct
agccagacttgggcagaaga

SEQ ID NO: 19053 - DNA, 23 bp, Artificial Sequence
  Synthetic Construct
ggcggaatcagcatctaggatag

SEQ ID NO: 19054 - DNA, 30 bp, Artificial Sequence
  Synthetic Construct
gcaggaagttaaaacaaactgagcactaca

SEQ ID NO: 19055 - DNA, 26 bp, Artificial Sequence
  Synthetic Construct
cacacccaaattatccattcgctgat

SEQ ID NO: 19056 - DNA, 28 bp, Artificial Sequence
  Synthetic Construct
gtcctcacacctactgttccttaagttg

SEQ ID NO: 19057 - DNA, 23 bp, Artificial Sequence
  Synthetic Construct
aagatgttttccctggccttctt

SEQ ID NO: 19058 - DNA, 23 bp, Artificial Sequence
  Synthetic Construct
gagaggttccttctcggtcttac

SEQ ID NO: 19059 - DNA, 26 bp, Artificial Sequence
  Synthetic Construct
gcaatggaatcccaaggaaacatagt

SEQ ID NO: 19060 - DNA, 24 bp, Artificial Sequence
  Synthetic Construct
tgatcgtggaaatggatctcaagt

SEQ ID NO: 19061 - DNA, 26 bp, Artificial Sequence
  Synthetic Construct
gagtcagccaataaagagagacttgt

SEQ ID NO: 19062 - DNA, 21 bp, Artificial Sequence
  Synthetic Construct
gccacgttcttcccattgtca

SEQ ID NO: 19063 - DNA, 23 bp, Artificial Sequence
  Synthetic Construct
tgccacctaaatgaagacccttt

SEQ ID NO: 19064 - DNA, 22 bp, Artificial Sequence
  Synthetic Construct
caccctttggtcctcctgtatc

SEQ ID NO: 19065 - DNA, 24 bp, Artificial Sequence
  Synthetic Construct
cccagtatgtcccaggcaatctgt

SEQ ID NO: 19066 - DNA, 23 bp, Artificial Sequence
  Synthetic Construct
gtccttgctcatgactcagaact

SEQ ID NO: 19067 - DNA, 22 bp, Artificial Sequence
  Synthetic Construct
gctggtgactgcacatttttca

SEQ ID NO: 19068 - DNA, 21 bp, Artificial Sequence
  Synthetic Construct
gctgagtatctgcgtgtctgt

SEQ ID NO: 19069 - DNA, 23 bp, Artificial Sequence
  Synthetic Construct
gcttggccttactgtacttctct

SEQ ID NO: 19070 - DNA, 24 bp, Artificial Sequence
  Synthetic Construct
ggagcaagtgggtatgttgagaag

SEQ ID NO: 19071 - DNA, 25 bp, Artificial Sequence
  Synthetic Construct
ggaggaccggtttacattcctgatg

SEQ ID NO: 19072 - DNA, 24 bp, Artificial Sequence
  Synthetic Construct
gcattagcctcttagtggttcctt

SEQ ID NO: 19073 - DNA, 24 bp, Artificial Sequence
  Synthetic Construct
acaacacttacctcccatgcattt

SEQ ID NO: 19074 - DNA, 22 bp, Artificial Sequence
  Synthetic Construct
cactgtgactggcctgttcgtt

SEQ ID NO: 19075 - DNA, 21 bp, Artificial Sequence
  Synthetic Construct
agccgtttgggaaaagtggaa

SEQ ID NO: 19076 - DNA, 26 bp, Artificial Sequence
  Synthetic Construct
gtccctaaggtaaggatggaaaatct

SEQ ID NO: 19077 - DNA, 23 bp, Artificial Sequence
  Synthetic Construct
gctttcgaaggggtgttcttttc

SEQ ID NO: 19078 - DNA, 25 bp, Artificial Sequence
  Synthetic Construct
cagcttgttggagaagcatctttac

SEQ ID NO: 19079 - DNA, 24 bp, Artificial Sequence
  Synthetic Construct
ctgtttgacaccgaaacactgcat

SEQ ID NO: 19080 - DNA, 21 bp, Artificial Sequence
  Synthetic Construct
gtgcctctgttgtccagagtt

SEQ ID NO: 19081 - DNA, 25 bp, Artificial Sequence
  Synthetic Construct
gggcaaaagaagtgcaaatgcaaca

SEQ ID NO: 19082 - DNA, 21 bp, Artificial Sequence
  Synthetic Construct
tgcagcagagactgtccacta

SEQ ID NO: 19083 - DNA, 22 bp, Artificial Sequence
  Synthetic Construct
tggacatcacatctgcatggaa

SEQ ID NO: 19084 - DNA, 23 bp, Artificial Sequence
  Synthetic Construct
gctatccctggacttctcggtta

SEQ ID NO: 19085 - DNA, 23 bp, Artificial Sequence
  Synthetic Construct
ggcagccttaattcccaccacaa

SEQ ID NO: 19086 - DNA, 23 bp, Artificial Sequence
  Synthetic Construct
cgtaagaggttgacaggtgctat

SEQ ID NO: 19087 - DNA, 20 bp, Artificial Sequence
  Synthetic Construct
tggctcctaccacaccttgt

SEQ ID NO: 19088 - DNA, 24 bp, Artificial Sequence
  Synthetic Construct
cacacagatgctactggagtgaac

SEQ ID NO: 19089 - DNA, 21 bp, Artificial Sequence
  Synthetic Construct
aggtcggtcttcccagctaga

SEQ ID NO: 19090 - DNA, 22 bp, Artificial Sequence
  Synthetic Construct
cgggagagttccttcctgttca

SEQ ID NO: 19091 - DNA, 22 bp, Artificial Sequence
  Synthetic Construct
gagggaacaccatgtcctcaca

SEQ ID NO: 19092 - DNA, 23 bp, Artificial Sequence
  Synthetic Construct
ccacagtgaggtcaaatggatca

SEQ ID NO: 19093 - DNA, 26 bp, Artificial Sequence
  Synthetic Construct
catgaacgagactccaaggtaattct

SEQ ID NO: 19094 - DNA, 26 bp, Artificial Sequence
  Synthetic Construct
ctgtaagtaagcttgactccctgtat

SEQ ID NO: 19095 - DNA, 24 bp, Artificial Sequence
  Synthetic Construct
ctggaaagatagagctgccacgat

SEQ ID NO: 19096 - DNA, 24 bp, Artificial Sequence
  Synthetic Construct
gtggtttaccaactgcactaccaa

SEQ ID NO: 19097 - DNA, 20 bp, Artificial Sequence
  Synthetic Construct
tgaggccctgcacttactga

SEQ ID NO: 19098 - DNA, 22 bp, Artificial Sequence
  Synthetic Construct
cagcttcctggttactgtgtga

SEQ ID NO: 19099 - DNA, 20 bp, Artificial Sequence
  Synthetic Construct
gtgtgcccaagaccctcttc

SEQ ID NO: 19100 - DNA, 23 bp, Artificial Sequence
  Synthetic Construct
ggcagcatggtctcaggaggata

SEQ ID NO: 19101 - DNA, 27 bp, Artificial Sequence
  Synthetic Construct
ccccaaatggtagtgaactctgcaata

SEQ ID NO: 19102 - DNA, 23 bp, Artificial Sequence
  Synthetic Construct
tctgctccagctgtctagacttt

SEQ ID NO: 19103 - DNA, 26 bp, Artificial Sequence
  Synthetic Construct
ctgtacagcatcacagctacctaaac

SEQ ID NO: 19104 - DNA, 25 bp, Artificial Sequence
  Synthetic Construct
gatgtgtctccagtattgtgtctgt

SEQ ID NO: 19105 - DNA, 22 bp, Artificial Sequence
  Synthetic Construct
ggaggagagaggcagaactgta

SEQ ID NO: 19106 - DNA, 20 bp, Artificial Sequence
  Synthetic Construct
gcggttagcgctagacaaca

SEQ ID NO: 19107 - DNA, 22 bp, Artificial Sequence
  Synthetic Construct
cccagaggttctgcatgttttg

SEQ ID NO: 19108 - DNA, 24 bp, Artificial Sequence
  Synthetic Construct
ccccagacaggtagtcctgagatt

SEQ ID NO: 19109 - DNA, 27 bp, Artificial Sequence
  Synthetic Construct
gctggaaagataatcgttgaggccaaa

SEQ ID NO: 19110 - DNA, 22 bp, Artificial Sequence
  Synthetic Construct
ggcggttgagagaaatggtaga

SEQ ID NO: 19111 - DNA, 24 bp, Artificial Sequence
  Synthetic Construct
aagtatctcaaaacagcggggtta

SEQ ID NO: 19112 - DNA, 22 bp, Artificial Sequence
  Synthetic Construct
gccgtaaagtcctgccacttac

SEQ ID NO: 19113 - DNA, 22 bp, Artificial Sequence
  Synthetic Construct
gccggggttttgcatagcttca

SEQ ID NO: 19114 - DNA, 23 bp, Artificial Sequence
  Synthetic Construct
agtgactatcagtgcccacaaac

SEQ ID NO: 19115 - DNA, 24 bp, Artificial Sequence
  Synthetic Construct
tgtccttggttgagtcactctttg

SEQ ID NO: 19116 - DNA, 22 bp, Artificial Sequence
  Synthetic Construct
tggatcaactctccccttgact

SEQ ID NO: 19117 - DNA, 21 bp, Artificial Sequence
  Synthetic Construct
aggacacaggctgaccacaca

SEQ ID NO: 19118 - DNA, 26 bp, Artificial Sequence
  Synthetic Construct
gtctcttgttcacaatccaaggagat

SEQ ID NO: 19119 - DNA, 25 bp, Artificial Sequence
  Synthetic Construct
gaggatctatcggaatcctctgtct

SEQ ID NO: 19120 - DNA, 24 bp, Artificial Sequence
  Synthetic Construct
tccagcaaagctacttctgtgaaa

SEQ ID NO: 19121 - DNA, 22 bp, Artificial Sequence
  Synthetic Construct
ctctccagcgttacccgatttc

SEQ ID NO: 19122 - DNA, 23 bp, Artificial Sequence
  Synthetic Construct
cgttccctctcttcttccccttt

SEQ ID NO: 19123 - DNA, 28 bp, Artificial Sequence
  Synthetic Construct
gggaaagcaagtagaggtactaacatga

SEQ ID NO: 19124 - DNA, 21 bp, Artificial Sequence
  Synthetic Construct
agcaccgtttctggatgtgat

SEQ ID NO: 19125 - DNA, 23 bp, Artificial Sequence
  Synthetic Construct
gaggagacaggcaattagcacat

SEQ ID NO: 19126 - DNA, 23 bp, Artificial Sequence
  Synthetic Construct
ccaggtgggactgtcttatctct

SEQ ID NO: 19127 - DNA, 20 bp, Artificial Sequence
  Synthetic Construct
tcacacctggaaccctgctt

SEQ ID NO: 19128 - DNA, 22 bp, Artificial Sequence
  Synthetic Construct
ccctactcactcccttctcagt

SEQ ID NO: 19129 - DNA, 25 bp, Artificial Sequence
  Synthetic Construct
cccgcaaggtggaaggtaatagtag

SEQ ID NO: 19130 - DNA, 26 bp, Artificial Sequence
  Synthetic Construct
gctagcagttgatgagagtggatttc

SEQ ID NO: 19131 - DNA, 19 bp, Artificial Sequence
  Synthetic Construct
ggggccacaaatggggaat

SEQ ID NO: 19132 - DNA, 24 bp, Artificial Sequence
  Synthetic Construct
gggtggtttgcgcttcttatcaca

SEQ ID NO: 19133 - DNA, 26 bp, Artificial Sequence
  Synthetic Construct
ctagcagctcttaacagatgatgttg

SEQ ID NO: 19134 - DNA, 22 bp, Artificial Sequence
  Synthetic Construct
ggtggtgtgagggctggatatt

SEQ ID NO: 19135 - DNA, 23 bp, Artificial Sequence
  Synthetic Construct
ctggttggcattatttgctccaa

SEQ ID NO: 19136 - DNA, 25 bp, Artificial Sequence
  Synthetic Construct
gtgtctgtcctctccacatgtcttg

SEQ ID NO: 19137 - DNA, 25 bp, Artificial Sequence
  Synthetic Construct
cacaccctgaagtcactatcctttc

SEQ ID NO: 19138 - DNA, 24 bp, Artificial Sequence
  Synthetic Construct
gctcgaattcactactgggctaaa

SEQ ID NO: 19139 - DNA, 24 bp, Artificial Sequence
  Synthetic Construct
ccatcttctttgccatgcagcaat

SEQ ID NO: 19140 - DNA, 25 bp, Artificial Sequence
  Synthetic Construct
ctcagaaatcacctcctccctgaag

SEQ ID NO: 19141 - DNA, 21 bp, Artificial Sequence
  Synthetic Construct
gctgttcaccgcacattcagt

SEQ ID NO: 19142 - DNA, 24 bp, Artificial Sequence
  Synthetic Construct
ctctgtctcctgtccctggaatac

SEQ ID NO: 19143 - DNA, 23 bp, Artificial Sequence
  Synthetic Construct
ggctcttgcactgctcctatttg

SEQ ID NO: 19144 - DNA, 21 bp, Artificial Sequence
  Synthetic Construct
tgaccccatgttccagctact

SEQ ID NO: 19145 - DNA, 24 bp, Artificial Sequence
  Synthetic Construct
catctgtgagacaactggtgaact

SEQ ID NO: 19146 - DNA, 22 bp, Artificial Sequence
  Synthetic Construct
gtgcagtgagaggcgaagtaca

SEQ ID NO: 19147 - DNA, 25 bp, Artificial Sequence
  Synthetic Construct
gaagtacataggggtgaccatgaaa

SEQ ID NO: 19148 - DNA, 19 bp, Artificial Sequence
  Synthetic Construct
agcgctctgcgatttcctt

SEQ ID NO: 19149 - DNA, 22 bp, Artificial Sequence
  Synthetic Construct
tcacaccacccatctggagtca

SEQ ID NO: 19150 - DNA, 26 bp, Artificial Sequence
  Synthetic Construct
ggaggcaaggaaacatagtctttaac

SEQ ID NO: 19151 - DNA, 27 bp, Artificial Sequence
  Synthetic Construct
cagttttcaggccacgttctaaacaag

SEQ ID NO: 19152 - DNA, 28 bp, Artificial Sequence
  Synthetic Construct
gcaggcatggtataaaacccattccatt

SEQ ID NO: 19153 - DNA, 23 bp, Artificial Sequence
  Synthetic Construct
ccctctgtggggtacttggtaga

SEQ ID NO: 19154 - DNA, 28 bp, Artificial Sequence
  Synthetic Construct
ggtgagaaatgctgttatccacctttag

SEQ ID NO: 19155 - DNA, 23 bp, Artificial Sequence
  Synthetic Construct
gcgcagatcaccttgttctccat

SEQ ID NO: 19156 - DNA, 22 bp, Artificial Sequence
  Synthetic Construct
ggaaggggctgtccttcttcta

SEQ ID NO: 19157 - DNA, 22 bp, Artificial Sequence
  Synthetic Construct
ccacaccaaacgggtgtgaaac

SEQ ID NO: 19158 - DNA, 25 bp, Artificial Sequence
  Synthetic Construct
tggatcgtgatatggcgtttttaag

SEQ ID NO: 19159 - DNA, 26 bp, Artificial Sequence
  Synthetic Construct
gggttttggcttaaagcagtctgagt

SEQ ID NO: 19160 - DNA, 24 bp, Artificial Sequence
  Synthetic Construct
gggaagaggacaaagtgggactgt

SEQ ID NO: 19161 - DNA, 22 bp, Artificial Sequence
  Synthetic Construct
cctcccaatccctgacctgtaa

SEQ ID NO: 19162 - DNA, 21 bp, Artificial Sequence
  Synthetic Construct
acacctccatctcggccacaa

SEQ ID NO: 19163 - DNA, 26 bp, Artificial Sequence
  Synthetic Construct
ggagttttacccactccacctgattc

SEQ ID NO: 19164 - DNA, 24 bp, Artificial Sequence
  Synthetic Construct
ggcagcatgtgtgtgtttccatct

SEQ ID NO: 19165 - DNA, 23 bp, Artificial Sequence
  Synthetic Construct
cctgaatgccaactggagggaat

SEQ ID NO: 19166 - DNA, 23 bp, Artificial Sequence
  Synthetic Construct
tctccatttctgacgggacattt

SEQ ID NO: 19167 - DNA, 23 bp, Artificial Sequence
  Synthetic Construct
ccaggacccagacataggtggat

SEQ ID NO: 19168 - DNA, 22 bp, Artificial Sequence
  Synthetic Construct
gctcagacacactcctggaaca

SEQ ID NO: 19169 - DNA, 26 bp, Artificial Sequence
  Synthetic Construct
cagtttcacctctgagcattgatttc

SEQ ID NO: 19170 - DNA, 29 bp, Artificial Sequence
  Synthetic Construct
ggtttctacagttgcctgttatagagaag

SEQ ID NO: 19171 - DNA, 23 bp, Artificial Sequence
  Synthetic Construct
aggacaaccagagaggaacaatg

SEQ ID NO: 19172 - DNA, 22 bp, Artificial Sequence
  Synthetic Construct
gagaggccactttcagccacta

SEQ ID NO: 19173 - DNA, 25 bp, Artificial Sequence
  Synthetic Construct
ggtagctgggagaaaagaaggttag

SEQ ID NO: 19174 - DNA, 26 bp, Artificial Sequence
  Synthetic Construct
gggatgaagatcgaaaataggaccaa

SEQ ID NO: 19175 - DNA, 21 bp, Artificial Sequence
  Synthetic Construct
gccaacgggaaacacattgaa

SEQ ID NO: 19176 - DNA, 25 bp, Artificial Sequence
  Synthetic Construct
gtgacttcctcacactcctggattc

SEQ ID NO: 19177 - DNA, 21 bp, Artificial Sequence
  Synthetic Construct
gtggagccaaaccaagccaat

SEQ ID NO: 19178 - DNA, 22 bp, Artificial Sequence
  Synthetic Construct
caggctcagttgaggtgaggtt

SEQ ID NO: 19179 - DNA, 22 bp, Artificial Sequence
  Synthetic Construct
gcaaaatggccaggtacgatgt

SEQ ID NO: 19180 - DNA, 25 bp, Artificial Sequence
  Synthetic Construct
gtttccagtctctgctcattaggaa

SEQ ID NO: 19181 - DNA, 22 bp, Artificial Sequence
  Synthetic Construct
agatgggctcttcctgctcatc

SEQ ID NO: 19182 - DNA, 29 bp, Artificial Sequence
  Synthetic Construct
ccagccttgattctttggaatcctgttac

SEQ ID NO: 19183 - DNA, 22 bp, Artificial Sequence
  Synthetic Construct
tccatcccctggcctcaaatct

SEQ ID NO: 19184 - DNA, 27 bp, Artificial Sequence
  Synthetic Construct
gtgtgccagtgtacttcattcatctgt

SEQ ID NO: 19185 - DNA, 23 bp, Artificial Sequence
  Synthetic Construct
ccttgcgagtgacttcagtgttg

SEQ ID NO: 19186 - DNA, 22 bp, Artificial Sequence
  Synthetic Construct
acgtcctggaagtcagtgtaac

SEQ ID NO: 19187 - DNA, 24 bp, Artificial Sequence
  Synthetic Construct
gaccacccaaaaagagaactgttg

SEQ ID NO: 19188 - DNA, 29 bp, Artificial Sequence
  Synthetic Construct
gggaaccaaaacaagcactaaagtgtgat

SEQ ID NO: 19189 - DNA, 21 bp, Artificial Sequence
  Synthetic Construct
ggggatcttgcactcacttgt

SEQ ID NO: 19190 - DNA, 27 bp, Artificial Sequence
  Synthetic Construct
gtcctgtagcatcagacctttaagaca

SEQ ID NO: 19191 - DNA, 26 bp, Artificial Sequence
  Synthetic Construct
ccctgcatctttcaaaggcatctttc

SEQ ID NO: 19192 - DNA, 23 bp, Artificial Sequence
  Synthetic Construct
ccagttcaagggcaaaggctact

SEQ ID NO: 19193 - DNA, 27 bp, Artificial Sequence
  Synthetic Construct
gtgactcctaatgaaggcagactccta

SEQ ID NO: 19194 - DNA, 22 bp, Artificial Sequence
  Synthetic Construct
gtgggctttgcagtcaggacat

SEQ ID NO: 19195 - DNA, 27 bp, Artificial Sequence
  Synthetic Construct
gaagaggggattgaatagtcaggttac

SEQ ID NO: 19196 - DNA, 24 bp, Artificial Sequence
  Synthetic Construct
tgcctctagaatggcactgtttag

SEQ ID NO: 19197 - DNA, 25 bp, Artificial Sequence
  Synthetic Construct
gtgtcaggggtagtgagtttggttt

SEQ ID NO: 19198 - DNA, 22 bp, Artificial Sequence
  Synthetic Construct
tcctgtggacatacccagttga

SEQ ID NO: 19199 - DNA, 24 bp, Artificial Sequence
  Synthetic Construct
gccagcagatgagtcatggagtat

SEQ ID NO: 19200 - DNA, 25 bp, Artificial Sequence
  Synthetic Construct
gtgggatgccaagaacttgactttg

SEQ ID NO: 19201 - DNA, 25 bp, Artificial Sequence
  Synthetic Construct
gagcaatgagagagcaatgcgttat

SEQ ID NO: 19202 - DNA, 24 bp, Artificial Sequence
  Synthetic Construct
gccacagggaatctgtgtttgaag

SEQ ID NO: 19203 - DNA, 23 bp, Artificial Sequence
  Synthetic Construct
cgtgctgacttaggcagattttg

SEQ ID NO: 19204 - DNA, 22 bp, Artificial Sequence
  Synthetic Construct
gccaacaaaagtcctcgctttg

SEQ ID NO: 19205 - DNA, 22 bp, Artificial Sequence
  Synthetic Construct
ccaggaaaagaggtgactgcat

SEQ ID NO: 19206 - DNA, 24 bp, Artificial Sequence
  Synthetic Construct
ctcagcatgttctaagggcagaga

SEQ ID NO: 19207 - DNA, 21 bp, Artificial Sequence
  Synthetic Construct
gtcctctgcccatgagtgaac

SEQ ID NO: 19208 - DNA, 21 bp, Artificial Sequence
  Synthetic Construct
ccctggaaatgcatccacgat

SEQ ID NO: 19209 - DNA, 27 bp, Artificial Sequence
  Synthetic Construct
ggcttgagtgaaatggtagtactcaaa

SEQ ID NO: 19210 - DNA, 24 bp, Artificial Sequence
  Synthetic Construct
gcctagtgtaggcaaaggaagtct

SEQ ID NO: 19211 - DNA, 22 bp, Artificial Sequence
  Synthetic Construct
tgggccctgtagagtgcatttc

SEQ ID NO: 19212 - DNA, 20 bp, Artificial Sequence
  Synthetic Construct
gtgtcctgggtgtgtgttca

SEQ ID NO: 19213 - DNA, 24 bp, Artificial Sequence
  Synthetic Construct
ctcctacttgggtggaggaagtct

SEQ ID NO: 19214 - DNA, 27 bp, Artificial Sequence
  Synthetic Construct
gtagcagtacagatgagtgacatagat

SEQ ID NO: 19215 - DNA, 29 bp, Artificial Sequence
  Synthetic Construct
gggtttcctgcaaaaatggagagcttttt

SEQ ID NO: 19216 - DNA, 24 bp, Artificial Sequence
  Synthetic Construct
caaaccaagcacttctccaaaact

SEQ ID NO: 19217 - DNA, 24 bp, Artificial Sequence
  Synthetic Construct
gcccctctttctctgcatctggta

SEQ ID NO: 19218 - DNA, 23 bp, Artificial Sequence
  Synthetic Construct
cctttcagccacacctgtctttg

SEQ ID NO: 19219 - DNA, 24 bp, Artificial Sequence
  Synthetic Construct
ggagactgtatccaggcagtgtgt

SEQ ID NO: 19220 - DNA, 20 bp, Artificial Sequence
  Synthetic Construct
gcccctctcttgctggcatt

SEQ ID NO: 19221 - DNA, 20 bp, Artificial Sequence
  Synthetic Construct
gcagccctttttgcgaggat

SEQ ID NO: 19222 - DNA, 24 bp, Artificial Sequence
  Synthetic Construct
gagctttgggaaaggggaaagaga

SEQ ID NO: 19223 - DNA, 22 bp, Artificial Sequence
  Synthetic Construct
tggcctcgggttttagatgaac

SEQ ID NO: 19224 - DNA, 24 bp, Artificial Sequence
  Synthetic Construct
gcaccttacagtgccaactgtttc

SEQ ID NO: 19225 - DNA, 28 bp, Artificial Sequence
  Synthetic Construct
ccacttctctgtgaccatttgtttggta

SEQ ID NO: 19226 - DNA, 21 bp, Artificial Sequence
  Synthetic Construct
tgggcaggtcacaccctgaat

SEQ ID NO: 19227 - DNA, 20 bp, Artificial Sequence
  Synthetic Construct
cacttgtccacgctgcgttt

SEQ ID NO: 19228 - DNA, 24 bp, Artificial Sequence
  Synthetic Construct
ccatcttcagctcttgctttgctt

SEQ ID NO: 19229 - DNA, 25 bp, Artificial Sequence
  Synthetic Construct
ggggtctccttagtatcatcccttt

SEQ ID NO: 19230 - DNA, 23 bp, Artificial Sequence
  Synthetic Construct
ccttcctggatgtgccttgaagt

SEQ ID NO: 19231 - DNA, 20 bp, Artificial Sequence
  Synthetic Construct
ccgggtcacaccaaccatct

SEQ ID NO: 19232 - DNA, 24 bp, Artificial Sequence
  Synthetic Construct
gggtcccactgttaccaactcttg

SEQ ID NO: 19233 - DNA, 24 bp, Artificial Sequence
  Synthetic Construct
gtgtggagtcaaacactcctggtt

SEQ ID NO: 19234 - DNA, 29 bp, Artificial Sequence
  Synthetic Construct
ggatgaaaagaaacccagacagagacttt

SEQ ID NO: 19235 - DNA, 22 bp, Artificial Sequence
  Synthetic Construct
tggggttgtctcagtggtgcta

SEQ ID NO: 19236 - DNA, 25 bp, Artificial Sequence
  Synthetic Construct
ggggtctgctgtagaattcctgttg

SEQ ID NO: 19237 - DNA, 26 bp, Artificial Sequence
  Synthetic Construct
gtttctggaagacaaatcggcattac

SEQ ID NO: 19238 - DNA, 29 bp, Artificial Sequence
  Synthetic Construct
ccctgcatcatattctgtgaaacactttg

SEQ ID NO: 19239 - DNA, 22 bp, Artificial Sequence
  Synthetic Construct
gggcaggcaatttcccctaaga

SEQ ID NO: 19240 - DNA, 22 bp, Artificial Sequence
  Synthetic Construct
ctctctgataaggccccggttt

SEQ ID NO: 19241 - DNA, 24 bp, Artificial Sequence
  Synthetic Construct
ccaccaaggaccctatgagcagtt

SEQ ID NO: 19242 - DNA, 21 bp, Artificial Sequence
  Synthetic Construct
tcccatccagagtccgaccat

SEQ ID NO: 19243 - DNA, 22 bp, Artificial Sequence
  Synthetic Construct
gaaccagcagatttggggctat

SEQ ID NO: 19244 - DNA, 22 bp, Artificial Sequence
  Synthetic Construct
gggcccgctttttaacactttg

SEQ ID NO: 19245 - DNA, 26 bp, Artificial Sequence
  Synthetic Construct
gagagtagttgtggatacccgagaaa

SEQ ID NO: 19246 - DNA, 24 bp, Artificial Sequence
  Synthetic Construct
tgctcaaaaccagtagcactttca

SEQ ID NO: 19247 - DNA, 24 bp, Artificial Sequence
  Synthetic Construct
ccaacctagacttccagcgttaag

SEQ ID NO: 19248 - DNA, 22 bp, Artificial Sequence
  Synthetic Construct
gcaaagggccccagttttgctt

SEQ ID NO: 19249 - DNA, 27 bp, Artificial Sequence
  Synthetic Construct
gccttgcagagaaacacatttttggat

SEQ ID NO: 19250 - DNA, 26 bp, Artificial Sequence
  Synthetic Construct
ggggagtatcattttcccagctccaa

SEQ ID NO: 19251 - DNA, 21 bp, Artificial Sequence
  Synthetic Construct
gtgtgtccgttgtgtgcaact

SEQ ID NO: 19252 - DNA, 18 bp, Artificial Sequence
  Synthetic Construct
agcggtgtagccgtctga

SEQ ID NO: 19253 - DNA, 22 bp, Artificial Sequence
  Synthetic Construct
cgctgaaggaccctcctcaaag

SEQ ID NO: 19254 - DNA, 20 bp, Artificial Sequence
  Synthetic Construct
agagaggccctgaggacttg

SEQ ID NO: 19255 - DNA, 25 bp, Artificial Sequence
  Synthetic Construct
tgtaactaaagtgtaggctgcgtat

SEQ ID NO: 19256 - DNA, 23 bp, Artificial Sequence
  Synthetic Construct
gaccaacgatgtgttgtgctctt

SEQ ID NO: 19257 - DNA, 22 bp, Artificial Sequence
  Synthetic Construct
ggtgtccatgcgggctttagta

SEQ ID NO: 19258 - DNA, 24 bp, Artificial Sequence
  Synthetic Construct
ctcggggatttgggaaatcactct

SEQ ID NO: 19259 - DNA, 22 bp, Artificial Sequence
  Synthetic Construct
cacgatgggagaggtcatcttg

SEQ ID NO: 19260 - DNA, 21 bp, Artificial Sequence
  Synthetic Construct
gcctttggcgacatcgtcttc

SEQ ID NO: 19261 - DNA, 28 bp, Artificial Sequence
  Synthetic Construct
gcaagaccccatgaaaatcaatggaaca

SEQ ID NO: 19262 - DNA, 24 bp, Artificial Sequence
  Synthetic Construct
gcagctgcaccatttacagcctaa

SEQ ID NO: 19263 - DNA, 19 bp, Artificial Sequence
  Synthetic Construct
tggccaggcagctctgtca

SEQ ID NO: 19264 - DNA, 25 bp, Artificial Sequence
  Synthetic Construct
ccaaactcattgtttctcctggttt

SEQ ID NO: 19265 - DNA, 26 bp, Artificial Sequence
  Synthetic Construct
gctgtggaaaggtcatctgagacatc

SEQ ID NO: 19266 - DNA, 21 bp, Artificial Sequence
  Synthetic Construct
tcacatccactggccgcattc

SEQ ID NO: 19267 - DNA, 23 bp, Artificial Sequence
  Synthetic Construct
tggccctgctgaaactttagaac

SEQ ID NO: 19268 - DNA, 21 bp, Artificial Sequence
  Synthetic Construct
cgtccacttccaggaccagaa

SEQ ID NO: 19269 - DNA, 20 bp, Artificial Sequence
  Synthetic Construct
aggtagtcggtgagcaggaa

SEQ ID NO: 19270 - DNA, 26 bp, Artificial Sequence
  Synthetic Construct
ggaagtttcccttgtgtgaaagtcaa

SEQ ID NO: 19271 - DNA, 22 bp, Artificial Sequence
  Synthetic Construct
ggttggcttgtcaccctagaga

SEQ ID NO: 19272 - DNA, 25 bp, Artificial Sequence
  Synthetic Construct
gtgatgcttttgggaattcacttct

SEQ ID NO: 19273 - DNA, 22 bp, Artificial Sequence
  Synthetic Construct
ccgaattttccgaggaccaagt

SEQ ID NO: 19274 - DNA, 23 bp, Artificial Sequence
  Synthetic Construct
gctctgctagatgctgaggatga

SEQ ID NO: 19275 - DNA, 25 bp, Artificial Sequence
  Synthetic Construct
ctgggaagaggtggataaatgttca

SEQ ID NO: 19276 - DNA, 24 bp, Artificial Sequence
  Synthetic Construct
agggagggaatgtgaagagaaagt

SEQ ID NO: 19277 - DNA, 24 bp, Artificial Sequence
  Synthetic Construct
gcttcccagtgcttaggaccacat

SEQ ID NO: 19278 - DNA, 24 bp, Artificial Sequence
  Synthetic Construct
gaggctttgactggatgatgttca

SEQ ID NO: 19279 - DNA, 22 bp, Artificial Sequence
  Synthetic Construct
gcccatgtcaaccccatccaaa

SEQ ID NO: 19280 - DNA, 24 bp, Artificial Sequence
  Synthetic Construct
gttggatcctttctagctccaaga

SEQ ID NO: 19281 - DNA, 24 bp, Artificial Sequence
  Synthetic Construct
gcctcagaccctatttgacacaag

SEQ ID NO: 19282 - DNA, 22 bp, Artificial Sequence
  Synthetic Construct
agaggggtattgccctgtctaa

SEQ ID NO: 19283 - DNA, 22 bp, Artificial Sequence
  Synthetic Construct
cgaactctccatccctgcttct

SEQ ID NO: 19284 - DNA, 26 bp, Artificial Sequence
  Synthetic Construct
gtgggctagtttatccttccaaaatc

SEQ ID NO: 19285 - DNA, 22 bp, Artificial Sequence
  Synthetic Construct
gcgctggagtatggtggtgtaa

SEQ ID NO: 19286 - DNA, 22 bp, Artificial Sequence
  Synthetic Construct
gtgccgactgtttttgctcaca

SEQ ID NO: 19287 - DNA, 22 bp, Artificial Sequence
  Synthetic Construct
cactggaggttggtggaagcaa

SEQ ID NO: 19288 - DNA, 23 bp, Artificial Sequence
  Synthetic Construct
gccacagttggctctatctgcta

SEQ ID NO: 19289 - DNA, 25 bp, Artificial Sequence
  Synthetic Construct
gactcccaattagcgctctttttca

SEQ ID NO: 19290 - DNA, 24 bp, Artificial Sequence
  Synthetic Construct
gacttttcacccacacatgggatt

SEQ ID NO: 19291 - DNA, 23 bp, Artificial Sequence
  Synthetic Construct
gcatgggcatcattagtcacaca

SEQ ID NO: 19292 - DNA, 22 bp, Artificial Sequence
  Synthetic Construct
ccctgcagaaccacttccgtta

SEQ ID NO: 19293 - DNA, 22 bp, Artificial Sequence
  Synthetic Construct
gccacctgagaccatgcttcta

SEQ ID NO: 19294 - DNA, 22 bp, Artificial Sequence
  Synthetic Construct
ggcttatcctggcaccgattct

SEQ ID NO: 19295 - DNA, 23 bp, Artificial Sequence
  Synthetic Construct
gggagacaaactcattggagtca

SEQ ID NO: 19296 - DNA, 24 bp, Artificial Sequence
  Synthetic Construct
ggaaagcacattgtccagatggtt

SEQ ID NO: 19297 - DNA, 20 bp, Artificial Sequence
  Synthetic Construct
ggcccacacatgcatgaaga

SEQ ID NO: 19298 - DNA, 26 bp, Artificial Sequence
  Synthetic Construct
ggcttgatctgctgttactggagaag

SEQ ID NO: 19299 - DNA, 25 bp, Artificial Sequence
  Synthetic Construct
cccaaagctccctcattaccttctt

SEQ ID NO: 19300 - DNA, 22 bp, Artificial Sequence
  Synthetic Construct
ccagtggggcattactgggtta

SEQ ID NO: 19301 - DNA, 24 bp, Artificial Sequence
  Synthetic Construct
ggaggcctttcagggatcttgcta

SEQ ID NO: 19302 - DNA, 22 bp, Artificial Sequence
  Synthetic Construct
ggtgtgtgaggctaatccttga

SEQ ID NO: 19303 - DNA, 23 bp, Artificial Sequence
  Synthetic Construct
cctccagagaagtcggcaatgtt

SEQ ID NO: 19304 - DNA, 22 bp, Artificial Sequence
  Synthetic Construct
gagcgaaagtgcgaggtcatag

SEQ ID NO: 19305 - DNA, 22 bp, Artificial Sequence
  Synthetic Construct
acagtgaaccagccccatcttc

SEQ ID NO: 19306 - DNA, 26 bp, Artificial Sequence
  Synthetic Construct
gaccagcttccttatgacttttggtt

SEQ ID NO: 19307 - DNA, 25 bp, Artificial Sequence
  Synthetic Construct
cccatacacgtcactgtctctcaca

SEQ ID NO: 19308 - DNA, 22 bp, Artificial Sequence
  Synthetic Construct
caagaaccccaggtcagagaac

SEQ ID NO: 19309 - DNA, 24 bp, Artificial Sequence
  Synthetic Construct
gtggtagcagcaaagactgtaatc

SEQ ID NO: 19310 - DNA, 23 bp, Artificial Sequence
  Synthetic Construct
gcacacacaaggacttgctcaca

SEQ ID NO: 19311 - DNA, 22 bp, Artificial Sequence
  Synthetic Construct
gcgaacaggcaggaaagactca

SEQ ID NO: 19312 - DNA, 26 bp, Artificial Sequence
  Synthetic Construct
gttacatgagtagaagggttgggtta

SEQ ID NO: 19313 - DNA, 23 bp, Artificial Sequence
  Synthetic Construct
gtacagcccagcaattctacctt

SEQ ID NO: 19314 - DNA, 29 bp, Artificial Sequence
  Synthetic Construct
ggtgtcatctctgtggcaatattgtgatg

SEQ ID NO: 19315 - DNA, 22 bp, Artificial Sequence
  Synthetic Construct
gctgccgggaaaaccatgtaga

SEQ ID NO: 19316 - DNA, 24 bp, Artificial Sequence
  Synthetic Construct
cggcagtgatctcaatgacaggat

SEQ ID NO: 19317 - DNA, 21 bp, Artificial Sequence
  Synthetic Construct
gccaaggaagctcgagggatt

SEQ ID NO: 19318 - DNA, 23 bp, Artificial Sequence
  Synthetic Construct
ctctccctgctatgtccctgaac

SEQ ID NO: 19319 - DNA, 26 bp, Artificial Sequence
  Synthetic Construct
gacttcaaacaatgaagaggggacta

SEQ ID NO: 19320 - DNA, 27 bp, Artificial Sequence
  Synthetic Construct
ggtgttgtacgtgggaaatttgggata

SEQ ID NO: 19321 - DNA, 29 bp, Artificial Sequence
  Synthetic Construct
ggagagatgagaagggaacagatgatttt

SEQ ID NO: 19322 - DNA, 21 bp, Artificial Sequence
  Synthetic Construct
gcacatcgtttctgcgtcttg

SEQ ID NO: 19323 - DNA, 22 bp, Artificial Sequence
  Synthetic Construct
tccctcctgttggtctctcctt

SEQ ID NO: 19324 - DNA, 22 bp, Artificial Sequence
  Synthetic Construct
gacagcccaaatcccagagagt

SEQ ID NO: 19325 - DNA, 20 bp, Artificial Sequence
  Synthetic Construct
gcaagcgggaagatggaaga

SEQ ID NO: 19326 - DNA, 24 bp, Artificial Sequence
  Synthetic Construct
ccgcctcaataccaggactcttag

SEQ ID NO: 19327 - DNA, 27 bp, Artificial Sequence
  Synthetic Construct
gctattgttctcacctatgttgtgttg

SEQ ID NO: 19328 - DNA, 22 bp, Artificial Sequence
  Synthetic Construct
gctggctttagagctgggcata

SEQ ID NO: 19329 - DNA, 26 bp, Artificial Sequence
  Synthetic Construct
ggattttcctctacagagtggtttct

SEQ ID NO: 19330 - DNA, 22 bp, Artificial Sequence
  Synthetic Construct
ctgcttgtgagaaggagaccaa

SEQ ID NO: 19331 - DNA, 24 bp, Artificial Sequence
  Synthetic Construct
gcttggccatgttcttggaagcta

SEQ ID NO: 19332 - DNA, 24 bp, Artificial Sequence
  Synthetic Construct
ggttgcttctgcacaaatccaagt

SEQ ID NO: 19333 - DNA, 22 bp, Artificial Sequence
  Synthetic Construct
cccgctctgtttgactcagtgt

SEQ ID NO: 19334 - DNA, 23 bp, Artificial Sequence
  Synthetic Construct
agaggaattgcgaaaccatgact

SEQ ID NO: 19335 - DNA, 20 bp, Artificial Sequence
  Synthetic Construct
tgagcgtggagatggtgatg

SEQ ID NO: 19336 - DNA, 23 bp, Artificial Sequence
  Synthetic Construct
tcggaagggactttctagtctgt

SEQ ID NO: 19337 - DNA, 22 bp, Artificial Sequence
  Synthetic Construct
ctcccagcaccttctgacaaac

SEQ ID NO: 19338 - DNA, 19 bp, Artificial Sequence
  Synthetic Construct
tgacccgcacagcatcttg

SEQ ID NO: 19339 - DNA, 23 bp, Artificial Sequence
  Synthetic Construct
ggatcctgctttccagtctgtca

SEQ ID NO: 19340 - DNA, 23 bp, Artificial Sequence
  Synthetic Construct
ggagttctttgctccgtgtctgt

SEQ ID NO: 19341 - DNA, 24 bp, Artificial Sequence
  Synthetic Construct
gtggtggtgttatggctaggttag

SEQ ID NO: 19342 - DNA, 26 bp, Artificial Sequence
  Synthetic Construct
cttccaaaccccagattctttagtct

SEQ ID NO: 19343 - DNA, 23 bp, Artificial Sequence
  Synthetic Construct
tcctgcccttagagtcagaaaga

SEQ ID NO: 19344 - DNA, 21 bp, Artificial Sequence
  Synthetic Construct
cccctgattgacagccagcaa

SEQ ID NO: 19345 - DNA, 29 bp, Artificial Sequence
  Synthetic Construct
gtcttctgtctacttggacctttaagtca

SEQ ID NO: 19346 - DNA, 24 bp, Artificial Sequence
  Synthetic Construct
cctcaggacctttgagcagtccaa

SEQ ID NO: 19347 - DNA, 24 bp, Artificial Sequence
  Synthetic Construct
ccagctgctgtttcaagagtgcat

SEQ ID NO: 19348 - DNA, 24 bp, Artificial Sequence
  Synthetic Construct
cccaggtgtgtgtaacaaaagttc

SEQ ID NO: 19349 - DNA, 24 bp, Artificial Sequence
  Synthetic Construct
ggagacaaacaagacagaggagat

SEQ ID NO: 19350 - DNA, 22 bp, Artificial Sequence
  Synthetic Construct
ggacctgtgtgatagcaagcat

SEQ ID NO: 19351 - DNA, 24 bp, Artificial Sequence
  Synthetic Construct
ggactggtctaagtgggtgtcact

SEQ ID NO: 19352 - DNA, 22 bp, Artificial Sequence
  Synthetic Construct
cagagcaggacaatggctctac

SEQ ID NO: 19353 - DNA, 25 bp, Artificial Sequence
  Synthetic Construct
gcttcggactgatttctgctgtgtt

SEQ ID NO: 19354 - DNA, 23 bp, Artificial Sequence
  Synthetic Construct
gcagtagcgagttgactccatca

SEQ ID NO: 19355 - DNA, 25 bp, Artificial Sequence
  Synthetic Construct
ccacagtgcaaggtgaatttagact

SEQ ID NO: 19356 - DNA, 21 bp, Artificial Sequence
  Synthetic Construct
ggctggtcttccttgctgtaa

SEQ ID NO: 19357 - DNA, 21 bp, Artificial Sequence
  Synthetic Construct
gcactggcatttccctttgtt

SEQ ID NO: 19358 - DNA, 22 bp, Artificial Sequence
  Synthetic Construct
gtccagaaccactagggcatga

SEQ ID NO: 19359 - DNA, 28 bp, Artificial Sequence
  Synthetic Construct
gaaggaaagaggagtatgtgtcttcatc

SEQ ID NO: 19360 - DNA, 25 bp, Artificial Sequence
  Synthetic Construct
ctgcttctcttcgcttttgcatttc

SEQ ID NO: 19361 - DNA, 23 bp, Artificial Sequence
  Synthetic Construct
gctccccggtcattctctcttct

SEQ ID NO: 19362 - DNA, 21 bp, Artificial Sequence
  Synthetic Construct
ccggggctatgcaatgtatca

SEQ ID NO: 19363 - DNA, 23 bp, Artificial Sequence
  Synthetic Construct
ctgcctcttggaacactaacagt

SEQ ID NO: 19364 - DNA, 23 bp, Artificial Sequence
  Synthetic Construct
gcttcaccccgaaatcagagaca

SEQ ID NO: 19365 - DNA, 26 bp, Artificial Sequence
  Synthetic Construct
gtcagactccataagtaccgtttaca

SEQ ID NO: 19366 - DNA, 23 bp, Artificial Sequence
  Synthetic Construct
ccagagcatgctgacgcgtattt

SEQ ID NO: 19367 - DNA, 26 bp, Artificial Sequence
  Synthetic Construct
ggtttgtggtgaattgtcaagcatgt

SEQ ID NO: 19368 - DNA, 22 bp, Artificial Sequence
  Synthetic Construct
gcagcccaagatcactggagtt

SEQ ID NO: 19369 - DNA, 21 bp, Artificial Sequence
  Synthetic Construct
tcagctgtggcgggtactgaa

SEQ ID NO: 19370 - DNA, 26 bp, Artificial Sequence
  Synthetic Construct
cgtactaccacgtatccaactctttg

SEQ ID NO: 19371 - DNA, 23 bp, Artificial Sequence
  Synthetic Construct
aacttggagtggagatgcagaaa

SEQ ID NO: 19372 - DNA, 22 bp, Artificial Sequence
  Synthetic Construct
aaccaggccaagacctttcttt

SEQ ID NO: 19373 - DNA, 20 bp, Artificial Sequence
  Synthetic Construct
gcttgactgccagtgtccaa

SEQ ID NO: 19374 - DNA, 22 bp, Artificial Sequence
  Synthetic Construct
cgctgtccagttttccctgtgt

SEQ ID NO: 19375 - DNA, 23 bp, Artificial Sequence
  Synthetic Construct
agccttgagagaggtgtgatgat

SEQ ID NO: 19376 - DNA, 22 bp, Artificial Sequence
  Synthetic Construct
caggtaacatgcgttccctttg

SEQ ID NO: 19377 - DNA, 23 bp, Artificial Sequence
  Synthetic Construct
caacagcgcactacaaaggctat

SEQ ID NO: 19378 - DNA, 25 bp, Artificial Sequence
  Synthetic Construct
gactgcagaatacagaggacgactt

SEQ ID NO: 19379 - DNA, 25 bp, Artificial Sequence
  Synthetic Construct
cttccttagaaaggtggcatcaagt

SEQ ID NO: 19380 - DNA, 23 bp, Artificial Sequence
  Synthetic Construct
cattgtgggcaaaagagcaaaac

SEQ ID NO: 19381 - DNA, 27 bp, Artificial Sequence
  Synthetic Construct
cctgggacaaaacctctttctctgaat

SEQ ID NO: 19382 - DNA, 23 bp, Artificial Sequence
  Synthetic Construct
ggaagacagagtgttgggaggta

SEQ ID NO: 19383 - DNA, 24 bp, Artificial Sequence
  Synthetic Construct
gggacaaaggtaggggtgtgatac

SEQ ID NO: 19384 - DNA, 22 bp, Artificial Sequence
  Synthetic Construct
gcggaattcctcaaggcacaga

SEQ ID NO: 19385 - DNA, 25 bp, Artificial Sequence
  Synthetic Construct
ccactggtttatcccactggcattt

SEQ ID NO: 19386 - DNA, 22 bp, Artificial Sequence
  Synthetic Construct
gggctattggtctggcacacat

SEQ ID NO: 19387 - DNA, 22 bp, Artificial Sequence
  Synthetic Construct
ggtgggtgcttccactcatcat

SEQ ID NO: 19388 - DNA, 24 bp, Artificial Sequence
  Synthetic Construct
ctggctgttagactgtgatgaaga

SEQ ID NO: 19389 - DNA, 23 bp, Artificial Sequence
  Synthetic Construct
gcagcttggccttagaacctttc

SEQ ID NO: 19390 - DNA, 25 bp, Artificial Sequence
  Synthetic Construct
gggaaggctattttactgacccaaa

SEQ ID NO: 19391 - DNA, 24 bp, Artificial Sequence
  Synthetic Construct
cacccatacttgctgggttcaaca

SEQ ID NO: 19392 - DNA, 25 bp, Artificial Sequence
  Synthetic Construct
gaaaccaacctctcaatccatcaag

SEQ ID NO: 19393 - DNA, 25 bp, Artificial Sequence
  Synthetic Construct
gggctcaagctgttctatgcctaac

SEQ ID NO: 19394 - DNA, 24 bp, Artificial Sequence
  Synthetic Construct
gaccttacccagcagttcaagcat

SEQ ID NO: 19395 - DNA, 23 bp, Artificial Sequence
  Synthetic Construct
gccataatttcagggaggacgta

SEQ ID NO: 19396 - DNA, 21 bp, Artificial Sequence
  Synthetic Construct
acctggcctcaagtggtccat

SEQ ID NO: 19397 - DNA, 26 bp, Artificial Sequence
  Synthetic Construct
ggtctgtcttgcttttaactggattg

SEQ ID NO: 19398 - DNA, 22 bp, Artificial Sequence
  Synthetic Construct
tcctggctctgtgagcaactac

SEQ ID NO: 19399 - DNA, 22 bp, Artificial Sequence
  Synthetic Construct
gggcaaagcacagtcagtcatc

SEQ ID NO: 19400 - DNA, 24 bp, Artificial Sequence
  Synthetic Construct
gctgacaatgtcctgttgctgaca

SEQ ID NO: 19401 - DNA, 22 bp, Artificial Sequence
  Synthetic Construct
gctgagtgtcccagaagctaag

SEQ ID NO: 19402 - DNA, 22 bp, Artificial Sequence
  Synthetic Construct
gcctgactttgtatgcctggat

SEQ ID NO: 19403 - DNA, 22 bp, Artificial Sequence
  Synthetic Construct
gctgcttggttcacatgcttac

SEQ ID NO: 19404 - DNA, 20 bp, Artificial Sequence
  Synthetic Construct
gcagggagtctgctccttca

SEQ ID NO: 19405 - DNA, 24 bp, Artificial Sequence
  Synthetic Construct
ctagcctctgtttccagctttaca

SEQ ID NO: 19406 - DNA, 21 bp, Artificial Sequence
  Synthetic Construct
gggcgtcaattgcaactcttc

SEQ ID NO: 19407 - DNA, 22 bp, Artificial Sequence
  Synthetic Construct
gggattggggacctgcttcaaa

SEQ ID NO: 19408 - DNA, 22 bp, Artificial Sequence
  Synthetic Construct
actcccagatgcataggacact

SEQ ID NO: 19409 - DNA, 20 bp, Artificial Sequence
  Synthetic Construct
aaggtttggggacggtctca

SEQ ID NO: 19410 - DNA, 24 bp, Artificial Sequence
  Synthetic Construct
cactgcaacagtcacagtctaaca

SEQ ID NO: 19411 - DNA, 26 bp, Artificial Sequence
  Synthetic Construct
catccacagtccaggaataggatttt

SEQ ID NO: 19412 - DNA, 26 bp, Artificial Sequence
  Synthetic Construct
gctttgttctaggacattggctgttc

SEQ ID NO: 19413 - DNA, 25 bp, Artificial Sequence
  Synthetic Construct
gagccagtgttaaaatggcatgaga

SEQ ID NO: 19414 - DNA, 22 bp, Artificial Sequence
  Synthetic Construct
ggcaccaaaattccaacagcaa

SEQ ID NO: 19415 - DNA, 22 bp, Artificial Sequence
  Synthetic Construct
catgaacttggggcttgtgtca

SEQ ID NO: 19416 - DNA, 24 bp, Artificial Sequence
  Synthetic Construct
ctttgggcaaaacacacagacaag

SEQ ID NO: 19417 - DNA, 20 bp, Artificial Sequence
  Synthetic Construct
cccatctccagccccacaaa

SEQ ID NO: 19418 - DNA, 23 bp, Artificial Sequence
  Synthetic Construct
tgcagccaagtaactgactcttc

SEQ ID NO: 19419 - DNA, 25 bp, Artificial Sequence
  Synthetic Construct
gcagacctcttacatgaagtgaatg

SEQ ID NO: 19420 - DNA, 21 bp, Artificial Sequence
  Synthetic Construct
ctgtctcaggcaaagctggat

SEQ ID NO: 19421 - DNA, 26 bp, Artificial Sequence
  Synthetic Construct
ggcaagaatcagatagcacccacaaa

SEQ ID NO: 19422 - DNA, 25 bp, Artificial Sequence
  Synthetic Construct
ggcctaaggcatcctgtatcccaaa

SEQ ID NO: 19423 - DNA, 18 bp, Artificial Sequence
  Synthetic Construct
agatgcgggacccactga

SEQ ID NO: 19424 - DNA, 24 bp, Artificial Sequence
  Synthetic Construct
gccccatgactatcgtgtgaggtt

SEQ ID NO: 19425 - DNA, 22 bp, Artificial Sequence
  Synthetic Construct
gttaccgcagcagcatgtttac

SEQ ID NO: 19426 - DNA, 23 bp, Artificial Sequence
  Synthetic Construct
ccctacaaatgccagcagctttc

SEQ ID NO: 19427 - DNA, 26 bp, Artificial Sequence
  Synthetic Construct
cccggatattattagccagttagcaa

SEQ ID NO: 19428 - DNA, 27 bp, Artificial Sequence
  Synthetic Construct
gcatggaaagagaaatctggtgtggat

SEQ ID NO: 19429 - DNA, 24 bp, Artificial Sequence
  Synthetic Construct
cctggcagtgtatgaagaggcatt

SEQ ID NO: 19430 - DNA, 24 bp, Artificial Sequence
  Synthetic Construct
ggggagtgtgactgaaggaaaaac

SEQ ID NO: 19431 - DNA, 24 bp, Artificial Sequence
  Synthetic Construct
gcccaaaatggaccagttcaaaac

SEQ ID NO: 19432 - DNA, 20 bp, Artificial Sequence
  Synthetic Construct
tccaggcttgccccttctca

SEQ ID NO: 19433 - DNA, 24 bp, Artificial Sequence
  Synthetic Construct
gggtaatgccgagtagagaattga

SEQ ID NO: 19434 - DNA, 24 bp, Artificial Sequence
  Synthetic Construct
tgtcctttttcattggagggtaca

SEQ ID NO: 19435 - DNA, 22 bp, Artificial Sequence
  Synthetic Construct
tgccctctcctccctgcaaata

SEQ ID NO: 19436 - DNA, 22 bp, Artificial Sequence
  Synthetic Construct
cagctcccagtcacagtgtttc

SEQ ID NO: 19437 - DNA, 23 bp, Artificial Sequence
  Synthetic Construct
gtcatgtcccgctgttctgatgt

SEQ ID NO: 19438 - DNA, 25 bp, Artificial Sequence
  Synthetic Construct
acctggaagttaccagtctttgaac

SEQ ID NO: 19439 - DNA, 24 bp, Artificial Sequence
  Synthetic Construct
ctggaggtagagccttggactttc

SEQ ID NO: 19440 - DNA, 26 bp, Artificial Sequence
  Synthetic Construct
tccccaagagatgttagcttttctac

SEQ ID NO: 19441 - DNA, 22 bp, Artificial Sequence
  Synthetic Construct
cggacaggtttcatgcggagta

SEQ ID NO: 19442 - DNA, 26 bp, Artificial Sequence
  Synthetic Construct
ggtgtctttccagaggctttctcttc

SEQ ID NO: 19443 - DNA, 24 bp, Artificial Sequence
  Synthetic Construct
cgatccagagagatgctggcaaaa

SEQ ID NO: 19444 - DNA, 27 bp, Artificial Sequence
  Synthetic Construct
gaagctgtgtatcctaagagcactttc

SEQ ID NO: 19445 - DNA, 22 bp, Artificial Sequence
  Synthetic Construct
ggccctgaaatccagcaagatg

SEQ ID NO: 19446 - DNA, 22 bp, Artificial Sequence
  Synthetic Construct
ggagcagataacgggtccaatg

SEQ ID NO: 19447 - DNA, 20 bp, Artificial Sequence
  Synthetic Construct
tgtggaagcggggaaactga

SEQ ID NO: 19448 - DNA, 27 bp, Artificial Sequence
  Synthetic Construct
ggcctatggtagcaaccactgctataa

SEQ ID NO: 19449 - DNA, 25 bp, Artificial Sequence
  Synthetic Construct
ctctccggcgatgtaatttctggat

SEQ ID NO: 19450 - DNA, 27 bp, Artificial Sequence
  Synthetic Construct
tgctatagagagaggacaacttgagat

SEQ ID NO: 19451 - DNA, 23 bp, Artificial Sequence
  Synthetic Construct
ccacactcagcctagcattcaga

SEQ ID NO: 19452 - DNA, 24 bp, Artificial Sequence
  Synthetic Construct
cgttaaatcctcacacagttgctt

SEQ ID NO: 19453 - DNA, 22 bp, Artificial Sequence
  Synthetic Construct
ggcgaactcgctgtggtattgt

SEQ ID NO: 19454 - DNA, 22 bp, Artificial Sequence
  Synthetic Construct
caccttggccatgccaacattc

SEQ ID NO: 19455 - DNA, 25 bp, Artificial Sequence
  Synthetic Construct
aagcaggaggaataagtgtgaatga

SEQ ID NO: 19456 - DNA, 24 bp, Artificial Sequence
  Synthetic Construct
cctgccaatctcagcactttctct

SEQ ID NO: 19457 - DNA, 24 bp, Artificial Sequence
  Synthetic Construct
ggctttgcaggtcatacagcttct

SEQ ID NO: 19458 - DNA, 20 bp, Artificial Sequence
  Synthetic Construct
gggttgttgcctgcttgctt

SEQ ID NO: 19459 - DNA, 22 bp, Artificial Sequence
  Synthetic Construct
gcaggggtaagaagcagagaag

SEQ ID NO: 19460 - DNA, 26 bp, Artificial Sequence
  Synthetic Construct
ggctcacaacggaaaagagtatttct

SEQ ID NO: 19461 - DNA, 22 bp, Artificial Sequence
  Synthetic Construct
gcaagagtgctggaggaacaga

SEQ ID NO: 19462 - DNA, 27 bp, Artificial Sequence
  Synthetic Construct
gggcattaggacaaagtaggaggtact

SEQ ID NO: 19463 - DNA, 22 bp, Artificial Sequence
  Synthetic Construct
ccctgtaggccttggcatttct

SEQ ID NO: 19464 - DNA, 23 bp, Artificial Sequence
  Synthetic Construct
gctggcttttggtttcaagaaca

SEQ ID NO: 19465 - DNA, 25 bp, Artificial Sequence
  Synthetic Construct
ggaaggctgtgatttcattttggtt

SEQ ID NO: 19466 - DNA, 29 bp, Artificial Sequence
  Synthetic Construct
ctggtaagactaaataaccctcactcact

SEQ ID NO: 19467 - DNA, 26 bp, Artificial Sequence
  Synthetic Construct
caggatggttgtatgggtatacttga

SEQ ID NO: 19468 - DNA, 23 bp, Artificial Sequence
  Synthetic Construct
agtttgtctagggccatgctaag

SEQ ID NO: 19469 - DNA, 20 bp, Artificial Sequence
  Synthetic Construct
gcagggtcccgattcaatgt

SEQ ID NO: 19470 - DNA, 22 bp, Artificial Sequence
  Synthetic Construct
acttgcctctgctctcattgaa

SEQ ID NO: 19471 - DNA, 20 bp, Artificial Sequence
  Synthetic Construct
tctggaagccccagtgttgt

SEQ ID NO: 19472 - DNA, 23 bp, Artificial Sequence
  Synthetic Construct
agaaaagggcaagtccccataaa

SEQ ID NO: 19473 - DNA, 21 bp, Artificial Sequence
  Synthetic Construct
gcctagtggtaaagccccatt

SEQ ID NO: 19474 - DNA, 24 bp, Artificial Sequence
  Synthetic Construct
ctctctaccctctgtcagcacatc

SEQ ID NO: 19475 - DNA, 23 bp, Artificial Sequence
  Synthetic Construct
cccacttgcccatatccaagttt

SEQ ID NO: 19476 - DNA, 29 bp, Artificial Sequence
  Synthetic Construct
gggaaacgagtgacctctattattactca

SEQ ID NO: 19477 - DNA, 22 bp, Artificial Sequence
  Synthetic Construct
ggtggtttgagatgccaccttt

SEQ ID NO: 19478 - DNA, 23 bp, Artificial Sequence
  Synthetic Construct
ggtatgaccaggatggtgtggtt

SEQ ID NO: 19479 - DNA, 28 bp, Artificial Sequence
  Synthetic Construct
gggagaatacggaagaactattggattg

SEQ ID NO: 19480 - DNA, 26 bp, Artificial Sequence
  Synthetic Construct
ccatggtgagcattaaaacactctca

SEQ ID NO: 19481 - DNA, 23 bp, Artificial Sequence
  Synthetic Construct
acaagacccagtttctgccattc

SEQ ID NO: 19482 - DNA, 21 bp, Artificial Sequence
  Synthetic Construct
actcagccgttgtttgtggaa

SEQ ID NO: 19483 - DNA, 27 bp, Artificial Sequence
  Synthetic Construct
tctaggagctgatactcttctagtgaa

SEQ ID NO: 19484 - DNA, 22 bp, Artificial Sequence
  Synthetic Construct
tccatgcaccttggtggagaag

SEQ ID NO: 19485 - DNA, 23 bp, Artificial Sequence
  Synthetic Construct
gatccttgttggcttctcaccta

SEQ ID NO: 19486 - DNA, 26 bp, Artificial Sequence
  Synthetic Construct
acagaccaactggatctttcacatac

SEQ ID NO: 19487 - DNA, 23 bp, Artificial Sequence
  Synthetic Construct
gagcagactgccattgtgcctat

SEQ ID NO: 19488 - DNA, 24 bp, Artificial Sequence
  Synthetic Construct
gaaagaaggccagatgtgtgacta

SEQ ID NO: 19489 - DNA, 27 bp, Artificial Sequence
  Synthetic Construct
gcagccaagattctaagtctgtctgaa

SEQ ID NO: 19490 - DNA, 26 bp, Artificial Sequence
  Synthetic Construct
gtggtatagggctcagatacaagaag

SEQ ID NO: 19491 - DNA, 24 bp, Artificial Sequence
  Synthetic Construct
cctgtttcatgccagccaatgttc

SEQ ID NO: 19492 - DNA, 26 bp, Artificial Sequence
  Synthetic Construct
caggtgacatccagggacaaataaag

SEQ ID NO: 19493 - DNA, 22 bp, Artificial Sequence
  Synthetic Construct
ccctggggagctatggaactga

SEQ ID NO: 19494 - DNA, 23 bp, Artificial Sequence
  Synthetic Construct
gaaccccaatttgctcaggtgtt

SEQ ID NO: 19495 - DNA, 24 bp, Artificial Sequence
  Synthetic Construct
gaatgaccccatactgtggtttgt

SEQ ID NO: 19496 - DNA, 22 bp, Artificial Sequence
  Synthetic Construct
ctgatgcagctgggcttctaac

SEQ ID NO: 19497 - DNA, 28 bp, Artificial Sequence
  Synthetic Construct
gggaatctgaagtccaaaacatggtaag

SEQ ID NO: 19498 - DNA, 28 bp, Artificial Sequence
  Synthetic Construct
cctcctaacggccaaatagaacatgtag

SEQ ID NO: 19499 - DNA, 25 bp, Artificial Sequence
  Synthetic Construct
gccttctattgatccttcacccaaa

SEQ ID NO: 19500 - DNA, 26 bp, Artificial Sequence
  Synthetic Construct
gtgtttgagaagacccttggaaaagt

SEQ ID NO: 19501 - DNA, 23 bp, Artificial Sequence
  Synthetic Construct
acacccagcaaatgaagcaatct

SEQ ID NO: 19502 - DNA, 22 bp, Artificial Sequence
  Synthetic Construct
cagatccgtcaggctcaacact

SEQ ID NO: 19503 - DNA, 24 bp, Artificial Sequence
  Synthetic Construct
ggaggtgggtacagagaaaagcta

SEQ ID NO: 19504 - DNA, 23 bp, Artificial Sequence
  Synthetic Construct
ctgttggtttcgagcaaacacat

SEQ ID NO: 19505 - DNA, 26 bp, Artificial Sequence
  Synthetic Construct
ggaaggctccaataacaccatgagat

SEQ ID NO: 19506 - DNA, 22 bp, Artificial Sequence
  Synthetic Construct
gagaagatcaccaagggcaact

SEQ ID NO: 19507 - DNA, 23 bp, Artificial Sequence
  Synthetic Construct
ctcatcaccattgacgtcctaca

SEQ ID NO: 19508 - DNA, 21 bp, Artificial Sequence
  Synthetic Construct
gggcctgtttgcctctctgaa

SEQ ID NO: 19509 - DNA, 20 bp, Artificial Sequence
  Synthetic Construct
actctctccgacctgcatct

SEQ ID NO: 19510 - DNA, 24 bp, Artificial Sequence
  Synthetic Construct
cccttcactctgtgaattccttct

SEQ ID NO: 19511 - DNA, 23 bp, Artificial Sequence
  Synthetic Construct
cctgtcagtagcagtccctcaaa

SEQ ID NO: 19512 - DNA, 24 bp, Artificial Sequence
  Synthetic Construct
gagcgatttccagggaaacacaga

SEQ ID NO: 19513 - DNA, 26 bp, Artificial Sequence
  Synthetic Construct
cctacaccaacactgtttctccacaa

SEQ ID NO: 19514 - DNA, 23 bp, Artificial Sequence
  Synthetic Construct
gcccagcccatctgttttaccaa

SEQ ID NO: 19515 - DNA, 24 bp, Artificial Sequence
  Synthetic Construct
ctgactgcatggacacttcctgtt

SEQ ID NO: 19516 - DNA, 26 bp, Artificial Sequence
  Synthetic Construct
ctgggtatgatgtttatgggtgagta

SEQ ID NO: 19517 - DNA, 27 bp, Artificial Sequence
  Synthetic Construct
cgaaacatttaaatcggctctgtgaac

SEQ ID NO: 19518 - DNA, 26 bp, Artificial Sequence
  Synthetic Construct
aagtcccagtgatctgttagagaaag

SEQ ID NO: 19519 - DNA, 24 bp, Artificial Sequence
  Synthetic Construct
acctgatgtttcaagagctggtta

SEQ ID NO: 19520 - DNA, 24 bp, Artificial Sequence
  Synthetic Construct
gagttctggcagtctgtgttttca

SEQ ID NO: 19521 - DNA, 25 bp, Artificial Sequence
  Synthetic Construct
gcctgttactcttggagacagagtt

SEQ ID NO: 19522 - DNA, 22 bp, Artificial Sequence
  Synthetic Construct
cacccaggctttctggcagatt

SEQ ID NO: 19523 - DNA, 27 bp, Artificial Sequence
  Synthetic Construct
cgtgccacaatagtttttagagggttt

SEQ ID NO: 19524 - DNA, 20 bp, Artificial Sequence
  Synthetic Construct
ttaccgcgtccggaacttca

SEQ ID NO: 19525 - DNA, 22 bp, Artificial Sequence
  Synthetic Construct
ggcatgcaagtcaagagtcaag

SEQ ID NO: 19526 - DNA, 26 bp, Artificial Sequence
  Synthetic Construct
agtaagagagggaagggatattgcat

SEQ ID NO: 19527 - DNA, 21 bp, Artificial Sequence
  Synthetic Construct
gccctctacccctctctgcaa

SEQ ID NO: 19528 - DNA, 25 bp, Artificial Sequence
  Synthetic Construct
ggaattcagtctgtacaagggatca

SEQ ID NO: 19529 - DNA, 23 bp, Artificial Sequence
  Synthetic Construct
gcacgtccaaatcttgctcaatc

SEQ ID NO: 19530 - DNA, 27 bp, Artificial Sequence
  Synthetic Construct
ccacactgcatttggaatttggtattg

SEQ ID NO: 19531 - DNA, 28 bp, Artificial Sequence
  Synthetic Construct
gacacctgactccctaaaagaaacttga

SEQ ID NO: 19532 - DNA, 24 bp, Artificial Sequence
  Synthetic Construct
ggccctccagaataagtgtgaaga

SEQ ID NO: 19533 - DNA, 22 bp, Artificial Sequence
  Synthetic Construct
ccacttctacctggccgatttc

SEQ ID NO: 19534 - DNA, 21 bp, Artificial Sequence
  Synthetic Construct
agagggctagagggctgaaat

SEQ ID NO: 19535 - DNA, 21 bp, Artificial Sequence
  Synthetic Construct
agtgtccatccagtccacgta

SEQ ID NO: 19536 - DNA, 24 bp, Artificial Sequence
  Synthetic Construct
tcttcccacacgtttatggacaat

SEQ ID NO: 19537 - DNA, 24 bp, Artificial Sequence
  Synthetic Construct
gcaaaacagacaggcagccaatag

SEQ ID NO: 19538 - DNA, 25 bp, Artificial Sequence
  Synthetic Construct
cctgtgctgctagactcaccagtaa

SEQ ID NO: 19539 - DNA, 24 bp, Artificial Sequence
  Synthetic Construct
ccctatacggcttcaccaaaaagt

SEQ ID NO: 19540 - DNA, 25 bp, Artificial Sequence
  Synthetic Construct
ggcagttctcaacttgcagtaatag

SEQ ID NO: 19541 - DNA, 25 bp, Artificial Sequence
  Synthetic Construct
gcatgaaaggggctaaggtcctagt

SEQ ID NO: 19542 - DNA, 22 bp, Artificial Sequence
  Synthetic Construct
ggcattgcaccatcccctaaga

SEQ ID NO: 19543 - DNA, 22 bp, Artificial Sequence
  Synthetic Construct
cagaggcagcttggagtactga

SEQ ID NO: 19544 - DNA, 22 bp, Artificial Sequence
  Synthetic Construct
ctgggtttctgggttccctttc

SEQ ID NO: 19545 - DNA, 26 bp, Artificial Sequence
  Synthetic Construct
gggtttagggacagaattcaactttc

SEQ ID NO: 19546 - DNA, 24 bp, Artificial Sequence
  Synthetic Construct
gggaggctaagtgatacacacaca

SEQ ID NO: 19547 - DNA, 24 bp, Artificial Sequence
  Synthetic Construct
ctccaccaaagcgattaggagact

SEQ ID NO: 19548 - DNA, 24 bp, Artificial Sequence
  Synthetic Construct
gggtgaccaaagacggaaagtaga

SEQ ID NO: 19549 - DNA, 25 bp, Artificial Sequence
  Synthetic Construct
ctccaagaggtttccctagttgtga

SEQ ID NO: 19550 - DNA, 22 bp, Artificial Sequence
  Synthetic Construct
gtcctgcctggattgggctttt

SEQ ID NO: 19551 - DNA, 23 bp, Artificial Sequence
  Synthetic Construct
ggtgggcttcatgctagggtttt

SEQ ID NO: 19552 - DNA, 24 bp, Artificial Sequence
  Synthetic Construct
tgatagtgaggagccaagatcact

SEQ ID NO: 19553 - DNA, 24 bp, Artificial Sequence
  Synthetic Construct
gcaaaagatgcctgtggacaaaga

SEQ ID NO: 19554 - DNA, 23 bp, Artificial Sequence
  Synthetic Construct
tgcattcttcccagtggagaaac

SEQ ID NO: 19555 - DNA, 30 bp, Artificial Sequence
  Synthetic Construct
ctcgtacagtactcttgggtgtaaaaattg

SEQ ID NO: 19556 - DNA, 22 bp, Artificial Sequence
  Synthetic Construct
tgggtgtttagtccctgagagt

SEQ ID NO: 19557 - DNA, 22 bp, Artificial Sequence
  Synthetic Construct
gctgggagaagggtttgtgtca

SEQ ID NO: 19558 - DNA, 24 bp, Artificial Sequence
  Synthetic Construct
ggcctaatcaggaatggcttcttc

SEQ ID NO: 19559 - DNA, 24 bp, Artificial Sequence
  Synthetic Construct
gccagtcactcacacttgggctat

SEQ ID NO: 19560 - DNA, 20 bp, Artificial Sequence
  Synthetic Construct
aggggaagtccttgccttga

SEQ ID NO: 19561 - DNA, 24 bp, Artificial Sequence
  Synthetic Construct
ggtgaaaggtgacttgtggtctga

SEQ ID NO: 19562 - DNA, 27 bp, Artificial Sequence
  Synthetic Construct
cagcatttctaaccttgtttcccaatc

SEQ ID NO: 19563 - DNA, 20 bp, Artificial Sequence
  Synthetic Construct
agcctgtgagctgggttttg

SEQ ID NO: 19564 - DNA, 23 bp, Artificial Sequence
  Synthetic Construct
ctgccatgacagcccatttctca

SEQ ID NO: 19565 - DNA, 20 bp, Artificial Sequence
  Synthetic Construct
ggacgcgcaaaggtgttttc

SEQ ID NO: 19566 - DNA, 23 bp, Artificial Sequence
  Synthetic Construct
cggcagccaaaatatagcagaga

SEQ ID NO: 19567 - DNA, 21 bp, Artificial Sequence
  Synthetic Construct
gccagaagatgctggcaaaaa

SEQ ID NO: 19568 - DNA, 21 bp, Artificial Sequence
  Synthetic Construct
tgagctggtactggtgtctct

SEQ ID NO: 19569 - DNA, 23 bp, Artificial Sequence
  Synthetic Construct
acaattgccctgaagttgtgtca

SEQ ID NO: 19570 - DNA, 20 bp, Artificial Sequence
  Synthetic Construct
cccgctgattcagggactct

SEQ ID NO: 19571 - DNA, 22 bp, Artificial Sequence
  Synthetic Construct
gcgtgtttgaaccaacatctga

SEQ ID NO: 19572 - DNA, 25 bp, Artificial Sequence
  Synthetic Construct
gccctaacacctacaaacccctttt

SEQ ID NO: 19573 - DNA, 26 bp, Artificial Sequence
  Synthetic Construct
cctgtggtttagcttctgtgttccat

SEQ ID NO: 19574 - DNA, 27 bp, Artificial Sequence
  Synthetic Construct
gcaaaccagaaactagagaaaggtatc

SEQ ID NO: 19575 - DNA, 30 bp, Artificial Sequence
  Synthetic Construct
gtcattgctcttctgtaatcctcagttttc

SEQ ID NO: 19576 - DNA, 22 bp, Artificial Sequence
  Synthetic Construct
ccaccatcagggagaagggata

SEQ ID NO: 19577 - DNA, 27 bp, Artificial Sequence
  Synthetic Construct
cgtccctaaaaccatcttccttcttca

SEQ ID NO: 19578 - DNA, 21 bp, Artificial Sequence
  Synthetic Construct
ccctctgcatgcgtgtctatc

SEQ ID NO: 19579 - DNA, 24 bp, Artificial Sequence
  Synthetic Construct
gccaacagtgtagtggacacaagt

SEQ ID NO: 19580 - DNA, 25 bp, Artificial Sequence
  Synthetic Construct
ctttgctaatcaaccctcagcaact

SEQ ID NO: 19581 - DNA, 21 bp, Artificial Sequence
  Synthetic Construct
ccagactccctcccagctaga

SEQ ID NO: 19582 - DNA, 24 bp, Artificial Sequence
  Synthetic Construct
ctcagtcctgaacaggtcaccatt

SEQ ID NO: 19583 - DNA, 24 bp, Artificial Sequence
  Synthetic Construct
gaccaccacactgatgtcaagaga

SEQ ID NO: 19584 - DNA, 28 bp, Artificial Sequence
  Synthetic Construct
cctaatggacctaactcaagagtcatag

SEQ ID NO: 19585 - DNA, 24 bp, Artificial Sequence
  Synthetic Construct
tcagccatgacagaagcaaatcta

SEQ ID NO: 19586 - DNA, 24 bp, Artificial Sequence
  Synthetic Construct
ccagtgataagcagctgggatttg

SEQ ID NO: 19587 - DNA, 24 bp, Artificial Sequence
  Synthetic Construct
ggcttgtatgtggactgcaaggtt

SEQ ID NO: 19588 - DNA, 23 bp, Artificial Sequence
  Synthetic Construct
gtctccagctcaatgcaaaggat

SEQ ID NO: 19589 - DNA, 25 bp, Artificial Sequence
  Synthetic Construct
ggtcagagaaggggagttggaaaac

SEQ ID NO: 19590 - DNA, 20 bp, Artificial Sequence
  Synthetic Construct
tgggctccaagaggcaacaa

SEQ ID NO: 19591 - DNA, 28 bp, Artificial Sequence
  Synthetic Construct
cccattctcagtatagggtttccactca

SEQ ID NO: 19592 - DNA, 27 bp, Artificial Sequence
  Synthetic Construct
ccctttgcatcaaatctatcaggaagt

SEQ ID NO: 19593 - DNA, 23 bp, Artificial Sequence
  Synthetic Construct
ccctcaaaacaatggagctggaa

SEQ ID NO: 19594 - DNA, 23 bp, Artificial Sequence
  Synthetic Construct
cattcctgctggtcttggttagt

SEQ ID NO: 19595 - DNA, 22 bp, Artificial Sequence
  Synthetic Construct
gttctgggccacgacatagaga

SEQ ID NO: 19596 - DNA, 23 bp, Artificial Sequence
  Synthetic Construct
ggctggttgtcttgaggaaatgt

SEQ ID NO: 19597 - DNA, 22 bp, Artificial Sequence
  Synthetic Construct
ggcccttgagaaggtgaaggat

SEQ ID NO: 19598 - DNA, 26 bp, Artificial Sequence
  Synthetic Construct
gcatcagtttccctttctctggttga

SEQ ID NO: 19599 - DNA, 26 bp, Artificial Sequence
  Synthetic Construct
gccctgtggaaagattctaacagttc

SEQ ID NO: 19600 - DNA, 22 bp, Artificial Sequence
  Synthetic Construct
gcaccacactttcccgagtgta

SEQ ID NO: 19601 - DNA, 22 bp, Artificial Sequence
  Synthetic Construct
ccccacaactactcccctttct

SEQ ID NO: 19602 - DNA, 25 bp, Artificial Sequence
  Synthetic Construct
gccttgacaaactgaattccagaga

SEQ ID NO: 19603 - DNA, 22 bp, Artificial Sequence
  Synthetic Construct
ggcagtagcatcaccagagaag

SEQ ID NO: 19604 - DNA, 25 bp, Artificial Sequence
  Synthetic Construct
tgcttagtggtcatcttttccttga

SEQ ID NO: 19605 - DNA, 24 bp, Artificial Sequence
  Synthetic Construct
ccaaagtcagagcagggaagttca

SEQ ID NO: 19606 - DNA, 29 bp, Artificial Sequence
  Synthetic Construct
ggctacacagaacctatataaccatcttg

SEQ ID NO: 19607 - DNA, 27 bp, Artificial Sequence
  Synthetic Construct
gtgaggtcaaatcatagacaggtggaa

SEQ ID NO: 19608 - DNA, 30 bp, Artificial Sequence
  Synthetic Construct
cggtagatctgaacaaccaaaagatgcaaa

SEQ ID NO: 19609 - DNA, 27 bp, Artificial Sequence
  Synthetic Construct
ccttgttaggcaaatgatgcagtcttc

SEQ ID NO: 19610 - DNA, 26 bp, Artificial Sequence
  Synthetic Construct
ggagactgaatgagaatcaaggttgt

SEQ ID NO: 19611 - DNA, 24 bp, Artificial Sequence
  Synthetic Construct
ctgacacttgcctcctccatgaaa

SEQ ID NO: 19612 - DNA, 21 bp, Artificial Sequence
  Synthetic Construct
acctgtcacgtagggctgctt

SEQ ID NO: 19613 - DNA, 24 bp, Artificial Sequence
  Synthetic Construct
cgtgtgctttaggctcctctgaaa

SEQ ID NO: 19614 - DNA, 27 bp, Artificial Sequence
  Synthetic Construct
gaagatgagctgaatagcagtcaaaca

SEQ ID NO: 19615 - DNA, 27 bp, Artificial Sequence
  Synthetic Construct
cgctcagattaggtgatcagaagcatt

SEQ ID NO: 19616 - DNA, 23 bp, Artificial Sequence
  Synthetic Construct
ctgtggctgtacacaaggactca

SEQ ID NO: 19617 - DNA, 28 bp, Artificial Sequence
  Synthetic Construct
gacctttatacgaagtcccttccctttg

SEQ ID NO: 19618 - DNA, 27 bp, Artificial Sequence
  Synthetic Construct
gtgtactaaatcccaactctccttaca

SEQ ID NO: 19619 - DNA, 28 bp, Artificial Sequence
  Synthetic Construct
ggtagcgattctcaaatcacatggaaag

SEQ ID NO: 19620 - DNA, 19 bp, Artificial Sequence
  Synthetic Construct
ggtcaactgagcggagcat

SEQ ID NO: 19621 - DNA, 25 bp, Artificial Sequence
  Synthetic Construct
gttctcccaccaaaaattccacttc

SEQ ID NO: 19622 - DNA, 22 bp, Artificial Sequence
  Synthetic Construct
agcaagccaatccgggaagaag

SEQ ID NO: 19623 - DNA, 26 bp, Artificial Sequence
  Synthetic Construct
ccaagagcataaccacagaggtcctt

SEQ ID NO: 19624 - DNA, 24 bp, Artificial Sequence
  Synthetic Construct
gcagttcatggcaggattttgaac

SEQ ID NO: 19625 - DNA, 24 bp, Artificial Sequence
  Synthetic Construct
gccatagctggagattggacttac

SEQ ID NO: 19626 - DNA, 22 bp, Artificial Sequence
  Synthetic Construct
ggttgctcgcagagagatggaa

SEQ ID NO: 19627 - DNA, 22 bp, Artificial Sequence
  Synthetic Construct
ccacctgaaccgtctgttccat

SEQ ID NO: 19628 - DNA, 26 bp, Artificial Sequence
  Synthetic Construct
cagaggagaaatgtgtggaacccaat

SEQ ID NO: 19629 - DNA, 20 bp, Artificial Sequence
  Synthetic Construct
gggctgtgaaaggcttctct

SEQ ID NO: 19630 - DNA, 22 bp, Artificial Sequence
  Synthetic Construct
ccttgacggttgaacgggagtt

SEQ ID NO: 19631 - DNA, 26 bp, Artificial Sequence
  Synthetic Construct
cttggtccacatttaaggcacttttc

SEQ ID NO: 19632 - DNA, 20 bp, Artificial Sequence
  Synthetic Construct
ggccctgaacacacatgcta

SEQ ID NO: 19633 - DNA, 22 bp, Artificial Sequence
  Synthetic Construct
catctacatggcagggaagtgt

SEQ ID NO: 19634 - DNA, 23 bp, Artificial Sequence
  Synthetic Construct
gcatcttaagtgccacaggttgt

SEQ ID NO: 19635 - DNA, 22 bp, Artificial Sequence
  Synthetic Construct
ggtgaggatgctaccccaactt

SEQ ID NO: 19636 - DNA, 25 bp, Artificial Sequence
  Synthetic Construct
ctggccacattccggaaatataaac

SEQ ID NO: 19637 - DNA, 26 bp, Artificial Sequence
  Synthetic Construct
gagactaggtctcccttacatttgtt

SEQ ID NO: 19638 - DNA, 24 bp, Artificial Sequence
  Synthetic Construct
ggctaattggctggatccctcact

SEQ ID NO: 19639 - DNA, 28 bp, Artificial Sequence
  Synthetic Construct
gtgacctgctaaagaaatacagcctaca

SEQ ID NO: 19640 - DNA, 19 bp, Artificial Sequence
  Synthetic Construct
cagatcggcagccaacaga

SEQ ID NO: 19641 - DNA, 24 bp, Artificial Sequence
  Synthetic Construct
ctgtggttgtgagaagggctatac

SEQ ID NO: 19642 - DNA, 22 bp, Artificial Sequence
  Synthetic Construct
gcagacctttgggcctagagaa

SEQ ID NO: 19643 - DNA, 29 bp, Artificial Sequence
  Synthetic Construct
gggatccaaacttactcttttgcatgtga

SEQ ID NO: 19644 - DNA, 27 bp, Artificial Sequence
  Synthetic Construct
ggcaaaggatgatatagaggagtccaa

SEQ ID NO: 19645 - DNA, 23 bp, Artificial Sequence
  Synthetic Construct
gcctggaatagaggcttgtggaa

SEQ ID NO: 19646 - DNA, 22 bp, Artificial Sequence
  Synthetic Construct
ctcctgtggagcctccttttca

SEQ ID NO: 19647 - DNA, 21 bp, Artificial Sequence
  Synthetic Construct
gccagttgggagccagaacaa

SEQ ID NO: 19648 - DNA, 21 bp, Artificial Sequence
  Synthetic Construct
ggagggttgctgttgctctga

SEQ ID NO: 19649 - DNA, 27 bp, Artificial Sequence
  Synthetic Construct
cacccaggggtatagaagtgtttcttc

SEQ ID NO: 19650 - DNA, 25 bp, Artificial Sequence
  Synthetic Construct
tcttactagcaaaacaaggggttca

SEQ ID NO: 19651 - DNA, 24 bp, Artificial Sequence
  Synthetic Construct
gctgtataagctccacctcccaat

SEQ ID NO: 19652 - DNA, 22 bp, Artificial Sequence
  Synthetic Construct
gcacccttagcacagggttcaa

SEQ ID NO: 19653 - DNA, 21 bp, Artificial Sequence
  Synthetic Construct
aggccctatacgcccctgttt

SEQ ID NO: 19654 - DNA, 21 bp, Artificial Sequence
  Synthetic Construct
ggaggacatgacccgaacctt

SEQ ID NO: 19655 - DNA, 25 bp, Artificial Sequence
  Synthetic Construct
ggaaaagcctaactaagctctcgat

SEQ ID NO: 19656 - DNA, 28 bp, Artificial Sequence
  Synthetic Construct
gactgtgactggatctggattttagaca

SEQ ID NO: 19657 - DNA, 23 bp, Artificial Sequence
  Synthetic Construct
gagagcctgtgatgaggaagaca

SEQ ID NO: 19658 - DNA, 23 bp, Artificial Sequence
  Synthetic Construct
tcagcagcttcccagagataaac

SEQ ID NO: 19659 - DNA, 23 bp, Artificial Sequence
  Synthetic Construct
ctcctttgctcgaagtcgacagt

SEQ ID NO: 19660 - DNA, 22 bp, Artificial Sequence
  Synthetic Construct
gcaggctgtagctcatcctatg

SEQ ID NO: 19661 - DNA, 23 bp, Artificial Sequence
  Synthetic Construct
gtgagtgactccatgtccacaga

SEQ ID NO: 19662 - DNA, 22 bp, Artificial Sequence
  Synthetic Construct
gccacacacgtccctgatgaaa

SEQ ID NO: 19663 - DNA, 21 bp, Artificial Sequence
  Synthetic Construct
tcaacgcaaagggcactaact

SEQ ID NO: 19664 - DNA, 25 bp, Artificial Sequence
  Synthetic Construct
ggcaacccagtcacagataatcttc

SEQ ID NO: 19665 - DNA, 22 bp, Artificial Sequence
  Synthetic Construct
ccagtaccaaagaagccgctat

SEQ ID NO: 19666 - DNA, 21 bp, Artificial Sequence
  Synthetic Construct
tgcagcgattttggggaatga

SEQ ID NO: 19667 - DNA, 23 bp, Artificial Sequence
  Synthetic Construct
tgaaacagcctctgctccttatc

SEQ ID NO: 19668 - DNA, 22 bp, Artificial Sequence
  Synthetic Construct
ccagctgttctctcagctcttc

SEQ ID NO: 19669 - DNA, 25 bp, Artificial Sequence
  Synthetic Construct
tgggttggaaggagaagatgttaga

SEQ ID NO: 19670 - DNA, 24 bp, Artificial Sequence
  Synthetic Construct
ccgggtgttcacagctttagtttc

SEQ ID NO: 19671 - DNA, 25 bp, Artificial Sequence
  Synthetic Construct
ggctctgagagtcttccttatgtga

SEQ ID NO: 19672 - DNA, 21 bp, Artificial Sequence
  Synthetic Construct
ccctccaatggctttccatca

SEQ ID NO: 19673 - DNA, 22 bp, Artificial Sequence
  Synthetic Construct
agagagcatgtgtgagcttgtt

SEQ ID NO: 19674 - DNA, 23 bp, Artificial Sequence
  Synthetic Construct
gctaggagaaagcaggtggaaga

SEQ ID NO: 19675 - DNA, 22 bp, Artificial Sequence
  Synthetic Construct
gccaaggaacacacagcaagtt

SEQ ID NO: 19676 - DNA, 25 bp, Artificial Sequence
  Synthetic Construct
cctcattctcactgttggacgttct

SEQ ID NO: 19677 - DNA, 24 bp, Artificial Sequence
  Synthetic Construct
ctctgcctactttcttgtggcaaa

SEQ ID NO: 19678 - DNA, 23 bp, Artificial Sequence
  Synthetic Construct
cctcatacctaggtgcagagaca

SEQ ID NO: 19679 - DNA, 21 bp, Artificial Sequence
  Synthetic Construct
gctctgtcaatacccctgcaa

SEQ ID NO: 19680 - DNA, 23 bp, Artificial Sequence
  Synthetic Construct
gtgctgcatcaaggagtctgaag

SEQ ID NO: 19681 - DNA, 20 bp, Artificial Sequence
  Synthetic Construct
agcctgagttccagcctttg

SEQ ID NO: 19682 - DNA, 26 bp, Artificial Sequence
  Synthetic Construct
cccacctctccaaataaaggagattc

SEQ ID NO: 19683 - DNA, 27 bp, Artificial Sequence
  Synthetic Construct
ggccatcctcttcatttcagatcagtt

SEQ ID NO: 19684 - DNA, 24 bp, Artificial Sequence
  Synthetic Construct
cagagagtcctcgaatttggtgaa

SEQ ID NO: 19685 - DNA, 21 bp, Artificial Sequence
  Synthetic Construct
gaagcaactggagcaggctta

SEQ ID NO: 19686 - DNA, 25 bp, Artificial Sequence
  Synthetic Construct
tggccaatgagataaaaggagttga

SEQ ID NO: 19687 - DNA, 30 bp, Artificial Sequence
  Synthetic Construct
gagaggatgagcaatagttaaagagactga

SEQ ID NO: 19688 - DNA, 23 bp, Artificial Sequence
  Synthetic Construct
cgatgagacaaataccggctgaa

SEQ ID NO: 19689 - DNA, 24 bp, Artificial Sequence
  Synthetic Construct
ccaactctgaaaggtgctgtggaa

SEQ ID NO: 19690 - DNA, 25 bp, Artificial Sequence
  Synthetic Construct
cgtgttgctaggtactgggattcat

SEQ ID NO: 19691 - DNA, 23 bp, Artificial Sequence
  Synthetic Construct
ggagcctttgatggactggcatt

SEQ ID NO: 19692 - DNA, 22 bp, Artificial Sequence
  Synthetic Construct
agagctggtgagagaggagtca

SEQ ID NO: 19693 - DNA, 25 bp, Artificial Sequence
  Synthetic Construct
ccactctcgggtgaaccagtacata

SEQ ID NO: 19694 - DNA, 27 bp, Artificial Sequence
  Synthetic Construct
gtgttccttctggaccctgaattctaa

SEQ ID NO: 19695 - DNA, 25 bp, Artificial Sequence
  Synthetic Construct
gagtcctacttctgctaggacattg

SEQ ID NO: 19696 - DNA, 22 bp, Artificial Sequence
  Synthetic Construct
accacaaccatcccagccattc

SEQ ID NO: 19697 - DNA, 26 bp, Artificial Sequence
  Synthetic Construct
ctgttatctgcttcacacctccttct

SEQ ID NO: 19698 - DNA, 25 bp, Artificial Sequence
  Synthetic Construct
cagcaagagaaatagcccgatccat

SEQ ID NO: 19699 - DNA, 27 bp, Artificial Sequence
  Synthetic Construct
cagttatagagggacaaactgctcaca

SEQ ID NO: 19700 - DNA, 25 bp, Artificial Sequence
  Synthetic Construct
gcagtggttggtttcatctttcact

SEQ ID NO: 19701 - DNA, 28 bp, Artificial Sequence
  Synthetic Construct
ctggagttccttggatttctacagtgtt

SEQ ID NO: 19702 - DNA, 23 bp, Artificial Sequence
  Synthetic Construct
cctacactctgccctccttatct

SEQ ID NO: 19703 - DNA, 26 bp, Artificial Sequence
  Synthetic Construct
caagtaagtctggtgtcagcagtaac

SEQ ID NO: 19704 - DNA, 20 bp, Artificial Sequence
  Synthetic Construct
cgtgttggtgccatgtgctt

SEQ ID NO: 19705 - DNA, 27 bp, Artificial Sequence
  Synthetic Construct
ccacattgccaataaaaggtccctgaa

SEQ ID NO: 19706 - DNA, 22 bp, Artificial Sequence
  Synthetic Construct
ggagacagcagggtctgagaga

SEQ ID NO: 19707 - DNA, 21 bp, Artificial Sequence
  Synthetic Construct
ccctggctccaaccctaaact

SEQ ID NO: 19708 - DNA, 23 bp, Artificial Sequence
  Synthetic Construct
cccttggtaatgcttgccctaga

SEQ ID NO: 19709 - DNA, 22 bp, Artificial Sequence
  Synthetic Construct
gttagccagactggaggctaag

SEQ ID NO: 19710 - DNA, 25 bp, Artificial Sequence
  Synthetic Construct
gaattacagcctgctgtgcattaaa

SEQ ID NO: 19711 - DNA, 23 bp, Artificial Sequence
  Synthetic Construct
ggggagggagtactcacagcaat

SEQ ID NO: 19712 - DNA, 26 bp, Artificial Sequence
  Synthetic Construct
gcattgggtcttttaccagtgaccaa

SEQ ID NO: 19713 - DNA, 26 bp, Artificial Sequence
  Synthetic Construct
cactgcacacaatcaggtttatgctt

SEQ ID NO: 19714 - DNA, 23 bp, Artificial Sequence
  Synthetic Construct
gggagctgagacttgccctaatc

SEQ ID NO: 19715 - DNA, 21 bp, Artificial Sequence
  Synthetic Construct
gctgggtgagaggggaagaga

SEQ ID NO: 19716 - DNA, 22 bp, Artificial Sequence
  Synthetic Construct
gccccaggctgttattccaatg

SEQ ID NO: 19717 - DNA, 24 bp, Artificial Sequence
  Synthetic Construct
gtgtccctgctaccctggatttac

SEQ ID NO: 19718 - DNA, 26 bp, Artificial Sequence
  Synthetic Construct
catcctttctcctagactggcaaaga

SEQ ID NO: 19719 - DNA, 20 bp, Artificial Sequence
  Synthetic Construct
tgcataaagggcggcagtag

SEQ ID NO: 19720 - DNA, 23 bp, Artificial Sequence
  Synthetic Construct
ctgtgtttgcatccactccctaa

SEQ ID NO: 19721 - DNA, 23 bp, Artificial Sequence
  Synthetic Construct
gttaaagtgccgtgagcgattag

SEQ ID NO: 19722 - DNA, 22 bp, Artificial Sequence
  Synthetic Construct
ggcaacactggtagcaccgtaa

SEQ ID NO: 19723 - DNA, 26 bp, Artificial Sequence
  Synthetic Construct
agttgggcagattgaagtaaccttag

SEQ ID NO: 19724 - DNA, 22 bp, Artificial Sequence
  Synthetic Construct
agctcgattccctgtgcagttc

SEQ ID NO: 19725 - DNA, 23 bp, Artificial Sequence
  Synthetic Construct
agggccaattttgttccactact

SEQ ID NO: 19726 - DNA, 23 bp, Artificial Sequence
  Synthetic Construct
agaaaggcaagcattccaagcta

SEQ ID NO: 19727 - DNA, 20 bp, Artificial Sequence
  Synthetic Construct
agcgtcgaacacaccacaga

SEQ ID NO: 19728 - DNA, 24 bp, Artificial Sequence
  Synthetic Construct
ggcatccagggagatgtgggaaat

SEQ ID NO: 19729 - DNA, 22 bp, Artificial Sequence
  Synthetic Construct
cccagcccaatcaggctaaact

SEQ ID NO: 19730 - DNA, 24 bp, Artificial Sequence
  Synthetic Construct
cctacagaactactggccaaggat

SEQ ID NO: 19731 - DNA, 25 bp, Artificial Sequence
  Synthetic Construct
ttcttaatgtgtcagcagagagtca

SEQ ID NO: 19732 - DNA, 23 bp, Artificial Sequence
  Synthetic Construct
gcactggaaagcagcttggtaga

SEQ ID NO: 19733 - DNA, 26 bp, Artificial Sequence
  Synthetic Construct
gtgtggaggggtaaagtagggattct

SEQ ID NO: 19734 - DNA, 25 bp, Artificial Sequence
  Synthetic Construct
tcccattgtgtttctcaggaaagat

SEQ ID NO: 19735 - DNA, 26 bp, Artificial Sequence
  Synthetic Construct
cgataatccaacccaaagcagaaact

SEQ ID NO: 19736 - DNA, 20 bp, Artificial Sequence
  Synthetic Construct
tgtagtgctcctggctcaga

SEQ ID NO: 19737 - DNA, 22 bp, Artificial Sequence
  Synthetic Construct
ccctgaaccccatcaagccaat

SEQ ID NO: 19738 - DNA, 24 bp, Artificial Sequence
  Synthetic Construct
ggcctcatgggagttcttttggat

SEQ ID NO: 19739 - DNA, 25 bp, Artificial Sequence
  Synthetic Construct
tgtgtgacatgtacaggtgaaagtt

SEQ ID NO: 19740 - DNA, 27 bp, Artificial Sequence
  Synthetic Construct
gccagatttggtttacctctaatcatc

SEQ ID NO: 19741 - DNA, 23 bp, Artificial Sequence
  Synthetic Construct
agctcagtcatcccagtttctct

SEQ ID NO: 19742 - DNA, 23 bp, Artificial Sequence
  Synthetic Construct
ggggccccattaggacacattac

SEQ ID NO: 19743 - DNA, 22 bp, Artificial Sequence
  Synthetic Construct
gccagccattgctcagtttttc

SEQ ID NO: 19744 - DNA, 22 bp, Artificial Sequence
  Synthetic Construct
ggtggctgtaatcccatcttca

SEQ ID NO: 19745 - DNA, 23 bp, Artificial Sequence
  Synthetic Construct
ctgtgtgggacaaaaagcacttg

SEQ ID NO: 19746 - DNA, 23 bp, Artificial Sequence
  Synthetic Construct
gtggcgttgggaaaaagaagtag

SEQ ID NO: 19747 - DNA, 21 bp, Artificial Sequence
  Synthetic Construct
gagggagaatggcacacatca

SEQ ID NO: 19748 - DNA, 25 bp, Artificial Sequence
  Synthetic Construct
ggaagtgaggagggaagaacagtct

SEQ ID NO: 19749 - DNA, 23 bp, Artificial Sequence
  Synthetic Construct
cctgttgttccgcatccatctct

SEQ ID NO: 19750 - DNA, 22 bp, Artificial Sequence
  Synthetic Construct
gtgcctgctgtttggttgagta

SEQ ID NO: 19751 - DNA, 26 bp, Artificial Sequence
  Synthetic Construct
gacctactcttgggtgatgacagtaa

SEQ ID NO: 19752 - DNA, 24 bp, Artificial Sequence
  Synthetic Construct
cctacctcccaggtttgctgtatg

SEQ ID NO: 19753 - DNA, 23 bp, Artificial Sequence
  Synthetic Construct
cctctccactttgtccccacttc

SEQ ID NO: 19754 - DNA, 24 bp, Artificial Sequence
  Synthetic Construct
cacaccgaccttgaactcctcttc

SEQ ID NO: 19755 - DNA, 24 bp, Artificial Sequence
  Synthetic Construct
ggtcagcccacagagagagtttag

SEQ ID NO: 19756 - DNA, 27 bp, Artificial Sequence
  Synthetic Construct
gtccaaggaagatagtctgggttgatg

SEQ ID NO: 19757 - DNA, 20 bp, Artificial Sequence
  Synthetic Construct
aggcctttcctgcccctcaa

SEQ ID NO: 19758 - DNA, 21 bp, Artificial Sequence
  Synthetic Construct
aggccaagtttagctgtgtgt

SEQ ID NO: 19759 - DNA, 23 bp, Artificial Sequence
  Synthetic Construct
tcatccagtccaacctcttcctt

SEQ ID NO: 19760 - DNA, 21 bp, Artificial Sequence
  Synthetic Construct
aggcagagacagaacccagaa

SEQ ID NO: 19761 - DNA, 22 bp, Artificial Sequence
  Synthetic Construct
ccaaaccagagcacactcaact

SEQ ID NO: 19762 - DNA, 24 bp, Artificial Sequence
  Synthetic Construct
acctcttcccctcatcctttatgt

SEQ ID NO: 19763 - DNA, 26 bp, Artificial Sequence
  Synthetic Construct
ctgtgttatctaggattgcaccttct

SEQ ID NO: 19764 - DNA, 20 bp, Artificial Sequence
  Synthetic Construct
cggccacattgtgagtctgt

SEQ ID NO: 19765 - DNA, 24 bp, Artificial Sequence
  Synthetic Construct
caaatgtctggcccttggatatga

SEQ ID NO: 19766 - DNA, 22 bp, Artificial Sequence
  Synthetic Construct
tggggtttggagtccatgttac

SEQ ID NO: 19767 - DNA, 26 bp, Artificial Sequence
  Synthetic Construct
gcaggaagcatgtaaagaacaagaag

SEQ ID NO: 19768 - DNA, 22 bp, Artificial Sequence
  Synthetic Construct
cctgtggaaggtggttgtcaga

SEQ ID NO: 19769 - DNA, 24 bp, Artificial Sequence
  Synthetic Construct
gaattgtcaatcccagcagtcaga

SEQ ID NO: 19770 - DNA, 23 bp, Artificial Sequence
  Synthetic Construct
aatgggtggtgttctggaagatt

SEQ ID NO: 19771 - DNA, 21 bp, Artificial Sequence
  Synthetic Construct
gggtctgaaaggggcagattg

SEQ ID NO: 19772 - DNA, 22 bp, Artificial Sequence
  Synthetic Construct
gggacaccaatctgggacagaa

SEQ ID NO: 19773 - DNA, 24 bp, Artificial Sequence
  Synthetic Construct
acgctggtagaggttctttcattt

SEQ ID NO: 19774 - DNA, 22 bp, Artificial Sequence
  Synthetic Construct
gcagagagtcaggcaggagaca

SEQ ID NO: 19775 - DNA, 22 bp, Artificial Sequence
  Synthetic Construct
ccagcatagtggtagcccttca

SEQ ID NO: 19776 - DNA, 24 bp, Artificial Sequence
  Synthetic Construct
ctctcaaacacttagctggcaaaa

SEQ ID NO: 19777 - DNA, 21 bp, Artificial Sequence
  Synthetic Construct
gctccaaagccctccttcatc

SEQ ID NO: 19778 - DNA, 24 bp, Artificial Sequence
  Synthetic Construct
ccgtgcctatcagttctccatttg

SEQ ID NO: 19779 - DNA, 23 bp, Artificial Sequence
  Synthetic Construct
tcctacagtcctcctcgctcaag

SEQ ID NO: 19780 - DNA, 27 bp, Artificial Sequence
  Synthetic Construct
ctgacatgtgcttttaagtccctgcta

SEQ ID NO: 19781 - DNA, 25 bp, Artificial Sequence
  Synthetic Construct
gccctaactgatcccatgagaggtt

SEQ ID NO: 19782 - DNA, 22 bp, Artificial Sequence
  Synthetic Construct
acagcccctgtagctagtggaa

SEQ ID NO: 19783 - DNA, 25 bp, Artificial Sequence
  Synthetic Construct
catttcagtccttgacgtaccaatc

SEQ ID NO: 19784 - DNA, 19 bp, Artificial Sequence
  Synthetic Construct
atggacccttccgctgaca

SEQ ID NO: 19785 - DNA, 20 bp, Artificial Sequence
  Synthetic Construct
tgcccttgtgctccccattc

SEQ ID NO: 19786 - DNA, 28 bp, Artificial Sequence
  Synthetic Construct
ccatcctccagtatatccctcctgtatg

SEQ ID NO: 19787 - DNA, 23 bp, Artificial Sequence
  Synthetic Construct
ggcttccctgcttcagagataga

SEQ ID NO: 19788 - DNA, 26 bp, Artificial Sequence
  Synthetic Construct
ctgacataggatcacttctgtagcat

SEQ ID NO: 19789 - DNA, 26 bp, Artificial Sequence
  Synthetic Construct
cagagctgaatttcctggctaaggat

SEQ ID NO: 19790 - DNA, 26 bp, Artificial Sequence
  Synthetic Construct
gcaaatgtatgccttgttgggcattg

SEQ ID NO: 19791 - DNA, 25 bp, Artificial Sequence
  Synthetic Construct
gcccagacatatcctcagtcatttg

SEQ ID NO: 19792 - DNA, 20 bp, Artificial Sequence
  Synthetic Construct
ggggcttctcagccattcaa

SEQ ID NO: 19793 - DNA, 25 bp, Artificial Sequence
  Synthetic Construct
ctgtgcctgacaaagtagtgacaga

SEQ ID NO: 19794 - DNA, 22 bp, Artificial Sequence
  Synthetic Construct
gaggcaaggaaagaccgtatca

SEQ ID NO: 19795 - DNA, 22 bp, Artificial Sequence
  Synthetic Construct
aggggtgcagttagtgctatga

SEQ ID NO: 19796 - DNA, 25 bp, Artificial Sequence
  Synthetic Construct
ggctgctgttacaagacagagacat

SEQ ID NO: 19797 - DNA, 23 bp, Artificial Sequence
  Synthetic Construct
ccaggaagctggcaagagttttt

SEQ ID NO: 19798 - DNA, 23 bp, Artificial Sequence
  Synthetic Construct
cacttcctgccacttgccttaaa

SEQ ID NO: 19799 - DNA, 18 bp, Artificial Sequence
  Synthetic Construct
actcgcagctgccgctaa

SEQ ID NO: 19800 - DNA, 27 bp, Artificial Sequence
  Synthetic Construct
ggatctgagcccatttgactataaaac

SEQ ID NO: 19801 - DNA, 25 bp, Artificial Sequence
  Synthetic Construct
gctaggttcaagtgaggataacact

SEQ ID NO: 19802 - DNA, 26 bp, Artificial Sequence
  Synthetic Construct
gtctcaggaataaagctactggttca

SEQ ID NO: 19803 - DNA, 23 bp, Artificial Sequence
  Synthetic Construct
ccccagtgtccccatcttggtaa

SEQ ID NO: 19804 - DNA, 23 bp, Artificial Sequence
  Synthetic Construct
caagaacaatgggtgctgagtct

SEQ ID NO: 19805 - DNA, 25 bp, Artificial Sequence
  Synthetic Construct
ggcagattcaccatgtatgttttgt

SEQ ID NO: 19806 - DNA, 26 bp, Artificial Sequence
  Synthetic Construct
ggagcagatcacctaaatctaaggaa

SEQ ID NO: 19807 - DNA, 23 bp, Artificial Sequence
  Synthetic Construct
tggctgacagttattgtcccatt

SEQ ID NO: 19808 - DNA, 23 bp, Artificial Sequence
  Synthetic Construct
tcctgaattcccaggtcttgtct

SEQ ID NO: 19809 - DNA, 26 bp, Artificial Sequence
  Synthetic Construct
gactggcatgtgtctagatatgttgt

SEQ ID NO: 19810 - DNA, 26 bp, Artificial Sequence
  Synthetic Construct
gggagcaagaatagaagaaggtgact

SEQ ID NO: 19811 - DNA, 22 bp, Artificial Sequence
  Synthetic Construct
ggtaagtgtccatccagccatt

SEQ ID NO: 19812 - DNA, 21 bp, Artificial Sequence
  Synthetic Construct
agccctgcaagacctagagat

SEQ ID NO: 19813 - DNA, 22 bp, Artificial Sequence
  Synthetic Construct
tcagagagaggggaagcccaaa

SEQ ID NO: 19814 - DNA, 27 bp, Artificial Sequence
  Synthetic Construct
ctctccctctatattaaaacggtgcat

SEQ ID NO: 19815 - DNA, 30 bp, Artificial Sequence
  Synthetic Construct
gacagaagaaatccaagacccagagatatt

SEQ ID NO: 19816 - DNA, 25 bp, Artificial Sequence
  Synthetic Construct
gcacccaaccacttttgtactcttg

SEQ ID NO: 19817 - DNA, 27 bp, Artificial Sequence
  Synthetic Construct
gggagtagcctagaagtgatatagaga

SEQ ID NO: 19818 - DNA, 23 bp, Artificial Sequence
  Synthetic Construct
ggccatgctgagaattgcaggaa

SEQ ID NO: 19819 - DNA, 24 bp, Artificial Sequence
  Synthetic Construct
gttatgcactcctcagccagtatc

SEQ ID NO: 19820 - DNA, 22 bp, Artificial Sequence
  Synthetic Construct
cctgaagtagagcctccagcat

SEQ ID NO: 19821 - DNA, 24 bp, Artificial Sequence
  Synthetic Construct
ccatggggataccttcaactgtaa

SEQ ID NO: 19822 - DNA, 21 bp, Artificial Sequence
  Synthetic Construct
ggggcaagttctcagccttga

SEQ ID NO: 19823 - DNA, 22 bp, Artificial Sequence
  Synthetic Construct
atgccagtctagctcagctttt

SEQ ID NO: 19824 - DNA, 22 bp, Artificial Sequence
  Synthetic Construct
ccaagatctaagccaccaccat

SEQ ID NO: 19825 - DNA, 22 bp, Artificial Sequence
  Synthetic Construct
cctcccaagtggcatgaggaaa

SEQ ID NO: 19826 - DNA, 23 bp, Artificial Sequence
  Synthetic Construct
gccagagacgttactgactggtt

SEQ ID NO: 19827 - DNA, 26 bp, Artificial Sequence
  Synthetic Construct
cagtcctttgtgttccattgaaggat

SEQ ID NO: 19828 - DNA, 25 bp, Artificial Sequence
  Synthetic Construct
ggatgtgcaccttgatgagtagaaa

SEQ ID NO: 19829 - DNA, 20 bp, Artificial Sequence
  Synthetic Construct
ggctctgaagcagctggaat

SEQ ID NO: 19830 - DNA, 24 bp, Artificial Sequence
  Synthetic Construct
tggcatgactcaatcctatgcttt

SEQ ID NO: 19831 - DNA, 28 bp, Artificial Sequence
  Synthetic Construct
gctcccttgctactataaagtgatgttc

SEQ ID NO: 19832 - DNA, 24 bp, Artificial Sequence
  Synthetic Construct
gcacagagacccatgagagttgaa

SEQ ID NO: 19833 - DNA, 25 bp, Artificial Sequence
  Synthetic Construct
gggtgtcgaaaggatccagagatta

SEQ ID NO: 19834 - DNA, 29 bp, Artificial Sequence
  Synthetic Construct
gcctccaatatttacgaacttgccttgta

SEQ ID NO: 19835 - DNA, 22 bp, Artificial Sequence
  Synthetic Construct
gaaggtaccaaaccctgctcaa

SEQ ID NO: 19836 - DNA, 25 bp, Artificial Sequence
  Synthetic Construct
gtcagacccctattcctctggacaa

SEQ ID NO: 19837 - DNA, 24 bp, Artificial Sequence
  Synthetic Construct
cccaaggacgtcaagtgtttctgt

SEQ ID NO: 19838 - DNA, 23 bp, Artificial Sequence
  Synthetic Construct
gagaccaaaaaggtcagccatgt

SEQ ID NO: 19839 - DNA, 21 bp, Artificial Sequence
  Synthetic Construct
cgctgagacccagggcttcta

SEQ ID NO: 19840 - DNA, 22 bp, Artificial Sequence
  Synthetic Construct
gccaccgggctaatttccatgt

SEQ ID NO: 19841 - DNA, 23 bp, Artificial Sequence
  Synthetic Construct
gcaccaagtgcatgacaaatgta

SEQ ID NO: 19842 - DNA, 24 bp, Artificial Sequence
  Synthetic Construct
tggatgcttcacctgtcttagtct

SEQ ID NO: 19843 - DNA, 23 bp, Artificial Sequence
  Synthetic Construct
gtcacaagtcctgaccagttaca

SEQ ID NO: 19844 - DNA, 25 bp, Artificial Sequence
  Synthetic Construct
gagcagtggtcctttatcatcatct

SEQ ID NO: 19845 - DNA, 23 bp, Artificial Sequence
  Synthetic Construct
gctcaacaggaggatcagagcat

SEQ ID NO: 19846 - DNA, 24 bp, Artificial Sequence
  Synthetic Construct
gggagatacacaacactgctcaga

SEQ ID NO: 19847 - DNA, 22 bp, Artificial Sequence
  Synthetic Construct
gagtggtggtaggacagagaca

SEQ ID NO: 19848 - DNA, 21 bp, Artificial Sequence
  Synthetic Construct
agaggcaagatggtgggatga

SEQ ID NO: 19849 - DNA, 28 bp, Artificial Sequence
  Synthetic Construct
gggtaagacattccccactaaatccata

SEQ ID NO: 19850 - DNA, 24 bp, Artificial Sequence
  Synthetic Construct
ggattggcattgtttgcctgtatg

SEQ ID NO: 19851 - DNA, 24 bp, Artificial Sequence
  Synthetic Construct
gggtttttgtgagcctgataggaa

SEQ ID NO: 19852 - DNA, 25 bp, Artificial Sequence
  Synthetic Construct
cactcaaaaacatgctgctttctct

SEQ ID NO: 19853 - DNA, 25 bp, Artificial Sequence
  Synthetic Construct
cactaggcaccatactcacatactt

SEQ ID NO: 19854 - DNA, 21 bp, Artificial Sequence
  Synthetic Construct
gctaaccccagccctcacttc

SEQ ID NO: 19855 - DNA, 25 bp, Artificial Sequence
  Synthetic Construct
cgaggccattgtagaacaagaaatc

SEQ ID NO: 19856 - DNA, 22 bp, Artificial Sequence
  Synthetic Construct
gcatgccctccttcatggtcta

SEQ ID NO: 19857 - DNA, 20 bp, Artificial Sequence
  Synthetic Construct
acccagcatgcaaagtcagt

SEQ ID NO: 19858 - DNA, 21 bp, Artificial Sequence
  Synthetic Construct
ccggggcaaaacttggtaaac

SEQ ID NO: 19859 - DNA, 21 bp, Artificial Sequence
  Synthetic Construct
tcagcattgcttcacctgtgt

SEQ ID NO: 19860 - DNA, 29 bp, Artificial Sequence
  Synthetic Construct
cccatggcctaaaggattaagagagtttc

SEQ ID NO: 19861 - DNA, 24 bp, Artificial Sequence
  Synthetic Construct
caagagctccacttacgtccaaag

SEQ ID NO: 19862 - DNA, 24 bp, Artificial Sequence
  Synthetic Construct
gtccagttttccaggtccaagaca

SEQ ID NO: 19863 - DNA, 28 bp, Artificial Sequence
  Synthetic Construct
ccctccaccttaaatgctctttcctgta

SEQ ID NO: 19864 - DNA, 23 bp, Artificial Sequence
  Synthetic Construct
tttggggttggtttcctgtactt

SEQ ID NO: 19865 - DNA, 23 bp, Artificial Sequence
  Synthetic Construct
tgcagcaccacactcaataatgt

SEQ ID NO: 19866 - DNA, 25 bp, Artificial Sequence
  Synthetic Construct
aggtcagttacttggttgtcaagaa

SEQ ID NO: 19867 - DNA, 23 bp, Artificial Sequence
  Synthetic Construct
agtgggagaactgaagacctcat

SEQ ID NO: 19868 - DNA, 24 bp, Artificial Sequence
  Synthetic Construct
ttcagaggtgttaggttcagcaaa

SEQ ID NO: 19869 - DNA, 19 bp, Artificial Sequence
  Synthetic Construct
ccgcgaagagcccctgaaa

SEQ ID NO: 19870 - DNA, 22 bp, Artificial Sequence
  Synthetic Construct
gcagtggggtttgttcatggta

SEQ ID NO: 19871 - DNA, 25 bp, Artificial Sequence
  Synthetic Construct
gcttggtttttggaaccattcttga

SEQ ID NO: 19872 - DNA, 25 bp, Artificial Sequence
  Synthetic Construct
gtgctttgcatacagtaggtcatca

SEQ ID NO: 19873 - DNA, 23 bp, Artificial Sequence
  Synthetic Construct
ggcggggtaccaagtaaagttgt

SEQ ID NO: 19874 - DNA, 26 bp, Artificial Sequence
  Synthetic Construct
cgggtcaacatttacactgactccaa

SEQ ID NO: 19875 - DNA, 24 bp, Artificial Sequence
  Synthetic Construct
gactgtgtttgagaggggcttcta

SEQ ID NO: 19876 - DNA, 23 bp, Artificial Sequence
  Synthetic Construct
acccttaagaggcatttgtgtca

SEQ ID NO: 19877 - DNA, 27 bp, Artificial Sequence
  Synthetic Construct
gactcctagttgctgaagtctctgtag

SEQ ID NO: 19878 - DNA, 30 bp, Artificial Sequence
  Synthetic Construct
ggaatggtcctataacctaaggtgtttact

SEQ ID NO: 19879 - DNA, 25 bp, Artificial Sequence
  Synthetic Construct
caaggggagagacattattggcatt

SEQ ID NO: 19880 - DNA, 27 bp, Artificial Sequence
  Synthetic Construct
ggagaagccaaaataagggtgttgttg

SEQ ID NO: 19881 - DNA, 21 bp, Artificial Sequence
  Synthetic Construct
acgttgccccagaccctatca

SEQ ID NO: 19882 - DNA, 23 bp, Artificial Sequence
  Synthetic Construct
ctctcagcgcaagaacctagaag

SEQ ID NO: 19883 - DNA, 23 bp, Artificial Sequence
  Synthetic Construct
cagagaagctaatgtggcagtga

SEQ ID NO: 19884 - DNA, 22 bp, Artificial Sequence
  Synthetic Construct
tggagtcaggcctagggtttag

SEQ ID NO: 19885 - DNA, 22 bp, Artificial Sequence
  Synthetic Construct
tccactctttgaggctgtgaga

SEQ ID NO: 19886 - DNA, 29 bp, Artificial Sequence
  Synthetic Construct
gcaaccattttcatgcccctttagtatca

SEQ ID NO: 19887 - DNA, 21 bp, Artificial Sequence
  Synthetic Construct
tggggaaagggaagaggacat

SEQ ID NO: 19888 - DNA, 25 bp, Artificial Sequence
  Synthetic Construct
caggaagaaatagggctactgtcaa

SEQ ID NO: 19889 - DNA, 24 bp, Artificial Sequence
  Synthetic Construct
gcaactttttgccttggtgttgtt

SEQ ID NO: 19890 - DNA, 22 bp, Artificial Sequence
  Synthetic Construct
agagccaggtacatgccagcta

SEQ ID NO: 19891 - DNA, 25 bp, Artificial Sequence
  Synthetic Construct
gggtttaggaatggcaggtcatttg

SEQ ID NO: 19892 - DNA, 22 bp, Artificial Sequence
  Synthetic Construct
tcctacacctgcctctccaatc

SEQ ID NO: 19893 - DNA, 24 bp, Artificial Sequence
  Synthetic Construct
actctggctgctggaataaacaat

SEQ ID NO: 19894 - DNA, 24 bp, Artificial Sequence
  Synthetic Construct
gtggctgttgtcagactttgattc

SEQ ID NO: 19895 - DNA, 22 bp, Artificial Sequence
  Synthetic Construct
ggcctgcttcaaagtcccagaa

SEQ ID NO: 19896 - DNA, 22 bp, Artificial Sequence
  Synthetic Construct
ctctcagctagcagacccacat

SEQ ID NO: 19897 - DNA, 25 bp, Artificial Sequence
  Synthetic Construct
cagtttggtgaatggaaggttctga

SEQ ID NO: 19898 - DNA, 20 bp, Artificial Sequence
  Synthetic Construct
agctgccatttccccacaat

SEQ ID NO: 19899 - DNA, 25 bp, Artificial Sequence
  Synthetic Construct
gccccaggtcttttcaggcatttag

SEQ ID NO: 19900 - DNA, 27 bp, Artificial Sequence
  Synthetic Construct
gccctttagaaagcttgaagtccttag

SEQ ID NO: 19901 - DNA, 20 bp, Artificial Sequence
  Synthetic Construct
aggccagcccctggagaact

SEQ ID NO: 19902 - DNA, 24 bp, Artificial Sequence
  Synthetic Construct
cacggcagtcttcaatgagtcaga

SEQ ID NO: 19903 - DNA, 21 bp, Artificial Sequence
  Synthetic Construct
gggtgggtgcttggttaacat

SEQ ID NO: 19904 - DNA, 26 bp, Artificial Sequence
  Synthetic Construct
gcaaccttggttcatatccattcgtt

SEQ ID NO: 19905 - DNA, 29 bp, Artificial Sequence
  Synthetic Construct
ggaagtttcttaaaggtaggaaccccata

SEQ ID NO: 19906 - DNA, 27 bp, Artificial Sequence
  Synthetic Construct
ggggaatttgtcttgcaccttagatgt

SEQ ID NO: 19907 - DNA, 24 bp, Artificial Sequence
  Synthetic Construct
ggatgcaagccactttagcactca

SEQ ID NO: 19908 - DNA, 26 bp, Artificial Sequence
  Synthetic Construct
gtgaaggattaaaacagcccaactgt

SEQ ID NO: 19909 - DNA, 23 bp, Artificial Sequence
  Synthetic Construct
gagaagggaactggaaggcgaat

SEQ ID NO: 19910 - DNA, 26 bp, Artificial Sequence
  Synthetic Construct
cagtatggatcatgcttctcttgtca

SEQ ID NO: 19911 - DNA, 21 bp, Artificial Sequence
  Synthetic Construct
tcacagcaacaagccatgtga

SEQ ID NO: 19912 - DNA, 23 bp, Artificial Sequence
  Synthetic Construct
ctgttgttccaaacctccctttc

SEQ ID NO: 19913 - DNA, 22 bp, Artificial Sequence
  Synthetic Construct
ctgcccatctccttctgtcttc

SEQ ID NO: 19914 - DNA, 22 bp, Artificial Sequence
  Synthetic Construct
ctgctgaagtcctcctctgtct

SEQ ID NO: 19915 - DNA, 23 bp, Artificial Sequence
  Synthetic Construct
ccaccaactactgcagtctgaac

SEQ ID NO: 19916 - DNA, 23 bp, Artificial Sequence
  Synthetic Construct
gtccccagtgtgtttcctagact

SEQ ID NO: 19917 - DNA, 24 bp, Artificial Sequence
  Synthetic Construct
gtttgactgtctggcgttctttct

SEQ ID NO: 19918 - DNA, 22 bp, Artificial Sequence
  Synthetic Construct
gcaatggcctccaccatacgat

SEQ ID NO: 19919 - DNA, 20 bp, Artificial Sequence
  Synthetic Construct
gccagggcatttgcactttg

SEQ ID NO: 19920 - DNA, 26 bp, Artificial Sequence
  Synthetic Construct
gcaccatttggtttctgctcatttag

SEQ ID NO: 19921 - DNA, 25 bp, Artificial Sequence
  Synthetic Construct
ggaagtgaaggaggcttctcctgat

SEQ ID NO: 19922 - DNA, 23 bp, Artificial Sequence
  Synthetic Construct
gcccagggaaatctccacttatc

SEQ ID NO: 19923 - DNA, 30 bp, Artificial Sequence
  Synthetic Construct
ccaagataagaagtacaggccaatttcgtt

SEQ ID NO: 19924 - DNA, 24 bp, Artificial Sequence
  Synthetic Construct
gttactgactcactgtaggcacaa

SEQ ID NO: 19925 - DNA, 24 bp, Artificial Sequence
  Synthetic Construct
acataagtcacgctggacaaagaa

SEQ ID NO: 19926 - DNA, 27 bp, Artificial Sequence
  Synthetic Construct
cacaagatgtgtgttcttagccattac

SEQ ID NO: 19927 - DNA, 24 bp, Artificial Sequence
  Synthetic Construct
gggcactgatgctatctctggaaa

SEQ ID NO: 19928 - DNA, 25 bp, Artificial Sequence
  Synthetic Construct
gtcaggatcacctccagactgtact

SEQ ID NO: 19929 - DNA, 23 bp, Artificial Sequence
  Synthetic Construct
gctgactctgtggaagtgtggtt

SEQ ID NO: 19930 - DNA, 26 bp, Artificial Sequence
  Synthetic Construct
gtgatggtgttttctggagaggattg

SEQ ID NO: 19931 - DNA, 25 bp, Artificial Sequence
  Synthetic Construct
gctcacctctcttggtagtttcact

SEQ ID NO: 19932 - DNA, 23 bp, Artificial Sequence
  Synthetic Construct
agagccctttggaatttcagctt

SEQ ID NO: 19933 - DNA, 24 bp, Artificial Sequence
  Synthetic Construct
ggtggctcttttagccgactttag

SEQ ID NO: 19934 - DNA, 27 bp, Artificial Sequence
  Synthetic Construct
ggccaaggttagtaattcatggagaga

SEQ ID NO: 19935 - DNA, 24 bp, Artificial Sequence
  Synthetic Construct
tctcaggaagaaagggtagactgt

SEQ ID NO: 19936 - DNA, 21 bp, Artificial Sequence
  Synthetic Construct
acggaggacaggtctctgcta

SEQ ID NO: 19937 - DNA, 24 bp, Artificial Sequence
  Synthetic Construct
tgactactttgggaatggggacta

SEQ ID NO: 19938 - DNA, 24 bp, Artificial Sequence
  Synthetic Construct
gcaggcttcatgctagtgaagaaa

SEQ ID NO: 19939 - DNA, 24 bp, Artificial Sequence
  Synthetic Construct
cccactagccactgaatgtgaatc

SEQ ID NO: 19940 - DNA, 25 bp, Artificial Sequence
  Synthetic Construct
cagctggttttgaccagttttgtct

SEQ ID NO: 19941 - DNA, 25 bp, Artificial Sequence
  Synthetic Construct
cacaatagggcaatcgaagggaaac

SEQ ID NO: 19942 - DNA, 24 bp, Artificial Sequence
  Synthetic Construct
tgatcctttagtctggggctcaca

SEQ ID NO: 19943 - DNA, 22 bp, Artificial Sequence
  Synthetic Construct
gctccagttccactttgcgttt

SEQ ID NO: 19944 - DNA, 19 bp, Artificial Sequence
  Synthetic Construct
gccacctatgccccaaagt

SEQ ID NO: 19945 - DNA, 23 bp, Artificial Sequence
  Synthetic Construct
ggcagggcagatagttccactaa

SEQ ID NO: 19946 - DNA, 29 bp, Artificial Sequence
  Synthetic Construct
ggcaaattcctgaatatcttgccttcagt

SEQ ID NO: 19947 - DNA, 22 bp, Artificial Sequence
  Synthetic Construct
caagcagtgaccaggagacctt

SEQ ID NO: 19948 - DNA, 23 bp, Artificial Sequence
  Synthetic Construct
tggttgaagcactgtcactgtaa

SEQ ID NO: 19949 - DNA, 25 bp, Artificial Sequence
  Synthetic Construct
gaagctggatatttcctgggactct

SEQ ID NO: 19950 - DNA, 28 bp, Artificial Sequence
  Synthetic Construct
gctctctcactgatcctttctggactaa

SEQ ID NO: 19951 - DNA, 27 bp, Artificial Sequence
  Synthetic Construct
cacaagctatgaacacatcagactaca

SEQ ID NO: 19952 - DNA, 23 bp, Artificial Sequence
  Synthetic Construct
gtgtgcatcacttctgctcacat

SEQ ID NO: 19953 - DNA, 23 bp, Artificial Sequence
  Synthetic Construct
gagttttcccctccaatgtgact

SEQ ID NO: 19954 - DNA, 24 bp, Artificial Sequence
  Synthetic Construct
tggactgcttctgtctctgttcta

SEQ ID NO: 19955 - DNA, 23 bp, Artificial Sequence
  Synthetic Construct
tgcttggagtaccacatgaaaca

SEQ ID NO: 19956 - DNA, 26 bp, Artificial Sequence
  Synthetic Construct
gcttgccttttcaagagactcacctt

SEQ ID NO: 19957 - DNA, 26 bp, Artificial Sequence
  Synthetic Construct
gccaccactttaatcaccttgcctaa

SEQ ID NO: 19958 - DNA, 22 bp, Artificial Sequence
  Synthetic Construct
acacctggttgaaaccaagaca

SEQ ID NO: 19959 - DNA, 22 bp, Artificial Sequence
  Synthetic Construct
cctgtgcttgaggagccaagaa

SEQ ID NO: 19960 - DNA, 26 bp, Artificial Sequence
  Synthetic Construct
gttgcatcctctgctttactttgaac

SEQ ID NO: 19961 - DNA, 25 bp, Artificial Sequence
  Synthetic Construct
cccagtttccttctctcaggaatca

SEQ ID NO: 19962 - DNA, 26 bp, Artificial Sequence
  Synthetic Construct
gtgaattggcctcagaacattacaga

SEQ ID NO: 19963 - DNA, 21 bp, Artificial Sequence
  Synthetic Construct
cggttttcgtgcagggtgatg

SEQ ID NO: 19964 - DNA, 24 bp, Artificial Sequence
  Synthetic Construct
aggggaaagagggtgaatttgatt

SEQ ID NO: 19965 - DNA, 23 bp, Artificial Sequence
  Synthetic Construct
cccacttttggtctcctgagtgt

SEQ ID NO: 19966 - DNA, 24 bp, Artificial Sequence
  Synthetic Construct
ggcataatgtcatgtccaccttgt

SEQ ID NO: 19967 - DNA, 24 bp, Artificial Sequence
  Synthetic Construct
gcctccggtttgtaatgcaaataa

SEQ ID NO: 19968 - DNA, 26 bp, Artificial Sequence
  Synthetic Construct
ggacctcagcactttttgtagcatta

SEQ ID NO: 19969 - DNA, 24 bp, Artificial Sequence
  Synthetic Construct
ccttttctccgtgtagtgcagagt

SEQ ID NO: 19970 - DNA, 25 bp, Artificial Sequence
  Synthetic Construct
aggcaaaggtgtatttagcagaaac

SEQ ID NO: 19971 - DNA, 26 bp, Artificial Sequence
  Synthetic Construct
tcctttcagtcctcattcttccctat

SEQ ID NO: 19972 - DNA, 22 bp, Artificial Sequence
  Synthetic Construct
tggggagggacatggcctaaaa

SEQ ID NO: 19973 - DNA, 27 bp, Artificial Sequence
  Synthetic Construct
cttgaccacctctctaaataagtctga

SEQ ID NO: 19974 - DNA, 23 bp, Artificial Sequence
  Synthetic Construct
gatgggaggtcatttcaccaagt

SEQ ID NO: 19975 - DNA, 22 bp, Artificial Sequence
  Synthetic Construct
tggtcttgtcccaggttgtagt

SEQ ID NO: 19976 - DNA, 23 bp, Artificial Sequence
  Synthetic Construct
tcctggcacatttgtcttctgtt

SEQ ID NO: 19977 - DNA, 23 bp, Artificial Sequence
  Synthetic Construct
ccctggctcaacaaactggaagt

SEQ ID NO: 19978 - DNA, 26 bp, Artificial Sequence
  Synthetic Construct
ctcaggtggcatgatataaacaggaa

SEQ ID NO: 19979 - DNA, 25 bp, Artificial Sequence
  Synthetic Construct
ctgctttaggtggcattggactttg

SEQ ID NO: 19980 - DNA, 24 bp, Artificial Sequence
  Synthetic Construct
gggttgctgataagtggagaggaa

SEQ ID NO: 19981 - DNA, 22 bp, Artificial Sequence
  Synthetic Construct
gtgagagggaagcacgactttc

SEQ ID NO: 19982 - DNA, 24 bp, Artificial Sequence
  Synthetic Construct
acccctcctcaatcactaaggaaa

SEQ ID NO: 19983 - DNA, 26 bp, Artificial Sequence
  Synthetic Construct
gcatctttactaatagctggctcagt

SEQ ID NO: 19984 - DNA, 21 bp, Artificial Sequence
  Synthetic Construct
gcccaggtttggctcagtttg

SEQ ID NO: 19985 - DNA, 20 bp, Artificial Sequence
  Synthetic Construct
tgacgcactacggtgacaag

SEQ ID NO: 19986 - DNA, 24 bp, Artificial Sequence
  Synthetic Construct
tgtgtaggcagtttagtgcatctt

SEQ ID NO: 19987 - DNA, 22 bp, Artificial Sequence
  Synthetic Construct
aaagaggatttccgcagtgtct

SEQ ID NO: 19988 - DNA, 22 bp, Artificial Sequence
  Synthetic Construct
cggcaatccactacaggtgaac

SEQ ID NO: 19989 - DNA, 22 bp, Artificial Sequence
  Synthetic Construct
caaccattagacccagcgaagt

SEQ ID NO: 19990 - DNA, 25 bp, Artificial Sequence
  Synthetic Construct
agaaccctatgatgatgtcctcctt

SEQ ID NO: 19991 - DNA, 22 bp, Artificial Sequence
  Synthetic Construct
ccagtcactgtgggtcatttct

SEQ ID NO: 19992 - DNA, 27 bp, Artificial Sequence
  Synthetic Construct
ggatagagctacaggatgcatctaaaa

SEQ ID NO: 19993 - DNA, 25 bp, Artificial Sequence
  Synthetic Construct
gtgtgacagattgattgtgttccat

SEQ ID NO: 19994 - DNA, 24 bp, Artificial Sequence
  Synthetic Construct
ggctcacattgaaacctgctgaga

SEQ ID NO: 19995 - DNA, 26 bp, Artificial Sequence
  Synthetic Construct
ggaaagttgttagctcctgtctgtct

SEQ ID NO: 19996 - DNA, 24 bp, Artificial Sequence
  Synthetic Construct
cagacttcattcaggacaggagaa

SEQ ID NO: 19997 - DNA, 22 bp, Artificial Sequence
  Synthetic Construct
tgggtgacgatgccaggattag

SEQ ID NO: 19998 - DNA, 22 bp, Artificial Sequence
  Synthetic Construct
gggctctttagtcaggttgtgt

SEQ ID NO: 19999 - DNA, 21 bp, Artificial Sequence
  Synthetic Construct
ggctccagttagcctctgcaa

SEQ ID NO: 20000 - DNA, 22 bp, Artificial Sequence
  Synthetic Construct
ctcagggaggaaaccctactgt

SEQ ID NO: 20001 - DNA, 21 bp, Artificial Sequence
  Synthetic Construct
tcttggttgcaccctgaaact

SEQ ID NO: 20002 - DNA, 22 bp, Artificial Sequence
  Synthetic Construct
ccttccttgcctcccagttaca

SEQ ID NO: 20003 - DNA, 22 bp, Artificial Sequence
  Synthetic Construct
gtctgtgaagtcagccgtggtt

SEQ ID NO: 20004 - DNA, 25 bp, Artificial Sequence
  Synthetic Construct
ggggtagcagcagatactaaaggaa

SEQ ID NO: 20005 - DNA, 18 bp, Artificial Sequence
  Synthetic Construct
accctgacacccgcacaa

SEQ ID NO: 20006 - DNA, 26 bp, Artificial Sequence
  Synthetic Construct
gcagtatgaagagactttcccataga

SEQ ID NO: 20007 - DNA, 23 bp, Artificial Sequence
  Synthetic Construct
ggaaggagctgatggtacacaga

SEQ ID NO: 20008 - DNA, 24 bp, Artificial Sequence
  Synthetic Construct
cccttccttggctgaagtgaacta

SEQ ID NO: 20009 - DNA, 28 bp, Artificial Sequence
  Synthetic Construct
gcgtctctccaagttctagcagttattc

SEQ ID NO: 20010 - DNA, 22 bp, Artificial Sequence
  Synthetic Construct
ggtggggaaatgtcaggagtct

SEQ ID NO: 20011 - DNA, 23 bp, Artificial Sequence
  Synthetic Construct
ggctcaaacatggctccatcact

SEQ ID NO: 20012 - DNA, 22 bp, Artificial Sequence
  Synthetic Construct
gctacaggcacaggacaagtga

SEQ ID NO: 20013 - DNA, 22 bp, Artificial Sequence
  Synthetic Construct
gccagccatactcttcctgaca

SEQ ID NO: 20014 - DNA, 25 bp, Artificial Sequence
  Synthetic Construct
gcaactccaatgccataagcatgaa

SEQ ID NO: 20015 - DNA, 21 bp, Artificial Sequence
  Synthetic Construct
tggatggacgaggagcctgta

SEQ ID NO: 20016 - DNA, 25 bp, Artificial Sequence
  Synthetic Construct
ccctgacatctatgagaaggaccta

SEQ ID NO: 20017 - DNA, 25 bp, Artificial Sequence
  Synthetic Construct
ctcactaagaccagcaagtctgcta

SEQ ID NO: 20018 - DNA, 22 bp, Artificial Sequence
  Synthetic Construct
tgtggtcaaggagctggagaga

SEQ ID NO: 20019 - DNA, 28 bp, Artificial Sequence
  Synthetic Construct
gctatgcaatttctgctaacaggaggta

SEQ ID NO: 20020 - DNA, 27 bp, Artificial Sequence
  Synthetic Construct
cctcagaaatgaaccctttccttccaa

SEQ ID NO: 20021 - DNA, 20 bp, Artificial Sequence
  Synthetic Construct
agtgcttggtgtggggaaag

SEQ ID NO: 20022 - DNA, 22 bp, Artificial Sequence
  Synthetic Construct
gcttaaaggccctctgggatct

SEQ ID NO: 20023 - DNA, 22 bp, Artificial Sequence
  Synthetic Construct
gcctaagttcaggttgccaaag

SEQ ID NO: 20024 - DNA, 24 bp, Artificial Sequence
  Synthetic Construct
gggagcacattcatgacagcattt

SEQ ID NO: 20025 - DNA, 24 bp, Artificial Sequence
  Synthetic Construct
gcaggaaaactcattccacagaag

SEQ ID NO: 20026 - DNA, 22 bp, Artificial Sequence
  Synthetic Construct
ccctgtgagcatggtctgttct

SEQ ID NO: 20027 - DNA, 22 bp, Artificial Sequence
  Synthetic Construct
cagctcagtaagaggcgggtat

SEQ ID NO: 20028 - DNA, 22 bp, Artificial Sequence
  Synthetic Construct
gcaaagggaaaggagggatgtt

SEQ ID NO: 20029 - DNA, 26 bp, Artificial Sequence
  Synthetic Construct
tccacctaggtttgtttgactctaag

SEQ ID NO: 20030 - DNA, 25 bp, Artificial Sequence
  Synthetic Construct
accatgttcttctggtcacgttatt

SEQ ID NO: 20031 - DNA, 25 bp, Artificial Sequence
  Synthetic Construct
tgggcattacatttgtcctcttgaa

SEQ ID NO: 20032 - DNA, 23 bp, Artificial Sequence
  Synthetic Construct
ggtctgtgtactcctcccctaca

SEQ ID NO: 20033 - DNA, 25 bp, Artificial Sequence
  Synthetic Construct
cagctcattccttccataagagtca

SEQ ID NO: 20034 - DNA, 22 bp, Artificial Sequence
  Synthetic Construct
gggcatactgcccttgccatta

SEQ ID NO: 20035 - DNA, 20 bp, Artificial Sequence
  Synthetic Construct
cttctccaccaacgccttct

SEQ ID NO: 20036 - DNA, 24 bp, Artificial Sequence
  Synthetic Construct
tgaacctagaaatggcctgaccta

SEQ ID NO: 20037 - DNA, 23 bp, Artificial Sequence
  Synthetic Construct
ggggtatgagtcatggagccaat

SEQ ID NO: 20038 - DNA, 25 bp, Artificial Sequence
  Synthetic Construct
ccgggttgacttcctatccatttga

SEQ ID NO: 20039 - DNA, 28 bp, Artificial Sequence
  Synthetic Construct
ggccttgtaattacgttccttctctaca

SEQ ID NO: 20040 - DNA, 25 bp, Artificial Sequence
  Synthetic Construct
cactagagatggaaaggggcatatt

SEQ ID NO: 20041 - DNA, 22 bp, Artificial Sequence
  Synthetic Construct
tgccatgtcctactgcttccta

SEQ ID NO: 20042 - DNA, 23 bp, Artificial Sequence
  Synthetic Construct
cccacccttagatcagggatagt

SEQ ID NO: 20043 - DNA, 25 bp, Artificial Sequence
  Synthetic Construct
gttggatgttttctctcccatgcaa

SEQ ID NO: 20044 - DNA, 25 bp, Artificial Sequence
  Synthetic Construct
ctgaagggttaatgtctggctgtca

SEQ ID NO: 20045 - DNA, 22 bp, Artificial Sequence
  Synthetic Construct
cctggaagccaggtacattcaa

SEQ ID NO: 20046 - DNA, 20 bp, Artificial Sequence
  Synthetic Construct
tgtgccgatgggaggaaatg

SEQ ID NO: 20047 - DNA, 24 bp, Artificial Sequence
  Synthetic Construct
gtgcccggacagaaaagactttca

SEQ ID NO: 20048 - DNA, 24 bp, Artificial Sequence
  Synthetic Construct
tcagctctgttttatgggtgacaa

SEQ ID NO: 20049 - DNA, 22 bp, Artificial Sequence
  Synthetic Construct
agggagggtagctggggtttac

SEQ ID NO: 20050 - DNA, 20 bp, Artificial Sequence
  Synthetic Construct
gcggctttagctggaagcaa

SEQ ID NO: 20051 - DNA, 24 bp, Artificial Sequence
  Synthetic Construct
ggatcccagctccttccatcatgt

SEQ ID NO: 20052 - DNA, 24 bp, Artificial Sequence
  Synthetic Construct
gctcttgtcgtctcgcttttcttc

SEQ ID NO: 20053 - DNA, 22 bp, Artificial Sequence
  Synthetic Construct
tggggaaaggatgcagttttca

SEQ ID NO: 20054 - DNA, 24 bp, Artificial Sequence
  Synthetic Construct
cgtcctttgttgcaatctcaactt

SEQ ID NO: 20055 - DNA, 23 bp, Artificial Sequence
  Synthetic Construct
gccgctatcagtacgagagttgt

SEQ ID NO: 20056 - DNA, 25 bp, Artificial Sequence
  Synthetic Construct
ccgggatcttaactggaatgacctt

SEQ ID NO: 20057 - DNA, 22 bp, Artificial Sequence
  Synthetic Construct
ggtctctgaggtctccctttga

SEQ ID NO: 20058 - DNA, 25 bp, Artificial Sequence
  Synthetic Construct
gcttaaaaagaatgtcctgggttca

SEQ ID NO: 20059 - DNA, 26 bp, Artificial Sequence
  Synthetic Construct
caacatgaaacatgggctccaaatct

SEQ ID NO: 20060 - DNA, 22 bp, Artificial Sequence
  Synthetic Construct
gaggtgggcaaaggaacacgta

SEQ ID NO: 20061 - DNA, 21 bp, Artificial Sequence
  Synthetic Construct
tggaggccttaggtcttgctt

SEQ ID NO: 20062 - DNA, 22 bp, Artificial Sequence
  Synthetic Construct
cagggaggaacaagtggcatga

SEQ ID NO: 20063 - DNA, 24 bp, Artificial Sequence
  Synthetic Construct
ggccctgaagtatgctcttaaagt

SEQ ID NO: 20064 - DNA, 22 bp, Artificial Sequence
  Synthetic Construct
aggggttatatctggcctggaa

SEQ ID NO: 20065 - DNA, 25 bp, Artificial Sequence
  Synthetic Construct
gactcttctccagttccaggaaaat

SEQ ID NO: 20066 - DNA, 22 bp, Artificial Sequence
  Synthetic Construct
gcagtgatggaactgccaccta

SEQ ID NO: 20067 - DNA, 23 bp, Artificial Sequence
  Synthetic Construct
cctgtaggtcccaggaaggtaaa

SEQ ID NO: 20068 - DNA, 25 bp, Artificial Sequence
  Synthetic Construct
ccagataccattttgcctcatgtca

SEQ ID NO: 20069 - DNA, 22 bp, Artificial Sequence
  Synthetic Construct
gtgtcgtttagcacgagcagtt

SEQ ID NO: 20070 - DNA, 24 bp, Artificial Sequence
  Synthetic Construct
cctgtggttggtaccctctcttct

SEQ ID NO: 20071 - DNA, 22 bp, Artificial Sequence
  Synthetic Construct
gaccagacctctgctgctttgt

SEQ ID NO: 20072 - DNA, 27 bp, Artificial Sequence
  Synthetic Construct
gcttctaatagagaccattctcctgaa

SEQ ID NO: 20073 - DNA, 24 bp, Artificial Sequence
  Synthetic Construct
ggcaagtaagtcttccctcctttg

SEQ ID NO: 20074 - DNA, 20 bp, Artificial Sequence
  Synthetic Construct
tgggctggaatcctgactct

SEQ ID NO: 20075 - DNA, 20 bp, Artificial Sequence
  Synthetic Construct
gttgggcgtgatgaggactt

SEQ ID NO: 20076 - DNA, 23 bp, Artificial Sequence
  Synthetic Construct
caagtgaggctttgtgccttttc

SEQ ID NO: 20077 - DNA, 25 bp, Artificial Sequence
  Synthetic Construct
gagaaaagaaaggggcaagaattga

SEQ ID NO: 20078 - DNA, 23 bp, Artificial Sequence
  Synthetic Construct
tcgctctttggtaaagtgagaca

SEQ ID NO: 20079 - DNA, 24 bp, Artificial Sequence
  Synthetic Construct
caacttaagtgcctcaggctgtct

SEQ ID NO: 20080 - DNA, 22 bp, Artificial Sequence
  Synthetic Construct
gcccaagaacccacaatcaatc

SEQ ID NO: 20081 - DNA, 24 bp, Artificial Sequence
  Synthetic Construct
ccgtcacagtccaagtaaaagcta

SEQ ID NO: 20082 - DNA, 28 bp, Artificial Sequence
  Synthetic Construct
gggagttagaaagggcctctaacagttt

SEQ ID NO: 20083 - DNA, 24 bp, Artificial Sequence
  Synthetic Construct
cgctaaacactcttcagacagaca

SEQ ID NO: 20084 - DNA, 25 bp, Artificial Sequence
  Synthetic Construct
ggggctactgatgaagcacatatag

SEQ ID NO: 20085 - DNA, 22 bp, Artificial Sequence
  Synthetic Construct
ggccctgtgaaccttgtagctt

SEQ ID NO: 20086 - DNA, 21 bp, Artificial Sequence
  Synthetic Construct
ccgtgcgaggaaagtgacagt

SEQ ID NO: 20087 - DNA, 24 bp, Artificial Sequence
  Synthetic Construct
gggagagtcagtgaccaaagtatg

SEQ ID NO: 20088 - DNA, 24 bp, Artificial Sequence
  Synthetic Construct
cgaggagatgaagggagcagaaat

SEQ ID NO: 20089 - DNA, 25 bp, Artificial Sequence
  Synthetic Construct
agaccttcaagaggaaagtgagagt

SEQ ID NO: 20090 - DNA, 24 bp, Artificial Sequence
  Synthetic Construct
aggactcagaatccactccctatg

SEQ ID NO: 20091 - DNA, 24 bp, Artificial Sequence
  Synthetic Construct
tgaggtggtgagaatgaacctact

SEQ ID NO: 20092 - DNA, 21 bp, Artificial Sequence
  Synthetic Construct
cccagtgcttcctgtttccaa

SEQ ID NO: 20093 - DNA, 26 bp, Artificial Sequence
  Synthetic Construct
ggtcaggtggggtttttattcaccaa

SEQ ID NO: 20094 - DNA, 22 bp, Artificial Sequence
  Synthetic Construct
gctgtcaaagcaagtgggaaga

SEQ ID NO: 20095 - DNA, 25 bp, Artificial Sequence
  Synthetic Construct
gccagatagagagcttgtgggttct

SEQ ID NO: 20096 - DNA, 28 bp, Artificial Sequence
  Synthetic Construct
ggttaaatgacatccactaggccaaaac

SEQ ID NO: 20097 - DNA, 25 bp, Artificial Sequence
  Synthetic Construct
ggcagcataggtaggtttggaattg

SEQ ID NO: 20098 - DNA, 25 bp, Artificial Sequence
  Synthetic Construct
cactcacatcccattgtccatatct

SEQ ID NO: 20099 - DNA, 22 bp, Artificial Sequence
  Synthetic Construct
ccacgggacacagtcagcatta

SEQ ID NO: 20100 - DNA, 22 bp, Artificial Sequence
  Synthetic Construct
ctgacacagtcctgccagatga

SEQ ID NO: 20101 - DNA, 21 bp, Artificial Sequence
  Synthetic Construct
ctgcgttgaaggtgactggat

SEQ ID NO: 20102 - DNA, 21 bp, Artificial Sequence
  Synthetic Construct
gttccgcaggcattctaccat

SEQ ID NO: 20103 - DNA, 24 bp, Artificial Sequence
  Synthetic Construct
cccatctgcttcacagggttatac

SEQ ID NO: 20104 - DNA, 23 bp, Artificial Sequence
  Synthetic Construct
ccgatgcttcaaccacacctaga

SEQ ID NO: 20105 - DNA, 24 bp, Artificial Sequence
  Synthetic Construct
gcaggctcctgtaaggaaggagtt

SEQ ID NO: 20106 - DNA, 20 bp, Artificial Sequence
  Synthetic Construct
tgccactgtcttggccgtaa

SEQ ID NO: 20107 - DNA, 24 bp, Artificial Sequence
  Synthetic Construct
ctgtatgtcaccccaagggagtat

SEQ ID NO: 20108 - DNA, 24 bp, Artificial Sequence
  Synthetic Construct
ccagggagccccttaggattaact

SEQ ID NO: 20109 - DNA, 23 bp, Artificial Sequence
  Synthetic Construct
gcccaggcaaaagcagggatatt

SEQ ID NO: 20110 - DNA, 30 bp, Artificial Sequence
  Synthetic Construct
cgaaagtaagggctaaagtctcttctgatg

SEQ ID NO: 20111 - DNA, 27 bp, Artificial Sequence
  Synthetic Construct
ggaggagtgcctcatgttatgataagt

SEQ ID NO: 20112 - DNA, 26 bp, Artificial Sequence
  Synthetic Construct
cctctctggtaggatgcaactgaaaa

SEQ ID NO: 20113 - DNA, 26 bp, Artificial Sequence
  Synthetic Construct
gggacctaccattaccattcccatct

SEQ ID NO: 20114 - DNA, 20 bp, Artificial Sequence
  Synthetic Construct
agcatggttgcaggcacaga

SEQ ID NO: 20115 - DNA, 22 bp, Artificial Sequence
  Synthetic Construct
gccaacacgaagtcgcttcaca

SEQ ID NO: 20116 - DNA, 24 bp, Artificial Sequence
  Synthetic Construct
tgcctgaattccaacgaggatttt

SEQ ID NO: 20117 - DNA, 22 bp, Artificial Sequence
  Synthetic Construct
gtggtctaggcaatccctcagt

SEQ ID NO: 20118 - DNA, 30 bp, Artificial Sequence
  Synthetic Construct
ggttgtctaggaataggctatagattggaa

SEQ ID NO: 20119 - DNA, 22 bp, Artificial Sequence
  Synthetic Construct
gtgcagttttgctttccctctt

SEQ ID NO: 20120 - DNA, 24 bp, Artificial Sequence
  Synthetic Construct
cacgcaagctccttaagctattgt

SEQ ID NO: 20121 - DNA, 20 bp, Artificial Sequence
  Synthetic Construct
tgtccttccgtgtgctgctt

SEQ ID NO: 20122 - DNA, 24 bp, Artificial Sequence
  Synthetic Construct
ggcttctgggaaaacccaagtaaa

SEQ ID NO: 20123 - DNA, 20 bp, Artificial Sequence
  Synthetic Construct
tggccaggatttggcagtga

SEQ ID NO: 20124 - DNA, 25 bp, Artificial Sequence
  Synthetic Construct
ggagaatggccttaggagtctgaca

SEQ ID NO: 20125 - DNA, 22 bp, Artificial Sequence
  Synthetic Construct
gctcctgaaactgagccacaca

SEQ ID NO: 20126 - DNA, 24 bp, Artificial Sequence
  Synthetic Construct
gtgtcattcaccacagaaccatgt

SEQ ID NO: 20127 - DNA, 25 bp, Artificial Sequence
  Synthetic Construct
ctccggctttaacacttcaaagact

SEQ ID NO: 20128 - DNA, 24 bp, Artificial Sequence
  Synthetic Construct
actgaccgcaaaggaaataaggat

SEQ ID NO: 20129 - DNA, 25 bp, Artificial Sequence
  Synthetic Construct
gtgcaactgggtgactaaagaccaa

SEQ ID NO: 20130 - DNA, 25 bp, Artificial Sequence
  Synthetic Construct
gctgtctcagtgcaacaacaagtga

SEQ ID NO: 20131 - DNA, 21 bp, Artificial Sequence
  Synthetic Construct
cccacttcaggcccctctctt

SEQ ID NO: 20132 - DNA, 29 bp, Artificial Sequence
  Synthetic Construct
ggcacagcctttagaatagcctctaaaat

SEQ ID NO: 20133 - DNA, 26 bp, Artificial Sequence
  Synthetic Construct
gtccgatgtaatggaaaagagacaca

SEQ ID NO: 20134 - DNA, 26 bp, Artificial Sequence
  Synthetic Construct
gcagagagagctcacatcttaccatt

SEQ ID NO: 20135 - DNA, 24 bp, Artificial Sequence
  Synthetic Construct
ggcatgtattgacaaaggcttctt

SEQ ID NO: 20136 - DNA, 20 bp, Artificial Sequence
  Synthetic Construct
ggcagcagactgcctgactt

SEQ ID NO: 20137 - DNA, 23 bp, Artificial Sequence
  Synthetic Construct
cacgctgagagaagcagcatttg

SEQ ID NO: 20138 - DNA, 24 bp, Artificial Sequence
  Synthetic Construct
ccagaggctgatctgcactaccaa

SEQ ID NO: 20139 - DNA, 20 bp, Artificial Sequence
  Synthetic Construct
tggggtgaagccagaagtca

SEQ ID NO: 20140 - DNA, 26 bp, Artificial Sequence
  Synthetic Construct
gtccaccagaggcatgttaaaaggta

SEQ ID NO: 20141 - DNA, 20 bp, Artificial Sequence
  Synthetic Construct
accaagcccaagtcctcctt

SEQ ID NO: 20142 - DNA, 25 bp, Artificial Sequence
  Synthetic Construct
cacgtcgtaaacatgactggtttta

SEQ ID NO: 20143 - DNA, 24 bp, Artificial Sequence
  Synthetic Construct
gccccatctctacttgtcactgat

SEQ ID NO: 20144 - DNA, 23 bp, Artificial Sequence
  Synthetic Construct
cttctgtcagacctacctgcatt

SEQ ID NO: 20145 - DNA, 24 bp, Artificial Sequence
  Synthetic Construct
ctgtgtggtttgtctggtgggtta

SEQ ID NO: 20146 - DNA, 22 bp, Artificial Sequence
  Synthetic Construct
ggcaacagagaacgtgatgaag

SEQ ID NO: 20147 - DNA, 20 bp, Artificial Sequence
  Synthetic Construct
tccctcccaaactgctctca

SEQ ID NO: 20148 - DNA, 22 bp, Artificial Sequence
  Synthetic Construct
ggcagaaggcaggagctttgaa

SEQ ID NO: 20149 - DNA, 27 bp, Artificial Sequence
  Synthetic Construct
ggcacatgccatatgattgatactgat

SEQ ID NO: 20150 - DNA, 23 bp, Artificial Sequence
  Synthetic Construct
ggggcgaacacatctaaaaccat

SEQ ID NO: 20151 - DNA, 23 bp, Artificial Sequence
  Synthetic Construct
ctcccaatgcaaccctgttcttg

SEQ ID NO: 20152 - DNA, 27 bp, Artificial Sequence
  Synthetic Construct
ggcaacccatgttatttagtagggaaa

SEQ ID NO: 20153 - DNA, 21 bp, Artificial Sequence
  Synthetic Construct
gagctggcaaaagcacaactt

SEQ ID NO: 20154 - DNA, 21 bp, Artificial Sequence
  Synthetic Construct
cgtgtggaactgcacctcatc

SEQ ID NO: 20155 - DNA, 22 bp, Artificial Sequence
  Synthetic Construct
cagggccccttttcacaacaac

SEQ ID NO: 20156 - DNA, 22 bp, Artificial Sequence
  Synthetic Construct
ttcgctgctgcatttctagtct

SEQ ID NO: 20157 - DNA, 22 bp, Artificial Sequence
  Synthetic Construct
tctctagatgcccaggaactgt

SEQ ID NO: 20158 - DNA, 21 bp, Artificial Sequence
  Synthetic Construct
ggtgtgtgtttccacctgtgt

SEQ ID NO: 20159 - DNA, 24 bp, Artificial Sequence
  Synthetic Construct
gcagcttgtgaccatgacaagaaa

SEQ ID NO: 20160 - DNA, 21 bp, Artificial Sequence
  Synthetic Construct
cggggcagtgagtcaggagta

SEQ ID NO: 20161 - DNA, 22 bp, Artificial Sequence
  Synthetic Construct
aggcacacaacaaagcagaaga

SEQ ID NO: 20162 - DNA, 27 bp, Artificial Sequence
  Synthetic Construct
ccaccttatagggtagccctcatatct

SEQ ID NO: 20163 - DNA, 22 bp, Artificial Sequence
  Synthetic Construct
gttcaaatgcgcagctcttagt

SEQ ID NO: 20164 - DNA, 20 bp, Artificial Sequence
  Synthetic Construct
gcatatgacctgcgccttga

SEQ ID NO: 20165 - DNA, 22 bp, Artificial Sequence
  Synthetic Construct
ctccaaaggaggtgtggtcaac

SEQ ID NO: 20166 - DNA, 28 bp, Artificial Sequence
  Synthetic Construct
ggggtagatctagttgttttggaccatt

SEQ ID NO: 20167 - DNA, 22 bp, Artificial Sequence
  Synthetic Construct
ccttcgccagggtaccattttc

SEQ ID NO: 20168 - DNA, 27 bp, Artificial Sequence
  Synthetic Construct
ctcatcttacctgttttcacggctact

SEQ ID NO: 20169 - DNA, 23 bp, Artificial Sequence
  Synthetic Construct
gcacatgccaatgtgggtgttag

SEQ ID NO: 20170 - DNA, 25 bp, Artificial Sequence
  Synthetic Construct
ccaacatatacactgcaccttgagt

SEQ ID NO: 20171 - DNA, 25 bp, Artificial Sequence
  Synthetic Construct
ccatctttgaacccctactgcctat

SEQ ID NO: 20172 - DNA, 23 bp, Artificial Sequence
  Synthetic Construct
actaaggcaatgctgagtggaaa

SEQ ID NO: 20173 - DNA, 20 bp, Artificial Sequence
  Synthetic Construct
tgggaaggttccaggcagtt

SEQ ID NO: 20174 - DNA, 22 bp, Artificial Sequence
  Synthetic Construct
tggcagctactggagactcgta

SEQ ID NO: 20175 - DNA, 25 bp, Artificial Sequence
  Synthetic Construct
caggagatgtacctttcaccaaaac

SEQ ID NO: 20176 - DNA, 26 bp, Artificial Sequence
  Synthetic Construct
ggggtaggatggagataggtttcaga

SEQ ID NO: 20177 - DNA, 27 bp, Artificial Sequence
  Synthetic Construct
ctcaatttggagggtctgaattggttt

SEQ ID NO: 20178 - DNA, 24 bp, Artificial Sequence
  Synthetic Construct
gatccaagccaatggggtattttc

SEQ ID NO: 20179 - DNA, 25 bp, Artificial Sequence
  Synthetic Construct
gccatcttagatcacaggagggaaa

SEQ ID NO: 20180 - DNA, 26 bp, Artificial Sequence
  Synthetic Construct
caccatatccccttagggtcttgaca

SEQ ID NO: 20181 - DNA, 24 bp, Artificial Sequence
  Synthetic Construct
ggcaaacagggagaatgggaatac

SEQ ID NO: 20182 - DNA, 24 bp, Artificial Sequence
  Synthetic Construct
gtgcaaggagagctgaatccatgt

SEQ ID NO: 20183 - DNA, 22 bp, Artificial Sequence
  Synthetic Construct
gtggtggggtttgttggcattc

SEQ ID NO: 20184 - DNA, 25 bp, Artificial Sequence
  Synthetic Construct
cgcaaccctgtttgttcaaagattc

SEQ ID NO: 20185 - DNA, 27 bp, Artificial Sequence
  Synthetic Construct
gggtagaggagacttcagtagttgtca

SEQ ID NO: 20186 - DNA, 24 bp, Artificial Sequence
  Synthetic Construct
ctttttctcatacctgcgcactct

SEQ ID NO: 20187 - DNA, 20 bp, Artificial Sequence
  Synthetic Construct
aaccacggaatgcgggactt

SEQ ID NO: 20188 - DNA, 23 bp, Artificial Sequence
  Synthetic Construct
tgacctggctatgcctgtttaat

SEQ ID NO: 20189 - DNA, 22 bp, Artificial Sequence
  Synthetic Construct
gtctgggaggaggaacaggaaa

SEQ ID NO: 20190 - DNA, 23 bp, Artificial Sequence
  Synthetic Construct
gcttgatgcaaaggaaggaaact

SEQ ID NO: 20191 - DNA, 23 bp, Artificial Sequence
  Synthetic Construct
gcccaatgccgttaaagatctga

SEQ ID NO: 20192 - DNA, 24 bp, Artificial Sequence
  Synthetic Construct
ctctcccaatttagcaccagcata

SEQ ID NO: 20193 - DNA, 22 bp, Artificial Sequence
  Synthetic Construct
ccctaactaggccagggagcaa

SEQ ID NO: 20194 - DNA, 24 bp, Artificial Sequence
  Synthetic Construct
ggggcttcccatagctaggattgt

SEQ ID NO: 20195 - DNA, 23 bp, Artificial Sequence
  Synthetic Construct
aggggagtacaaagccatcattg

SEQ ID NO: 20196 - DNA, 24 bp, Artificial Sequence
  Synthetic Construct
cactctcagtgggaagggaattag

SEQ ID NO: 20197 - DNA, 22 bp, Artificial Sequence
  Synthetic Construct
tgtcttgaaacagctcgtcact

SEQ ID NO: 20198 - DNA, 29 bp, Artificial Sequence
  Synthetic Construct
gagacccaataatggctgtagggatttta

SEQ ID NO: 20199 - DNA, 25 bp, Artificial Sequence
  Synthetic Construct
ctcaccaaggtccaccaattttcat

SEQ ID NO: 20200 - DNA, 27 bp, Artificial Sequence
  Synthetic Construct
ctccatccaatctgctgacctaagaac

SEQ ID NO: 20201 - DNA, 23 bp, Artificial Sequence
  Synthetic Construct
actgctttctagcatgtcaccaa

SEQ ID NO: 20202 - DNA, 25 bp, Artificial Sequence
  Synthetic Construct
gggaacatccttgcaataactccta

SEQ ID NO: 20203 - DNA, 24 bp, Artificial Sequence
  Synthetic Construct
gggctccaggtttagttagcagat

SEQ ID NO: 20204 - DNA, 22 bp, Artificial Sequence
  Synthetic Construct
cgctacgtgacttctgcttagt

SEQ ID NO: 20205 - DNA, 23 bp, Artificial Sequence
  Synthetic Construct
caccaagatggctaagtgacgaa

SEQ ID NO: 20206 - DNA, 22 bp, Artificial Sequence
  Synthetic Construct
gcctgggtaagtgatggcatag

SEQ ID NO: 20207 - DNA, 25 bp, Artificial Sequence
  Synthetic Construct
ggtcaactataggcttgcacgtgat

SEQ ID NO: 20208 - DNA, 25 bp, Artificial Sequence
  Synthetic Construct
cgctgactccaagtttctctatttg

SEQ ID NO: 20209 - DNA, 21 bp, Artificial Sequence
  Synthetic Construct
gggtgtgctgtttacgtggat

SEQ ID NO: 20210 - DNA, 22 bp, Artificial Sequence
  Synthetic Construct
tgttggaggtcagtcaggttgt

SEQ ID NO: 20211 - DNA, 24 bp, Artificial Sequence
  Synthetic Construct
gtagggcagatcaaaggaatgaga

SEQ ID NO: 20212 - DNA, 23 bp, Artificial Sequence
  Synthetic Construct
cctgagccaaaccatgcatcttc

SEQ ID NO: 20213 - DNA, 23 bp, Artificial Sequence
  Synthetic Construct
aggttaggtggtcctcagctatg

SEQ ID NO: 20214 - DNA, 22 bp, Artificial Sequence
  Synthetic Construct
agagcactcctcaaccaacttc

SEQ ID NO: 20215 - DNA, 24 bp, Artificial Sequence
  Synthetic Construct
ctggcacacctgttgatgttgaag

SEQ ID NO: 20216 - DNA, 24 bp, Artificial Sequence
  Synthetic Construct
ggcttcacagaagaggtggtatga

SEQ ID NO: 20217 - DNA, 21 bp, Artificial Sequence
  Synthetic Construct
gctaggcgctacccctagaag

SEQ ID NO: 20218 - DNA, 26 bp, Artificial Sequence
  Synthetic Construct
cctggatgtagcagataagggttttc

SEQ ID NO: 20219 - DNA, 25 bp, Artificial Sequence
  Synthetic Construct
cccactggaaggaagctttaagatg

SEQ ID NO: 20220 - DNA, 27 bp, Artificial Sequence
  Synthetic Construct
ctagctctctcgtatcattcagactac

SEQ ID NO: 20221 - DNA, 22 bp, Artificial Sequence
  Synthetic Construct
ttcacacagctgtcacagacaa

SEQ ID NO: 20222 - DNA, 25 bp, Artificial Sequence
  Synthetic Construct
cttgaggtctgattggatgaagtga

SEQ ID NO: 20223 - DNA, 26 bp, Artificial Sequence
  Synthetic Construct
cacgtccactaaaattcctgctcttg

SEQ ID NO: 20224 - DNA, 22 bp, Artificial Sequence
  Synthetic Construct
ccagaggcaaagggaagactca

SEQ ID NO: 20225 - DNA, 27 bp, Artificial Sequence
  Synthetic Construct
ggccatagataacctgatgaacacaag

SEQ ID NO: 20226 - DNA, 25 bp, Artificial Sequence
  Synthetic Construct
tgaacttgattctacaggcagtgat

SEQ ID NO: 20227 - DNA, 21 bp, Artificial Sequence
  Synthetic Construct
tggctgctacaccaaatcgtt

SEQ ID NO: 20228 - DNA, 23 bp, Artificial Sequence
  Synthetic Construct
acagtgcaaagaaggggcttaaa

SEQ ID NO: 20229 - DNA, 27 bp, Artificial Sequence
  Synthetic Construct
ggctttgtgactgctttgactaacaga

SEQ ID NO: 20230 - DNA, 22 bp, Artificial Sequence
  Synthetic Construct
ccgccaatcctctccaacttgt

SEQ ID NO: 20231 - DNA, 25 bp, Artificial Sequence
  Synthetic Construct
ggtctgttcctaaaggtcggagact

SEQ ID NO: 20232 - DNA, 25 bp, Artificial Sequence
  Synthetic Construct
ggggattgaaattcagcaccaccaa

SEQ ID NO: 20233 - DNA, 28 bp, Artificial Sequence
  Synthetic Construct
cggagtaagtctttgtctcaaacagcat

SEQ ID NO: 20234 - DNA, 20 bp, Artificial Sequence
  Synthetic Construct
aaggcaggtgctgctcctat

SEQ ID NO: 20235 - DNA, 23 bp, Artificial Sequence
  Synthetic Construct
ggggtgcagtagccctctatgaa

SEQ ID NO: 20236 - DNA, 23 bp, Artificial Sequence
  Synthetic Construct
cgtttcggaagctaacgctttct

SEQ ID NO: 20237 - DNA, 25 bp, Artificial Sequence
  Synthetic Construct
acattgtacagatgctgcctaagaa

SEQ ID NO: 20238 - DNA, 25 bp, Artificial Sequence
  Synthetic Construct
ggatgaaaagtggaagacagggaaa

SEQ ID NO: 20239 - DNA, 23 bp, Artificial Sequence
  Synthetic Construct
gcacccacttaccttctccatag

SEQ ID NO: 20240 - DNA, 25 bp, Artificial Sequence
  Synthetic Construct
gagctgttgtgtcatggtgaaaaat

SEQ ID NO: 20241 - DNA, 23 bp, Artificial Sequence
  Synthetic Construct
tgctagagactcagatcccaaga

SEQ ID NO: 20242 - DNA, 22 bp, Artificial Sequence
  Synthetic Construct
ctggtccccatgtttgctttct

SEQ ID NO: 20243 - DNA, 22 bp, Artificial Sequence
  Synthetic Construct
agcggtgtgaggtagagacact

SEQ ID NO: 20244 - DNA, 23 bp, Artificial Sequence
  Synthetic Construct
gcagcctgacaaccttggtaagt

SEQ ID NO: 20245 - DNA, 27 bp, Artificial Sequence
  Synthetic Construct
ctctaactacaacattggcctcagaac

SEQ ID NO: 20246 - DNA, 26 bp, Artificial Sequence
  Synthetic Construct
ctgtgaaccaatagacggaattgatg

SEQ ID NO: 20247 - DNA, 23 bp, Artificial Sequence
  Synthetic Construct
cagagctggactaagacttgctt

SEQ ID NO: 20248 - DNA, 21 bp, Artificial Sequence
  Synthetic Construct
tccacctcttcgctgcctttg

SEQ ID NO: 20249 - DNA, 24 bp, Artificial Sequence
  Synthetic Construct
tcccaaagtgaatgctgacataga

SEQ ID NO: 20250 - DNA, 26 bp, Artificial Sequence
  Synthetic Construct
gctgtcgttgcctatacaactgttac

SEQ ID NO: 20251 - DNA, 22 bp, Artificial Sequence
  Synthetic Construct
ggagcctactgggaatcaggaa

SEQ ID NO: 20252 - DNA, 25 bp, Artificial Sequence
  Synthetic Construct
ggaagagctgggctttgttttctgt

SEQ ID NO: 20253 - DNA, 24 bp, Artificial Sequence
  Synthetic Construct
gccagatgcaggaaaggaacaatg

SEQ ID NO: 20254 - DNA, 23 bp, Artificial Sequence
  Synthetic Construct
cgatcaggacactgagcctatca

SEQ ID NO: 20255 - DNA, 26 bp, Artificial Sequence
  Synthetic Construct
ttggagaggtagatgaaagaggagat

SEQ ID NO: 20256 - DNA, 21 bp, Artificial Sequence
  Synthetic Construct
ccccagtgcaacacagagctt

SEQ ID NO: 20257 - DNA, 19 bp, Artificial Sequence
  Synthetic Construct
aggagcaaccgcgccatac

SEQ ID NO: 20258 - DNA, 23 bp, Artificial Sequence
  Synthetic Construct
cggccctcatctttcaggaagta

SEQ ID NO: 20259 - DNA, 22 bp, Artificial Sequence
  Synthetic Construct
ctggctgcttcctcttcctatc

SEQ ID NO: 20260 - DNA, 29 bp, Artificial Sequence
  Synthetic Construct
gggatctaggcatataaacagttctcttc

SEQ ID NO: 20261 - DNA, 22 bp, Artificial Sequence
  Synthetic Construct
ctggagctcattggctggaagt

SEQ ID NO: 20262 - DNA, 23 bp, Artificial Sequence
  Synthetic Construct
ggtattctctgctgcatggatct

SEQ ID NO: 20263 - DNA, 26 bp, Artificial Sequence
  Synthetic Construct
gaccccttaaactttctggagcaaac

SEQ ID NO: 20264 - DNA, 21 bp, Artificial Sequence
  Synthetic Construct
ccctctcagggccttggtttc

SEQ ID NO: 20265 - DNA, 26 bp, Artificial Sequence
  Synthetic Construct
gctaaggacaccatgaaggatagcaa

SEQ ID NO: 20266 - DNA, 20 bp, Artificial Sequence
  Synthetic Construct
aagtcaggcgctgtctggaa

SEQ ID NO: 20267 - DNA, 20 bp, Artificial Sequence
  Synthetic Construct
tggcagtgagggagggattc

SEQ ID NO: 20268 - DNA, 22 bp, Artificial Sequence
  Synthetic Construct
tgggaggagattcgcctgatga

SEQ ID NO: 20269 - DNA, 25 bp, Artificial Sequence
  Synthetic Construct
gcccagatttaagaagagagggatt

SEQ ID NO: 20270 - DNA, 24 bp, Artificial Sequence
  Synthetic Construct
ctgtcctccaagcctgtacaaagt

SEQ ID NO: 20271 - DNA, 22 bp, Artificial Sequence
  Synthetic Construct
acccctctaccttccagtgaac

SEQ ID NO: 20272 - DNA, 22 bp, Artificial Sequence
  Synthetic Construct
gccagtttcttcagctccaagt

SEQ ID NO: 20273 - DNA, 21 bp, Artificial Sequence
  Synthetic Construct
ccctgaagctgttcggctttg

SEQ ID NO: 20274 - DNA, 21 bp, Artificial Sequence
  Synthetic Construct
tggggagggatcagagacaca

SEQ ID NO: 20275 - DNA, 22 bp, Artificial Sequence
  Synthetic Construct
gcctcttgaggagggacctttc

SEQ ID NO: 20276 - DNA, 22 bp, Artificial Sequence
  Synthetic Construct
tcccactgccctaagtctttga

SEQ ID NO: 20277 - DNA, 21 bp, Artificial Sequence
  Synthetic Construct
cgccaatggctctcctcactt

SEQ ID NO: 20278 - DNA, 25 bp, Artificial Sequence
  Synthetic Construct
cttcccagcatattgcaaagacaca

SEQ ID NO: 20279 - DNA, 24 bp, Artificial Sequence
  Synthetic Construct
gaacctgtgtggacctgatcaaac

SEQ ID NO: 20280 - DNA, 24 bp, Artificial Sequence
  Synthetic Construct
gctgtggtttgggctgaagaattt

SEQ ID NO: 20281 - DNA, 22 bp, Artificial Sequence
  Synthetic Construct
gctcaagggttggactccatgt

SEQ ID NO: 20282 - DNA, 22 bp, Artificial Sequence
  Synthetic Construct
gggatgtggtgggaatcaccat

SEQ ID NO: 20283 - DNA, 26 bp, Artificial Sequence
  Synthetic Construct
cagaaactaccaggtgcttcatggtt

SEQ ID NO: 20284 - DNA, 21 bp, Artificial Sequence
  Synthetic Construct
ggcctcatcttcccagtgctt

SEQ ID NO: 20285 - DNA, 25 bp, Artificial Sequence
  Synthetic Construct
gtcaggggcatcttagttttctgta

SEQ ID NO: 20286 - DNA, 26 bp, Artificial Sequence
  Synthetic Construct
actctcctttactggatcttcctact

SEQ ID NO: 20287 - DNA, 24 bp, Artificial Sequence
  Synthetic Construct
ccttggagtcaccctagattcttc

SEQ ID NO: 20288 - DNA, 22 bp, Artificial Sequence
  Synthetic Construct
agcccctgatgtacctttctgt

SEQ ID NO: 20289 - DNA, 25 bp, Artificial Sequence
  Synthetic Construct
ctagtccatggatactggcatttct

SEQ ID NO: 20290 - DNA, 20 bp, Artificial Sequence
  Synthetic Construct
gccagcatggttggcttttg

SEQ ID NO: 20291 - DNA, 23 bp, Artificial Sequence
  Synthetic Construct
ggccaccttagaggtttgtttgt

SEQ ID NO: 20292 - DNA, 22 bp, Artificial Sequence
  Synthetic Construct
ggggagggtcaactgtcctcta

SEQ ID NO: 20293 - DNA, 22 bp, Artificial Sequence
  Synthetic Construct
ccaacccattccaaggcagtca

SEQ ID NO: 20294 - DNA, 24 bp, Artificial Sequence
  Synthetic Construct
tgaatcctagagagcggaactttg

SEQ ID NO: 20295 - DNA, 27 bp, Artificial Sequence
  Synthetic Construct
gtgttacctgtcatttcctacccttag

SEQ ID NO: 20296 - DNA, 21 bp, Artificial Sequence
  Synthetic Construct
attcccctgtgccgggacttc

SEQ ID NO: 20297 - DNA, 26 bp, Artificial Sequence
  Synthetic Construct
gcaatggctagctcttagctattcta

SEQ ID NO: 20298 - DNA, 23 bp, Artificial Sequence
  Synthetic Construct
gccatgtgcctttggtcatgaga

SEQ ID NO: 20299 - DNA, 24 bp, Artificial Sequence
  Synthetic Construct
gacaagcctcttcacgatgaaaca

SEQ ID NO: 20300 - DNA, 27 bp, Artificial Sequence
  Synthetic Construct
ggatatttgtacggggacctcctatac

SEQ ID NO: 20301 - DNA, 20 bp, Artificial Sequence
  Synthetic Construct
ttgacctctgcctgccattc

SEQ ID NO: 20302 - DNA, 20 bp, Artificial Sequence
  Synthetic Construct
tgtgggcaggcctcttagat

SEQ ID NO: 20303 - DNA, 28 bp, Artificial Sequence
  Synthetic Construct
cagctccttccccttaagaagtaaatca

SEQ ID NO: 20304 - DNA, 25 bp, Artificial Sequence
  Synthetic Construct
gcccttagaacacaggatccagaag

SEQ ID NO: 20305 - DNA, 27 bp, Artificial Sequence
  Synthetic Construct
ccaagtctgtcgtgcaaaaattctaac

SEQ ID NO: 20306 - DNA, 29 bp, Artificial Sequence
  Synthetic Construct
gactaggaagctaaagaatcagtgagagt

SEQ ID NO: 20307 - DNA, 25 bp, Artificial Sequence
  Synthetic Construct
gacgggtgactaagtctcacagttg

SEQ ID NO: 20308 - DNA, 23 bp, Artificial Sequence
  Synthetic Construct
ccctggaaagactgattggcatt

SEQ ID NO: 20309 - DNA, 20 bp, Artificial Sequence
  Synthetic Construct
ccggattcacgagtgcctaa

SEQ ID NO: 20310 - DNA, 23 bp, Artificial Sequence
  Synthetic Construct
gggaattggcatttctggcaaca

SEQ ID NO: 20311 - DNA, 23 bp, Artificial Sequence
  Synthetic Construct
ccccttccattttccctttcctt

SEQ ID NO: 20312 - DNA, 25 bp, Artificial Sequence
  Synthetic Construct
tcgccatctacccagaaaagattta

SEQ ID NO: 20313 - DNA, 20 bp, Artificial Sequence
  Synthetic Construct
tgcgacaaggctctctgact

SEQ ID NO: 20314 - DNA, 23 bp, Artificial Sequence
  Synthetic Construct
gggcgaccataaattgccctgaa

SEQ ID NO: 20315 - DNA, 22 bp, Artificial Sequence
  Synthetic Construct
gcctagacccagaggcaattct

SEQ ID NO: 20316 - DNA, 27 bp, Artificial Sequence
  Synthetic Construct
ccagtgaaggtttctgacatgaccata

SEQ ID NO: 20317 - DNA, 21 bp, Artificial Sequence
  Synthetic Construct
gccaggatgtacggcgtgtaa

SEQ ID NO: 20318 - DNA, 21 bp, Artificial Sequence
  Synthetic Construct
tgttctgtctggctggcattc

SEQ ID NO: 20319 - DNA, 21 bp, Artificial Sequence
  Synthetic Construct
cctggctgataccttggcttt

SEQ ID NO: 20320 - DNA, 22 bp, Artificial Sequence
  Synthetic Construct
caaccagtctggggtagagcaa

SEQ ID NO: 20321 - DNA, 30 bp, Artificial Sequence
  Synthetic Construct
ggaccgaagaatgttttgaactacaccata

SEQ ID NO: 20322 - DNA, 24 bp, Artificial Sequence
  Synthetic Construct
gagggttcagttagcctgagtatc

SEQ ID NO: 20323 - DNA, 27 bp, Artificial Sequence
  Synthetic Construct
gcattagtgagtgtgagctatggttag

SEQ ID NO: 20324 - DNA, 25 bp, Artificial Sequence
  Synthetic Construct
gcagggaccctattgtaacaagaca

SEQ ID NO: 20325 - DNA, 24 bp, Artificial Sequence
  Synthetic Construct
ccacagggactgattcagcagtga

SEQ ID NO: 20326 - DNA, 24 bp, Artificial Sequence
  Synthetic Construct
ggggagagacaggatcaaccagta

SEQ ID NO: 20327 - DNA, 24 bp, Artificial Sequence
  Synthetic Construct
ccccaggtattctcagcttcaatg

SEQ ID NO: 20328 - DNA, 22 bp, Artificial Sequence
  Synthetic Construct
ttccaaagcctgcggaattcta

SEQ ID NO: 20329 - DNA, 30 bp, Artificial Sequence
  Synthetic Construct
gggaacaatcagtggtcactatatttgcat

SEQ ID NO: 20330 - DNA, 24 bp, Artificial Sequence
  Synthetic Construct
cactgctcagatcacccttaaaga

SEQ ID NO: 20331 - DNA, 30 bp, Artificial Sequence
  Synthetic Construct
ccagtttaactttgaatgctcaacgcttct

SEQ ID NO: 20332 - DNA, 22 bp, Artificial Sequence
  Synthetic Construct
ccaccctgtaaaagcaggaaga

SEQ ID NO: 20333 - DNA, 25 bp, Artificial Sequence
  Synthetic Construct
cgtaagtcctttgtggcctccaata

SEQ ID NO: 20334 - DNA, 22 bp, Artificial Sequence
  Synthetic Construct
ggtggaggaatgctctgctaaa

SEQ ID NO: 20335 - DNA, 24 bp, Artificial Sequence
  Synthetic Construct
ggtgattgctgcagatgggctaag

SEQ ID NO: 20336 - DNA, 27 bp, Artificial Sequence
  Synthetic Construct
gcagcattaacattgctgaacgtttct

SEQ ID NO: 20337 - DNA, 30 bp, Artificial Sequence
  Synthetic Construct
gagcaacactgatggagaagaaagaaatgt

SEQ ID NO: 20338 - DNA, 22 bp, Artificial Sequence
  Synthetic Construct
ggctgtgctagacaggttgaag

SEQ ID NO: 20339 - DNA, 26 bp, Artificial Sequence
  Synthetic Construct
cacatgagtgagcctgaaagtggata

SEQ ID NO: 20340 - DNA, 23 bp, Artificial Sequence
  Synthetic Construct
ctggtgctctccatgcactcatt

SEQ ID NO: 20341 - DNA, 25 bp, Artificial Sequence
  Synthetic Construct
gagggtttattcaccatccatcaca

SEQ ID NO: 20342 - DNA, 24 bp, Artificial Sequence
  Synthetic Construct
ctggagtctgaagtcccctgaatc

SEQ ID NO: 20343 - DNA, 22 bp, Artificial Sequence
  Synthetic Construct
gttctggccactctttctctgt

SEQ ID NO: 20344 - DNA, 28 bp, Artificial Sequence
  Synthetic Construct
cctggaaaatttcttctccagtcccaaa

SEQ ID NO: 20345 - DNA, 26 bp, Artificial Sequence
  Synthetic Construct
gccatgctttgtagttatgggagaga

SEQ ID NO: 20346 - DNA, 27 bp, Artificial Sequence
  Synthetic Construct
ctgaatctactcagctccattgacaag

SEQ ID NO: 20347 - DNA, 25 bp, Artificial Sequence
  Synthetic Construct
gcatggagtatattgctgctgaaag

SEQ ID NO: 20348 - DNA, 27 bp, Artificial Sequence
  Synthetic Construct
ggtcagagagagaacaaacacttcctt

SEQ ID NO: 20349 - DNA, 22 bp, Artificial Sequence
  Synthetic Construct
cttccaagccagtccaccaaca

SEQ ID NO: 20350 - DNA, 24 bp, Artificial Sequence
  Synthetic Construct
ggtcgtgtttggaagagacacaca

SEQ ID NO: 20351 - DNA, 23 bp, Artificial Sequence
  Synthetic Construct
agctccatagcaacctctctgaa

SEQ ID NO: 20352 - DNA, 23 bp, Artificial Sequence
  Synthetic Construct
acccttccttgcaagacattgat

SEQ ID NO: 20353 - DNA, 27 bp, Artificial Sequence
  Synthetic Construct
gggagaatagcaagtctggtagcaaag

SEQ ID NO: 20354 - DNA, 24 bp, Artificial Sequence
  Synthetic Construct
ggatctgtggctgttttcaagaag

SEQ ID NO: 20355 - DNA, 25 bp, Artificial Sequence
  Synthetic Construct
agggctatttcataggcttggattc

SEQ ID NO: 20356 - DNA, 25 bp, Artificial Sequence
  Synthetic Construct
gagacagcaggtatttgttcagttg

SEQ ID NO: 20357 - DNA, 22 bp, Artificial Sequence
  Synthetic Construct
ccctggctctgagctcatttca

SEQ ID NO: 20358 - DNA, 26 bp, Artificial Sequence
  Synthetic Construct
gctctccatagcctcatttcccacta

SEQ ID NO: 20359 - DNA, 26 bp, Artificial Sequence
  Synthetic Construct
gcaacaaccttgtgtaaatcccttca

SEQ ID NO: 20360 - DNA, 24 bp, Artificial Sequence
  Synthetic Construct
ctcaagcgatcctccctctctttg

SEQ ID NO: 20361 - DNA, 22 bp, Artificial Sequence
  Synthetic Construct
tggtttgcacttcactcgtttc

SEQ ID NO: 20362 - DNA, 23 bp, Artificial Sequence
  Synthetic Construct
gcttttgcaccattgtgaagttg

SEQ ID NO: 20363 - DNA, 24 bp, Artificial Sequence
  Synthetic Construct
ctgaaccgtctgtgggaaagttct

SEQ ID NO: 20364 - DNA, 24 bp, Artificial Sequence
  Synthetic Construct
ctcccataggcacatcaattctga

SEQ ID NO: 20365 - DNA, 29 bp, Artificial Sequence
  Synthetic Construct
ctgttcagaatcaggactgactactctct

SEQ ID NO: 20366 - DNA, 24 bp, Artificial Sequence
  Synthetic Construct
cccttagttgtgaaggatggttct

SEQ ID NO: 20367 - DNA, 21 bp, Artificial Sequence
  Synthetic Construct
gctggcatctactggcacaca

SEQ ID NO: 20368 - DNA, 20 bp, Artificial Sequence
  Synthetic Construct
ggactgtgtcggtggtttga

SEQ ID NO: 20369 - DNA, 24 bp, Artificial Sequence
  Synthetic Construct
cagtaagttctgaggtcctgtgtt

SEQ ID NO: 20370 - DNA, 22 bp, Artificial Sequence
  Synthetic Construct
gaggaaagggtggccatcatca

SEQ ID NO: 20371 - DNA, 23 bp, Artificial Sequence
  Synthetic Construct
gctgcacaggattttccacaatg

SEQ ID NO: 20372 - DNA, 22 bp, Artificial Sequence
  Synthetic Construct
ttgcctgggcttttgaggtatt

SEQ ID NO: 20373 - DNA, 20 bp, Artificial Sequence
  Synthetic Construct
ctgctctttgctccgtgaca

SEQ ID NO: 20374 - DNA, 20 bp, Artificial Sequence
  Synthetic Construct
tcagactggccttcgagaca

SEQ ID NO: 20375 - DNA, 22 bp, Artificial Sequence
  Synthetic Construct
ggaccccagtcactgcatttca

SEQ ID NO: 20376 - DNA, 27 bp, Artificial Sequence
  Synthetic Construct
gcagatcttggagatgacccataattc

SEQ ID NO: 20377 - DNA, 24 bp, Artificial Sequence
  Synthetic Construct
gcaaagagccaacttctgatctgt

SEQ ID NO: 20378 - DNA, 24 bp, Artificial Sequence
  Synthetic Construct
aggtaaggagggcagtttctatga

SEQ ID NO: 20379 - DNA, 21 bp, Artificial Sequence
  Synthetic Construct
cgtggtaacaccgcactcaag

SEQ ID NO: 20380 - DNA, 24 bp, Artificial Sequence
  Synthetic Construct
gggtccaaaggacatttcagacta

SEQ ID NO: 20381 - DNA, 20 bp, Artificial Sequence
  Synthetic Construct
agggctgtgtgaggttccat

SEQ ID NO: 20382 - DNA, 25 bp, Artificial Sequence
  Synthetic Construct
gccttgaagttgccttcaaaacact

SEQ ID NO: 20383 - DNA, 23 bp, Artificial Sequence
  Synthetic Construct
gcctgaccaattctgtggctctt

SEQ ID NO: 20384 - DNA, 24 bp, Artificial Sequence
  Synthetic Construct
ggtctcatctcactgtgtctcaac

SEQ ID NO: 20385 - DNA, 27 bp, Artificial Sequence
  Synthetic Construct
cgggcaatggataaccaagttttcttc

SEQ ID NO: 20386 - DNA, 26 bp, Artificial Sequence
  Synthetic Construct
gtgtcatcccacattgagtgaaaact

SEQ ID NO: 20387 - DNA, 22 bp, Artificial Sequence
  Synthetic Construct
ccctcgtcagcttttccactct

SEQ ID NO: 20388 - DNA, 25 bp, Artificial Sequence
  Synthetic Construct
cttggtccttggtgccttatttagt

SEQ ID NO: 20389 - DNA, 25 bp, Artificial Sequence
  Synthetic Construct
cgtgggcctaagttttcaactcatt

SEQ ID NO: 20390 - DNA, 22 bp, Artificial Sequence
  Synthetic Construct
tggagacccatgctgtcaggaa

SEQ ID NO: 20391 - DNA, 23 bp, Artificial Sequence
  Synthetic Construct
ccaaggaggctgaatgaagtgat

SEQ ID NO: 20392 - DNA, 23 bp, Artificial Sequence
  Synthetic Construct
tgaagaaccattgctgtcctgat

SEQ ID NO: 20393 - DNA, 22 bp, Artificial Sequence
  Synthetic Construct
tccatccacctcggtctccaaa

SEQ ID NO: 20394 - DNA, 22 bp, Artificial Sequence
  Synthetic Construct
agggtcattttctggcctttga

SEQ ID NO: 20395 - DNA, 22 bp, Artificial Sequence
  Synthetic Construct
gtgttctggacacggacgtaag

SEQ ID NO: 20396 - DNA, 28 bp, Artificial Sequence
  Synthetic Construct
gtggatctttgctcttggtgaagatgta

SEQ ID NO: 20397 - DNA, 18 bp, Artificial Sequence
  Synthetic Construct
ttggggcatgccgtcact

SEQ ID NO: 20398 - DNA, 27 bp, Artificial Sequence
  Synthetic Construct
gacaaggtggtcctcagatagattaca

SEQ ID NO: 20399 - DNA, 21 bp, Artificial Sequence
  Synthetic Construct
agtgtgctaacttggctgcaa

SEQ ID NO: 20400 - DNA, 28 bp, Artificial Sequence
  Synthetic Construct
ggcagtggacttaaaatatggggaagat

SEQ ID NO: 20401 - DNA, 24 bp, Artificial Sequence
  Synthetic Construct
gccaaaggttgtctaactggtagt

SEQ ID NO: 20402 - DNA, 21 bp, Artificial Sequence
  Synthetic Construct
cctgcaccgtgccttctcatt

SEQ ID NO: 20403 - DNA, 23 bp, Artificial Sequence
  Synthetic Construct
ctggaatcagctgctgtggtatg

SEQ ID NO: 20404 - DNA, 22 bp, Artificial Sequence
  Synthetic Construct
gcagctacacatccccttctct

SEQ ID NO: 20405 - DNA, 22 bp, Artificial Sequence
  Synthetic Construct
cctctccatttctgggctcctt

SEQ ID NO: 20406 - DNA, 25 bp, Artificial Sequence
  Synthetic Construct
gcaggagtcagaaaagtaacacaaa

SEQ ID NO: 20407 - DNA, 25 bp, Artificial Sequence
  Synthetic Construct
gtgaaggggctgagtcaaaatgaac

SEQ ID NO: 20408 - DNA, 24 bp, Artificial Sequence
  Synthetic Construct
cagtggttttcaggagccctaatc

SEQ ID NO: 20409 - DNA, 23 bp, Artificial Sequence
  Synthetic Construct
gtgtcatttgctcgtttgccttt

SEQ ID NO: 20410 - DNA, 22 bp, Artificial Sequence
  Synthetic Construct
ggtggggcacaaattcagttac

SEQ ID NO: 20411 - DNA, 26 bp, Artificial Sequence
  Synthetic Construct
gcactttacacatcctgatgtctctt

SEQ ID NO: 20412 - DNA, 20 bp, Artificial Sequence
  Synthetic Construct
ccaggctttgggaacaccat

SEQ ID NO: 20413 - DNA, 26 bp, Artificial Sequence
  Synthetic Construct
gcctgacatttttcctagagggagat

SEQ ID NO: 20414 - DNA, 24 bp, Artificial Sequence
  Synthetic Construct
agaagggaactcagaggttaccaa

SEQ ID NO: 20415 - DNA, 20 bp, Artificial Sequence
  Synthetic Construct
ggcttcagcagggtcagact

SEQ ID NO: 20416 - DNA, 23 bp, Artificial Sequence
  Synthetic Construct
cccactacaccatgagctcttct

SEQ ID NO: 20417 - DNA, 25 bp, Artificial Sequence
  Synthetic Construct
ccatgtgaaaaactgcttcccttct

SEQ ID NO: 20418 - DNA, 23 bp, Artificial Sequence
  Synthetic Construct
gctcaggggtttagccttctttg

SEQ ID NO: 20419 - DNA, 26 bp, Artificial Sequence
  Synthetic Construct
caagaaggaagccaagtttggttatg

SEQ ID NO: 20420 - DNA, 25 bp, Artificial Sequence
  Synthetic Construct
cacagtcctgatggttgtcatggtt

SEQ ID NO: 20421 - DNA, 25 bp, Artificial Sequence
  Synthetic Construct
cagaagacaagatctctcccagatg

SEQ ID NO: 20422 - DNA, 23 bp, Artificial Sequence
  Synthetic Construct
gtctcctttgacactggccaaaa

SEQ ID NO: 20423 - DNA, 21 bp, Artificial Sequence
  Synthetic Construct
tcaacacacatggggttgcat

SEQ ID NO: 20424 - DNA, 26 bp, Artificial Sequence
  Synthetic Construct
ggacctagtcttattggactgggaat

SEQ ID NO: 20425 - DNA, 27 bp, Artificial Sequence
  Synthetic Construct
cgcccggccttatatagtattttcact

SEQ ID NO: 20426 - DNA, 27 bp, Artificial Sequence
  Synthetic Construct
ctctggcctttttagtttacagagttc

SEQ ID NO: 20427 - DNA, 24 bp, Artificial Sequence
  Synthetic Construct
tgctcattcacttgggatttggaa

SEQ ID NO: 20428 - DNA, 24 bp, Artificial Sequence
  Synthetic Construct
ccatcacctgcaatgcccattagt

SEQ ID NO: 20429 - DNA, 26 bp, Artificial Sequence
  Synthetic Construct
ggcactggggattactagaggaataa

SEQ ID NO: 20430 - DNA, 25 bp, Artificial Sequence
  Synthetic Construct
tctctcttcagccgagatgtaattg

SEQ ID NO: 20431 - DNA, 24 bp, Artificial Sequence
  Synthetic Construct
aggtgtgttggagaggaaaaacaa

SEQ ID NO: 20432 - DNA, 22 bp, Artificial Sequence
  Synthetic Construct
ggccccacaaaccttcttttct

SEQ ID NO: 20433 - DNA, 21 bp, Artificial Sequence
  Synthetic Construct
ggcttgtgtcacgaagggaaa

SEQ ID NO: 20434 - DNA, 22 bp, Artificial Sequence
  Synthetic Construct
gcacaagactcacaacctctgt

SEQ ID NO: 20435 - DNA, 25 bp, Artificial Sequence
  Synthetic Construct
ggcctcagatatttttggacgcaat

SEQ ID NO: 20436 - DNA, 25 bp, Artificial Sequence
  Synthetic Construct
gccctctagttctcagtttgacaga

SEQ ID NO: 20437 - DNA, 22 bp, Artificial Sequence
  Synthetic Construct
gtcccagaagtggcacagatca

SEQ ID NO: 20438 - DNA, 23 bp, Artificial Sequence
  Synthetic Construct
agatgggaactagcctggtatgt

SEQ ID NO: 20439 - DNA, 24 bp, Artificial Sequence
  Synthetic Construct
gccgtgggatcttgactgcaattt

SEQ ID NO: 20440 - DNA, 22 bp, Artificial Sequence
  Synthetic Construct
gtcccttcgtttgtcaccttct

SEQ ID NO: 20441 - DNA, 30 bp, Artificial Sequence
  Synthetic Construct
ggagctgaaaaacaattactgaacccgtta

SEQ ID NO: 20442 - DNA, 28 bp, Artificial Sequence
  Synthetic Construct
gcctgatctattagaggagcagagatgt

SEQ ID NO: 20443 - DNA, 24 bp, Artificial Sequence
  Synthetic Construct
gccatctggggaaaactggagaac

SEQ ID NO: 20444 - DNA, 25 bp, Artificial Sequence
  Synthetic Construct
ctgcaaaggtcagagctgtttgttg

SEQ ID NO: 20445 - DNA, 22 bp, Artificial Sequence
  Synthetic Construct
gagctggcctttgtgagtctct

SEQ ID NO: 20446 - DNA, 22 bp, Artificial Sequence
  Synthetic Construct
gtgctgaaagcaaggcgagaag

SEQ ID NO: 20447 - DNA, 23 bp, Artificial Sequence
  Synthetic Construct
ctggaaaacaggcagagcaaaga

SEQ ID NO: 20448 - DNA, 23 bp, Artificial Sequence
  Synthetic Construct
tccagtatacagaagcagcgttt

SEQ ID NO: 20449 - DNA, 30 bp, Artificial Sequence
  Synthetic Construct
ccagatataccgatcactgggtatcagttc

SEQ ID NO: 20450 - DNA, 22 bp, Artificial Sequence
  Synthetic Construct
gcaggcccaccttctcatgaat

SEQ ID NO: 20451 - DNA, 26 bp, Artificial Sequence
  Synthetic Construct
cctctccaacttaaacccttgatttc

SEQ ID NO: 20452 - DNA, 22 bp, Artificial Sequence
  Synthetic Construct
tccccagactgtggtgattttc

SEQ ID NO: 20453 - DNA, 24 bp, Artificial Sequence
  Synthetic Construct
tggaggagaggaggtattttggtt

SEQ ID NO: 20454 - DNA, 24 bp, Artificial Sequence
  Synthetic Construct
ggactctgggacattgggaactgt

SEQ ID NO: 20455 - DNA, 24 bp, Artificial Sequence
  Synthetic Construct
ccagatgttttggtctgtgcagta

SEQ ID NO: 20456 - DNA, 22 bp, Artificial Sequence
  Synthetic Construct
ggcgagagtaagagccagtaag

SEQ ID NO: 20457 - DNA, 29 bp, Artificial Sequence
  Synthetic Construct
ccctttatccactagattctatccctact

SEQ ID NO: 20458 - DNA, 28 bp, Artificial Sequence
  Synthetic Construct
ccttgccatattcccattcatgctgtag

SEQ ID NO: 20459 - DNA, 23 bp, Artificial Sequence
  Synthetic Construct
ccagtgaacaaggtgaggtgtag

SEQ ID NO: 20460 - DNA, 23 bp, Artificial Sequence
  Synthetic Construct
aaagtccctgatgaagtgctgtt

SEQ ID NO: 20461 - DNA, 22 bp, Artificial Sequence
  Synthetic Construct
ccaacacctcaggctaccttct

SEQ ID NO: 20462 - DNA, 23 bp, Artificial Sequence
  Synthetic Construct
agttgccctgaattcttgtgtga

SEQ ID NO: 20463 - DNA, 23 bp, Artificial Sequence
  Synthetic Construct
gctatcaaaggcctgacaacaag

SEQ ID NO: 20464 - DNA, 21 bp, Artificial Sequence
  Synthetic Construct
tggcctaaggaggggtgaatc

SEQ ID NO: 20465 - DNA, 22 bp, Artificial Sequence
  Synthetic Construct
gccctgcttagatccactttgt

SEQ ID NO: 20466 - DNA, 25 bp, Artificial Sequence
  Synthetic Construct
gctggtacagctgatagagagacta

SEQ ID NO: 20467 - DNA, 23 bp, Artificial Sequence
  Synthetic Construct
ggtgtcaaacactcactctgtca

SEQ ID NO: 20468 - DNA, 25 bp, Artificial Sequence
  Synthetic Construct
caggggtttgtttgatccattttga

SEQ ID NO: 20469 - DNA, 22 bp, Artificial Sequence
  Synthetic Construct
agggaggatcaccaggaagaaa

SEQ ID NO: 20470 - DNA, 21 bp, Artificial Sequence
  Synthetic Construct
agggccgtgacacttgctcta

SEQ ID NO: 20471 - DNA, 23 bp, Artificial Sequence
  Synthetic Construct
gcagagctaatgttttgggcaat

SEQ ID NO: 20472 - DNA, 26 bp, Artificial Sequence
  Synthetic Construct
cctggttcaacagttcaatgctgtct

SEQ ID NO: 20473 - DNA, 24 bp, Artificial Sequence
  Synthetic Construct
gcctttgcctaagacagagagaac

SEQ ID NO: 20474 - DNA, 29 bp, Artificial Sequence
  Synthetic Construct
gtctctgtgttcagaaggtagttttgact

SEQ ID NO: 20475 - DNA, 23 bp, Artificial Sequence
  Synthetic Construct
ggctttgagcagctttgatgaag

SEQ ID NO: 20476 - DNA, 22 bp, Artificial Sequence
  Synthetic Construct
gcagtgaagccaggtcctctaa

SEQ ID NO: 20477 - DNA, 27 bp, Artificial Sequence
  Synthetic Construct
ggaacagcccacctatatatccagatt

SEQ ID NO: 20478 - DNA, 25 bp, Artificial Sequence
  Synthetic Construct
gctaactcttgcttcgacaagaaac

SEQ ID NO: 20479 - DNA, 24 bp, Artificial Sequence
  Synthetic Construct
ggacagacgtagagcccagaatac

SEQ ID NO: 20480 - DNA, 23 bp, Artificial Sequence
  Synthetic Construct
gcaaagacagtggtgaaggatga

SEQ ID NO: 20481 - DNA, 23 bp, Artificial Sequence
  Synthetic Construct
cccaagaaggcacagaaccacaa

SEQ ID NO: 20482 - DNA, 22 bp, Artificial Sequence
  Synthetic Construct
atcctaccctactggggagcta

SEQ ID NO: 20483 - DNA, 26 bp, Artificial Sequence
  Synthetic Construct
tgtcacagtccagttgtctgaataac

SEQ ID NO: 20484 - DNA, 22 bp, Artificial Sequence
  Synthetic Construct
ccctgtttgcactctgccatct

SEQ ID NO: 20485 - DNA, 22 bp, Artificial Sequence
  Synthetic Construct
ggccacagaagggagaaagagt

SEQ ID NO: 20486 - DNA, 29 bp, Artificial Sequence
  Synthetic Construct
gctgctggtattattcaggagttacattg

SEQ ID NO: 20487 - DNA, 24 bp, Artificial Sequence
  Synthetic Construct
gagcaactctagctcaaagcaaca

SEQ ID NO: 20488 - DNA, 26 bp, Artificial Sequence
  Synthetic Construct
cgtgaaggacatttcttcttctgcat

SEQ ID NO: 20489 - DNA, 24 bp, Artificial Sequence
  Synthetic Construct
ggtggctgtttaggagagagttag

SEQ ID NO: 20490 - DNA, 23 bp, Artificial Sequence
  Synthetic Construct
ctgtgagtcggcttgttttctca

SEQ ID NO: 20491 - DNA, 24 bp, Artificial Sequence
  Synthetic Construct
cagccactggaaagtgagaggata

SEQ ID NO: 20492 - DNA, 25 bp, Artificial Sequence
  Synthetic Construct
ccttagaggtaaacagcaactgaga

SEQ ID NO: 20493 - DNA, 23 bp, Artificial Sequence
  Synthetic Construct
gcccactagaacccttcacaatc

SEQ ID NO: 20494 - DNA, 23 bp, Artificial Sequence
  Synthetic Construct
gggtatgggacccagtgtgatct

SEQ ID NO: 20495 - DNA, 22 bp, Artificial Sequence
  Synthetic Construct
tcctgttcaccatcctctccaa

SEQ ID NO: 20496 - DNA, 27 bp, Artificial Sequence
  Synthetic Construct
gtggacttgattttaaggacaccaaca

SEQ ID NO: 20497 - DNA, 26 bp, Artificial Sequence
  Synthetic Construct
tctcatctcagtggctcacatttatc

SEQ ID NO: 20498 - DNA, 25 bp, Artificial Sequence
  Synthetic Construct
ggattttagctgtcaggagacaaca

SEQ ID NO: 20499 - DNA, 22 bp, Artificial Sequence
  Synthetic Construct
agcccctcctaccacagctaac

SEQ ID NO: 20500 - DNA, 27 bp, Artificial Sequence
  Synthetic Construct
cccaagcaagagattatcaatgcttca

SEQ ID NO: 20501 - DNA, 25 bp, Artificial Sequence
  Synthetic Construct
gcagcaattggtaacaaggtgcata

SEQ ID NO: 20502 - DNA, 27 bp, Artificial Sequence
  Synthetic Construct
ggaaaccagttcagaaaagggaggaaa

SEQ ID NO: 20503 - DNA, 24 bp, Artificial Sequence
  Synthetic Construct
gaagcaagacaccttcacaagaca

SEQ ID NO: 20504 - DNA, 24 bp, Artificial Sequence
  Synthetic Construct
gagtcttagggccttgagtgaaca

SEQ ID NO: 20505 - DNA, 20 bp, Artificial Sequence
  Synthetic Construct
gcctcagcaagtctgctctt

SEQ ID NO: 20506 - DNA, 22 bp, Artificial Sequence
  Synthetic Construct
ggggcttctagagccactttac

SEQ ID NO: 20507 - DNA, 22 bp, Artificial Sequence
  Synthetic Construct
ggtggtgaaggagcttcctaag

SEQ ID NO: 20508 - DNA, 26 bp, Artificial Sequence
  Synthetic Construct
ttctagggccctcacttattatccta

SEQ ID NO: 20509 - DNA, 21 bp, Artificial Sequence
  Synthetic Construct
tggtctgccaactttgctgtt

SEQ ID NO: 20510 - DNA, 21 bp, Artificial Sequence
  Synthetic Construct
acaaggccacccaggaaccta

SEQ ID NO: 20511 - DNA, 28 bp, Artificial Sequence
  Synthetic Construct
cccaagaattctgctaggacctaaaaac

SEQ ID NO: 20512 - DNA, 21 bp, Artificial Sequence
  Synthetic Construct
tgaagaccccaagagcctact

SEQ ID NO: 20513 - DNA, 23 bp, Artificial Sequence
  Synthetic Construct
ggtgggacaaaagccagatcaca

SEQ ID NO: 20514 - DNA, 23 bp, Artificial Sequence
  Synthetic Construct
gagacaaaactgcaagccagtga

SEQ ID NO: 20515 - DNA, 20 bp, Artificial Sequence
  Synthetic Construct
tccatacagctggccacaga

SEQ ID NO: 20516 - DNA, 25 bp, Artificial Sequence
  Synthetic Construct
cacaactgtgctatgctaggggtat

SEQ ID NO: 20517 - DNA, 24 bp, Artificial Sequence
  Synthetic Construct
gctacaggcagtgaattcgtgatg

SEQ ID NO: 20518 - DNA, 25 bp, Artificial Sequence
  Synthetic Construct
ggtcatgctactgtctaaggtgcaa

SEQ ID NO: 20519 - DNA, 24 bp, Artificial Sequence
  Synthetic Construct
ctgaagtgaactgatgtggagtca

SEQ ID NO: 20520 - DNA, 28 bp, Artificial Sequence
  Synthetic Construct
ggtcatgccagtgattacaatggagtaa

SEQ ID NO: 20521 - DNA, 22 bp, Artificial Sequence
  Synthetic Construct
actgggtcaactgaagggtaga

SEQ ID NO: 20522 - DNA, 26 bp, Artificial Sequence
  Synthetic Construct
gcaacatggaagtcagggtaatcttg

SEQ ID NO: 20523 - DNA, 22 bp, Artificial Sequence
  Synthetic Construct
ggcctcagcttccacttttcaa

SEQ ID NO: 20524 - DNA, 21 bp, Artificial Sequence
  Synthetic Construct
tgcccttcaccctaccaaact

SEQ ID NO: 20525 - DNA, 23 bp, Artificial Sequence
  Synthetic Construct
ccactagacagtgcatctggatt

SEQ ID NO: 20526 - DNA, 23 bp, Artificial Sequence
  Synthetic Construct
gtgccttactctcacctcagtca

SEQ ID NO: 20527 - DNA, 25 bp, Artificial Sequence
  Synthetic Construct
gctgcttggatgactcagctgtttt

SEQ ID NO: 20528 - DNA, 24 bp, Artificial Sequence
  Synthetic Construct
gccccagttttcatgccaacatac

SEQ ID NO: 20529 - DNA, 26 bp, Artificial Sequence
  Synthetic Construct
ccagaggaaagaattgtgtggtccat

SEQ ID NO: 20530 - DNA, 23 bp, Artificial Sequence
  Synthetic Construct
ggcattgttccacagaagcaagt

SEQ ID NO: 20531 - DNA, 23 bp, Artificial Sequence
  Synthetic Construct
gaaatttaagcggcatgggttga

SEQ ID NO: 20532 - DNA, 24 bp, Artificial Sequence
  Synthetic Construct
gcctgtactagtctctcccaggaa

SEQ ID NO: 20533 - DNA, 26 bp, Artificial Sequence
  Synthetic Construct
ggtcagaaataccccatctgtgatga

SEQ ID NO: 20534 - DNA, 25 bp, Artificial Sequence
  Synthetic Construct
ggcgctaatctccatgcattttact

SEQ ID NO: 20535 - DNA, 23 bp, Artificial Sequence
  Synthetic Construct
tgtggtcaaggatggtgagattg

SEQ ID NO: 20536 - DNA, 27 bp, Artificial Sequence
  Synthetic Construct
acttacccaaggataaacctaccaaga

SEQ ID NO: 20537 - DNA, 22 bp, Artificial Sequence
  Synthetic Construct
cttctctcctggggcctacttt

SEQ ID NO: 20538 - DNA, 25 bp, Artificial Sequence
  Synthetic Construct
ccacctgactttcttaggagcacaa

SEQ ID NO: 20539 - DNA, 22 bp, Artificial Sequence
  Synthetic Construct
gggaggaaccaaggtggacaag

SEQ ID NO: 20540 - DNA, 23 bp, Artificial Sequence
  Synthetic Construct
tgccagtgtgaatcttaccaagt

SEQ ID NO: 20541 - DNA, 22 bp, Artificial Sequence
  Synthetic Construct
ggcctgcccatctcctttatgt

SEQ ID NO: 20542 - DNA, 23 bp, Artificial Sequence
  Synthetic Construct
ctgcctgtgtttctaggctcttc

SEQ ID NO: 20543 - DNA, 26 bp, Artificial Sequence
  Synthetic Construct
ctggaggagctaggtagcagaaatag

SEQ ID NO: 20544 - DNA, 22 bp, Artificial Sequence
  Synthetic Construct
gggctgggtgttggggatataa

SEQ ID NO: 20545 - DNA, 29 bp, Artificial Sequence
  Synthetic Construct
cagagtgaagacctctttgactatgattg

SEQ ID NO: 20546 - DNA, 23 bp, Artificial Sequence
  Synthetic Construct
cttcccctagatagctggctttg

SEQ ID NO: 20547 - DNA, 29 bp, Artificial Sequence
  Synthetic Construct
cccaagtaaacccactaatttcacacttg

SEQ ID NO: 20548 - DNA, 27 bp, Artificial Sequence
  Synthetic Construct
ccctacacaatggatgagtgactggat

SEQ ID NO: 20549 - DNA, 25 bp, Artificial Sequence
  Synthetic Construct
accaggagagtgtgatgttatggat

SEQ ID NO: 20550 - DNA, 26 bp, Artificial Sequence
  Synthetic Construct
ggctcagaccattgtatttcttccat

SEQ ID NO: 20551 - DNA, 25 bp, Artificial Sequence
  Synthetic Construct
ggccaagacagtctacctcatgtgt

SEQ ID NO: 20552 - DNA, 28 bp, Artificial Sequence
  Synthetic Construct
ctcctcttctcccatatacaactggaat

SEQ ID NO: 20553 - DNA, 22 bp, Artificial Sequence
  Synthetic Construct
gagtggatgacacgcaatgcaa

SEQ ID NO: 20554 - DNA, 30 bp, Artificial Sequence
  Synthetic Construct
gtctaccccagagattatttccctcatact

SEQ ID NO: 20555 - DNA, 21 bp, Artificial Sequence
  Synthetic Construct
gctcaaggggaggggaatgta

SEQ ID NO: 20556 - DNA, 22 bp, Artificial Sequence
  Synthetic Construct
ggagctggttacagagggcttt

SEQ ID NO: 20557 - DNA, 24 bp, Artificial Sequence
  Synthetic Construct
cccttgtgggtgtatgagggaagt

SEQ ID NO: 20558 - DNA, 22 bp, Artificial Sequence
  Synthetic Construct
gaggcaagagagtgaggctttc

SEQ ID NO: 20559 - DNA, 23 bp, Artificial Sequence
  Synthetic Construct
gtttgtgtagacaccctctgctt

SEQ ID NO: 20560 - DNA, 24 bp, Artificial Sequence
  Synthetic Construct
ggagccagacaggtaagaagtaaa

SEQ ID NO: 20561 - DNA, 24 bp, Artificial Sequence
  Synthetic Construct
cagccttcctgaactgaacagaca

SEQ ID NO: 20562 - DNA, 24 bp, Artificial Sequence
  Synthetic Construct
gccaggactcaagtggaagagaag

SEQ ID NO: 20563 - DNA, 22 bp, Artificial Sequence
  Synthetic Construct
gttggcttgaacctgggattga

SEQ ID NO: 20564 - DNA, 20 bp, Artificial Sequence
  Synthetic Construct
tcccctttgcctctcaccat

SEQ ID NO: 20565 - DNA, 20 bp, Artificial Sequence
  Synthetic Construct
gagagccattgcccatctgt

SEQ ID NO: 20566 - DNA, 24 bp, Artificial Sequence
  Synthetic Construct
accgaaagacagagtttgtcagat

SEQ ID NO: 20567 - DNA, 21 bp, Artificial Sequence
  Synthetic Construct
tctccgtccctccctctcaaa

SEQ ID NO: 20568 - DNA, 23 bp, Artificial Sequence
  Synthetic Construct
agcaacccagctagttctgaaaa

SEQ ID NO: 20569 - DNA, 23 bp, Artificial Sequence
  Synthetic Construct
cctctggtttgcccctaaattct

SEQ ID NO: 20570 - DNA, 23 bp, Artificial Sequence
  Synthetic Construct
gctagaaactgtgaggcttgagt

SEQ ID NO: 20571 - DNA, 23 bp, Artificial Sequence
  Synthetic Construct
gtccgtgctttatccagatccaa

SEQ ID NO: 20572 - DNA, 25 bp, Artificial Sequence
  Synthetic Construct
ctggaccctttctagcatcttctct

SEQ ID NO: 20573 - DNA, 22 bp, Artificial Sequence
  Synthetic Construct
ccaccaagcattccctgcaagt

SEQ ID NO: 20574 - DNA, 26 bp, Artificial Sequence
  Synthetic Construct
cgtagaatgtcttgtatggtgagagt

SEQ ID NO: 20575 - DNA, 22 bp, Artificial Sequence
  Synthetic Construct
ggaggtgaagactgaggcacaa

SEQ ID NO: 20576 - DNA, 21 bp, Artificial Sequence
  Synthetic Construct
tccaccctcttgcacctttct

SEQ ID NO: 20577 - DNA, 24 bp, Artificial Sequence
  Synthetic Construct
gttttggaaaatgcagcactcaag

SEQ ID NO: 20578 - DNA, 24 bp, Artificial Sequence
  Synthetic Construct
tttctctaccacccaagaaagcat

SEQ ID NO: 20579 - DNA, 24 bp, Artificial Sequence
  Synthetic Construct
ccaggaagtgttgaagtgactgaa

SEQ ID NO: 20580 - DNA, 22 bp, Artificial Sequence
  Synthetic Construct
gggaaatccaagcccagaggtt

SEQ ID NO: 20581 - DNA, 25 bp, Artificial Sequence
  Synthetic Construct
ggggataacccaaagctatttgcat

SEQ ID NO: 20582 - DNA, 22 bp, Artificial Sequence
  Synthetic Construct
ccttgcatctgcatcccttaga

SEQ ID NO: 20583 - DNA, 22 bp, Artificial Sequence
  Synthetic Construct
cagatgttgcaggcacctctca

SEQ ID NO: 20584 - DNA, 23 bp, Artificial Sequence
  Synthetic Construct
ggggttggggaaatatcctgctt

SEQ ID NO: 20585 - DNA, 27 bp, Artificial Sequence
  Synthetic Construct
gggaggtagcatttgaactaagtcttg

SEQ ID NO: 20586 - DNA, 28 bp, Artificial Sequence
  Synthetic Construct
gccactcaagctaatcctgaaattggaa

SEQ ID NO: 20587 - DNA, 26 bp, Artificial Sequence
  Synthetic Construct
tgtcctttcctacccatgaatgaaac

SEQ ID NO: 20588 - DNA, 27 bp, Artificial Sequence
  Synthetic Construct
gcatagcatgagaaataccttgcagtt

SEQ ID NO: 20589 - DNA, 27 bp, Artificial Sequence
  Synthetic Construct
gggaaagtgtaccacgatttgttcaga

SEQ ID NO: 20590 - DNA, 29 bp, Artificial Sequence
  Synthetic Construct
cagggaacatagtcaatgcctgagttaat

SEQ ID NO: 20591 - DNA, 21 bp, Artificial Sequence
  Synthetic Construct
cagctcctttgccacagcata

SEQ ID NO: 20592 - DNA, 24 bp, Artificial Sequence
  Synthetic Construct
ggggccaaatgtgctaattgttca

SEQ ID NO: 20593 - DNA, 24 bp, Artificial Sequence
  Synthetic Construct
actttactctgtcctcaccctagt

SEQ ID NO: 20594 - DNA, 25 bp, Artificial Sequence
  Synthetic Construct
gagcaagaattactgcctccagata

SEQ ID NO: 20595 - DNA, 25 bp, Artificial Sequence
  Synthetic Construct
cctgaaaagctgctagtggatgttg

SEQ ID NO: 20596 - DNA, 30 bp, Artificial Sequence
  Synthetic Construct
ccctcccttgcaatttgatatagtcctaag

SEQ ID NO: 20597 - DNA, 24 bp, Artificial Sequence
  Synthetic Construct
ggacattgtgattgaccgaaccta

SEQ ID NO: 20598 - DNA, 23 bp, Artificial Sequence
  Synthetic Construct
ctgttgggagggagttggatgaa

SEQ ID NO: 20599 - DNA, 26 bp, Artificial Sequence
  Synthetic Construct
gttacgctcggtgaagaatgtttaag

SEQ ID NO: 20600 - DNA, 20 bp, Artificial Sequence
  Synthetic Construct
ctgttttcctggccgcatct

SEQ ID NO: 20601 - DNA, 25 bp, Artificial Sequence
  Synthetic Construct
tgtaacaaacatggaccagaacagt

SEQ ID NO: 20602 - DNA, 24 bp, Artificial Sequence
  Synthetic Construct
ctgaggctttcctgactccagaat

SEQ ID NO: 20603 - DNA, 24 bp, Artificial Sequence
  Synthetic Construct
ggtgcctgctgcatagcatagtag

SEQ ID NO: 20604 - DNA, 27 bp, Artificial Sequence
  Synthetic Construct
ggtctgcttgatctctgactactccta

SEQ ID NO: 20605 - DNA, 27 bp, Artificial Sequence
  Synthetic Construct
gttgtgatgctaaagggctaatggata

SEQ ID NO: 20606 - DNA, 23 bp, Artificial Sequence
  Synthetic Construct
cagagggcttagctcacttcgtt

SEQ ID NO: 20607 - DNA, 22 bp, Artificial Sequence
  Synthetic Construct
ggctcaagcaatcttcctgtct

SEQ ID NO: 20608 - DNA, 26 bp, Artificial Sequence
  Synthetic Construct
gtttctgctttcaatgtccagacttc

SEQ ID NO: 20609 - DNA, 22 bp, Artificial Sequence
  Synthetic Construct
tccccacaatctccctggtact

SEQ ID NO: 20610 - DNA, 21 bp, Artificial Sequence
  Synthetic Construct
gcttccagtgtggggatgtga

SEQ ID NO: 20611 - DNA, 27 bp, Artificial Sequence
  Synthetic Construct
gctccattttctgagctggaaaagttc

SEQ ID NO: 20612 - DNA, 25 bp, Artificial Sequence
  Synthetic Construct
gagtgagagaatccaagaggacaag

SEQ ID NO: 20613 - DNA, 24 bp, Artificial Sequence
  Synthetic Construct
ccaccaacagaggacatcagaact

SEQ ID NO: 20614 - DNA, 26 bp, Artificial Sequence
  Synthetic Construct
ggtgggacatcatttctgaccagtag

SEQ ID NO: 20615 - DNA, 22 bp, Artificial Sequence
  Synthetic Construct
cgcttcatcccattggcctaca

SEQ ID NO: 20616 - DNA, 25 bp, Artificial Sequence
  Synthetic Construct
gtattgacaggtcttctgccttcta

SEQ ID NO: 20617 - DNA, 21 bp, Artificial Sequence
  Synthetic Construct
tgcttatggtcccagctcttg

SEQ ID NO: 20618 - DNA, 24 bp, Artificial Sequence
  Synthetic Construct
gactgacaggcagaatacctgtgt

SEQ ID NO: 20619 - DNA, 27 bp, Artificial Sequence
  Synthetic Construct
ctgaacccctgctctacacttaagaag

SEQ ID NO: 20620 - DNA, 24 bp, Artificial Sequence
  Synthetic Construct
gcagatggactaccatgccttgtt

SEQ ID NO: 20621 - DNA, 23 bp, Artificial Sequence
  Synthetic Construct
ggaagcatgacagcaggactgta

SEQ ID NO: 20622 - DNA, 22 bp, Artificial Sequence
  Synthetic Construct
aggatcctgctaggtgctgaat

SEQ ID NO: 20623 - DNA, 24 bp, Artificial Sequence
  Synthetic Construct
gcaaaaacgaatcatgcccaaaac

SEQ ID NO: 20624 - DNA, 24 bp, Artificial Sequence
  Synthetic Construct
cggggaccaaatttacagggacaa

SEQ ID NO: 20625 - DNA, 23 bp, Artificial Sequence
  Synthetic Construct
cccgggagggtcttagagtttgt

SEQ ID NO: 20626 - DNA, 21 bp, Artificial Sequence
  Synthetic Construct
cccctgcttcatgggctcaaa

SEQ ID NO: 20627 - DNA, 20 bp, Artificial Sequence
  Synthetic Construct
accacatcccagctcacaga

SEQ ID NO: 20628 - DNA, 26 bp, Artificial Sequence
  Synthetic Construct
gggcattaatgagcacattccttttc

SEQ ID NO: 20629 - DNA, 24 bp, Artificial Sequence
  Synthetic Construct
gttgttggctcagtcaatgagaag

SEQ ID NO: 20630 - DNA, 27 bp, Artificial Sequence
  Synthetic Construct
cgcctctgattctaatcccactattac

SEQ ID NO: 20631 - DNA, 25 bp, Artificial Sequence
  Synthetic Construct
ggctactggtctcagacaaagatac

SEQ ID NO: 20632 - DNA, 24 bp, Artificial Sequence
  Synthetic Construct
gcctgaaggtgagacaatcagaaa

SEQ ID NO: 20633 - DNA, 21 bp, Artificial Sequence
  Synthetic Construct
agtggggtatgcctgcagttg

SEQ ID NO: 20634 - DNA, 25 bp, Artificial Sequence
  Synthetic Construct
gtgtggactcgaagaggattgttga

SEQ ID NO: 20635 - DNA, 23 bp, Artificial Sequence
  Synthetic Construct
gagcacgatcctgaaacaggtta

SEQ ID NO: 20636 - DNA, 21 bp, Artificial Sequence
  Synthetic Construct
agtcagtctggcccagcagta

SEQ ID NO: 20637 - DNA, 24 bp, Artificial Sequence
  Synthetic Construct
ccacctggcaaatgcagttaaagt

SEQ ID NO: 20638 - DNA, 25 bp, Artificial Sequence
  Synthetic Construct
ggggtaatagggcttaggaggaaca

SEQ ID NO: 20639 - DNA, 21 bp, Artificial Sequence
  Synthetic Construct
acagggctgagaccagcacat

SEQ ID NO: 20640 - DNA, 30 bp, Artificial Sequence
  Synthetic Construct
cactgctagtacaggttgtaaattggtatg

SEQ ID NO: 20641 - DNA, 24 bp, Artificial Sequence
  Synthetic Construct
ggtgctgactccaactactgaaac

SEQ ID NO: 20642 - DNA, 23 bp, Artificial Sequence
  Synthetic Construct
cttggctgctgattggaattgtt

SEQ ID NO: 20643 - DNA, 23 bp, Artificial Sequence
  Synthetic Construct
ccagccagtaaagccttgtatga

SEQ ID NO: 20644 - DNA, 24 bp, Artificial Sequence
  Synthetic Construct
gctccttcattcccttggcaagta

SEQ ID NO: 20645 - DNA, 22 bp, Artificial Sequence
  Synthetic Construct
ggaaggcatctggggctctaag

SEQ ID NO: 20646 - DNA, 20 bp, Artificial Sequence
  Synthetic Construct
agggcatcctcgagccaaat

SEQ ID NO: 20647 - DNA, 26 bp, Artificial Sequence
  Synthetic Construct
ggatgtatccagatggtgtgtgaaag

SEQ ID NO: 20648 - DNA, 24 bp, Artificial Sequence
  Synthetic Construct
gggactagtgtaccttctggtcta

SEQ ID NO: 20649 - DNA, 22 bp, Artificial Sequence
  Synthetic Construct
ggacgtggtttgctaaggtgtt

SEQ ID NO: 20650 - DNA, 20 bp, Artificial Sequence
  Synthetic Construct
actgtgtcccctggcaccta

SEQ ID NO: 20651 - DNA, 20 bp, Artificial Sequence
  Synthetic Construct
ggcaggatctgccagcaaaa

SEQ ID NO: 20652 - DNA, 23 bp, Artificial Sequence
  Synthetic Construct
gtccttcctgtctgctcttggta

SEQ ID NO: 20653 - DNA, 24 bp, Artificial Sequence
  Synthetic Construct
cccagacataccagtgaggcttga

SEQ ID NO: 20654 - DNA, 24 bp, Artificial Sequence
  Synthetic Construct
gttgaagccagatcatggaagact

SEQ ID NO: 20655 - DNA, 24 bp, Artificial Sequence
  Synthetic Construct
tctggaaagcagtacagcatcttt

SEQ ID NO: 20656 - DNA, 26 bp, Artificial Sequence
  Synthetic Construct
caagatctcgtgctattcgtgttttg

SEQ ID NO: 20657 - DNA, 26 bp, Artificial Sequence
  Synthetic Construct
ccatctgccatgatagtattgtgtct

SEQ ID NO: 20658 - DNA, 22 bp, Artificial Sequence
  Synthetic Construct
cggtgtttggggtcccatgtat

SEQ ID NO: 20659 - DNA, 25 bp, Artificial Sequence
  Synthetic Construct
ggctttgttaggacagacccagttc

SEQ ID NO: 20660 - DNA, 24 bp, Artificial Sequence
  Synthetic Construct
cctggccctgtattagctgtggat

SEQ ID NO: 20661 - DNA, 20 bp, Artificial Sequence
  Synthetic Construct
cctccagcctggcctgatac

SEQ ID NO: 20662 - DNA, 28 bp, Artificial Sequence
  Synthetic Construct
ggggagaaaacattccacccataagata

SEQ ID NO: 20663 - DNA, 22 bp, Artificial Sequence
  Synthetic Construct
gtcaaaggcaggagccatgaga

SEQ ID NO: 20664 - DNA, 25 bp, Artificial Sequence
  Synthetic Construct
tgtcatatgaggacacagtgtttga

SEQ ID NO: 20665 - DNA, 25 bp, Artificial Sequence
  Synthetic Construct
ggacattatatgtcagggagtgcaa

SEQ ID NO: 20666 - DNA, 25 bp, Artificial Sequence
  Synthetic Construct
gagaggcaggtgtgagaaatcattg

SEQ ID NO: 20667 - DNA, 27 bp, Artificial Sequence
  Synthetic Construct
cccatctttgtgtgggaaagttagtga

SEQ ID NO: 20668 - DNA, 23 bp, Artificial Sequence
  Synthetic Construct
gtccagctgttcatggagtcaac

SEQ ID NO: 20669 - DNA, 22 bp, Artificial Sequence
  Synthetic Construct
tcaggttagtgggttcccttct

SEQ ID NO: 20670 - DNA, 24 bp, Artificial Sequence
  Synthetic Construct
ccctagcaacaccaaggaacaaag

SEQ ID NO: 20671 - DNA, 27 bp, Artificial Sequence
  Synthetic Construct
ggaaagaataggtaggagtgcttctct

SEQ ID NO: 20672 - DNA, 26 bp, Artificial Sequence
  Synthetic Construct
tggcagagaaagtctgagagtaaatg

SEQ ID NO: 20673 - DNA, 24 bp, Artificial Sequence
  Synthetic Construct
accctctcataacctcacttgaca

SEQ ID NO: 20674 - DNA, 22 bp, Artificial Sequence
  Synthetic Construct
gggcaggtagcatctacagcaa

SEQ ID NO: 20675 - DNA, 24 bp, Artificial Sequence
  Synthetic Construct
ggccaacagaccaagaagtgctta

SEQ ID NO: 20676 - DNA, 26 bp, Artificial Sequence
  Synthetic Construct
ccagggagctctaggatagaactgaa

SEQ ID NO: 20677 - DNA, 27 bp, Artificial Sequence
  Synthetic Construct
ggaagtgggtctttgaagagatcatgt

SEQ ID NO: 20678 - DNA, 22 bp, Artificial Sequence
  Synthetic Construct
gctgccaggatgaaaccagaga

SEQ ID NO: 20679 - DNA, 24 bp, Artificial Sequence
  Synthetic Construct
gtttggtgtttaatggggcgatag

SEQ ID NO: 20680 - DNA, 24 bp, Artificial Sequence
  Synthetic Construct
gttcagtggaaaactgatgcaact

SEQ ID NO: 20681 - DNA, 25 bp, Artificial Sequence
  Synthetic Construct
cccatctttctggctcattccatct

SEQ ID NO: 20682 - DNA, 25 bp, Artificial Sequence
  Synthetic Construct
gctttaggaccaagttgctgaattg

SEQ ID NO: 20683 - DNA, 21 bp, Artificial Sequence
  Synthetic Construct
ggggctcaaacaggtaaggtt

SEQ ID NO: 20684 - DNA, 22 bp, Artificial Sequence
  Synthetic Construct
cccagcaaagccatgctacagt

SEQ ID NO: 20685 - DNA, 26 bp, Artificial Sequence
  Synthetic Construct
gcctgaaacaaccaaataccaggaaa

SEQ ID NO: 20686 - DNA, 25 bp, Artificial Sequence
  Synthetic Construct
caccctggaacctatgggaagaatg

SEQ ID NO: 20687 - DNA, 21 bp, Artificial Sequence
  Synthetic Construct
aacctgcagaagcacatcagt

SEQ ID NO: 20688 - DNA, 30 bp, Artificial Sequence
  Synthetic Construct
caagttaagtagtgtagaaatcgggagtag

SEQ ID NO: 20689 - DNA, 26 bp, Artificial Sequence
  Synthetic Construct
cccagaccttatcctgtagctgaatg

SEQ ID NO: 20690 - DNA, 21 bp, Artificial Sequence
  Synthetic Construct
aggtagcctcttggcatctgt

SEQ ID NO: 20691 - DNA, 24 bp, Artificial Sequence
  Synthetic Construct
gggcctcagaaaactactggaact

SEQ ID NO: 20692 - DNA, 24 bp, Artificial Sequence
  Synthetic Construct
gaaaggcataaaccccacaagcta

SEQ ID NO: 20693 - DNA, 22 bp, Artificial Sequence
  Synthetic Construct
tgcaaggttcgaatcgagtgat

SEQ ID NO: 20694 - DNA, 27 bp, Artificial Sequence
  Synthetic Construct
ggaagagctggatcagagggatgataa

SEQ ID NO: 20695 - DNA, 23 bp, Artificial Sequence
  Synthetic Construct
ctgggatagatggtgtccgactt

SEQ ID NO: 20696 - DNA, 23 bp, Artificial Sequence
  Synthetic Construct
ggccctactgaaacaggagagtt

SEQ ID NO: 20697 - DNA, 22 bp, Artificial Sequence
  Synthetic Construct
gcctatcggctggtaggatgaa

SEQ ID NO: 20698 - DNA, 25 bp, Artificial Sequence
  Synthetic Construct
gccatacacaaacaagcacacaatc

SEQ ID NO: 20699 - DNA, 21 bp, Artificial Sequence
  Synthetic Construct
ggcgcagatacagcggactta

SEQ ID NO: 20700 - DNA, 26 bp, Artificial Sequence
  Synthetic Construct
gggaagacagagatatgtgaccgttt

SEQ ID NO: 20701 - DNA, 23 bp, Artificial Sequence
  Synthetic Construct
gggcagcttgaaggaatgtggaa

SEQ ID NO: 20702 - DNA, 20 bp, Artificial Sequence
  Synthetic Construct
agcttgtgtggcaggtgtgt

SEQ ID NO: 20703 - DNA, 22 bp, Artificial Sequence
  Synthetic Construct
tgtcccttttccttgggactgt

SEQ ID NO: 20704 - DNA, 26 bp, Artificial Sequence
  Synthetic Construct
gctgtttcttctggcaacaaagtttc

SEQ ID NO: 20705 - DNA, 22 bp, Artificial Sequence
  Synthetic Construct
ggccctccattcgaaagtcaac

SEQ ID NO: 20706 - DNA, 24 bp, Artificial Sequence
  Synthetic Construct
gcccagacacctattgactggaaa

SEQ ID NO: 20707 - DNA, 22 bp, Artificial Sequence
  Synthetic Construct
gcccatgcactgatgactccaa

SEQ ID NO: 20708 - DNA, 23 bp, Artificial Sequence
  Synthetic Construct
ctgattccagagcttggggagaa

SEQ ID NO: 20709 - DNA, 27 bp, Artificial Sequence
  Synthetic Construct
gggcccatttcagcattagaactcatc

SEQ ID NO: 20710 - DNA, 23 bp, Artificial Sequence
  Synthetic Construct
cacaggaatccagagccactatg

SEQ ID NO: 20711 - DNA, 26 bp, Artificial Sequence
  Synthetic Construct
gactgattcatttgtgttcccgagtt

SEQ ID NO: 20712 - DNA, 24 bp, Artificial Sequence
  Synthetic Construct
agccctaccaatgcattcattcaa

SEQ ID NO: 20713 - DNA, 25 bp, Artificial Sequence
  Synthetic Construct
ggagaagttattggtccaaggtgat

SEQ ID NO: 20714 - DNA, 21 bp, Artificial Sequence
  Synthetic Construct
cctgcttttggcatggtcttg

SEQ ID NO: 20715 - DNA, 26 bp, Artificial Sequence
  Synthetic Construct
gtccttgtggtccaagttcaactctt

SEQ ID NO: 20716 - DNA, 22 bp, Artificial Sequence
  Synthetic Construct
caagtgggcatttggggtctct

SEQ ID NO: 20717 - DNA, 25 bp, Artificial Sequence
  Synthetic Construct
agttgctgaactaaggcagctattt

SEQ ID NO: 20718 - DNA, 25 bp, Artificial Sequence
  Synthetic Construct
gggaaaccccacctaagtcactttc

SEQ ID NO: 20719 - DNA, 23 bp, Artificial Sequence
  Synthetic Construct
ggctggtttggtgttttcctttc

SEQ ID NO: 20720 - DNA, 24 bp, Artificial Sequence
  Synthetic Construct
cagtgagggaaatttgctgtgtag

SEQ ID NO: 20721 - DNA, 25 bp, Artificial Sequence
  Synthetic Construct
gctgttaaatccagatgacccaaac

SEQ ID NO: 20722 - DNA, 27 bp, Artificial Sequence
  Synthetic Construct
ggaacatctgaagatcatgtgtcttgt

SEQ ID NO: 20723 - DNA, 26 bp, Artificial Sequence
  Synthetic Construct
tcttggtgtaatggggtaggtctaat

SEQ ID NO: 20724 - DNA, 22 bp, Artificial Sequence
  Synthetic Construct
gaggcaaccaacaacccttttg

SEQ ID NO: 20725 - DNA, 27 bp, Artificial Sequence
  Synthetic Construct
ccagatgtggtttcattctgtgagcaa

SEQ ID NO: 20726 - DNA, 25 bp, Artificial Sequence
  Synthetic Construct
tctgggatggggaaaggatattagt

SEQ ID NO: 20727 - DNA, 22 bp, Artificial Sequence
  Synthetic Construct
caaccctggctctccttccaaa

SEQ ID NO: 20728 - DNA, 24 bp, Artificial Sequence
  Synthetic Construct
gtatggcaactgaagaccaagaga

SEQ ID NO: 20729 - DNA, 27 bp, Artificial Sequence
  Synthetic Construct
gactggacttctactttcactggaaac

SEQ ID NO: 20730 - DNA, 21 bp, Artificial Sequence
  Synthetic Construct
ttcgattggcccctggctcta

SEQ ID NO: 20731 - DNA, 25 bp, Artificial Sequence
  Synthetic Construct
gaactaccactgtagcatctcaact

SEQ ID NO: 20732 - DNA, 21 bp, Artificial Sequence
  Synthetic Construct
tggcttgcttgagcccatatt

SEQ ID NO: 20733 - DNA, 24 bp, Artificial Sequence
  Synthetic Construct
gtttgcactgagttgcacatactt

SEQ ID NO: 20734 - DNA, 25 bp, Artificial Sequence
  Synthetic Construct
gaggggagaaatggaaatcaactgt

SEQ ID NO: 20735 - DNA, 22 bp, Artificial Sequence
  Synthetic Construct
ccaggctagaaaggcctggtaa

SEQ ID NO: 20736 - DNA, 24 bp, Artificial Sequence
  Synthetic Construct
catgtaggcttcctgtccctatac

SEQ ID NO: 20737 - DNA, 25 bp, Artificial Sequence
  Synthetic Construct
ggcaaaagaaagcaagatgcctatg

SEQ ID NO: 20738 - DNA, 22 bp, Artificial Sequence
  Synthetic Construct
gtctacccagtgctgcagtttc

SEQ ID NO: 20739 - DNA, 28 bp, Artificial Sequence
  Synthetic Construct
gcaaggaaatacactgtcactactccta

SEQ ID NO: 20740 - DNA, 26 bp, Artificial Sequence
  Synthetic Construct
gggccaaatttcaaagtcagatggat

SEQ ID NO: 20741 - DNA, 26 bp, Artificial Sequence
  Synthetic Construct
ccaactctgctttggagaacctgtta

SEQ ID NO: 20742 - DNA, 22 bp, Artificial Sequence
  Synthetic Construct
ctgtcagctcacgagtgtgttt

SEQ ID NO: 20743 - DNA, 24 bp, Artificial Sequence
  Synthetic Construct
cccaggaagaagcagaggtagttg

SEQ ID NO: 20744 - DNA, 30 bp, Artificial Sequence
  Synthetic Construct
gacttggtccataaaaatctctccttgcat

SEQ ID NO: 20745 - DNA, 23 bp, Artificial Sequence
  Synthetic Construct
ggggcaaattaggctgacctttg

SEQ ID NO: 20746 - DNA, 25 bp, Artificial Sequence
  Synthetic Construct
cagtctcctttgccattctgctaca

SEQ ID NO: 20747 - DNA, 21 bp, Artificial Sequence
  Synthetic Construct
acaccataggtagggctcaca

SEQ ID NO: 20748 - DNA, 22 bp, Artificial Sequence
  Synthetic Construct
tctgttgcctcagctcttttca

SEQ ID NO: 20749 - DNA, 25 bp, Artificial Sequence
  Synthetic Construct
acttggagttggtaggtgtctttag

SEQ ID NO: 20750 - DNA, 24 bp, Artificial Sequence
  Synthetic Construct
gcaatgtcgcagagaaggtagtct

SEQ ID NO: 20751 - DNA, 22 bp, Artificial Sequence
  Synthetic Construct
gtggggagactctagactggat

SEQ ID NO: 20752 - DNA, 20 bp, Artificial Sequence
  Synthetic Construct
accgtgtcgcatggttctct

SEQ ID NO: 20753 - DNA, 22 bp, Artificial Sequence
  Synthetic Construct
gaggaagagcaagatggcagaa

SEQ ID NO: 20754 - DNA, 25 bp, Artificial Sequence
  Synthetic Construct
gtcagaaccaggtatcactgagcta

SEQ ID NO: 20755 - DNA, 25 bp, Artificial Sequence
  Synthetic Construct
tccgaaaagccattgtgtttaccta

SEQ ID NO: 20756 - DNA, 25 bp, Artificial Sequence
  Synthetic Construct
cacttatctctaggggtccagaaga

SEQ ID NO: 20757 - DNA, 22 bp, Artificial Sequence
  Synthetic Construct
cctggccaaaccctgttaccta

SEQ ID NO: 20758 - DNA, 22 bp, Artificial Sequence
  Synthetic Construct
aggttcagctccccactagtct

SEQ ID NO: 20759 - DNA, 24 bp, Artificial Sequence
  Synthetic Construct
ctctctgtagtactttgcccaaca

SEQ ID NO: 20760 - DNA, 27 bp, Artificial Sequence
  Synthetic Construct
cctctacacccttggaatactctcctt

SEQ ID NO: 20761 - DNA, 27 bp, Artificial Sequence
  Synthetic Construct
cactgatggtctttcttctggaccttt

SEQ ID NO: 20762 - DNA, 23 bp, Artificial Sequence
  Synthetic Construct
ggagctacagacctggctctctt

SEQ ID NO: 20763 - DNA, 23 bp, Artificial Sequence
  Synthetic Construct
gtgcttagagctggatggctgaa

SEQ ID NO: 20764 - DNA, 24 bp, Artificial Sequence
  Synthetic Construct
tctgctctttgagaactgttgctt

SEQ ID NO: 20765 - DNA, 22 bp, Artificial Sequence
  Synthetic Construct
gccctaactcccaggtgacatt

SEQ ID NO: 20766 - DNA, 26 bp, Artificial Sequence
  Synthetic Construct
gcttaaggggaaagaatggagcaaac

SEQ ID NO: 20767 - DNA, 20 bp, Artificial Sequence
  Synthetic Construct
gcccttcagagctgccattc

SEQ ID NO: 20768 - DNA, 22 bp, Artificial Sequence
  Synthetic Construct
cgggcagccttttcaaagaagt

SEQ ID NO: 20769 - DNA, 22 bp, Artificial Sequence
  Synthetic Construct
agccagtccaggataggccaaa

SEQ ID NO: 20770 - DNA, 20 bp, Artificial Sequence
  Synthetic Construct
gggcagggtgggaaaagttc

SEQ ID NO: 20771 - DNA, 25 bp, Artificial Sequence
  Synthetic Construct
agcccggtaagataaattcctgatt

SEQ ID NO: 20772 - DNA, 22 bp, Artificial Sequence
  Synthetic Construct
ggcacccaattgttttgaggtt

SEQ ID NO: 20773 - DNA, 24 bp, Artificial Sequence
  Synthetic Construct
cccttttggagtagcaagggttac

SEQ ID NO: 20774 - DNA, 24 bp, Artificial Sequence
  Synthetic Construct
caccatcccttaatgctcttgtga

SEQ ID NO: 20775 - DNA, 24 bp, Artificial Sequence
  Synthetic Construct
caaggcacaagtgaaaagctggaa

SEQ ID NO: 20776 - DNA, 23 bp, Artificial Sequence
  Synthetic Construct
gggatgtgtggttttggcagaag

SEQ ID NO: 20777 - DNA, 23 bp, Artificial Sequence
  Synthetic Construct
ccatcttgctactacgcctctct

SEQ ID NO: 20778 - DNA, 24 bp, Artificial Sequence
  Synthetic Construct
ggcagtagagtcacatcaccttga

SEQ ID NO: 20779 - DNA, 22 bp, Artificial Sequence
  Synthetic Construct
tccctttaccctgggcttcaca

SEQ ID NO: 20780 - DNA, 26 bp, Artificial Sequence
  Synthetic Construct
caatgcctgttaccctaggtattact

SEQ ID NO: 20781 - DNA, 22 bp, Artificial Sequence
  Synthetic Construct
caacgtctatcctgtgcctgaa

SEQ ID NO: 20782 - DNA, 25 bp, Artificial Sequence
  Synthetic Construct
ggcaagtgttgaaaaacttcctgtt

SEQ ID NO: 20783 - DNA, 23 bp, Artificial Sequence
  Synthetic Construct
caggttgtgttggatgcgtaaag

SEQ ID NO: 20784 - DNA, 22 bp, Artificial Sequence
  Synthetic Construct
ggccatcctgtagccaccaaat

SEQ ID NO: 20785 - DNA, 24 bp, Artificial Sequence
  Synthetic Construct
ccaggttgcatcccttctcaggaa

SEQ ID NO: 20786 - DNA, 21 bp, Artificial Sequence
  Synthetic Construct
ggctccattccaatggcacaa

SEQ ID NO: 20787 - DNA, 23 bp, Artificial Sequence
  Synthetic Construct
ggccttgaaatgcagcggagaaa

SEQ ID NO: 20788 - DNA, 25 bp, Artificial Sequence
  Synthetic Construct
tgaatcaaatcttctggcgtaggat

SEQ ID NO: 20789 - DNA, 23 bp, Artificial Sequence
  Synthetic Construct
gcaaagctcaacctcagggattc

SEQ ID NO: 20790 - DNA, 24 bp, Artificial Sequence
  Synthetic Construct
gtagtcccatctgctagagaggtt

SEQ ID NO: 20791 - DNA, 24 bp, Artificial Sequence
  Synthetic Construct
ggcctccaaaaggtagcttgttct

SEQ ID NO: 20792 - DNA, 28 bp, Artificial Sequence
  Synthetic Construct
cctctcttcctcctctttcaatgtgcta

SEQ ID NO: 20793 - DNA, 22 bp, Artificial Sequence
  Synthetic Construct
ggcagcagttcatgggtagaga

SEQ ID NO: 20794 - DNA, 22 bp, Artificial Sequence
  Synthetic Construct
gggccacaagcctttgagtgta

SEQ ID NO: 20795 - DNA, 21 bp, Artificial Sequence
  Synthetic Construct
gggaatgccccgttttgaatc

SEQ ID NO: 20796 - DNA, 24 bp, Artificial Sequence
  Synthetic Construct
tcaaggcagcatagtgtcatgaat

SEQ ID NO: 20797 - DNA, 22 bp, Artificial Sequence
  Synthetic Construct
tgcgatgtccgtgatgatgatg

SEQ ID NO: 20798 - DNA, 28 bp, Artificial Sequence
  Synthetic Construct
ggagagctgtactatggtaaagttgaga

SEQ ID NO: 20799 - DNA, 26 bp, Artificial Sequence
  Synthetic Construct
acacaaacactacctacctcctaagt

SEQ ID NO: 20800 - DNA, 26 bp, Artificial Sequence
  Synthetic Construct
cctcaggggaatgaacttcttttaga

SEQ ID NO: 20801 - DNA, 21 bp, Artificial Sequence
  Synthetic Construct
aggtgcagaaaggccatgaag

SEQ ID NO: 20802 - DNA, 22 bp, Artificial Sequence
  Synthetic Construct
gctatgcgagagggttgcttga

SEQ ID NO: 20803 - DNA, 26 bp, Artificial Sequence
  Synthetic Construct
ccctgtgctgttctcattattctttg

SEQ ID NO: 20804 - DNA, 21 bp, Artificial Sequence
  Synthetic Construct
gcccaaggctatgtcttctgt

SEQ ID NO: 20805 - DNA, 21 bp, Artificial Sequence
  Synthetic Construct
agggctccatgatctcacctt

SEQ ID NO: 20806 - DNA, 22 bp, Artificial Sequence
  Synthetic Construct
ggactgttgtggtactggcaat

SEQ ID NO: 20807 - DNA, 24 bp, Artificial Sequence
  Synthetic Construct
gcagctaagtggcagctcatcttg

SEQ ID NO: 20808 - DNA, 25 bp, Artificial Sequence
  Synthetic Construct
gtcgtttgcttgctgttttaactgt

SEQ ID NO: 20809 - DNA, 23 bp, Artificial Sequence
  Synthetic Construct
gccagaaagtgggctttgagtgt

SEQ ID NO: 20810 - DNA, 24 bp, Artificial Sequence
  Synthetic Construct
ggtgtctcagactactcccatgat

SEQ ID NO: 20811 - DNA, 26 bp, Artificial Sequence
  Synthetic Construct
gaacgatagcccctaaaatgatgtgt

SEQ ID NO: 20812 - DNA, 26 bp, Artificial Sequence
  Synthetic Construct
gctacccagagatagaagcacaccta

SEQ ID NO: 20813 - DNA, 23 bp, Artificial Sequence
  Synthetic Construct
cgctgaccaagtcttgtttgaat

SEQ ID NO: 20814 - DNA, 24 bp, Artificial Sequence
  Synthetic Construct
gggcctttatactcacagccatag

SEQ ID NO: 20815 - DNA, 25 bp, Artificial Sequence
  Synthetic Construct
gggcatgcaattcagggatatggaa

SEQ ID NO: 20816 - DNA, 23 bp, Artificial Sequence
  Synthetic Construct
cccatctttccccacgaagtatg

SEQ ID NO: 20817 - DNA, 22 bp, Artificial Sequence
  Synthetic Construct
agctgataccctccaggtcttt

SEQ ID NO: 20818 - DNA, 25 bp, Artificial Sequence
  Synthetic Construct
tgacgatagtcacaccttcacaaag

SEQ ID NO: 20819 - DNA, 23 bp, Artificial Sequence
  Synthetic Construct
gtagcccagccttattcaaggaa

SEQ ID NO: 20820 - DNA, 22 bp, Artificial Sequence
  Synthetic Construct
gctagctgctgagacagtgaag

SEQ ID NO: 20821 - DNA, 20 bp, Artificial Sequence
  Synthetic Construct
tggcagcactacctgagagt

SEQ ID NO: 20822 - DNA, 23 bp, Artificial Sequence
  Synthetic Construct
gccccttaggtaactgctgatag

SEQ ID NO: 20823 - DNA, 24 bp, Artificial Sequence
  Synthetic Construct
tgctctctgaattgactcactgtt

SEQ ID NO: 20824 - DNA, 23 bp, Artificial Sequence
  Synthetic Construct
ttgatcaccatgactctgcatgt

SEQ ID NO: 20825 - DNA, 27 bp, Artificial Sequence
  Synthetic Construct
cctgctcaaactgatttctcactctct

SEQ ID NO: 20826 - DNA, 24 bp, Artificial Sequence
  Synthetic Construct
gaggtgcctgtttcctttctggat

SEQ ID NO: 20827 - DNA, 27 bp, Artificial Sequence
  Synthetic Construct
ccctttcgactctcaaaacttccttac

SEQ ID NO: 20828 - DNA, 22 bp, Artificial Sequence
  Synthetic Construct
tcctcccagaaacctggtgctt

SEQ ID NO: 20829 - DNA, 22 bp, Artificial Sequence
  Synthetic Construct
gcctgccaccatttcatggtta

SEQ ID NO: 20830 - DNA, 23 bp, Artificial Sequence
  Synthetic Construct
ctgtgacaccaaaggcagaaaca

SEQ ID NO: 20831 - DNA, 22 bp, Artificial Sequence
  Synthetic Construct
ggtcggaatgatgacccctgtt

SEQ ID NO: 20832 - DNA, 22 bp, Artificial Sequence
  Synthetic Construct
gagcattccagcagaggtcagt

SEQ ID NO: 20833 - DNA, 23 bp, Artificial Sequence
  Synthetic Construct
ccaggagccagacttgagaatca

SEQ ID NO: 20834 - DNA, 25 bp, Artificial Sequence
  Synthetic Construct
gggtagaagccattggtatagttca

SEQ ID NO: 20835 - DNA, 24 bp, Artificial Sequence
  Synthetic Construct
gtgccagtccttgtgttaggttct

SEQ ID NO: 20836 - DNA, 21 bp, Artificial Sequence
  Synthetic Construct
accagcctctgtaccggcaat

SEQ ID NO: 20837 - DNA, 22 bp, Artificial Sequence
  Synthetic Construct
gctctgggatcatcacacaaca

SEQ ID NO: 20838 - DNA, 24 bp, Artificial Sequence
  Synthetic Construct
tgacgcttctgtttccaacagtta

SEQ ID NO: 20839 - DNA, 26 bp, Artificial Sequence
  Synthetic Construct
cctctctgtacttttgcactcactgt

SEQ ID NO: 20840 - DNA, 22 bp, Artificial Sequence
  Synthetic Construct
cctcccctctcacacaggaaga

SEQ ID NO: 20841 - DNA, 27 bp, Artificial Sequence
  Synthetic Construct
cacatttcccaaaccagactgtagaga

SEQ ID NO: 20842 - DNA, 23 bp, Artificial Sequence
  Synthetic Construct
gattccagcagcatgaacagaca

SEQ ID NO: 20843 - DNA, 27 bp, Artificial Sequence
  Synthetic Construct
ggaaagggtactgggatttttgtttag

SEQ ID NO: 20844 - DNA, 22 bp, Artificial Sequence
  Synthetic Construct
cctgagctagcctttccacact

SEQ ID NO: 20845 - DNA, 24 bp, Artificial Sequence
  Synthetic Construct
ccctcaggtttgggaatagtcatc

SEQ ID NO: 20846 - DNA, 22 bp, Artificial Sequence
  Synthetic Construct
gtcgtcactacaaggggctcaa

SEQ ID NO: 20847 - DNA, 22 bp, Artificial Sequence
  Synthetic Construct
tggggtcctcacaaggaaatgt

SEQ ID NO: 20848 - DNA, 24 bp, Artificial Sequence
  Synthetic Construct
gtagaagactactgctctggcaaa

SEQ ID NO: 20849 - DNA, 23 bp, Artificial Sequence
  Synthetic Construct
gagctgggaatttggtggttttg

SEQ ID NO: 20850 - DNA, 22 bp, Artificial Sequence
  Synthetic Construct
caccacaggtttcttgccaatc

SEQ ID NO: 20851 - DNA, 23 bp, Artificial Sequence
  Synthetic Construct
ccctggaggtcagacagagaagt

SEQ ID NO: 20852 - DNA, 21 bp, Artificial Sequence
  Synthetic Construct
gaggagtgtggtggttggaaa

SEQ ID NO: 20853 - DNA, 20 bp, Artificial Sequence
  Synthetic Construct
tgtgctgcgctgacactttg

SEQ ID NO: 20854 - DNA, 22 bp, Artificial Sequence
  Synthetic Construct
ctctccaggtacaaccccagta

SEQ ID NO: 20855 - DNA, 23 bp, Artificial Sequence
  Synthetic Construct
ccgtcttcaaagccaatgctaag

SEQ ID NO: 20856 - DNA, 23 bp, Artificial Sequence
  Synthetic Construct
ggagggcagcatgggataaagaa

SEQ ID NO: 20857 - DNA, 24 bp, Artificial Sequence
  Synthetic Construct
tgttgccaaaagttgctcagtaag

SEQ ID NO: 20858 - DNA, 24 bp, Artificial Sequence
  Synthetic Construct
cccacacgctaaaggcaagaaaac

SEQ ID NO: 20859 - DNA, 22 bp, Artificial Sequence
  Synthetic Construct
gccctctaccctttccactaac

SEQ ID NO: 20860 - DNA, 23 bp, Artificial Sequence
  Synthetic Construct
ctgcctttcaccaagttcctttc

SEQ ID NO: 20861 - DNA, 21 bp, Artificial Sequence
  Synthetic Construct
gccgatggttgcattcctact

SEQ ID NO: 20862 - DNA, 22 bp, Artificial Sequence
  Synthetic Construct
ccactggggttgagagagaaca

SEQ ID NO: 20863 - DNA, 20 bp, Artificial Sequence
  Synthetic Construct
ccattgctggccgtgtcact

SEQ ID NO: 20864 - DNA, 25 bp, Artificial Sequence
  Synthetic Construct
gaccacctttttcctacagagatgt

SEQ ID NO: 20865 - DNA, 25 bp, Artificial Sequence
  Synthetic Construct
agtggagctgtttgttttctaccta

SEQ ID NO: 20866 - DNA, 26 bp, Artificial Sequence
  Synthetic Construct
ggggttctgaggtgcacatagttaag

SEQ ID NO: 20867 - DNA, 22 bp, Artificial Sequence
  Synthetic Construct
ctctactcgcaagggtctggtt

SEQ ID NO: 20868 - DNA, 24 bp, Artificial Sequence
  Synthetic Construct
gcctgtccagtctcatctagcatt

SEQ ID NO: 20869 - DNA, 22 bp, Artificial Sequence
  Synthetic Construct
gtagtggagcacccaaacactt

SEQ ID NO: 20870 - DNA, 22 bp, Artificial Sequence
  Synthetic Construct
aagagagagctgtcctccttga

SEQ ID NO: 20871 - DNA, 23 bp, Artificial Sequence
  Synthetic Construct
cttctttagggcttggtgtcact

SEQ ID NO: 20872 - DNA, 21 bp, Artificial Sequence
  Synthetic Construct
gctgctttggtctggctgttg

SEQ ID NO: 20873 - DNA, 22 bp, Artificial Sequence
  Synthetic Construct
cagtttcccctgggagcacttt

SEQ ID NO: 20874 - DNA, 27 bp, Artificial Sequence
  Synthetic Construct
cgagttatctaatcctcccctacaatg

SEQ ID NO: 20875 - DNA, 22 bp, Artificial Sequence
  Synthetic Construct
cctccctgcaaagacacttaca

SEQ ID NO: 20876 - DNA, 25 bp, Artificial Sequence
  Synthetic Construct
tgcagctgtactttatggatgacaa

SEQ ID NO: 20877 - DNA, 22 bp, Artificial Sequence
  Synthetic Construct
tctggctctatcacctgggttt

SEQ ID NO: 20878 - DNA, 20 bp, Artificial Sequence
  Synthetic Construct
aaggggagtcgcatgggtta

SEQ ID NO: 20879 - DNA, 21 bp, Artificial Sequence
  Synthetic Construct
agcggaaaaacctggctaaga

SEQ ID NO: 20880 - DNA, 23 bp, Artificial Sequence
  Synthetic Construct
ggcagactgtgacgttagtgaga

SEQ ID NO: 20881 - DNA, 27 bp, Artificial Sequence
  Synthetic Construct
gccattggaacctagaattctgtctgt

SEQ ID NO: 20882 - DNA, 24 bp, Artificial Sequence
  Synthetic Construct
ccacactactccatgccaggatct

SEQ ID NO: 20883 - DNA, 26 bp, Artificial Sequence
  Synthetic Construct
agtcacagaactccccagaaatatac

SEQ ID NO: 20884 - DNA, 26 bp, Artificial Sequence
  Synthetic Construct
cacccttggctatagctgctaatttc

SEQ ID NO: 20885 - DNA, 22 bp, Artificial Sequence
  Synthetic Construct
gccttttgggagcccgaactat

SEQ ID NO: 20886 - DNA, 24 bp, Artificial Sequence
  Synthetic Construct
ccagttccccacagaggaggaaaa

SEQ ID NO: 20887 - DNA, 26 bp, Artificial Sequence
  Synthetic Construct
cctgtcaacatgatggtcgtagtaac

SEQ ID NO: 20888 - DNA, 26 bp, Artificial Sequence
  Synthetic Construct
cctgtgtaacatgacttgtactccta

SEQ ID NO: 20889 - DNA, 25 bp, Artificial Sequence
  Synthetic Construct
gaagaaaagcagttcatcccaaaca

SEQ ID NO: 20890 - DNA, 26 bp, Artificial Sequence
  Synthetic Construct
gggagcttgctttctctctttactct

SEQ ID NO: 20891 - DNA, 21 bp, Artificial Sequence
  Synthetic Construct
cctggttgggtgtctttgtgt

SEQ ID NO: 20892 - DNA, 24 bp, Artificial Sequence
  Synthetic Construct
agaagagaggtccttctggtatgt

SEQ ID NO: 20893 - DNA, 22 bp, Artificial Sequence
  Synthetic Construct
gggcaaaggagtggcataatct

SEQ ID NO: 20894 - DNA, 23 bp, Artificial Sequence
  Synthetic Construct
ggctcatggtagctacacctttc

SEQ ID NO: 20895 - DNA, 24 bp, Artificial Sequence
  Synthetic Construct
ggcttcagcagagtaaagtaggaa

SEQ ID NO: 20896 - DNA, 25 bp, Artificial Sequence
  Synthetic Construct
ccaactctcctccaaacagtgattc

SEQ ID NO: 20897 - DNA, 25 bp, Artificial Sequence
  Synthetic Construct
cagattacacgcgattcacaaatca

SEQ ID NO: 20898 - DNA, 27 bp, Artificial Sequence
  Synthetic Construct
gaaggaagtagaatccaccagatcaac

SEQ ID NO: 20899 - DNA, 27 bp, Artificial Sequence
  Synthetic Construct
ggaggaggaatcaatgatggtgtagat

SEQ ID NO: 20900 - DNA, 25 bp, Artificial Sequence
  Synthetic Construct
gtctgctagggttaaacagggcttt

SEQ ID NO: 20901 - DNA, 26 bp, Artificial Sequence
  Synthetic Construct
cagcacagccatcatttcttccaatg

SEQ ID NO: 20902 - DNA, 26 bp, Artificial Sequence
  Synthetic Construct
gagatgtgcctatactgcgtttgaag

SEQ ID NO: 20903 - DNA, 23 bp, Artificial Sequence
  Synthetic Construct
tgggagggaatgaggtgttatct

SEQ ID NO: 20904 - DNA, 27 bp, Artificial Sequence
  Synthetic Construct
gagacaaaatcccactgtcaggataac

SEQ ID NO: 20905 - DNA, 22 bp, Artificial Sequence
  Synthetic Construct
ggcacagaagtagaggctgtag

SEQ ID NO: 20906 - DNA, 22 bp, Artificial Sequence
  Synthetic Construct
acaccccaggtcctgactgata

SEQ ID NO: 20907 - DNA, 23 bp, Artificial Sequence
  Synthetic Construct
cctcttgtttgccccaagctttc

SEQ ID NO: 20908 - DNA, 25 bp, Artificial Sequence
  Synthetic Construct
gcttttcaagaacgggagacacaca

SEQ ID NO: 20909 - DNA, 26 bp, Artificial Sequence
  Synthetic Construct
ccaggaaggaatgtttttacctcttc

SEQ ID NO: 20910 - DNA, 23 bp, Artificial Sequence
  Synthetic Construct
ggagtggctttcattaccctcaa

SEQ ID NO: 20911 - DNA, 25 bp, Artificial Sequence
  Synthetic Construct
cctggctttagtatatgccgagaca

SEQ ID NO: 20912 - DNA, 26 bp, Artificial Sequence
  Synthetic Construct
gcccaaactccacttaagagcagaaa

SEQ ID NO: 20913 - DNA, 20 bp, Artificial Sequence
  Synthetic Construct
aggctccagttggggacaca

SEQ ID NO: 20914 - DNA, 21 bp, Artificial Sequence
  Synthetic Construct
cacttccatccacctgcaaca

SEQ ID NO: 20915 - DNA, 22 bp, Artificial Sequence
  Synthetic Construct
gcagctcctcctacaacaaaga

SEQ ID NO: 20916 - DNA, 23 bp, Artificial Sequence
  Synthetic Construct
ctgcctgttggagagacttgaca

SEQ ID NO: 20917 - DNA, 20 bp, Artificial Sequence
  Synthetic Construct
ccgtgtttgcccctcctttt

SEQ ID NO: 20918 - DNA, 23 bp, Artificial Sequence
  Synthetic Construct
gccctacagggaagatgcagaga

SEQ ID NO: 20919 - DNA, 27 bp, Artificial Sequence
  Synthetic Construct
cctcaggggtatatcaactttgtgtca

SEQ ID NO: 20920 - DNA, 26 bp, Artificial Sequence
  Synthetic Construct
ctacttggaaactccctcttccttag

SEQ ID NO: 20921 - DNA, 21 bp, Artificial Sequence
  Synthetic Construct
ttgccgagacagggatttcaa

SEQ ID NO: 20922 - DNA, 28 bp, Artificial Sequence
  Synthetic Construct
gcctctctgacaatgaccataaccctta

SEQ ID NO: 20923 - DNA, 24 bp, Artificial Sequence
  Synthetic Construct
tcacttcccagtggtgatatgagt

SEQ ID NO: 20924 - DNA, 22 bp, Artificial Sequence
  Synthetic Construct
cctcctgcaagagcagcattga

SEQ ID NO: 20925 - DNA, 23 bp, Artificial Sequence
  Synthetic Construct
gctggccttgtgatctgctttga

SEQ ID NO: 20926 - DNA, 22 bp, Artificial Sequence
  Synthetic Construct
ggaggcaaagggaggatagtca

SEQ ID NO: 20927 - DNA, 25 bp, Artificial Sequence
  Synthetic Construct
gcttgtcaagttctctctgatgcaa

SEQ ID NO: 20928 - DNA, 20 bp, Artificial Sequence
  Synthetic Construct
actcaccatgggtgggtcaa

SEQ ID NO: 20929 - DNA, 23 bp, Artificial Sequence
  Synthetic Construct
cggcaaaatccgagaaggacgtt

SEQ ID NO: 20930 - DNA, 24 bp, Artificial Sequence
  Synthetic Construct
ccattgcagaaagatgtggtcttg

SEQ ID NO: 20931 - DNA, 24 bp, Artificial Sequence
  Synthetic Construct
cccaccattaccgaagtagccatt

SEQ ID NO: 20932 - DNA, 22 bp, Artificial Sequence
  Synthetic Construct
ccctgggcttgtagttttgctt

SEQ ID NO: 20933 - DNA, 20 bp, Artificial Sequence
  Synthetic Construct
acacaccccgctccattact

SEQ ID NO: 20934 - DNA, 22 bp, Artificial Sequence
  Synthetic Construct
cctgccacacatttttggtgaa

SEQ ID NO: 20935 - DNA, 25 bp, Artificial Sequence
  Synthetic Construct
ggcactggctgctaattaaggcaat

SEQ ID NO: 20936 - DNA, 22 bp, Artificial Sequence
  Synthetic Construct
gccactactggcatcttagcaa

SEQ ID NO: 20937 - DNA, 27 bp, Artificial Sequence
  Synthetic Construct
tctgagacagcttctttacttgacttc

SEQ ID NO: 20938 - DNA, 23 bp, Artificial Sequence
  Synthetic Construct
ggagcctggtggtacttttgttc

SEQ ID NO: 20939 - DNA, 23 bp, Artificial Sequence
  Synthetic Construct
cgggaatcaggcaagagatccaa

SEQ ID NO: 20940 - DNA, 24 bp, Artificial Sequence
  Synthetic Construct
gggccagtaggaacatctgtgaac

SEQ ID NO: 20941 - DNA, 27 bp, Artificial Sequence
  Synthetic Construct
gttaggagggtgtaaatctgtgaatga

SEQ ID NO: 20942 - DNA, 21 bp, Artificial Sequence
  Synthetic Construct
gctgtcaccttccggttggat

SEQ ID NO: 20943 - DNA, 22 bp, Artificial Sequence
  Synthetic Construct
ggtcagacactggcttgtccat

SEQ ID NO: 20944 - DNA, 22 bp, Artificial Sequence
  Synthetic Construct
gggtctgcgtgaagagaaaaca

SEQ ID NO: 20945 - DNA, 26 bp, Artificial Sequence
  Synthetic Construct
gtcttccttttacaacctacgtgaca

SEQ ID NO: 20946 - DNA, 21 bp, Artificial Sequence
  Synthetic Construct
gctgcttcgttcctttgttgt

SEQ ID NO: 20947 - DNA, 22 bp, Artificial Sequence
  Synthetic Construct
ctgcccctggttagaatcaact

SEQ ID NO: 20948 - DNA, 23 bp, Artificial Sequence
  Synthetic Construct
gctgtgactcatccacactgtct

SEQ ID NO: 20949 - DNA, 22 bp, Artificial Sequence
  Synthetic Construct
gggcaggtggatgctaagtttg

SEQ ID NO: 20950 - DNA, 25 bp, Artificial Sequence
  Synthetic Construct
ccttacatcaaagagggtgaactgt

SEQ ID NO: 20951 - DNA, 23 bp, Artificial Sequence
  Synthetic Construct
gtgtgtgacagcgatatgagcta

SEQ ID NO: 20952 - DNA, 21 bp, Artificial Sequence
  Synthetic Construct
aggccagagtttgtccaggat

SEQ ID NO: 20953 - DNA, 24 bp, Artificial Sequence
  Synthetic Construct
actgcagttaccttgctttctttc

SEQ ID NO: 20954 - DNA, 24 bp, Artificial Sequence
  Synthetic Construct
cagcaggggctactgtatttgtgt

SEQ ID NO: 20955 - DNA, 26 bp, Artificial Sequence
  Synthetic Construct
ggtttttgagacacaagtctgctgat

SEQ ID NO: 20956 - DNA, 24 bp, Artificial Sequence
  Synthetic Construct
ggacgggtgaagggattttcaaac

SEQ ID NO: 20957 - DNA, 22 bp, Artificial Sequence
  Synthetic Construct
gcacacacagactggctagaag

SEQ ID NO: 20958 - DNA, 23 bp, Artificial Sequence
  Synthetic Construct
gtgacactgcaaaggagctgaaa

SEQ ID NO: 20959 - DNA, 22 bp, Artificial Sequence
  Synthetic Construct
cctgcttcctggaaatgagcaa

SEQ ID NO: 20960 - DNA, 21 bp, Artificial Sequence
  Synthetic Construct
cggaggcgatgaacagggaaa

SEQ ID NO: 20961 - DNA, 28 bp, Artificial Sequence
  Synthetic Construct
ggtttctcagggagtttactcttgcatt

SEQ ID NO: 20962 - DNA, 20 bp, Artificial Sequence
  Synthetic Construct
tcagcacttgccccaacttc

SEQ ID NO: 20963 - DNA, 22 bp, Artificial Sequence
  Synthetic Construct
gggttgaacagttgctgcaaag

SEQ ID NO: 20964 - DNA, 24 bp, Artificial Sequence
  Synthetic Construct
ccaccatcactactaccactctgt

SEQ ID NO: 20965 - DNA, 25 bp, Artificial Sequence
  Synthetic Construct
ccagccataaccagaggtcaagttc

SEQ ID NO: 20966 - DNA, 23 bp, Artificial Sequence
  Synthetic Construct
tgctggacaccttgaattgtttc

SEQ ID NO: 20967 - DNA, 24 bp, Artificial Sequence
  Synthetic Construct
ggatggcgctagagacaggtgata

SEQ ID NO: 20968 - DNA, 21 bp, Artificial Sequence
  Synthetic Construct
ccaccaaccttgcttccaagt

SEQ ID NO: 20969 - DNA, 28 bp, Artificial Sequence
  Synthetic Construct
ccatgtcctgatatacagccttgcaaat

SEQ ID NO: 20970 - DNA, 21 bp, Artificial Sequence
  Synthetic Construct
tgccaggggttttctctctgt

SEQ ID NO: 20971 - DNA, 24 bp, Artificial Sequence
  Synthetic Construct
gcagctggcaattttgctctttct

SEQ ID NO: 20972 - DNA, 22 bp, Artificial Sequence
  Synthetic Construct
gggcagccaacatagcctagaa

SEQ ID NO: 20973 - DNA, 23 bp, Artificial Sequence
  Synthetic Construct
gccggttgagacacaagacagtt

SEQ ID NO: 20974 - DNA, 26 bp, Artificial Sequence
  Synthetic Construct
ccctcaaatggatggattgtgtggta

SEQ ID NO: 20975 - DNA, 23 bp, Artificial Sequence
  Synthetic Construct
gcatatgggacaatcgtggcttt

SEQ ID NO: 20976 - DNA, 23 bp, Artificial Sequence
  Synthetic Construct
gctttccagcctcgtttctcact

SEQ ID NO: 20977 - DNA, 26 bp, Artificial Sequence
  Synthetic Construct
cagtggagcagaaaaacccatacatc

SEQ ID NO: 20978 - DNA, 22 bp, Artificial Sequence
  Synthetic Construct
ggggcgcattgaaagtgaggat

SEQ ID NO: 20979 - DNA, 26 bp, Artificial Sequence
  Synthetic Construct
gagctctgactgaatgatgtgctact

SEQ ID NO: 20980 - DNA, 25 bp, Artificial Sequence
  Synthetic Construct
ccatgagcagcagagtttagcttgt

SEQ ID NO: 20981 - DNA, 21 bp, Artificial Sequence
  Synthetic Construct
acccacttgggttcctccatt

SEQ ID NO: 20982 - DNA, 25 bp, Artificial Sequence
  Synthetic Construct
ccagaggtaacttctcctcccatga

SEQ ID NO: 20983 - DNA, 22 bp, Artificial Sequence
  Synthetic Construct
gtgagaaaaggcaaggcaacat

SEQ ID NO: 20984 - DNA, 22 bp, Artificial Sequence
  Synthetic Construct
cctggtgtttgcttggcaacta

SEQ ID NO: 20985 - DNA, 25 bp, Artificial Sequence
  Synthetic Construct
ccatggactgacaaaatgcaagttc

SEQ ID NO: 20986 - DNA, 22 bp, Artificial Sequence
  Synthetic Construct
ctcgtacgggtaacggttgcta

SEQ ID NO: 20987 - DNA, 20 bp, Artificial Sequence
  Synthetic Construct
gctttgcggagggccttcaa

SEQ ID NO: 20988 - DNA, 25 bp, Artificial Sequence
  Synthetic Construct
gcattcacagcaatctcagccattt

SEQ ID NO: 20989 - DNA, 23 bp, Artificial Sequence
  Synthetic Construct
tgccagaaaggtctcctgataca

SEQ ID NO: 20990 - DNA, 26 bp, Artificial Sequence
  Synthetic Construct
gagactgttaggttaatcctgtgcta

SEQ ID NO: 20991 - DNA, 23 bp, Artificial Sequence
  Synthetic Construct
ggcacatgtttgctcttggcttt

SEQ ID NO: 20992 - DNA, 25 bp, Artificial Sequence
  Synthetic Construct
gggtttactgcctttgagtgcttac

SEQ ID NO: 20993 - DNA, 24 bp, Artificial Sequence
  Synthetic Construct
ggaccgactgctgttgtcctaaag

SEQ ID NO: 20994 - DNA, 26 bp, Artificial Sequence
  Synthetic Construct
cctctgtggctgaacaagaatagaag

SEQ ID NO: 20995 - DNA, 24 bp, Artificial Sequence
  Synthetic Construct
gggcatctctgaaagttgtccaaa

SEQ ID NO: 20996 - DNA, 26 bp, Artificial Sequence
  Synthetic Construct
ggtaaaccaataagcccagagaggaa

SEQ ID NO: 20997 - DNA, 25 bp, Artificial Sequence
  Synthetic Construct
gccacatgtctactgttagccaatc

SEQ ID NO: 20998 - DNA, 23 bp, Artificial Sequence
  Synthetic Construct
ggggaccaatcaggggtactttc

SEQ ID NO: 20999 - DNA, 26 bp, Artificial Sequence
  Synthetic Construct
cagagaggaacttgggaacattcagt

SEQ ID NO: 21000 - DNA, 20 bp, Artificial Sequence
  Synthetic Construct
aggactctgggctgaactga

SEQ ID NO: 21001 - DNA, 22 bp, Artificial Sequence
  Synthetic Construct
cactcactgtcatggcccagtt

SEQ ID NO: 21002 - DNA, 20 bp, Artificial Sequence
  Synthetic Construct
tgcttgccctcggaatgatg

SEQ ID NO: 21003 - DNA, 23 bp, Artificial Sequence
  Synthetic Construct
cagcccaacctaattcaccacaa

SEQ ID NO: 21004 - DNA, 24 bp, Artificial Sequence
  Synthetic Construct
ccactgtcctcatagtgtgcttct

SEQ ID NO: 21005 - DNA, 25 bp, Artificial Sequence
  Synthetic Construct
ggactgaacaagcacagacggtaac

SEQ ID NO: 21006 - DNA, 22 bp, Artificial Sequence
  Synthetic Construct
ggtcaacgggctctgacttttc

SEQ ID NO: 21007 - DNA, 27 bp, Artificial Sequence
  Synthetic Construct
ggaagcttctgatcctcttaagtgcta

SEQ ID NO: 21008 - DNA, 23 bp, Artificial Sequence
  Synthetic Construct
cgtctgcctgtctgtaagggtat

SEQ ID NO: 21009 - DNA, 20 bp, Artificial Sequence
  Synthetic Construct
tctgtctggaggcggagttg

SEQ ID NO: 21010 - DNA, 27 bp, Artificial Sequence
  Synthetic Construct
cctgtgagtaagtgtctcaccaagtct

SEQ ID NO: 21011 - DNA, 22 bp, Artificial Sequence
  Synthetic Construct
tggggtaccatcagggcaattc

SEQ ID NO: 21012 - DNA, 23 bp, Artificial Sequence
  Synthetic Construct
tgcttatgacaggagtggagaga

SEQ ID NO: 21013 - DNA, 20 bp, Artificial Sequence
  Synthetic Construct
cccgattcgccaccttttca

SEQ ID NO: 21014 - DNA, 23 bp, Artificial Sequence
  Synthetic Construct
gtgcctccattccaggaacaagt

SEQ ID NO: 21015 - DNA, 27 bp, Artificial Sequence
  Synthetic Construct
cctacttgaaacaaatcaggtgtgcat

SEQ ID NO: 21016 - DNA, 24 bp, Artificial Sequence
  Synthetic Construct
cagagaactgtggatcaagactga

SEQ ID NO: 21017 - DNA, 24 bp, Artificial Sequence
  Synthetic Construct
ggatcagtctggcttctgatttct

SEQ ID NO: 21018 - DNA, 23 bp, Artificial Sequence
  Synthetic Construct
gaaacccaactctgacacactga

SEQ ID NO: 21019 - DNA, 26 bp, Artificial Sequence
  Synthetic Construct
cccataagacaggaactgagctttga

SEQ ID NO: 21020 - DNA, 22 bp, Artificial Sequence
  Synthetic Construct
cgtggggtaactcatggtctct

SEQ ID NO: 21021 - DNA, 23 bp, Artificial Sequence
  Synthetic Construct
gaccaaaggcaatccagagtgta

SEQ ID NO: 21022 - DNA, 27 bp, Artificial Sequence
  Synthetic Construct
gtttaatgttggttctctgcctagact

SEQ ID NO: 21023 - DNA, 28 bp, Artificial Sequence
  Synthetic Construct
ccataattgctagccacagtttgcttac

SEQ ID NO: 21024 - DNA, 25 bp, Artificial Sequence
  Synthetic Construct
gcacaatcattgctattggccgtaa

SEQ ID NO: 21025 - DNA, 23 bp, Artificial Sequence
  Synthetic Construct
tccacacatcaaacttggagcat

SEQ ID NO: 21026 - DNA, 23 bp, Artificial Sequence
  Synthetic Construct
cctcatctcagactgccgtagaa

SEQ ID NO: 21027 - DNA, 24 bp, Artificial Sequence
  Synthetic Construct
ggatgtgatagctggatcctgaag

SEQ ID NO: 21028 - DNA, 25 bp, Artificial Sequence
  Synthetic Construct
gttccaaggcctattttagcagttg

SEQ ID NO: 21029 - DNA, 25 bp, Artificial Sequence
  Synthetic Construct
gccctctcttcctttgaacttttgt

SEQ ID NO: 21030 - DNA, 26 bp, Artificial Sequence
  Synthetic Construct
ggatgacagcataaagtccagaccaa

SEQ ID NO: 21031 - DNA, 23 bp, Artificial Sequence
  Synthetic Construct
gtcaccacccattggattgttgt

SEQ ID NO: 21032 - DNA, 22 bp, Artificial Sequence
  Synthetic Construct
ccaccccattctctgaccaatc

SEQ ID NO: 21033 - DNA, 24 bp, Artificial Sequence
  Synthetic Construct
ccaaacaaagtgcctcttctttca

SEQ ID NO: 21034 - DNA, 24 bp, Artificial Sequence
  Synthetic Construct
cacctaagtcagcttgtgctcttc

SEQ ID NO: 21035 - DNA, 25 bp, Artificial Sequence
  Synthetic Construct
gtgttgtttggcccataaggtatgt

SEQ ID NO: 21036 - DNA, 26 bp, Artificial Sequence
  Synthetic Construct
caccacacatgccaatgctcatattc

SEQ ID NO: 21037 - DNA, 21 bp, Artificial Sequence
  Synthetic Construct
actgtgcattcaggcaaggtt

SEQ ID NO: 21038 - DNA, 27 bp, Artificial Sequence
  Synthetic Construct
gtgtttgtgtagaaggtttgagtgcta

SEQ ID NO: 21039 - DNA, 21 bp, Artificial Sequence
  Synthetic Construct
cgacaactgcactcctctgaa

SEQ ID NO: 21040 - DNA, 21 bp, Artificial Sequence
  Synthetic Construct
ccatgccctgggctgattgtt

SEQ ID NO: 21041 - DNA, 28 bp, Artificial Sequence
  Synthetic Construct
gcttggctgatgttaaagcttactcctt

SEQ ID NO: 21042 - DNA, 26 bp, Artificial Sequence
  Synthetic Construct
ggtttagttcctggatctcacactga

SEQ ID NO: 21043 - DNA, 25 bp, Artificial Sequence
  Synthetic Construct
gcatctcaggactgagtgactctac

SEQ ID NO: 21044 - DNA, 26 bp, Artificial Sequence
  Synthetic Construct
gacatgggttatggaatgaggcaaat

SEQ ID NO: 21045 - DNA, 23 bp, Artificial Sequence
  Synthetic Construct
gcagtttctctgttgtgggaaga

SEQ ID NO: 21046 - DNA, 26 bp, Artificial Sequence
  Synthetic Construct
cctcccacaattttacccatgtcttc

SEQ ID NO: 21047 - DNA, 24 bp, Artificial Sequence
  Synthetic Construct
cccgtcacaagtctgagtctaagt

SEQ ID NO: 21048 - DNA, 23 bp, Artificial Sequence
  Synthetic Construct
tcccacatgaaggcaaactttct

SEQ ID NO: 21049 - DNA, 25 bp, Artificial Sequence
  Synthetic Construct
agggtgagaaggagttatccaactt

SEQ ID NO: 21050 - DNA, 20 bp, Artificial Sequence
  Synthetic Construct
cccacactggttgtccacat

SEQ ID NO: 21051 - DNA, 24 bp, Artificial Sequence
  Synthetic Construct
cacgtccacctacatctcccttac

SEQ ID NO: 21052 - DNA, 27 bp, Artificial Sequence
  Synthetic Construct
ggttttcagatggtaaagtggtgtcaa

SEQ ID NO: 21053 - DNA, 23 bp, Artificial Sequence
  Synthetic Construct
ccaaagttgaggcaagcatgaca

SEQ ID NO: 21054 - DNA, 23 bp, Artificial Sequence
  Synthetic Construct
tctaggtacagcctgagcattca

SEQ ID NO: 21055 - DNA, 24 bp, Artificial Sequence
  Synthetic Construct
ggcctgactttgtcatggaaggat

SEQ ID NO: 21056 - DNA, 23 bp, Artificial Sequence
  Synthetic Construct
ctgtggctttagctgagagttca

SEQ ID NO: 21057 - DNA, 25 bp, Artificial Sequence
  Synthetic Construct
gaggaagagttgcaatacagccaat

SEQ ID NO: 21058 - DNA, 28 bp, Artificial Sequence
  Synthetic Construct
gggtaatcccagcatgaaatgaggtaaa

SEQ ID NO: 21059 - DNA, 25 bp, Artificial Sequence
  Synthetic Construct
ggacagccactccttagttgtttga

SEQ ID NO: 21060 - DNA, 22 bp, Artificial Sequence
  Synthetic Construct
gggtcatgtctccatccagtga

SEQ ID NO: 21061 - DNA, 23 bp, Artificial Sequence
  Synthetic Construct
ccaggagtgtcaaatcagctctt

SEQ ID NO: 21062 - DNA, 24 bp, Artificial Sequence
  Synthetic Construct
ctcctctccctcattacctctcaa

SEQ ID NO: 21063 - DNA, 22 bp, Artificial Sequence
  Synthetic Construct
cgcatgtccctaatgcgtggat

SEQ ID NO: 21064 - DNA, 22 bp, Artificial Sequence
  Synthetic Construct
gcacagccagcattcccatagt

SEQ ID NO: 21065 - DNA, 24 bp, Artificial Sequence
  Synthetic Construct
cgttgcctacagttctcctctatc

SEQ ID NO: 21066 - DNA, 25 bp, Artificial Sequence
  Synthetic Construct
ccgagaatgtcacttctgctgtatc

SEQ ID NO: 21067 - DNA, 24 bp, Artificial Sequence
  Synthetic Construct
gccaagtctgtggctagaggaagt

SEQ ID NO: 21068 - DNA, 24 bp, Artificial Sequence
  Synthetic Construct
ggctgcccgattcttaaatcattc

SEQ ID NO: 21069 - DNA, 24 bp, Artificial Sequence
  Synthetic Construct
accggaagccttaaccaatttttg

SEQ ID NO: 21070 - DNA, 24 bp, Artificial Sequence
  Synthetic Construct
ccctggaacccctacctgtcttat

SEQ ID NO: 21071 - DNA, 20 bp, Artificial Sequence
  Synthetic Construct
gcccacaacccactgagcat

SEQ ID NO: 21072 - DNA, 26 bp, Artificial Sequence
  Synthetic Construct
gtatttaccccagatgggatgtttca

SEQ ID NO: 21073 - DNA, 22 bp, Artificial Sequence
  Synthetic Construct
cagggctggagttgtgatgagt

SEQ ID NO: 21074 - DNA, 26 bp, Artificial Sequence
  Synthetic Construct
tcccactatcagaacattacctggat

SEQ ID NO: 21075 - DNA, 22 bp, Artificial Sequence
  Synthetic Construct
gtggagcttccacgtgatcctt

SEQ ID NO: 21076 - DNA, 25 bp, Artificial Sequence
  Synthetic Construct
gttcctaccccataggatcaagatg

SEQ ID NO: 21077 - DNA, 23 bp, Artificial Sequence
  Synthetic Construct
ctgaatggtgaacaggacagtct

SEQ ID NO: 21078 - DNA, 24 bp, Artificial Sequence
  Synthetic Construct
tcagccttcgacatctttcattgt

SEQ ID NO: 21079 - DNA, 27 bp, Artificial Sequence
  Synthetic Construct
ggaaagggctcacagaaaattaagaga

SEQ ID NO: 21080 - DNA, 25 bp, Artificial Sequence
  Synthetic Construct
gggctatttccattgtaagcacttt

SEQ ID NO: 21081 - DNA, 26 bp, Artificial Sequence
  Synthetic Construct
cttggtatggtcaagaaaacggaaac

SEQ ID NO: 21082 - DNA, 25 bp, Artificial Sequence
  Synthetic Construct
ggctgagactctaggacaggtaatg

SEQ ID NO: 21083 - DNA, 25 bp, Artificial Sequence
  Synthetic Construct
gcatcgaaagggatgtagtcactta

SEQ ID NO: 21084 - DNA, 26 bp, Artificial Sequence
  Synthetic Construct
cctccccagaggtaataacgatgtag

SEQ ID NO: 21085 - DNA, 23 bp, Artificial Sequence
  Synthetic Construct
caaaaccacacacaacacaccat

SEQ ID NO: 21086 - DNA, 23 bp, Artificial Sequence
  Synthetic Construct
gccaaagaccaaaaccacctaga

SEQ ID NO: 21087 - DNA, 24 bp, Artificial Sequence
  Synthetic Construct
catctcaagcattcacacccagat

SEQ ID NO: 21088 - DNA, 26 bp, Artificial Sequence
  Synthetic Construct
accactcctttcacacaaatcctatg

SEQ ID NO: 21089 - DNA, 27 bp, Artificial Sequence
  Synthetic Construct
ccacgttagatacctgacaacctcaga

SEQ ID NO: 21090 - DNA, 22 bp, Artificial Sequence
  Synthetic Construct
ccctgccaaattttccctggtt

SEQ ID NO: 21091 - DNA, 22 bp, Artificial Sequence
  Synthetic Construct
ggagtcaagcccagccaagttt

SEQ ID NO: 21092 - DNA, 23 bp, Artificial Sequence
  Synthetic Construct
tgagaggcattgggagatagcaa

SEQ ID NO: 21093 - DNA, 24 bp, Artificial Sequence
  Synthetic Construct
ggaagatcctagcaagaggtgaaa

SEQ ID NO: 21094 - DNA, 24 bp, Artificial Sequence
  Synthetic Construct
ccttgccatagcaggtagtagaag

SEQ ID NO: 21095 - DNA, 26 bp, Artificial Sequence
  Synthetic Construct
cacaacctgagtattcccctgtattc

SEQ ID NO: 21096 - DNA, 22 bp, Artificial Sequence
  Synthetic Construct
cccatgctcatcactgcccaat

SEQ ID NO: 21097 - DNA, 25 bp, Artificial Sequence
  Synthetic Construct
ctgaagcaaggcacctatgaactct

SEQ ID NO: 21098 - DNA, 24 bp, Artificial Sequence
  Synthetic Construct
gcatgtcccaaacacttcctgtgt

SEQ ID NO: 21099 - DNA, 25 bp, Artificial Sequence
  Synthetic Construct
ctgcattccattcgcttttccaaat

SEQ ID NO: 21100 - DNA, 24 bp, Artificial Sequence
  Synthetic Construct
aggggagcagagatctagggattc

SEQ ID NO: 21101 - DNA, 22 bp, Artificial Sequence
  Synthetic Construct
ggctgccgttaggatgtagaac

SEQ ID NO: 21102 - DNA, 22 bp, Artificial Sequence
  Synthetic Construct
cacacaaacctgagcagccatt

SEQ ID NO: 21103 - DNA, 24 bp, Artificial Sequence
  Synthetic Construct
cacttgccttacaaccacctgatg

SEQ ID NO: 21104 - DNA, 22 bp, Artificial Sequence
  Synthetic Construct
cacttccacttccaccccttga

SEQ ID NO: 21105 - DNA, 24 bp, Artificial Sequence
  Synthetic Construct
tgttgccagtaatatacgccatct

SEQ ID NO: 21106 - DNA, 24 bp, Artificial Sequence
  Synthetic Construct
gcccatagcttcctaaacctccat

SEQ ID NO: 21107 - DNA, 26 bp, Artificial Sequence
  Synthetic Construct
ccaaacctgtaatttgctgaggtaca

SEQ ID NO: 21108 - DNA, 26 bp, Artificial Sequence
  Synthetic Construct
gccattgtgtggaagacatagtgtga

SEQ ID NO: 21109 - DNA, 24 bp, Artificial Sequence
  Synthetic Construct
gattcagacccagactccagattt

SEQ ID NO: 21110 - DNA, 22 bp, Artificial Sequence
  Synthetic Construct
ctcctgcggtgtttttgtctct

SEQ ID NO: 21111 - DNA, 27 bp, Artificial Sequence
  Synthetic Construct
cctggtttacatctactcccaactttc

SEQ ID NO: 21112 - DNA, 26 bp, Artificial Sequence
  Synthetic Construct
gctaaggaggattctaaaggtgctaa

SEQ ID NO: 21113 - DNA, 23 bp, Artificial Sequence
  Synthetic Construct
cagtcactgcttgaacaccatgt

SEQ ID NO: 21114 - DNA, 23 bp, Artificial Sequence
  Synthetic Construct
gccaggagctttgagagcttgta

SEQ ID NO: 21115 - DNA, 25 bp, Artificial Sequence
  Synthetic Construct
tgacttgggagaccattcatttcaa

SEQ ID NO: 21116 - DNA, 26 bp, Artificial Sequence
  Synthetic Construct
gcatttaaggggtattcgtgggacta

SEQ ID NO: 21117 - DNA, 23 bp, Artificial Sequence
  Synthetic Construct
gggcagtttgtgtcacagtcttt

SEQ ID NO: 21118 - DNA, 24 bp, Artificial Sequence
  Synthetic Construct
ctgcaagctgtggttttcagtttc

SEQ ID NO: 21119 - DNA, 26 bp, Artificial Sequence
  Synthetic Construct
cagattccagccacaaatatctcatc

SEQ ID NO: 21120 - DNA, 22 bp, Artificial Sequence
  Synthetic Construct
ttgggaaaccagggtccagaga

SEQ ID NO: 21121 - DNA, 21 bp, Artificial Sequence
  Synthetic Construct
gcaggaggtaactggggcata

SEQ ID NO: 21122 - DNA, 26 bp, Artificial Sequence
  Synthetic Construct
gctgagcattttacactgaccctttg

SEQ ID NO: 21123 - DNA, 23 bp, Artificial Sequence
  Synthetic Construct
agggtaagctgaggcaagtttag

SEQ ID NO: 21124 - DNA, 27 bp, Artificial Sequence
  Synthetic Construct
ggcttgttcttatggtagggttccaaa

SEQ ID NO: 21125 - DNA, 24 bp, Artificial Sequence
  Synthetic Construct
ggtggaagaatgaggctgtacctt

SEQ ID NO: 21126 - DNA, 21 bp, Artificial Sequence
  Synthetic Construct
ggtaggcaatggcctggtatt

SEQ ID NO: 21127 - DNA, 25 bp, Artificial Sequence
  Synthetic Construct
ctgtggactctttcatcttgcatgt

SEQ ID NO: 21128 - DNA, 27 bp, Artificial Sequence
  Synthetic Construct
caagaggggaaaaatcctctttagaca

SEQ ID NO: 21129 - DNA, 25 bp, Artificial Sequence
  Synthetic Construct
ccaagtaacactgcagctttaagaa

SEQ ID NO: 21130 - DNA, 22 bp, Artificial Sequence
  Synthetic Construct
gctctgtcatccccagctgaaa

SEQ ID NO: 21131 - DNA, 22 bp, Artificial Sequence
  Synthetic Construct
ctgccaacagcacttgtcatac

SEQ ID NO: 21132 - DNA, 27 bp, Artificial Sequence
  Synthetic Construct
ctggggtaaaaggaggttatcaagcat

SEQ ID NO: 21133 - DNA, 24 bp, Artificial Sequence
  Synthetic Construct
ctctctccctgcttagatgtttgt

SEQ ID NO: 21134 - DNA, 27 bp, Artificial Sequence
  Synthetic Construct
cggctaagctaacgatattccatctct

SEQ ID NO: 21135 - DNA, 23 bp, Artificial Sequence
  Synthetic Construct
ggctcccatttgttgtcggctaa

SEQ ID NO: 21136 - DNA, 23 bp, Artificial Sequence
  Synthetic Construct
ccgcttagccaatatgccctttg

SEQ ID NO: 21137 - DNA, 26 bp, Artificial Sequence
  Synthetic Construct
gaacacaggtcagtttcaggtagatg

SEQ ID NO: 21138 - DNA, 28 bp, Artificial Sequence
  Synthetic Construct
cagtgttctgtttaaggtcacctcttct

SEQ ID NO: 21139 - DNA, 22 bp, Artificial Sequence
  Synthetic Construct
gctcagagcagcactcgttttg

SEQ ID NO: 21140 - DNA, 22 bp, Artificial Sequence
  Synthetic Construct
ccacagctcagattgactcaca

SEQ ID NO: 21141 - DNA, 23 bp, Artificial Sequence
  Synthetic Construct
ccctcagcaatgtcgctagtagt

SEQ ID NO: 21142 - DNA, 22 bp, Artificial Sequence
  Synthetic Construct
ggagcacatggtgactctctga

SEQ ID NO: 21143 - DNA, 24 bp, Artificial Sequence
  Synthetic Construct
cggtgggtcctacacctgagaata

SEQ ID NO: 21144 - DNA, 22 bp, Artificial Sequence
  Synthetic Construct
ccccaatctgtgccttcatgtt

SEQ ID NO: 21145 - DNA, 24 bp, Artificial Sequence
  Synthetic Construct
cctcaggcataaagccaggtcagt

SEQ ID NO: 21146 - DNA, 24 bp, Artificial Sequence
  Synthetic Construct
tcatccaagagttctaccctgtct

SEQ ID NO: 21147 - DNA, 26 bp, Artificial Sequence
  Synthetic Construct
cctttctacacatccagcctaagttc

SEQ ID NO: 21148 - DNA, 25 bp, Artificial Sequence
  Synthetic Construct
gacagtccctcactgagtaggttga

SEQ ID NO: 21149 - DNA, 25 bp, Artificial Sequence
  Synthetic Construct
gcctcaggatacttttagcagaaga

SEQ ID NO: 21150 - DNA, 23 bp, Artificial Sequence
  Synthetic Construct
gaacccaggcatagagagtctga

SEQ ID NO: 21151 - DNA, 22 bp, Artificial Sequence
  Synthetic Construct
gtagctggaatgcacagcctta

SEQ ID NO: 21152 - DNA, 20 bp, Artificial Sequence
  Synthetic Construct
cccgtgacgaaagcttccaa

SEQ ID NO: 21153 - DNA, 23 bp, Artificial Sequence
  Synthetic Construct
gcagacagtgacacacctgtaag

SEQ ID NO: 21154 - DNA, 22 bp, Artificial Sequence
  Synthetic Construct
ccctgactgcctaagctgaaga

SEQ ID NO: 21155 - DNA, 22 bp, Artificial Sequence
  Synthetic Construct
gggtcctcctattgtggtgcaa

SEQ ID NO: 21156 - DNA, 22 bp, Artificial Sequence
  Synthetic Construct
ccaagcctctccccaagctaga

SEQ ID NO: 21157 - DNA, 28 bp, Artificial Sequence
  Synthetic Construct
gcctgaacctatcctactaaatcagtca

SEQ ID NO: 21158 - DNA, 24 bp, Artificial Sequence
  Synthetic Construct
caaggagaatgtgccccttctaaa

SEQ ID NO: 21159 - DNA, 27 bp, Artificial Sequence
  Synthetic Construct
ctgttgttcccaggttggaatgaaatg

SEQ ID NO: 21160 - DNA, 22 bp, Artificial Sequence
  Synthetic Construct
gttccctctttcccctgagtgt

SEQ ID NO: 21161 - DNA, 26 bp, Artificial Sequence
  Synthetic Construct
tccaggtaatgtgtgaagggtttatg

SEQ ID NO: 21162 - DNA, 29 bp, Artificial Sequence
  Synthetic Construct
ggctgatggctaaaacttactgtttccta

SEQ ID NO: 21163 - DNA, 24 bp, Artificial Sequence
  Synthetic Construct
tctcctccttccatcctcttttga

SEQ ID NO: 21164 - DNA, 23 bp, Artificial Sequence
  Synthetic Construct
ctgacactggcttttgactggaa

SEQ ID NO: 21165 - DNA, 24 bp, Artificial Sequence
  Synthetic Construct
gcatgattcccagttcctagatgt

SEQ ID NO: 21166 - DNA, 24 bp, Artificial Sequence
  Synthetic Construct
gctgtgaactgtggaaaacacaga

SEQ ID NO: 21167 - DNA, 27 bp, Artificial Sequence
  Synthetic Construct
ggcattgggaaacttgagctatgtact

SEQ ID NO: 21168 - DNA, 23 bp, Artificial Sequence
  Synthetic Construct
ggctgtgtgtgttctctggtcat

SEQ ID NO: 21169 - DNA, 24 bp, Artificial Sequence
  Synthetic Construct
ggtggcagagaaagcctaaaattc

SEQ ID NO: 21170 - DNA, 25 bp, Artificial Sequence
  Synthetic Construct
cccagcacacacttaaaaagaacaa

SEQ ID NO: 21171 - DNA, 23 bp, Artificial Sequence
  Synthetic Construct
gctcctgtacttgccaatagcat

SEQ ID NO: 21172 - DNA, 25 bp, Artificial Sequence
  Synthetic Construct
ccccttatgtccttccttaccacat

SEQ ID NO: 21173 - DNA, 23 bp, Artificial Sequence
  Synthetic Construct
gctgccttgctttcttggtgaca

SEQ ID NO: 21174 - DNA, 25 bp, Artificial Sequence
  Synthetic Construct
acactccagtaaaacgttccttaca

SEQ ID NO: 21175 - DNA, 22 bp, Artificial Sequence
  Synthetic Construct
ttccttgtggtggtccaagatg

SEQ ID NO: 21176 - DNA, 25 bp, Artificial Sequence
  Synthetic Construct
gtcaccacagaaacacacctttaac

SEQ ID NO: 21177 - DNA, 22 bp, Artificial Sequence
  Synthetic Construct
ctgccctgaatcctactgtgtt

SEQ ID NO: 21178 - DNA, 26 bp, Artificial Sequence
  Synthetic Construct
ggtgcattttggactagcagaagcat

SEQ ID NO: 21179 - DNA, 22 bp, Artificial Sequence
  Synthetic Construct
tcctgaggctattggcggaact

SEQ ID NO: 21180 - DNA, 25 bp, Artificial Sequence
  Synthetic Construct
gctgttggtttcattttggagaaac

SEQ ID NO: 21181 - DNA, 28 bp, Artificial Sequence
  Synthetic Construct
gagatgctatttttggtggatggcaaag

SEQ ID NO: 21182 - DNA, 24 bp, Artificial Sequence
  Synthetic Construct
gccatccttcatggtagagacact

SEQ ID NO: 21183 - DNA, 25 bp, Artificial Sequence
  Synthetic Construct
ggaacagcaaggttgctagtctgta

SEQ ID NO: 21184 - DNA, 24 bp, Artificial Sequence
  Synthetic Construct
gtgacaaacccacttccaggattg

SEQ ID NO: 21185 - DNA, 23 bp, Artificial Sequence
  Synthetic Construct
gctgttctcacagacacactgtt

SEQ ID NO: 21186 - DNA, 23 bp, Artificial Sequence
  Synthetic Construct
ctgcccttcctgttttcctgcta

SEQ ID NO: 21187 - DNA, 23 bp, Artificial Sequence
  Synthetic Construct
gcagcccaatagcagaactgtgt

SEQ ID NO: 21188 - DNA, 22 bp, Artificial Sequence
  Synthetic Construct
tgctggagtagaccaagagtca

SEQ ID NO: 21189 - DNA, 20 bp, Artificial Sequence
  Synthetic Construct
aacgtgggccattcctccta

SEQ ID NO: 21190 - DNA, 23 bp, Artificial Sequence
  Synthetic Construct
cactttctggctcacagatggta

SEQ ID NO: 21191 - DNA, 30 bp, Artificial Sequence
  Synthetic Construct
gtgttttggctgtactatctctagtgcaaa

SEQ ID NO: 21192 - DNA, 25 bp, Artificial Sequence
  Synthetic Construct
cacaaaaccagtgtccccagtattc

SEQ ID NO: 21193 - DNA, 23 bp, Artificial Sequence
  Synthetic Construct
gctcttccaagcctttcattgtt

SEQ ID NO: 21194 - DNA, 26 bp, Artificial Sequence
  Synthetic Construct
gggactatcctgaagcatgtaaaagt

SEQ ID NO: 21195 - DNA, 23 bp, Artificial Sequence
  Synthetic Construct
tctggacttgacagtgacagatg

SEQ ID NO: 21196 - DNA, 25 bp, Artificial Sequence
  Synthetic Construct
gtaagaaaagcttcactggaacaca

SEQ ID NO: 21197 - DNA, 23 bp, Artificial Sequence
  Synthetic Construct
cggctcatttgcaatgggcatca

SEQ ID NO: 21198 - DNA, 21 bp, Artificial Sequence
  Synthetic Construct
gggaactgcaggccatagaca

SEQ ID NO: 21199 - DNA, 23 bp, Artificial Sequence
  Synthetic Construct
ccctgcctctaatcctccagtgt

SEQ ID NO: 21200 - DNA, 21 bp, Artificial Sequence
  Synthetic Construct
tttccctgccctgggctcaca

SEQ ID NO: 21201 - DNA, 20 bp, Artificial Sequence
  Synthetic Construct
ggctctgcctcactgtgact

SEQ ID NO: 21202 - DNA, 21 bp, Artificial Sequence
  Synthetic Construct
tcaccctcttactgcctccaa

SEQ ID NO: 21203 - DNA, 26 bp, Artificial Sequence
  Synthetic Construct
gagccagagtgtaaagagggatccta

SEQ ID NO: 21204 - DNA, 22 bp, Artificial Sequence
  Synthetic Construct
caggagggattgtgtggtctga

SEQ ID NO: 21205 - DNA, 23 bp, Artificial Sequence
  Synthetic Construct
gctccaatcccggactagcctta

SEQ ID NO: 21206 - DNA, 20 bp, Artificial Sequence
  Synthetic Construct
gccacgttaagggcccaagt

SEQ ID NO: 21207 - DNA, 25 bp, Artificial Sequence
  Synthetic Construct
gaaaaatagtctgccccatccatct

SEQ ID NO: 21208 - DNA, 24 bp, Artificial Sequence
  Synthetic Construct
cctttgatagcaccactggcaaga

SEQ ID NO: 21209 - DNA, 24 bp, Artificial Sequence
  Synthetic Construct
gaggtgtgttgattgtgctaccta

SEQ ID NO: 21210 - DNA, 21 bp, Artificial Sequence
  Synthetic Construct
ggtgcagatcggtgctcacaa

SEQ ID NO: 21211 - DNA, 29 bp, Artificial Sequence
  Synthetic Construct
ccaaggaaggtggtgaagtattattcagt

SEQ ID NO: 21212 - DNA, 28 bp, Artificial Sequence
  Synthetic Construct
ggacatatgttgcaggtagagctaggaa

SEQ ID NO: 21213 - DNA, 24 bp, Artificial Sequence
  Synthetic Construct
gctagaccaaggatccctctgatg

SEQ ID NO: 21214 - DNA, 22 bp, Artificial Sequence
  Synthetic Construct
tggagtggattcaggcttgcta

SEQ ID NO: 21215 - DNA, 25 bp, Artificial Sequence
  Synthetic Construct
ccttcaacaaaggttaggccacaaa

SEQ ID NO: 21216 - DNA, 23 bp, Artificial Sequence
  Synthetic Construct
agccaaagaaggaggagcttatg

SEQ ID NO: 21217 - DNA, 22 bp, Artificial Sequence
  Synthetic Construct
ggtcctgggcatacagtgattt

SEQ ID NO: 21218 - DNA, 28 bp, Artificial Sequence
  Synthetic Construct
ctgaacacgtacactctatcttcccaaa

SEQ ID NO: 21219 - DNA, 25 bp, Artificial Sequence
  Synthetic Construct
gtgcctgctgataaaaactcactac

SEQ ID NO: 21220 - DNA, 21 bp, Artificial Sequence
  Synthetic Construct
ggcagtgcatcagttcctctt

SEQ ID NO: 21221 - DNA, 25 bp, Artificial Sequence
  Synthetic Construct
gaccagggagcatattactggatca

SEQ ID NO: 21222 - DNA, 20 bp, Artificial Sequence
  Synthetic Construct
gctgggaacagggtttcaca

SEQ ID NO: 21223 - DNA, 23 bp, Artificial Sequence
  Synthetic Construct
cagctgtggtaggggctatagaa

SEQ ID NO: 21224 - DNA, 23 bp, Artificial Sequence
  Synthetic Construct
ccaaaacctccaaagtcgtgaag

SEQ ID NO: 21225 - DNA, 24 bp, Artificial Sequence
  Synthetic Construct
ctaagctcagaagccatccaatct

SEQ ID NO: 21226 - DNA, 27 bp, Artificial Sequence
  Synthetic Construct
ctgaaacagtaggaactcaaggtgcaa

SEQ ID NO: 21227 - DNA, 22 bp, Artificial Sequence
  Synthetic Construct
aggacaaggctgttctggtact

SEQ ID NO: 21228 - DNA, 22 bp, Artificial Sequence
  Synthetic Construct
ggggaaggatagagcagtgcaa

SEQ ID NO: 21229 - DNA, 24 bp, Artificial Sequence
  Synthetic Construct
gtgtgtaggtgagcctgaccaaag

SEQ ID NO: 21230 - DNA, 22 bp, Artificial Sequence
  Synthetic Construct
ggctaccaactagccagtgctt

SEQ ID NO: 21231 - DNA, 24 bp, Artificial Sequence
  Synthetic Construct
agggcagaacgatgtaaaaacaac

SEQ ID NO: 21232 - DNA, 26 bp, Artificial Sequence
  Synthetic Construct
tcctacctaatctaaccctcatgcta

SEQ ID NO: 21233 - DNA, 22 bp, Artificial Sequence
  Synthetic Construct
gccgtgaacaggcttactctca

SEQ ID NO: 21234 - DNA, 28 bp, Artificial Sequence
  Synthetic Construct
cctctaggaatttaactccacccacaac

SEQ ID NO: 21235 - DNA, 22 bp, Artificial Sequence
  Synthetic Construct
acggtcctaccagtgttgatga

SEQ ID NO: 21236 - DNA, 24 bp, Artificial Sequence
  Synthetic Construct
gggaggtggaagacatgatggata

SEQ ID NO: 21237 - DNA, 25 bp, Artificial Sequence
  Synthetic Construct
gttgagtgatggcaaaatgggtgaa

SEQ ID NO: 21238 - DNA, 22 bp, Artificial Sequence
  Synthetic Construct
cccagtccccttttccactaga

SEQ ID NO: 21239 - DNA, 28 bp, Artificial Sequence
  Synthetic Construct
gcctgtttgctctctatacccataccta

SEQ ID NO: 21240 - DNA, 24 bp, Artificial Sequence
  Synthetic Construct
ggctttgccacttgtcatgctaac

SEQ ID NO: 21241 - DNA, 24 bp, Artificial Sequence
  Synthetic Construct
gctgtggatagcagtagcaacact

SEQ ID NO: 21242 - DNA, 24 bp, Artificial Sequence
  Synthetic Construct
ggagcctctctctgggttctatct

SEQ ID NO: 21243 - DNA, 22 bp, Artificial Sequence
  Synthetic Construct
gcccaacccctaaagactgaca

SEQ ID NO: 21244 - DNA, 23 bp, Artificial Sequence
  Synthetic Construct
gtggctgctgttagacgtgttag

SEQ ID NO: 21245 - DNA, 22 bp, Artificial Sequence
  Synthetic Construct
gcctcacacagggaatgagaga

SEQ ID NO: 21246 - DNA, 26 bp, Artificial Sequence
  Synthetic Construct
ctgggttcaaagctaattctgccatt

SEQ ID NO: 21247 - DNA, 24 bp, Artificial Sequence
  Synthetic Construct
agcctctgaactgtaagatgcaaa

SEQ ID NO: 21248 - DNA, 22 bp, Artificial Sequence
  Synthetic Construct
cacacagccagccagtcctatt

SEQ ID NO: 21249 - DNA, 21 bp, Artificial Sequence
  Synthetic Construct
ccggatcctcaacccaagaag

SEQ ID NO: 21250 - DNA, 25 bp, Artificial Sequence
  Synthetic Construct
agtggaatgtcttgaaggagagatg

SEQ ID NO: 21251 - DNA, 24 bp, Artificial Sequence
  Synthetic Construct
gggagaatgagtgactgctgacat

SEQ ID NO: 21252 - DNA, 24 bp, Artificial Sequence
  Synthetic Construct
gttctggccaaccttactgtcttc

SEQ ID NO: 21253 - DNA, 22 bp, Artificial Sequence
  Synthetic Construct
ccgagttccaggctaggagtat

SEQ ID NO: 21254 - DNA, 23 bp, Artificial Sequence
  Synthetic Construct
ccagtggagactttcaccccata

SEQ ID NO: 21255 - DNA, 26 bp, Artificial Sequence
  Synthetic Construct
cctcaatgtagacaaggaagatgtca

SEQ ID NO: 21256 - DNA, 22 bp, Artificial Sequence
  Synthetic Construct
gtgaagcctgggtgtagctttg

SEQ ID NO: 21257 - DNA, 21 bp, Artificial Sequence
  Synthetic Construct
tgtaccaggtggctgctcttg

SEQ ID NO: 21258 - DNA, 25 bp, Artificial Sequence
  Synthetic Construct
cggtttaagttcagcaggaaaaagt

SEQ ID NO: 21259 - DNA, 22 bp, Artificial Sequence
  Synthetic Construct
tggctcagagatcgtcccttct

SEQ ID NO: 21260 - DNA, 27 bp, Artificial Sequence
  Synthetic Construct
ggttcaaagacaactgtgaagcgatga

SEQ ID NO: 21261 - DNA, 28 bp, Artificial Sequence
  Synthetic Construct
gacctatgggctttacaattggagtaga

SEQ ID NO: 21262 - DNA, 23 bp, Artificial Sequence
  Synthetic Construct
ccagaaggctttgagccatcaca

SEQ ID NO: 21263 - DNA, 24 bp, Artificial Sequence
  Synthetic Construct
ctctctgagcagctgaagttctgt

SEQ ID NO: 21264 - DNA, 21 bp, Artificial Sequence
  Synthetic Construct
caccggcatatgtgccaagaa

SEQ ID NO: 21265 - DNA, 24 bp, Artificial Sequence
  Synthetic Construct
gaatcctttgaacccaggactttg

SEQ ID NO: 21266 - DNA, 22 bp, Artificial Sequence
  Synthetic Construct
ggtgtagccacgtcccaattct

SEQ ID NO: 21267 - DNA, 26 bp, Artificial Sequence
  Synthetic Construct
ccaaacggatgtatgtaggacaccaa

SEQ ID NO: 21268 - DNA, 25 bp, Artificial Sequence
  Synthetic Construct
cttcctgtgattgctttccctttga

SEQ ID NO: 21269 - DNA, 26 bp, Artificial Sequence
  Synthetic Construct
gacagttggctgacgatattctcctt

SEQ ID NO: 21270 - DNA, 24 bp, Artificial Sequence
  Synthetic Construct
ccccttgaaactggcttatactct

SEQ ID NO: 21271 - DNA, 23 bp, Artificial Sequence
  Synthetic Construct
ggtgaccaagggtaggtatgaca

SEQ ID NO: 21272 - DNA, 24 bp, Artificial Sequence
  Synthetic Construct
ggaagtgaccaagctgacatggaa

SEQ ID NO: 21273 - DNA, 24 bp, Artificial Sequence
  Synthetic Construct
ccgtggagttggtttgagggagat

SEQ ID NO: 21274 - DNA, 23 bp, Artificial Sequence
  Synthetic Construct
cgcccaggtacagagaatagcat

SEQ ID NO: 21275 - DNA, 23 bp, Artificial Sequence
  Synthetic Construct
ccacctggtgaacttgagcttga

SEQ ID NO: 21276 - DNA, 22 bp, Artificial Sequence
  Synthetic Construct
gatcccagttgtgtgcccttag

SEQ ID NO: 21277 - DNA, 24 bp, Artificial Sequence
  Synthetic Construct
gggtggtgaggagatcagactgta

SEQ ID NO: 21278 - DNA, 24 bp, Artificial Sequence
  Synthetic Construct
cacacacagagaaaaggtcacttc

SEQ ID NO: 21279 - DNA, 27 bp, Artificial Sequence
  Synthetic Construct
gcaagcctaatcgggattttagctctt

SEQ ID NO: 21280 - DNA, 23 bp, Artificial Sequence
  Synthetic Construct
ggagaacagagccacatgctaac

SEQ ID NO: 21281 - DNA, 23 bp, Artificial Sequence
  Synthetic Construct
gctcctcgtggaatcctgaaatg

SEQ ID NO: 21282 - DNA, 26 bp, Artificial Sequence
  Synthetic Construct
gccctctgagagtagtcaggaaacta

SEQ ID NO: 21283 - DNA, 26 bp, Artificial Sequence
  Synthetic Construct
gctggtatggagaacaattcctgaca

SEQ ID NO: 21284 - DNA, 23 bp, Artificial Sequence
  Synthetic Construct
ccctctcttgcctggtctatttt

SEQ ID NO: 21285 - DNA, 23 bp, Artificial Sequence
  Synthetic Construct
ccctgcattccttcttcttggat

SEQ ID NO: 21286 - DNA, 27 bp, Artificial Sequence
  Synthetic Construct
gcaaggaatcttgtgtctctatgattg

SEQ ID NO: 21287 - DNA, 26 bp, Artificial Sequence
  Synthetic Construct
ctggaggaataccaatcagacgacaa

SEQ ID NO: 21288 - DNA, 23 bp, Artificial Sequence
  Synthetic Construct
atgcaagggtgatgaagaaggaa

SEQ ID NO: 21289 - DNA, 27 bp, Artificial Sequence
  Synthetic Construct
ggagttaagagggagttgaagtcaaag

SEQ ID NO: 21290 - DNA, 26 bp, Artificial Sequence
  Synthetic Construct
actctgcctctgagattctagatagt

SEQ ID NO: 21291 - DNA, 22 bp, Artificial Sequence
  Synthetic Construct
tcctcattcctcagagctgaca

SEQ ID NO: 21292 - DNA, 20 bp, Artificial Sequence
  Synthetic Construct
gacgggtactacgggtccat

SEQ ID NO: 21293 - DNA, 26 bp, Artificial Sequence
  Synthetic Construct
gactgcctctatgaagccatttccta

SEQ ID NO: 21294 - DNA, 24 bp, Artificial Sequence
  Synthetic Construct
cagccacaaggaacaatctcaaaa

SEQ ID NO: 21295 - DNA, 20 bp, Artificial Sequence
  Synthetic Construct
tgccagctctgcctctctaa

SEQ ID NO: 21296 - DNA, 26 bp, Artificial Sequence
  Synthetic Construct
gagtaggacttcttacatggcagttg

SEQ ID NO: 21297 - DNA, 20 bp, Artificial Sequence
  Synthetic Construct
acagtcacctctgcctgtct

SEQ ID NO: 21298 - DNA, 22 bp, Artificial Sequence
  Synthetic Construct
gggtctgatcaccccaacattc

SEQ ID NO: 21299 - DNA, 28 bp, Artificial Sequence
  Synthetic Construct
cccaggaacttaaatgaaatgggcatac

SEQ ID NO: 21300 - DNA, 20 bp, Artificial Sequence
  Synthetic Construct
tcggagctgtctgggaagtt

SEQ ID NO: 21301 - DNA, 24 bp, Artificial Sequence
  Synthetic Construct
ccacatgcctcctatatgctttgt

SEQ ID NO: 21302 - DNA, 22 bp, Artificial Sequence
  Synthetic Construct
cagcaccactttgcactacttc

SEQ ID NO: 21303 - DNA, 24 bp, Artificial Sequence
  Synthetic Construct
agttctctccagtctcttccagtt

SEQ ID NO: 21304 - DNA, 22 bp, Artificial Sequence
  Synthetic Construct
gccctgagtccattccaagtct

SEQ ID NO: 21305 - DNA, 24 bp, Artificial Sequence
  Synthetic Construct
cgcaaactggtatccctggtcaac

SEQ ID NO: 21306 - DNA, 29 bp, Artificial Sequence
  Synthetic Construct
gaccaatggaagcaactacagaaactttg

SEQ ID NO: 21307 - DNA, 19 bp, Artificial Sequence
  Synthetic Construct
agcgctcttggcctttgtt

SEQ ID NO: 21308 - DNA, 24 bp, Artificial Sequence
  Synthetic Construct
cctccaacattcctcctctacaac

SEQ ID NO: 21309 - DNA, 23 bp, Artificial Sequence
  Synthetic Construct
agggaagtccctggctcctaaag

SEQ ID NO: 21310 - DNA, 25 bp, Artificial Sequence
  Synthetic Construct
caaatggcccagctatatctgattg

SEQ ID NO: 21311 - DNA, 22 bp, Artificial Sequence
  Synthetic Construct
cacccaaggagggctgtaatga

SEQ ID NO: 21312 - DNA, 29 bp, Artificial Sequence
  Synthetic Construct
ccaaagagatctaggacacagacataact

SEQ ID NO: 21313 - DNA, 21 bp, Artificial Sequence
  Synthetic Construct
tccaggtgccattccccattg

SEQ ID NO: 21314 - DNA, 27 bp, Artificial Sequence
  Synthetic Construct
ccaattctcttgttccattagcgagaa

SEQ ID NO: 21315 - DNA, 21 bp, Artificial Sequence
  Synthetic Construct
gtggctcttcccattggcttt

SEQ ID NO: 21316 - DNA, 24 bp, Artificial Sequence
  Synthetic Construct
gcacctgaccatacttgctacact

SEQ ID NO: 21317 - DNA, 26 bp, Artificial Sequence
  Synthetic Construct
acccagatctctgcttctaaaacttg

SEQ ID NO: 21318 - DNA, 29 bp, Artificial Sequence
  Synthetic Construct
cagagctctatactgagctttccctctat

SEQ ID NO: 21319 - DNA, 22 bp, Artificial Sequence
  Synthetic Construct
ccatgcctgctattgccactat

SEQ ID NO: 21320 - DNA, 23 bp, Artificial Sequence
  Synthetic Construct
acatgcaggagcttagagactga

SEQ ID NO: 21321 - DNA, 25 bp, Artificial Sequence
  Synthetic Construct
actggacccttagttccatccatag

SEQ ID NO: 21322 - DNA, 26 bp, Artificial Sequence
  Synthetic Construct
gcatggcagaaaaactacctttgtca

SEQ ID NO: 21323 - DNA, 25 bp, Artificial Sequence
  Synthetic Construct
gcatgtacacagtgcatacctctga

SEQ ID NO: 21324 - DNA, 25 bp, Artificial Sequence
  Synthetic Construct
gtgactcacaccaatgacagttaca

SEQ ID NO: 21325 - DNA, 24 bp, Artificial Sequence
  Synthetic Construct
ccgacgttgtcatctcacattatc

SEQ ID NO: 21326 - DNA, 25 bp, Artificial Sequence
  Synthetic Construct
gctctctgcaaatgggaggatggta

SEQ ID NO: 21327 - DNA, 21 bp, Artificial Sequence
  Synthetic Construct
ctcttggtttccaggcagaca

SEQ ID NO: 21328 - DNA, 20 bp, Artificial Sequence
  Synthetic Construct
ggtggtttgtgtgggtctga

SEQ ID NO: 21329 - DNA, 22 bp, Artificial Sequence
  Synthetic Construct
cctttgtgaatgcctgatgcaa

SEQ ID NO: 21330 - DNA, 23 bp, Artificial Sequence
  Synthetic Construct
ggcaaactccacttcagcaggat

SEQ ID NO: 21331 - DNA, 23 bp, Artificial Sequence
  Synthetic Construct
tccactctggattcctgaacaac

SEQ ID NO: 21332 - DNA, 22 bp, Artificial Sequence
  Synthetic Construct
agggaaccagcaaaaccaatga

SEQ ID NO: 21333 - DNA, 20 bp, Artificial Sequence
  Synthetic Construct
gcggcagtgtttcctctgtt

SEQ ID NO: 21334 - DNA, 27 bp, Artificial Sequence
  Synthetic Construct
gtctaaggaagtctgtaggctgaatac

SEQ ID NO: 21335 - DNA, 23 bp, Artificial Sequence
  Synthetic Construct
agcacttcccctttgatccattc

SEQ ID NO: 21336 - DNA, 22 bp, Artificial Sequence
  Synthetic Construct
ggggacataggcaacaggacaa

SEQ ID NO: 21337 - DNA, 22 bp, Artificial Sequence
  Synthetic Construct
gagcttctcactgtcccctgta

SEQ ID NO: 21338 - DNA, 23 bp, Artificial Sequence
  Synthetic Construct
tgtccaaggaatgggaagggtaa

SEQ ID NO: 21339 - DNA, 22 bp, Artificial Sequence
  Synthetic Construct
cgccccaacagaagaggaagtt

SEQ ID NO: 21340 - DNA, 22 bp, Artificial Sequence
  Synthetic Construct
acgcaatgccttttcagagcta

SEQ ID NO: 21341 - DNA, 23 bp, Artificial Sequence
  Synthetic Construct
ctccattgccctgtcttcagagt

SEQ ID NO: 21342 - DNA, 25 bp, Artificial Sequence
  Synthetic Construct
ggaaaccacaacaatctcactgaag

SEQ ID NO: 21343 - DNA, 22 bp, Artificial Sequence
  Synthetic Construct
caccctccagtttctggtttca

SEQ ID NO: 21344 - DNA, 23 bp, Artificial Sequence
  Synthetic Construct
ggctcactccaaagcccatattc

SEQ ID NO: 21345 - DNA, 26 bp, Artificial Sequence
  Synthetic Construct
gttggcatcagacaactcttacctat

SEQ ID NO: 21346 - DNA, 24 bp, Artificial Sequence
  Synthetic Construct
cgcatattgcaggaaccaggtagt

SEQ ID NO: 21347 - DNA, 26 bp, Artificial Sequence
  Synthetic Construct
cgaggagggaccaaccaagattaaca

SEQ ID NO: 21348 - DNA, 23 bp, Artificial Sequence
  Synthetic Construct
agggcttaccagggtgaggtatc

SEQ ID NO: 21349 - DNA, 23 bp, Artificial Sequence
  Synthetic Construct
ctgtgacacccgttttcctgaga

SEQ ID NO: 21350 - DNA, 26 bp, Artificial Sequence
  Synthetic Construct
gtcttcactagactagccctgcagta

SEQ ID NO: 21351 - DNA, 26 bp, Artificial Sequence
  Synthetic Construct
cacaggtctatttagtgcagggaact

SEQ ID NO: 21352 - DNA, 24 bp, Artificial Sequence
  Synthetic Construct
actgattgcatatggggtttgaca

SEQ ID NO: 21353 - DNA, 21 bp, Artificial Sequence
  Synthetic Construct
agcctgcagtacccctcttgt

SEQ ID NO: 21354 - DNA, 23 bp, Artificial Sequence
  Synthetic Construct
tggggttctttcatgctttgtgt

SEQ ID NO: 21355 - DNA, 25 bp, Artificial Sequence
  Synthetic Construct
ctgagtaggacagtgatcccagagt

SEQ ID NO: 21356 - DNA, 24 bp, Artificial Sequence
  Synthetic Construct
ccaagctgcaaagtaaacttggat

SEQ ID NO: 21357 - DNA, 22 bp, Artificial Sequence
  Synthetic Construct
gcccacctctttatggaacgta

SEQ ID NO: 21358 - DNA, 30 bp, Artificial Sequence
  Synthetic Construct
cagcagagctggtatttaagtattctggtt

SEQ ID NO: 21359 - DNA, 22 bp, Artificial Sequence
  Synthetic Construct
ggtccaagatggaatgggttct

SEQ ID NO: 21360 - DNA, 26 bp, Artificial Sequence
  Synthetic Construct
gagcttaggctgtttctatccagtca

SEQ ID NO: 21361 - DNA, 25 bp, Artificial Sequence
  Synthetic Construct
cctgaaacttgcaaagcctcacaga

SEQ ID NO: 21362 - DNA, 22 bp, Artificial Sequence
  Synthetic Construct
tgcagtgtcaagctttgtcaga

SEQ ID NO: 21363 - DNA, 22 bp, Artificial Sequence
  Synthetic Construct
gccagcactcacaactagactt

SEQ ID NO: 21364 - DNA, 22 bp, Artificial Sequence
  Synthetic Construct
tgtgtgggctttcactctcaag

SEQ ID NO: 21365 - DNA, 26 bp, Artificial Sequence
  Synthetic Construct
tgcatggatcttcatagtcctactct

SEQ ID NO: 21366 - DNA, 26 bp, Artificial Sequence
  Synthetic Construct
gagttcttctcttcctccacctaaaa

SEQ ID NO: 21367 - DNA, 23 bp, Artificial Sequence
  Synthetic Construct
cgtgagcattagtagcagtgaca

SEQ ID NO: 21368 - DNA, 26 bp, Artificial Sequence
  Synthetic Construct
gactgtcagcaagcaaacaatacaag

SEQ ID NO: 21369 - DNA, 25 bp, Artificial Sequence
  Synthetic Construct
ctgagatccaaggagctgtacaaag

SEQ ID NO: 21370 - DNA, 24 bp, Artificial Sequence
  Synthetic Construct
ggaggtttggaactggtagagaga

SEQ ID NO: 21371 - DNA, 22 bp, Artificial Sequence
  Synthetic Construct
ggctgttaggttgggagaggat

SEQ ID NO: 21372 - DNA, 23 bp, Artificial Sequence
  Synthetic Construct
ctgccttccatagttgccaccaa

SEQ ID NO: 21373 - DNA, 27 bp, Artificial Sequence
  Synthetic Construct
ctctggaaaaggctgagaaaactccta

SEQ ID NO: 21374 - DNA, 22 bp, Artificial Sequence
  Synthetic Construct
gttgagggctagagggctaaga

SEQ ID NO: 21375 - DNA, 22 bp, Artificial Sequence
  Synthetic Construct
aaggctggagctaggagtcaca

SEQ ID NO: 21376 - DNA, 23 bp, Artificial Sequence
  Synthetic Construct
gccatgacagttgagtcacacat

SEQ ID NO: 21377 - DNA, 22 bp, Artificial Sequence
  Synthetic Construct
actgcattcccaccataccaaa

SEQ ID NO: 21378 - DNA, 25 bp, Artificial Sequence
  Synthetic Construct
tgaaacctcagtagggatcttccat

SEQ ID NO: 21379 - DNA, 22 bp, Artificial Sequence
  Synthetic Construct
ggttgtgaagccgcacttggtt

SEQ ID NO: 21380 - DNA, 25 bp, Artificial Sequence
  Synthetic Construct
gcaagaggattgggcatactggtaa

SEQ ID NO: 21381 - DNA, 21 bp, Artificial Sequence
  Synthetic Construct
gcgcagccagaaatgatgaac

SEQ ID NO: 21382 - DNA, 27 bp, Artificial Sequence
  Synthetic Construct
ccgtctgcttacatctccatttaggtt

SEQ ID NO: 21383 - DNA, 26 bp, Artificial Sequence
  Synthetic Construct
cactcttcactatctgaggccatgaa

SEQ ID NO: 21384 - DNA, 20 bp, Artificial Sequence
  Synthetic Construct
tcccttcagcagagcagtca

SEQ ID NO: 21385 - DNA, 22 bp, Artificial Sequence
  Synthetic Construct
gacagagatggtgcatggatgt

SEQ ID NO: 21386 - DNA, 22 bp, Artificial Sequence
  Synthetic Construct
gtgcctgcctgttaatgagtgt

SEQ ID NO: 21387 - DNA, 24 bp, Artificial Sequence
  Synthetic Construct
ccctcttggtgaatgtcctctagt

SEQ ID NO: 21388 - DNA, 24 bp, Artificial Sequence
  Synthetic Construct
gtggtaagtttggaaggaggctta

SEQ ID NO: 21389 - DNA, 20 bp, Artificial Sequence
  Synthetic Construct
gcgcaggaatgtgtgcatga

SEQ ID NO: 21390 - DNA, 22 bp, Artificial Sequence
  Synthetic Construct
cacctcctttgctgctaccata

SEQ ID NO: 21391 - DNA, 23 bp, Artificial Sequence
  Synthetic Construct
ggggcccagatacactcttcttc

SEQ ID NO: 21392 - DNA, 25 bp, Artificial Sequence
  Synthetic Construct
cctgtctttggaaatccgaccacta

SEQ ID NO: 21393 - DNA, 22 bp, Artificial Sequence
  Synthetic Construct
gctttcccgaacaaggttcact

SEQ ID NO: 21394 - DNA, 22 bp, Artificial Sequence
  Synthetic Construct
ggggagaggatgaagtgggttt

SEQ ID NO: 21395 - DNA, 23 bp, Artificial Sequence
  Synthetic Construct
gggcctgggtatcctaacctcat

SEQ ID NO: 21396 - DNA, 23 bp, Artificial Sequence
  Synthetic Construct
tcagcgcattaccagtcctttag

SEQ ID NO: 21397 - DNA, 25 bp, Artificial Sequence
  Synthetic Construct
ggggattgttaggacttatcacact

SEQ ID NO: 21398 - DNA, 22 bp, Artificial Sequence
  Synthetic Construct
tggggctgaagggttgactgta

SEQ ID NO: 21399 - DNA, 23 bp, Artificial Sequence
  Synthetic Construct
cctttgccattcctggacactct

SEQ ID NO: 21400 - DNA, 26 bp, Artificial Sequence
  Synthetic Construct
ggaacacctaccctttatgtgtaact

SEQ ID NO: 21401 - DNA, 27 bp, Artificial Sequence
  Synthetic Construct
gcctgagcaaagtaagtttagggttct

SEQ ID NO: 21402 - DNA, 25 bp, Artificial Sequence
  Synthetic Construct
tcctagggctgagttttgagatttg

SEQ ID NO: 21403 - DNA, 23 bp, Artificial Sequence
  Synthetic Construct
ggatggagggtccttcattttct

SEQ ID NO: 21404 - DNA, 27 bp, Artificial Sequence
  Synthetic Construct
gcctggaaaccaaatgattgtcaaaga

SEQ ID NO: 21405 - DNA, 25 bp, Artificial Sequence
  Synthetic Construct
gtgggactcaaagatcttccagaat

SEQ ID NO: 21406 - DNA, 25 bp, Artificial Sequence
  Synthetic Construct
gcccagggttcaagtttagtgtttg

SEQ ID NO: 21407 - DNA, 24 bp, Artificial Sequence
  Synthetic Construct
ccaccctccaaaacaagtcactct

SEQ ID NO: 21408 - DNA, 23 bp, Artificial Sequence
  Synthetic Construct
gccagagcatgtacctagcaaac

SEQ ID NO: 21409 - DNA, 22 bp, Artificial Sequence
  Synthetic Construct
gcacccttggaatagggattga

SEQ ID NO: 21410 - DNA, 24 bp, Artificial Sequence
  Synthetic Construct
gacattggctgtcaaagttccatt

SEQ ID NO: 21411 - DNA, 22 bp, Artificial Sequence
  Synthetic Construct
agccataccttagggccagaac

SEQ ID NO: 21412 - DNA, 23 bp, Artificial Sequence
  Synthetic Construct
caccctgcagttgacatgggaaa

SEQ ID NO: 21413 - DNA, 29 bp, Artificial Sequence
  Synthetic Construct
ggaaactcaggtttaagcccataaggaaa

SEQ ID NO: 21414 - DNA, 24 bp, Artificial Sequence
  Synthetic Construct
ggcttgagttggcctttctcagat

SEQ ID NO: 21415 - DNA, 27 bp, Artificial Sequence
  Synthetic Construct
gcttaattgccagattccgtattcaag

SEQ ID NO: 21416 - DNA, 24 bp, Artificial Sequence
  Synthetic Construct
ggctgggatatcaaaggagctaga

SEQ ID NO: 21417 - DNA, 22 bp, Artificial Sequence
  Synthetic Construct
cagttggtcaccacgtgtgttt

SEQ ID NO: 21418 - DNA, 25 bp, Artificial Sequence
  Synthetic Construct
tgccaaggtagatctcgttcatttc

SEQ ID NO: 21419 - DNA, 19 bp, Artificial Sequence
  Synthetic Construct
aggccaggggctgtgtcat

SEQ ID NO: 21420 - DNA, 25 bp, Artificial Sequence
  Synthetic Construct
gcacacttgcctgaaatgagacaca

SEQ ID NO: 21421 - DNA, 22 bp, Artificial Sequence
  Synthetic Construct
gggctagaacaacaagccaagt

SEQ ID NO: 21422 - DNA, 22 bp, Artificial Sequence
  Synthetic Construct
gtgacgtgtgtcaccactggaa

SEQ ID NO: 21423 - DNA, 23 bp, Artificial Sequence
  Synthetic Construct
gtcccaaccaaatactgcacaga

SEQ ID NO: 21424 - DNA, 22 bp, Artificial Sequence
  Synthetic Construct
ggcaggactggttgagaacatc

SEQ ID NO: 21425 - DNA, 23 bp, Artificial Sequence
  Synthetic Construct
agagcctgagcaacgtgtataag

SEQ ID NO: 21426 - DNA, 26 bp, Artificial Sequence
  Synthetic Construct
tgatgggccctagttttctacttttg

SEQ ID NO: 21427 - DNA, 23 bp, Artificial Sequence
  Synthetic Construct
aggctaaggttaaggcactgaag

SEQ ID NO: 21428 - DNA, 21 bp, Artificial Sequence
  Synthetic Construct
cctgcttccctgccacttttg

SEQ ID NO: 21429 - DNA, 23 bp, Artificial Sequence
  Synthetic Construct
cgtgcggtgacttctttctgtga

SEQ ID NO: 21430 - DNA, 23 bp, Artificial Sequence
  Synthetic Construct
tgctgaaaggctgccatatttgt

SEQ ID NO: 21431 - DNA, 25 bp, Artificial Sequence
  Synthetic Construct
ccctctcaatgtccatttgtgtaga

SEQ ID NO: 21432 - DNA, 22 bp, Artificial Sequence
  Synthetic Construct
gcaaagagagcccctcgaactt

SEQ ID NO: 21433 - DNA, 27 bp, Artificial Sequence
  Synthetic Construct
ggaaggaacaacctcattatggtttca

SEQ ID NO: 21434 - DNA, 23 bp, Artificial Sequence
  Synthetic Construct
ccccacaatgagtctctgcaact

SEQ ID NO: 21435 - DNA, 24 bp, Artificial Sequence
  Synthetic Construct
caacaggacttgatcaccaagcaa

SEQ ID NO: 21436 - DNA, 20 bp, Artificial Sequence
  Synthetic Construct
tccacagtgacacggagcta

SEQ ID NO: 21437 - DNA, 24 bp, Artificial Sequence
  Synthetic Construct
cacagaatctctctgcctgcatca

SEQ ID NO: 21438 - DNA, 26 bp, Artificial Sequence
  Synthetic Construct
gctggttgataaattgccacgacttc

SEQ ID NO: 21439 - DNA, 23 bp, Artificial Sequence
  Synthetic Construct
gctttggggctactcccttccta

SEQ ID NO: 21440 - DNA, 24 bp, Artificial Sequence
  Synthetic Construct
gccagggataaagctggcttcaga

SEQ ID NO: 21441 - DNA, 25 bp, Artificial Sequence
  Synthetic Construct
ctcctcagtgcaattagaggacttc

SEQ ID NO: 21442 - DNA, 23 bp, Artificial Sequence
  Synthetic Construct
gctgcaacaagggatcagactca

SEQ ID NO: 21443 - DNA, 26 bp, Artificial Sequence
  Synthetic Construct
gcttctgaatgtctctggaatgacaa

SEQ ID NO: 21444 - DNA, 22 bp, Artificial Sequence
  Synthetic Construct
tgccaggtagtgggtgagtcaa

SEQ ID NO: 21445 - DNA, 25 bp, Artificial Sequence
  Synthetic Construct
ctcgtagccgcaagtagaaatgaag

SEQ ID NO: 21446 - DNA, 22 bp, Artificial Sequence
  Synthetic Construct
agatggaggctcctccttgaca

SEQ ID NO: 21447 - DNA, 26 bp, Artificial Sequence
  Synthetic Construct
gattgcccaaggaacatatagaggaa

SEQ ID NO: 21448 - DNA, 22 bp, Artificial Sequence
  Synthetic Construct
cagacatgtgtggagcgactgt

SEQ ID NO: 21449 - DNA, 24 bp, Artificial Sequence
  Synthetic Construct
ccctggaaacagtacctacccaat

SEQ ID NO: 21450 - DNA, 20 bp, Artificial Sequence
  Synthetic Construct
ggccaaatgcctgcaaaaga

SEQ ID NO: 21451 - DNA, 24 bp, Artificial Sequence
  Synthetic Construct
agccaagagctggtttttagaaga

SEQ ID NO: 21452 - DNA, 24 bp, Artificial Sequence
  Synthetic Construct
tgtcttcaaacactcagcaccttt

SEQ ID NO: 21453 - DNA, 21 bp, Artificial Sequence
  Synthetic Construct
cctttgtgtccctccccttct

SEQ ID NO: 21454 - DNA, 30 bp, Artificial Sequence
  Synthetic Construct
ggtggatcttttgttagggctacatttcta

SEQ ID NO: 21455 - DNA, 25 bp, Artificial Sequence
  Synthetic Construct
ccagatctgacttcatggagtgttg

SEQ ID NO: 21456 - DNA, 25 bp, Artificial Sequence
  Synthetic Construct
gtcctgctacatctaaccttccttt

SEQ ID NO: 21457 - DNA, 23 bp, Artificial Sequence
  Synthetic Construct
gctcagagagtccatgaccactt

SEQ ID NO: 21458 - DNA, 23 bp, Artificial Sequence
  Synthetic Construct
gctctgcttccatctcagtcaca

SEQ ID NO: 21459 - DNA, 25 bp, Artificial Sequence
  Synthetic Construct
gtggtgtaaaggttagaagcacaaa

SEQ ID NO: 21460 - DNA, 22 bp, Artificial Sequence
  Synthetic Construct
cagtgcccagaaattgccaaca

SEQ ID NO: 21461 - DNA, 22 bp, Artificial Sequence
  Synthetic Construct
cgctctaggagtttgcagtaca

SEQ ID NO: 21462 - DNA, 21 bp, Artificial Sequence
  Synthetic Construct
agagcaaggcccactcagaga

SEQ ID NO: 21463 - DNA, 24 bp, Artificial Sequence
  Synthetic Construct
ggtggagagtgaatctggcaaatg

SEQ ID NO: 21464 - DNA, 24 bp, Artificial Sequence
  Synthetic Construct
gccccaataaagtggtgcttgact

SEQ ID NO: 21465 - DNA, 22 bp, Artificial Sequence
  Synthetic Construct
cagtgttggcagccaggataca

SEQ ID NO: 21466 - DNA, 20 bp, Artificial Sequence
  Synthetic Construct
actcccaaccccagcagtct

SEQ ID NO: 21467 - DNA, 23 bp, Artificial Sequence
  Synthetic Construct
ctctggggactctttccatcaga

SEQ ID NO: 21468 - DNA, 22 bp, Artificial Sequence
  Synthetic Construct
gcctggaactgcatggcttaga

SEQ ID NO: 21469 - DNA, 23 bp, Artificial Sequence
  Synthetic Construct
cccaactgtcacctccttctatg

SEQ ID NO: 21470 - DNA, 23 bp, Artificial Sequence
  Synthetic Construct
cggggtgggaagaagtaggacat

SEQ ID NO: 21471 - DNA, 23 bp, Artificial Sequence
  Synthetic Construct
gaaagcaagtccattgctccaaa

SEQ ID NO: 21472 - DNA, 25 bp, Artificial Sequence
  Synthetic Construct
gcacaggatgaggctattctctgaa

SEQ ID NO: 21473 - DNA, 30 bp, Artificial Sequence
  Synthetic Construct
gctgcttggaatagtttgttctcatcttag

SEQ ID NO: 21474 - DNA, 24 bp, Artificial Sequence
  Synthetic Construct
cagggtgtagccatctgatttaca

SEQ ID NO: 21475 - DNA, 22 bp, Artificial Sequence
  Synthetic Construct
caaggtgggccaaggaaactga

SEQ ID NO: 21476 - DNA, 24 bp, Artificial Sequence
  Synthetic Construct
acccactccaattttgaagcaaac

SEQ ID NO: 21477 - DNA, 23 bp, Artificial Sequence
  Synthetic Construct
caggcttggaaagggagtgatag

SEQ ID NO: 21478 - DNA, 23 bp, Artificial Sequence
  Synthetic Construct
gacagccaaaagccaggtgttag

SEQ ID NO: 21479 - DNA, 26 bp, Artificial Sequence
  Synthetic Construct
ggttgttggctgttagagcgtatttc

SEQ ID NO: 21480 - DNA, 20 bp, Artificial Sequence
  Synthetic Construct
tgggtggtagggcacattca

SEQ ID NO: 21481 - DNA, 26 bp, Artificial Sequence
  Synthetic Construct
gggtgttatagccagaccagaaaaca

SEQ ID NO: 21482 - DNA, 24 bp, Artificial Sequence
  Synthetic Construct
ccaggtagctaagcagtgaagaca

SEQ ID NO: 21483 - DNA, 26 bp, Artificial Sequence
  Synthetic Construct
ggcaaggcaatttggattatgcttca

SEQ ID NO: 21484 - DNA, 23 bp, Artificial Sequence
  Synthetic Construct
ggaatgtctgctttcactgcttt

SEQ ID NO: 21485 - DNA, 22 bp, Artificial Sequence
  Synthetic Construct
cctgtacagcatctgtcgctat

SEQ ID NO: 21486 - DNA, 22 bp, Artificial Sequence
  Synthetic Construct
gaacaggccagattcgcctaag

SEQ ID NO: 21487 - DNA, 25 bp, Artificial Sequence
  Synthetic Construct
gtttcttttcacctccaacatggaa

SEQ ID NO: 21488 - DNA, 24 bp, Artificial Sequence
  Synthetic Construct
ccctacttgggtaccttgttgcta

SEQ ID NO: 21489 - DNA, 24 bp, Artificial Sequence
  Synthetic Construct
aggttgagtccatgagtacagaca

SEQ ID NO: 21490 - DNA, 24 bp, Artificial Sequence
  Synthetic Construct
ccgaacttcagggaatagccaaga

SEQ ID NO: 21491 - DNA, 23 bp, Artificial Sequence
  Synthetic Construct
gctcaaaccccacctacttgtct

SEQ ID NO: 21492 - DNA, 24 bp, Artificial Sequence
  Synthetic Construct
cctccccaagaagtagtcttcgat

SEQ ID NO: 21493 - DNA, 24 bp, Artificial Sequence
  Synthetic Construct
gcaatctcctcaccctctggagaa

SEQ ID NO: 21494 - DNA, 24 bp, Artificial Sequence
  Synthetic Construct
agcaacaagcttggtatgttcaag

SEQ ID NO: 21495 - DNA, 25 bp, Artificial Sequence
  Synthetic Construct
ccccagtgtttgagtgagtactttg

SEQ ID NO: 21496 - DNA, 23 bp, Artificial Sequence
  Synthetic Construct
cccactgggagaaaagggagtga

SEQ ID NO: 21497 - DNA, 24 bp, Artificial Sequence
  Synthetic Construct
ggctgaatagacaaccagccttga

SEQ ID NO: 21498 - DNA, 23 bp, Artificial Sequence
  Synthetic Construct
ctctgtcaccaactctgtgtcat

SEQ ID NO: 21499 - DNA, 24 bp, Artificial Sequence
  Synthetic Construct
ctcttcatggaatgggtgatcctt

SEQ ID NO: 21500 - DNA, 23 bp, Artificial Sequence
  Synthetic Construct
ccttctcactccctagctttgtt

SEQ ID NO: 21501 - DNA, 23 bp, Artificial Sequence
  Synthetic Construct
ggctgtgctgaagttttgtctct

SEQ ID NO: 21502 - DNA, 25 bp, Artificial Sequence
  Synthetic Construct
cgtaacctctacatggccaatgact

SEQ ID NO: 21503 - DNA, 24 bp, Artificial Sequence
  Synthetic Construct
gtcctctccttgctgtctccaaag

SEQ ID NO: 21504 - DNA, 25 bp, Artificial Sequence
  Synthetic Construct
gtctgcttggatgtagagaggtcaa

SEQ ID NO: 21505 - DNA, 22 bp, Artificial Sequence
  Synthetic Construct
cagggctaccaaggtttccatt

SEQ ID NO: 21506 - DNA, 25 bp, Artificial Sequence
  Synthetic Construct
ggagacgattcccaatgtcaatgtt

SEQ ID NO: 21507 - DNA, 27 bp, Artificial Sequence
  Synthetic Construct
cagttactttacccagacattgtcatc

SEQ ID NO: 21508 - DNA, 27 bp, Artificial Sequence
  Synthetic Construct
ccttgggtgggaatttttgaagagaaa

SEQ ID NO: 21509 - DNA, 20 bp, Artificial Sequence
  Synthetic Construct
aggcccagtgatgcacagat

SEQ ID NO: 21510 - DNA, 23 bp, Artificial Sequence
  Synthetic Construct
ggcggataagcccagatagtttc

SEQ ID NO: 21511 - DNA, 24 bp, Artificial Sequence
  Synthetic Construct
gggcagaaaccatatctttgcatt

SEQ ID NO: 21512 - DNA, 25 bp, Artificial Sequence
  Synthetic Construct
gcaccttggatgattcttgagaaaa

SEQ ID NO: 21513 - DNA, 24 bp, Artificial Sequence
  Synthetic Construct
cctccgacctacaaaactactgaa

SEQ ID NO: 21514 - DNA, 24 bp, Artificial Sequence
  Synthetic Construct
gcaaggatgggttcagttgcattt

SEQ ID NO: 21515 - DNA, 25 bp, Artificial Sequence
  Synthetic Construct
ccactcatagcattgagggccaaag

SEQ ID NO: 21516 - DNA, 21 bp, Artificial Sequence
  Synthetic Construct
ccagcagaagtggggatgtga

SEQ ID NO: 21517 - DNA, 22 bp, Artificial Sequence
  Synthetic Construct
acaattgtgatgccgtgggaat

SEQ ID NO: 21518 - DNA, 25 bp, Artificial Sequence
  Synthetic Construct
cagggcttgatctttggtagagtga

SEQ ID NO: 21519 - DNA, 29 bp, Artificial Sequence
  Synthetic Construct
ggggcttttgtaaggctggaagtatttag

SEQ ID NO: 21520 - DNA, 24 bp, Artificial Sequence
  Synthetic Construct
ggagacctgtcaatcccacagaag

SEQ ID NO: 21521 - DNA, 24 bp, Artificial Sequence
  Synthetic Construct
ccaggtgggtcagaaaacatcaca

SEQ ID NO: 21522 - DNA, 26 bp, Artificial Sequence
  Synthetic Construct
ggcgctcactcaggaaaattaaccat

SEQ ID NO: 21523 - DNA, 25 bp, Artificial Sequence
  Synthetic Construct
cgtgttctgaggacctacagttatt

SEQ ID NO: 21524 - DNA, 21 bp, Artificial Sequence
  Synthetic Construct
tgacagtgcacacagtgactt

SEQ ID NO: 21525 - DNA, 19 bp, Artificial Sequence
  Synthetic Construct
accagatgggctccacaca

SEQ ID NO: 21526 - DNA, 23 bp, Artificial Sequence
  Synthetic Construct
cccaacctcagcatagcttttga

SEQ ID NO: 21527 - DNA, 24 bp, Artificial Sequence
  Synthetic Construct
gggctttgctcagtcttcctgttc

SEQ ID NO: 21528 - DNA, 26 bp, Artificial Sequence
  Synthetic Construct
gcagatccagtaaagacaacctgtca

SEQ ID NO: 21529 - DNA, 23 bp, Artificial Sequence
  Synthetic Construct
gcaccagttccccttttctcctt

SEQ ID NO: 21530 - DNA, 23 bp, Artificial Sequence
  Synthetic Construct
ctggtttcccacatgctgtgtct

SEQ ID NO: 21531 - DNA, 23 bp, Artificial Sequence
  Synthetic Construct
ccagattcagtcctcacccttgt

SEQ ID NO: 21532 - DNA, 27 bp, Artificial Sequence
  Synthetic Construct
ctgatagcttgtgacctaagcctagta

SEQ ID NO: 21533 - DNA, 20 bp, Artificial Sequence
  Synthetic Construct
gctctcctccctcccagtct

SEQ ID NO: 21534 - DNA, 24 bp, Artificial Sequence
  Synthetic Construct
gaggaagacagcttggaagtttga

SEQ ID NO: 21535 - DNA, 25 bp, Artificial Sequence
  Synthetic Construct
cactaaccctaaaccacctcctgaa

SEQ ID NO: 21536 - DNA, 23 bp, Artificial Sequence
  Synthetic Construct
ctccccaaagggtacagtaggaa

SEQ ID NO: 21537 - DNA, 22 bp, Artificial Sequence
  Synthetic Construct
gttcttcgtcttccctgaccat

SEQ ID NO: 21538 - DNA, 25 bp, Artificial Sequence
  Synthetic Construct
gtccagtgagtggtatctgttggaa

SEQ ID NO: 21539 - DNA, 27 bp, Artificial Sequence
  Synthetic Construct
gacctgaacaagaatgtgatgcctaag

SEQ ID NO: 21540 - DNA, 24 bp, Artificial Sequence
  Synthetic Construct
tgccaggagaagatccaagttttg

SEQ ID NO: 21541 - DNA, 23 bp, Artificial Sequence
  Synthetic Construct
aacagagggtatgggatgtgttg

SEQ ID NO: 21542 - DNA, 24 bp, Artificial Sequence
  Synthetic Construct
gacccaaatctctctttcctctgt

SEQ ID NO: 21543 - DNA, 22 bp, Artificial Sequence
  Synthetic Construct
tggggaggtgttgatggagttg

SEQ ID NO: 21544 - DNA, 20 bp, Artificial Sequence
  Synthetic Construct
actcgctaaccccacgactt

SEQ ID NO: 21545 - DNA, 29 bp, Artificial Sequence
  Synthetic Construct
cctgggatttgaaggatttctagggaact

SEQ ID NO: 21546 - DNA, 20 bp, Artificial Sequence
  Synthetic Construct
ggagtagctgtgccaacctt

SEQ ID NO: 21547 - DNA, 25 bp, Artificial Sequence
  Synthetic Construct
cagagcaaggcagtcatacaagtga

SEQ ID NO: 21548 - DNA, 23 bp, Artificial Sequence
  Synthetic Construct
acaccccttcactttccttctct

SEQ ID NO: 21549 - DNA, 23 bp, Artificial Sequence
  Synthetic Construct
ggcaaacgtaaggaaggatgact

SEQ ID NO: 21550 - DNA, 22 bp, Artificial Sequence
  Synthetic Construct
gtgtagcagaagtgaggcaagt

SEQ ID NO: 21551 - DNA, 21 bp, Artificial Sequence
  Synthetic Construct
ccagctaattggtggcaggtt

SEQ ID NO: 21552 - DNA, 24 bp, Artificial Sequence
  Synthetic Construct
gtggcaaagcagttttgttggttt

SEQ ID NO: 21553 - DNA, 25 bp, Artificial Sequence
  Synthetic Construct
ggtgagctatgtgaaaatgccctat

SEQ ID NO: 21554 - DNA, 25 bp, Artificial Sequence
  Synthetic Construct
cctttgacaactgatgtaagccaat

SEQ ID NO: 21555 - DNA, 24 bp, Artificial Sequence
  Synthetic Construct
tcaccatcaccaataacagcagta

SEQ ID NO: 21556 - DNA, 23 bp, Artificial Sequence
  Synthetic Construct
cactcctgcatctcttcccatag

SEQ ID NO: 21557 - DNA, 21 bp, Artificial Sequence
  Synthetic Construct
ttctctgccccaggaggttga

SEQ ID NO: 21558 - DNA, 22 bp, Artificial Sequence
  Synthetic Construct
tctggtgctttaggggatccat

SEQ ID NO: 21559 - DNA, 23 bp, Artificial Sequence
  Synthetic Construct
gcgtgcttcacttaactgggata

SEQ ID NO: 21560 - DNA, 24 bp, Artificial Sequence
  Synthetic Construct
cagtagtgcgtcatagctcactgt

SEQ ID NO: 21561 - DNA, 30 bp, Artificial Sequence
  Synthetic Construct
ggtaactgtttagtccacacttagggaatc

SEQ ID NO: 21562 - DNA, 25 bp, Artificial Sequence
  Synthetic Construct
gcagaggtgtgtttcaacctaatgt

SEQ ID NO: 21563 - DNA, 27 bp, Artificial Sequence
  Synthetic Construct
ccctagcctgatgacaaatgtttctac

SEQ ID NO: 21564 - DNA, 25 bp, Artificial Sequence
  Synthetic Construct
attgctcccattctacaacagaaga

SEQ ID NO: 21565 - DNA, 21 bp, Artificial Sequence
  Synthetic Construct
gcacaacccctctccctgttc

SEQ ID NO: 21566 - DNA, 24 bp, Artificial Sequence
  Synthetic Construct
ggtggtggtaaatgacgtggatgt

SEQ ID NO: 21567 - DNA, 23 bp, Artificial Sequence
  Synthetic Construct
ccttacagctgagtcctggtcta

SEQ ID NO: 21568 - DNA, 26 bp, Artificial Sequence
  Synthetic Construct
gatgacttccaaaaggggaaagaaac

SEQ ID NO: 21569 - DNA, 22 bp, Artificial Sequence
  Synthetic Construct
ggtgacatctgcttgccaggaa

SEQ ID NO: 21570 - DNA, 24 bp, Artificial Sequence
  Synthetic Construct
ccctgacagagtcctctctacctt

SEQ ID NO: 21571 - DNA, 23 bp, Artificial Sequence
  Synthetic Construct
gacccagatggatgagtctgaag

SEQ ID NO: 21572 - DNA, 26 bp, Artificial Sequence
  Synthetic Construct
ggaacttacatgttcctggtgtggtt

SEQ ID NO: 21573 - DNA, 23 bp, Artificial Sequence
  Synthetic Construct
caggcgtttgttcaggctcaaag

SEQ ID NO: 21574 - DNA, 25 bp, Artificial Sequence
  Synthetic Construct
ctgcttaagctgatccaggtcaaaa

SEQ ID NO: 21575 - DNA, 25 bp, Artificial Sequence
  Synthetic Construct
catggtccagaagttggaaaagcta

SEQ ID NO: 21576 - DNA, 23 bp, Artificial Sequence
  Synthetic Construct
catccaagtcattggcaggaatc

SEQ ID NO: 21577 - DNA, 20 bp, Artificial Sequence
  Synthetic Construct
gctggtgttggcagtgtttg

SEQ ID NO: 21578 - DNA, 24 bp, Artificial Sequence
  Synthetic Construct
gtcagtgaccagggagtctgtaag

SEQ ID NO: 21579 - DNA, 21 bp, Artificial Sequence
  Synthetic Construct
ggacctttttggctgcagaag

SEQ ID NO: 21580 - DNA, 21 bp, Artificial Sequence
  Synthetic Construct
ccaggagcattgctgttgcat

SEQ ID NO: 21581 - DNA, 27 bp, Artificial Sequence
  Synthetic Construct
ccaatgtctagctgtgtctagctctat

SEQ ID NO: 21582 - DNA, 22 bp, Artificial Sequence
  Synthetic Construct
gggagcccggtttgctctataa

SEQ ID NO: 21583 - DNA, 23 bp, Artificial Sequence
  Synthetic Construct
agatctagaaccaaggccactga

SEQ ID NO: 21584 - DNA, 24 bp, Artificial Sequence
  Synthetic Construct
cagccctattgtaccctggctaag

SEQ ID NO: 21585 - DNA, 26 bp, Artificial Sequence
  Synthetic Construct
acatttggggagatgagacctactaa

SEQ ID NO: 21586 - DNA, 25 bp, Artificial Sequence
  Synthetic Construct
acacaggcatccttaaccaataaca

SEQ ID NO: 21587 - DNA, 23 bp, Artificial Sequence
  Synthetic Construct
tgccttcacatcaagggtgattc

SEQ ID NO: 21588 - DNA, 29 bp, Artificial Sequence
  Synthetic Construct
ggtaaagacaaggactttctccatgatgt

SEQ ID NO: 21589 - DNA, 24 bp, Artificial Sequence
  Synthetic Construct
agaacccatgtctagtagccttca

SEQ ID NO: 21590 - DNA, 22 bp, Artificial Sequence
  Synthetic Construct
ccaactacagggaaggctggaa

SEQ ID NO: 21591 - DNA, 24 bp, Artificial Sequence
  Synthetic Construct
gtcattgcctagatcgtccagtag

SEQ ID NO: 21592 - DNA, 24 bp, Artificial Sequence
  Synthetic Construct
caggtgtacacagcacacccttag

SEQ ID NO: 21593 - DNA, 23 bp, Artificial Sequence
  Synthetic Construct
aaaagcaacagtgagggagatca

SEQ ID NO: 21594 - DNA, 25 bp, Artificial Sequence
  Synthetic Construct
caggtcccatgtgaagtgttaggat

SEQ ID NO: 21595 - DNA, 23 bp, Artificial Sequence
  Synthetic Construct
cgggaggacaatttctggcaatg

SEQ ID NO: 21596 - DNA, 22 bp, Artificial Sequence
  Synthetic Construct
ccagatggctgtgagtgtctgt

SEQ ID NO: 21597 - DNA, 26 bp, Artificial Sequence
  Synthetic Construct
ggtcacgtaacttcctaaaagtccat

SEQ ID NO: 21598 - DNA, 27 bp, Artificial Sequence
  Synthetic Construct
caagaactgagaaaaggccttcaaaga

SEQ ID NO: 21599 - DNA, 24 bp, Artificial Sequence
  Synthetic Construct
ccgcatgctttattctagccactt

SEQ ID NO: 21600 - DNA, 22 bp, Artificial Sequence
  Synthetic Construct
ccacaaagtgctctgggctttc

SEQ ID NO: 21601 - DNA, 22 bp, Artificial Sequence
  Synthetic Construct
gagtgttgaggacggaaagtca

SEQ ID NO: 21602 - DNA, 22 bp, Artificial Sequence
  Synthetic Construct
ccctatgggaggcaacccttct

SEQ ID NO: 21603 - DNA, 21 bp, Artificial Sequence
  Synthetic Construct
tgaggatcgcattgagcaaca

SEQ ID NO: 21604 - DNA, 26 bp, Artificial Sequence
  Synthetic Construct
ccaggctgctaaacattttccagaga

SEQ ID NO: 21605 - DNA, 23 bp, Artificial Sequence
  Synthetic Construct
ggagtcatgccttctgcaatttt

SEQ ID NO: 21606 - DNA, 26 bp, Artificial Sequence
  Synthetic Construct
gaagtgggtagagatggaagaaggaa

SEQ ID NO: 21607 - DNA, 23 bp, Artificial Sequence
  Synthetic Construct
cttgactgatagttcccggcttt

SEQ ID NO: 21608 - DNA, 22 bp, Artificial Sequence
  Synthetic Construct
ggaacactggggacttgtctga

SEQ ID NO: 21609 - DNA, 24 bp, Artificial Sequence
  Synthetic Construct
ggaagtccaggagtggagatgtca

SEQ ID NO: 21610 - DNA, 22 bp, Artificial Sequence
  Synthetic Construct
tcctttgggtaccaggagatga

SEQ ID NO: 21611 - DNA, 21 bp, Artificial Sequence
  Synthetic Construct
ggcttcatctccacccatgaa

SEQ ID NO: 21612 - DNA, 26 bp, Artificial Sequence
  Synthetic Construct
gcctcccaatataactgactgctttc

SEQ ID NO: 21613 - DNA, 25 bp, Artificial Sequence
  Synthetic Construct
gacatgagggagagaggtgttctca

SEQ ID NO: 21614 - DNA, 25 bp, Artificial Sequence
  Synthetic Construct
ggagacactacctgtaggtcaaaag

SEQ ID NO: 21615 - DNA, 23 bp, Artificial Sequence
  Synthetic Construct
gctatcactgggttctccgaact

SEQ ID NO: 21616 - DNA, 29 bp, Artificial Sequence
  Synthetic Construct
ggtcttattaaccctaagaagctgtgaac

SEQ ID NO: 21617 - DNA, 24 bp, Artificial Sequence
  Synthetic Construct
acttctcgcagctttcctaaatca

SEQ ID NO: 21618 - DNA, 22 bp, Artificial Sequence
  Synthetic Construct
gacagccttacagagactgctt

SEQ ID NO: 21619 - DNA, 20 bp, Artificial Sequence
  Synthetic Construct
agtgagtggctcctgcatgt

SEQ ID NO: 21620 - DNA, 25 bp, Artificial Sequence
  Synthetic Construct
gaagctgtagcaaggaggagaaatg

SEQ ID NO: 21621 - DNA, 22 bp, Artificial Sequence
  Synthetic Construct
aggctcaccttgcatccacttg

SEQ ID NO: 21622 - DNA, 23 bp, Artificial Sequence
  Synthetic Construct
actcaccaaagtgtgccctaaac

SEQ ID NO: 21623 - DNA, 24 bp, Artificial Sequence
  Synthetic Construct
agaagacatggagttgggatttgt

SEQ ID NO: 21624 - DNA, 20 bp, Artificial Sequence
  Synthetic Construct
gcgtcactgttggcatcaca

SEQ ID NO: 21625 - DNA, 20 bp, Artificial Sequence
  Synthetic Construct
actgcctggcctgctatttc

SEQ ID NO: 21626 - DNA, 26 bp, Artificial Sequence
  Synthetic Construct
ggattgtgacagcacagtaacagttg

SEQ ID NO: 21627 - DNA, 27 bp, Artificial Sequence
  Synthetic Construct
tcacaatctggagtcacagacattatc

SEQ ID NO: 21628 - DNA, 22 bp, Artificial Sequence
  Synthetic Construct
ggagtcagtggcctgagttcta

SEQ ID NO: 21629 - DNA, 22 bp, Artificial Sequence
  Synthetic Construct
cgccaccagacaaatggtgttg

SEQ ID NO: 21630 - DNA, 25 bp, Artificial Sequence
  Synthetic Construct
cccagtttctgcttcaactcactgt

SEQ ID NO: 21631 - DNA, 27 bp, Artificial Sequence
  Synthetic Construct
ccttgatctgtctgactgagtggattt

SEQ ID NO: 21632 - DNA, 24 bp, Artificial Sequence
  Synthetic Construct
ggggttgagaatgaacttgtcact

SEQ ID NO: 21633 - DNA, 26 bp, Artificial Sequence
  Synthetic Construct
cctgcaattcttgactgaatggtttg

SEQ ID NO: 21634 - DNA, 23 bp, Artificial Sequence
  Synthetic Construct
gagggaagaaggttcaggtcagt

SEQ ID NO: 21635 - DNA, 22 bp, Artificial Sequence
  Synthetic Construct
cccactgtgccccatgttgttt

SEQ ID NO: 21636 - DNA, 23 bp, Artificial Sequence
  Synthetic Construct
ggtggaaggctaccctgacatac

SEQ ID NO: 21637 - DNA, 22 bp, Artificial Sequence
  Synthetic Construct
gcctgatgtgatgggaggttgt

SEQ ID NO: 21638 - DNA, 23 bp, Artificial Sequence
  Synthetic Construct
tgcgggaaattccagtgattaga

SEQ ID NO: 21639 - DNA, 25 bp, Artificial Sequence
  Synthetic Construct
ccctccacacagattggtaagcaaa

SEQ ID NO: 21640 - DNA, 24 bp, Artificial Sequence
  Synthetic Construct
ggtgtgtctgaggatagacgttac

SEQ ID NO: 21641 - DNA, 24 bp, Artificial Sequence
  Synthetic Construct
gtcagcgtctctctccctgataca

SEQ ID NO: 21642 - DNA, 22 bp, Artificial Sequence
  Synthetic Construct
ctctccatgtctggtcccttgt

SEQ ID NO: 21643 - DNA, 23 bp, Artificial Sequence
  Synthetic Construct
ctccaccatgcaacttgtgaaag

SEQ ID NO: 21644 - DNA, 24 bp, Artificial Sequence
  Synthetic Construct
gcctggtccaccctagaaggaata

SEQ ID NO: 21645 - DNA, 21 bp, Artificial Sequence
  Synthetic Construct
caagactgagctggtctgcaa

SEQ ID NO: 21646 - DNA, 25 bp, Artificial Sequence
  Synthetic Construct
gcttcaggggaagttttgtccatac

SEQ ID NO: 21647 - DNA, 23 bp, Artificial Sequence
  Synthetic Construct
ctgggtgctctgagaaaggtgat

SEQ ID NO: 21648 - DNA, 24 bp, Artificial Sequence
  Synthetic Construct
gcccgctgaagatgagatttcaag

SEQ ID NO: 21649 - DNA, 23 bp, Artificial Sequence
  Synthetic Construct
cctgccaaaaagagaagggaact

SEQ ID NO: 21650 - DNA, 24 bp, Artificial Sequence
  Synthetic Construct
gaccttgctaggcactgtgatttg

SEQ ID NO: 21651 - DNA, 27 bp, Artificial Sequence
  Synthetic Construct
caggatgcagtaaatggcaaagactac

SEQ ID NO: 21652 - DNA, 23 bp, Artificial Sequence
  Synthetic Construct
tttacaggctagatgcggaaaca

SEQ ID NO: 21653 - DNA, 23 bp, Artificial Sequence
  Synthetic Construct
tgaggacgagggatgagaagatg

SEQ ID NO: 21654 - DNA, 23 bp, Artificial Sequence
  Synthetic Construct
ggtttgctctgcagtctggtcaa

SEQ ID NO: 21655 - DNA, 21 bp, Artificial Sequence
  Synthetic Construct
tccatgggacttgaggtggaa

SEQ ID NO: 21656 - DNA, 20 bp, Artificial Sequence
  Synthetic Construct
gccaagcagatctccactgt

SEQ ID NO: 21657 - DNA, 22 bp, Artificial Sequence
  Synthetic Construct
catacccacctcaggctactgt

SEQ ID NO: 21658 - DNA, 28 bp, Artificial Sequence
  Synthetic Construct
ggagtctcaatccctgcaatagaacagt

SEQ ID NO: 21659 - DNA, 24 bp, Artificial Sequence
  Synthetic Construct
ctccctccttcattggtgaagaca

SEQ ID NO: 21660 - DNA, 23 bp, Artificial Sequence
  Synthetic Construct
tcaatgcggtaatgggtcctaag

SEQ ID NO: 21661 - DNA, 26 bp, Artificial Sequence
  Synthetic Construct
cagctaacacagtatctcttcactca

SEQ ID NO: 21662 - DNA, 23 bp, Artificial Sequence
  Synthetic Construct
cgacaaagtttgcaggcagtaac

SEQ ID NO: 21663 - DNA, 22 bp, Artificial Sequence
  Synthetic Construct
ccttgtctgtcaccctggttca

SEQ ID NO: 21664 - DNA, 22 bp, Artificial Sequence
  Synthetic Construct
ctgcctgcaagtcaggatgaga

SEQ ID NO: 21665 - DNA, 26 bp, Artificial Sequence
  Synthetic Construct
ctctccttcccctttaaaccttgtga

SEQ ID NO: 21666 - DNA, 22 bp, Artificial Sequence
  Synthetic Construct
ggtcctggcccagttccaattt

SEQ ID NO: 21667 - DNA, 19 bp, Artificial Sequence
  Synthetic Construct
agcaggttggggccaatga

SEQ ID NO: 21668 - DNA, 22 bp, Artificial Sequence
  Synthetic Construct
agctggagtgaggatggagttc

SEQ ID NO: 21669 - DNA, 22 bp, Artificial Sequence
  Synthetic Construct
agtgcgaggaagccaccatcta

SEQ ID NO: 21670 - DNA, 24 bp, Artificial Sequence
  Synthetic Construct
gacctggtattggtgaccctaaga

SEQ ID NO: 21671 - DNA, 24 bp, Artificial Sequence
  Synthetic Construct
ggctgggacatgaaatccttgact

SEQ ID NO: 21672 - DNA, 24 bp, Artificial Sequence
  Synthetic Construct
cgctgttggttaaatttgcagttg

SEQ ID NO: 21673 - DNA, 20 bp, Artificial Sequence
  Synthetic Construct
gcagccacagacaacacaga

SEQ ID NO: 21674 - DNA, 24 bp, Artificial Sequence
  Synthetic Construct
ggtgacatggtgggtagtggatga

SEQ ID NO: 21675 - DNA, 25 bp, Artificial Sequence
  Synthetic Construct
ggttttgagagggtaggtaggtttg

SEQ ID NO: 21676 - DNA, 26 bp, Artificial Sequence
  Synthetic Construct
gcagtgtcttggaaaggaaagggata

SEQ ID NO: 21677 - DNA, 23 bp, Artificial Sequence
  Synthetic Construct
ctggtgttaggctcctggatatg

SEQ ID NO: 21678 - DNA, 20 bp, Artificial Sequence
  Synthetic Construct
tgcctggtgccttcacactt

SEQ ID NO: 21679 - DNA, 26 bp, Artificial Sequence
  Synthetic Construct
cagcctcttagtttttccacccttct

SEQ ID NO: 21680 - DNA, 23 bp, Artificial Sequence
  Synthetic Construct
atgtgtagggactagaggtcgtt

SEQ ID NO: 21681 - DNA, 22 bp, Artificial Sequence
  Synthetic Construct
ctccagagagtgacctctccat

SEQ ID NO: 21682 - DNA, 19 bp, Artificial Sequence
  Synthetic Construct
tcccagctccaggctccaa

SEQ ID NO: 21683 - DNA, 29 bp, Artificial Sequence
  Synthetic Construct
gggatcagtggaaacattgaatgcctttt

SEQ ID NO: 21684 - DNA, 25 bp, Artificial Sequence
  Synthetic Construct
gcagagggtttatcccattccaaac

SEQ ID NO: 21685 - DNA, 27 bp, Artificial Sequence
  Synthetic Construct
gcttgttacacagctgcctattatttc

SEQ ID NO: 21686 - DNA, 26 bp, Artificial Sequence
  Synthetic Construct
gtgcactgaaattcctcagtggttac

SEQ ID NO: 21687 - DNA, 25 bp, Artificial Sequence
  Synthetic Construct
gcaaagctgtcttttgtgaggaaga

SEQ ID NO: 21688 - DNA, 22 bp, Artificial Sequence
  Synthetic Construct
tctacctgcaaaggtccactca

SEQ ID NO: 21689 - DNA, 20 bp, Artificial Sequence
  Synthetic Construct
tggtggatgaaggcgacgtt

SEQ ID NO: 21690 - DNA, 27 bp, Artificial Sequence
  Synthetic Construct
gccatatttgctgtttcacagccttag

SEQ ID NO: 21691 - DNA, 27 bp, Artificial Sequence
  Synthetic Construct
gcacggtttcatcactaagttgagatt

SEQ ID NO: 21692 - DNA, 20 bp, Artificial Sequence
  Synthetic Construct
ggctgcatcaaacccactct

SEQ ID NO: 21693 - DNA, 22 bp, Artificial Sequence
  Synthetic Construct
gccatcacctaggtccaactac

SEQ ID NO: 21694 - DNA, 24 bp, Artificial Sequence
  Synthetic Construct
gtcaagctcaactgtcatctgctt

SEQ ID NO: 21695 - DNA, 26 bp, Artificial Sequence
  Synthetic Construct
gccttcatcgaggtaggataatttgt

SEQ ID NO: 21696 - DNA, 22 bp, Artificial Sequence
  Synthetic Construct
gtgtgctcatccatcccacctt

SEQ ID NO: 21697 - DNA, 25 bp, Artificial Sequence
  Synthetic Construct
cccaaactgcctattctaggacgaa

SEQ ID NO: 21698 - DNA, 22 bp, Artificial Sequence
  Synthetic Construct
acaggctcttgacccctaaagt

SEQ ID NO: 21699 - DNA, 24 bp, Artificial Sequence
  Synthetic Construct
cgtggcagaatttgtttggagaga

SEQ ID NO: 21700 - DNA, 21 bp, Artificial Sequence
  Synthetic Construct
agccctgtgaaagggagattg

SEQ ID NO: 21701 - DNA, 21 bp, Artificial Sequence
  Synthetic Construct
agcctctggaagagccaggaa

SEQ ID NO: 21702 - DNA, 23 bp, Artificial Sequence
  Synthetic Construct
gccataccaccaagggctatttg

SEQ ID NO: 21703 - DNA, 22 bp, Artificial Sequence
  Synthetic Construct
gggcagcgtgttagaccctaaa

SEQ ID NO: 21704 - DNA, 22 bp, Artificial Sequence
  Synthetic Construct
cccagtgacctttcctcaccat

SEQ ID NO: 21705 - DNA, 27 bp, Artificial Sequence
  Synthetic Construct
ctgctgaaattagaggttaggctgaga

SEQ ID NO: 21706 - DNA, 24 bp, Artificial Sequence
  Synthetic Construct
actgttcccagattttcagcaaac

SEQ ID NO: 21707 - DNA, 24 bp, Artificial Sequence
  Synthetic Construct
ggggattagggtgctaatggattc

SEQ ID NO: 21708 - DNA, 24 bp, Artificial Sequence
  Synthetic Construct
gctgggaacacaggtgcatgtaag

SEQ ID NO: 21709 - DNA, 20 bp, Artificial Sequence
  Synthetic Construct
gaccctgttgtgaggctgtt

SEQ ID NO: 21710 - DNA, 26 bp, Artificial Sequence
  Synthetic Construct
ccgtaaaacaccaatgactacctttg

SEQ ID NO: 21711 - DNA, 24 bp, Artificial Sequence
  Synthetic Construct
gggctgcatgaaacagaacgtgta

SEQ ID NO: 21712 - DNA, 22 bp, Artificial Sequence
  Synthetic Construct
ctcaacccagtagccagagtga

SEQ ID NO: 21713 - DNA, 22 bp, Artificial Sequence
  Synthetic Construct
tgggcatcttacatgggtgttg

SEQ ID NO: 21714 - DNA, 24 bp, Artificial Sequence
  Synthetic Construct
cagccttcatgctttctgaacttg

SEQ ID NO: 21715 - DNA, 24 bp, Artificial Sequence
  Synthetic Construct
ggaaagtcagcattagcagcaagt

SEQ ID NO: 21716 - DNA, 24 bp, Artificial Sequence
  Synthetic Construct
ggcttgttactcaccccaggaaga

SEQ ID NO: 21717 - DNA, 22 bp, Artificial Sequence
  Synthetic Construct
tgtctgggctcttgcatctttg

SEQ ID NO: 21718 - DNA, 25 bp, Artificial Sequence
  Synthetic Construct
caaacctgcatgtgatacgtttaga

SEQ ID NO: 21719 - DNA, 27 bp, Artificial Sequence
  Synthetic Construct
gcaacatacccaaatgctaatgctagt

SEQ ID NO: 21720 - DNA, 22 bp, Artificial Sequence
  Synthetic Construct
ccagcagtggctgttctctgaa

SEQ ID NO: 21721 - DNA, 22 bp, Artificial Sequence
  Synthetic Construct
tcgcctctacggaccaaacttc

SEQ ID NO: 21722 - DNA, 21 bp, Artificial Sequence
  Synthetic Construct
gggcttgtttcgagggtcact

SEQ ID NO: 21723 - DNA, 26 bp, Artificial Sequence
  Synthetic Construct
cccagttagtaacaaagagtggtttc

SEQ ID NO: 21724 - DNA, 22 bp, Artificial Sequence
  Synthetic Construct
ggccacgcagctagtaaacaga

SEQ ID NO: 21725 - DNA, 21 bp, Artificial Sequence
  Synthetic Construct
cgtcacatggcttgggctttc

SEQ ID NO: 21726 - DNA, 21 bp, Artificial Sequence
  Synthetic Construct
aacgtgctcacagggagaaaa

SEQ ID NO: 21727 - DNA, 20 bp, Artificial Sequence
  Synthetic Construct
gccagctccatggcctttgt

SEQ ID NO: 21728 - DNA, 27 bp, Artificial Sequence
  Synthetic Construct
ggactcaaagacattgatttcccttca

SEQ ID NO: 21729 - DNA, 27 bp, Artificial Sequence
  Synthetic Construct
caaggtctatatcccttccccttgaac

SEQ ID NO: 21730 - DNA, 23 bp, Artificial Sequence
  Synthetic Construct
ggagggctttggtgttctgaatc

SEQ ID NO: 21731 - DNA, 24 bp, Artificial Sequence
  Synthetic Construct
gcctttactttcctagtgggatga

SEQ ID NO: 21732 - DNA, 24 bp, Artificial Sequence
  Synthetic Construct
caggaaatgggagcttagaaggtt

SEQ ID NO: 21733 - DNA, 24 bp, Artificial Sequence
  Synthetic Construct
acctagttacagactgggctctac

SEQ ID NO: 21734 - DNA, 25 bp, Artificial Sequence
  Synthetic Construct
aagagcaagaatcatccgtatctgt

SEQ ID NO: 21735 - DNA, 30 bp, Artificial Sequence
  Synthetic Construct
cctagagataggagcatctacttctcacaa

SEQ ID NO: 21736 - DNA, 22 bp, Artificial Sequence
  Synthetic Construct
tcccctggcatatggtggttca

SEQ ID NO: 21737 - DNA, 25 bp, Artificial Sequence
  Synthetic Construct
ttcaccacattgtcctgattactgt

SEQ ID NO: 21738 - DNA, 23 bp, Artificial Sequence
  Synthetic Construct
gtgggttaggatggtaggtgctt

SEQ ID NO: 21739 - DNA, 20 bp, Artificial Sequence
  Synthetic Construct
ccttaagcgcatgccagaca

SEQ ID NO: 21740 - DNA, 21 bp, Artificial Sequence
  Synthetic Construct
ttgtcagtggccacgcctttc

SEQ ID NO: 21741 - DNA, 23 bp, Artificial Sequence
  Synthetic Construct
cctaaggaagggtctctccttct

SEQ ID NO: 21742 - DNA, 21 bp, Artificial Sequence
  Synthetic Construct
tgcctcactccagggctttac

SEQ ID NO: 21743 - DNA, 20 bp, Artificial Sequence
  Synthetic Construct
tccttggcctcagcgacctt

SEQ ID NO: 21744 - DNA, 20 bp, Artificial Sequence
  Synthetic Construct
ggagaccatggctgctgttg

SEQ ID NO: 21745 - DNA, 25 bp, Artificial Sequence
  Synthetic Construct
ccccaagtcttttctagagggatga

SEQ ID NO: 21746 - DNA, 22 bp, Artificial Sequence
  Synthetic Construct
cccttgtgggaagtgagaaaca

SEQ ID NO: 21747 - DNA, 23 bp, Artificial Sequence
  Synthetic Construct
aggacatgacctaccccagattc

SEQ ID NO: 21748 - DNA, 26 bp, Artificial Sequence
  Synthetic Construct
ccacttggctctcatttctctctttc

SEQ ID NO: 21749 - DNA, 28 bp, Artificial Sequence
  Synthetic Construct
cgtttccacactccccattatacttaca

SEQ ID NO: 21750 - DNA, 24 bp, Artificial Sequence
  Synthetic Construct
caaaagtagtcctggtgctgattg

SEQ ID NO: 21751 - DNA, 22 bp, Artificial Sequence
  Synthetic Construct
ggtgactgtgtactgggcttct

SEQ ID NO: 21752 - DNA, 24 bp, Artificial Sequence
  Synthetic Construct
gccttgaatgacggctctttcctt

SEQ ID NO: 21753 - DNA, 24 bp, Artificial Sequence
  Synthetic Construct
agaaaccgttatggtggattgctt

SEQ ID NO: 21754 - DNA, 21 bp, Artificial Sequence
  Synthetic Construct
tggtcccacatttccaagcaa

SEQ ID NO: 21755 - DNA, 25 bp, Artificial Sequence
  Synthetic Construct
gagcagagatggctgtaagtcaaac

SEQ ID NO: 21756 - DNA, 25 bp, Artificial Sequence
  Synthetic Construct
ggcatatcccaccagaaatgggttt

SEQ ID NO: 21757 - DNA, 21 bp, Artificial Sequence
  Synthetic Construct
ccggggcctatcctagcatgt

SEQ ID NO: 21758 - DNA, 24 bp, Artificial Sequence
  Synthetic Construct
ttcctccaatccagttgtctcttc

SEQ ID NO: 21759 - DNA, 22 bp, Artificial Sequence
  Synthetic Construct
ggaggaaggtgtgggctacata

SEQ ID NO: 21760 - DNA, 22 bp, Artificial Sequence
  Synthetic Construct
gggtttgtagtcggagctcttg

SEQ ID NO: 21761 - DNA, 27 bp, Artificial Sequence
  Synthetic Construct
gctccacctaagtgtaaatggagttca

SEQ ID NO: 21762 - DNA, 30 bp, Artificial Sequence
  Synthetic Construct
ctgttgtggtcttatggaaacttgatctga

SEQ ID NO: 21763 - DNA, 22 bp, Artificial Sequence
  Synthetic Construct
tccccaaaacccaggtccatga

SEQ ID NO: 21764 - DNA, 24 bp, Artificial Sequence
  Synthetic Construct
gaggaaggccagattgagggtaac

SEQ ID NO: 21765 - DNA, 22 bp, Artificial Sequence
  Synthetic Construct
agacagttgccagaagtcacaa

SEQ ID NO: 21766 - DNA, 22 bp, Artificial Sequence
  Synthetic Construct
gcatctgccaacagatgtgtga

SEQ ID NO: 21767 - DNA, 22 bp, Artificial Sequence
  Synthetic Construct
ggtgctacccacttccaaggtt

SEQ ID NO: 21768 - DNA, 21 bp, Artificial Sequence
  Synthetic Construct
tccacctccaatccacctcaa

SEQ ID NO: 21769 - DNA, 24 bp, Artificial Sequence
  Synthetic Construct
acaggtggccttttagagagtttc

SEQ ID NO: 21770 - DNA, 24 bp, Artificial Sequence
  Synthetic Construct
cctcccctcttaccctgttcttct

SEQ ID NO: 21771 - DNA, 20 bp, Artificial Sequence
  Synthetic Construct
tccaagtggagtggggagaa

SEQ ID NO: 21772 - DNA, 27 bp, Artificial Sequence
  Synthetic Construct
gaccctacagaagaaagttgtgaacat

SEQ ID NO: 21773 - DNA, 23 bp, Artificial Sequence
  Synthetic Construct
gggcagaaatgcccaatgtgaag

SEQ ID NO: 21774 - DNA, 24 bp, Artificial Sequence
  Synthetic Construct
cactcagcagatgaggagatgtgt

SEQ ID NO: 21775 - DNA, 21 bp, Artificial Sequence
  Synthetic Construct
acacaggtgccttccactatg

SEQ ID NO: 21776 - DNA, 19 bp, Artificial Sequence
  Synthetic Construct
ttggcggcgtccactgaga

SEQ ID NO: 21777 - DNA, 22 bp, Artificial Sequence
  Synthetic Construct
cgggcctccttgttatgctaga

SEQ ID NO: 21778 - DNA, 22 bp, Artificial Sequence
  Synthetic Construct
cgaggcaggacttccctttgtt

SEQ ID NO: 21779 - DNA, 23 bp, Artificial Sequence
  Synthetic Construct
cttcctggatggctggacttaaa

SEQ ID NO: 21780 - DNA, 26 bp, Artificial Sequence
  Synthetic Construct
caagtccagcctactcaatttacgtt

SEQ ID NO: 21781 - DNA, 25 bp, Artificial Sequence
  Synthetic Construct
ccacctttcctctgtttcagcctta

SEQ ID NO: 21782 - DNA, 22 bp, Artificial Sequence
  Synthetic Construct
cagcacatgggagctggttttg

SEQ ID NO: 21783 - DNA, 23 bp, Artificial Sequence
  Synthetic Construct
cagcagccatgctttcatcattc

SEQ ID NO: 21784 - DNA, 22 bp, Artificial Sequence
  Synthetic Construct
acctcccgccatattcctctca

SEQ ID NO: 21785 - DNA, 25 bp, Artificial Sequence
  Synthetic Construct
gcaagggaaatgtgtgctttattca

SEQ ID NO: 21786 - DNA, 23 bp, Artificial Sequence
  Synthetic Construct
cctatggtttccggtctgtgcat

SEQ ID NO: 21787 - DNA, 26 bp, Artificial Sequence
  Synthetic Construct
gtgcttatcatccaaacccagtcaac

SEQ ID NO: 21788 - DNA, 21 bp, Artificial Sequence
  Synthetic Construct
gggagtggatgcagctcaaca

SEQ ID NO: 21789 - DNA, 24 bp, Artificial Sequence
  Synthetic Construct
cccgtaatcgtgtctaagcacaaa

SEQ ID NO: 21790 - DNA, 27 bp, Artificial Sequence
  Synthetic Construct
gcagttaagtggtttaagtggtgttag

SEQ ID NO: 21791 - DNA, 26 bp, Artificial Sequence
  Synthetic Construct
ggcggctctttaaacaaactcgttct

SEQ ID NO: 21792 - DNA, 29 bp, Artificial Sequence
  Synthetic Construct
cagtttgacttgtgatccattccactttg

SEQ ID NO: 21793 - DNA, 28 bp, Artificial Sequence
  Synthetic Construct
ggagtcttcagtggtttttaggttcaag

SEQ ID NO: 21794 - DNA, 27 bp, Artificial Sequence
  Synthetic Construct
gagaggtaactatcactcttgcctttt

SEQ ID NO: 21795 - DNA, 23 bp, Artificial Sequence
  Synthetic Construct
ccaccaaaacttggactgccata

SEQ ID NO: 21796 - DNA, 20 bp, Artificial Sequence
  Synthetic Construct
cggggcttctgtgggtcatt

SEQ ID NO: 21797 - DNA, 22 bp, Artificial Sequence
  Synthetic Construct
gacgctgatctttacgcccaat

SEQ ID NO: 21798 - DNA, 22 bp, Artificial Sequence
  Synthetic Construct
gcagtgggataagtggcttcaa

SEQ ID NO: 21799 - DNA, 23 bp, Artificial Sequence
  Synthetic Construct
gggatctgaacctctttgggatt

SEQ ID NO: 21800 - DNA, 26 bp, Artificial Sequence
  Synthetic Construct
gaggaacaggctctcactagacattg

SEQ ID NO: 21801 - DNA, 24 bp, Artificial Sequence
  Synthetic Construct
gcccagtttcatggtcctagagaa

SEQ ID NO: 21802 - DNA, 27 bp, Artificial Sequence
  Synthetic Construct
ccgaggactatagaagagtgaggtttc

SEQ ID NO: 21803 - DNA, 25 bp, Artificial Sequence
  Synthetic Construct
gaaggggaatgaacaagaggagaga

SEQ ID NO: 21804 - DNA, 23 bp, Artificial Sequence
  Synthetic Construct
gctcagctcacagtcccttacaa

SEQ ID NO: 21805 - DNA, 27 bp, Artificial Sequence
  Synthetic Construct
gcttttggttgagttacagtgggttac

SEQ ID NO: 21806 - DNA, 24 bp, Artificial Sequence
  Synthetic Construct
ggactgtgtccacatctggagctt

SEQ ID NO: 21807 - DNA, 26 bp, Artificial Sequence
  Synthetic Construct
gctccatcagcttaatctaccctact

SEQ ID NO: 21808 - DNA, 23 bp, Artificial Sequence
  Synthetic Construct
ctgggagtgtctctctcttgagt

SEQ ID NO: 21809 - DNA, 22 bp, Artificial Sequence
  Synthetic Construct
gagaggggagaagcaggagata

SEQ ID NO: 21810 - DNA, 23 bp, Artificial Sequence
  Synthetic Construct
ccagcccaagatgttctgtggat

SEQ ID NO: 21811 - DNA, 25 bp, Artificial Sequence
  Synthetic Construct
ccagcattcccctcctctcaaaatc

SEQ ID NO: 21812 - DNA, 21 bp, Artificial Sequence
  Synthetic Construct
tggaaagacaagccccagaca

SEQ ID NO: 21813 - DNA, 23 bp, Artificial Sequence
  Synthetic Construct
ccacattccaaagccagggaaaa

SEQ ID NO: 21814 - DNA, 27 bp, Artificial Sequence
  Synthetic Construct
ccacttttgagtggaaaatgcatccaa

SEQ ID NO: 21815 - DNA, 26 bp, Artificial Sequence
  Synthetic Construct
ctgctgattgcctgacaatttggatt

SEQ ID NO: 21816 - DNA, 22 bp, Artificial Sequence
  Synthetic Construct
accagggactgagcattaccaa

SEQ ID NO: 21817 - DNA, 24 bp, Artificial Sequence
  Synthetic Construct
gcatctcaacactcacctccattg

SEQ ID NO: 21818 - DNA, 23 bp, Artificial Sequence
  Synthetic Construct
gcgtgtggaaaacttggctctca

SEQ ID NO: 21819 - DNA, 21 bp, Artificial Sequence
  Synthetic Construct
acctcagcctccagcacctta

SEQ ID NO: 21820 - DNA, 23 bp, Artificial Sequence
  Synthetic Construct
accagcacaaccatgaaaactct

SEQ ID NO: 21821 - DNA, 21 bp, Artificial Sequence
  Synthetic Construct
gctgcaatggaagccacttga

SEQ ID NO: 21822 - DNA, 20 bp, Artificial Sequence
  Synthetic Construct
ggcgggacacatcaaaggaa

SEQ ID NO: 21823 - DNA, 21 bp, Artificial Sequence
  Synthetic Construct
gggtcagtgggagtcctgtct

SEQ ID NO: 21824 - DNA, 20 bp, Artificial Sequence
  Synthetic Construct
aggcttctccttcccagtga

SEQ ID NO: 21825 - DNA, 25 bp, Artificial Sequence
  Synthetic Construct
gcctgggttctaggtaacaaagcaa

SEQ ID NO: 21826 - DNA, 21 bp, Artificial Sequence
  Synthetic Construct
gccccagactgatttggactt

SEQ ID NO: 21827 - DNA, 22 bp, Artificial Sequence
  Synthetic Construct
gagaagctgggaccagatcagt

SEQ ID NO: 21828 - DNA, 21 bp, Artificial Sequence
  Synthetic Construct
ggaactgtccctgctggcaat

SEQ ID NO: 21829 - DNA, 25 bp, Artificial Sequence
  Synthetic Construct
aacccatcacactgtcttaacttga

SEQ ID NO: 21830 - DNA, 22 bp, Artificial Sequence
  Synthetic Construct
tcttgcttgccagcatcagtag

SEQ ID NO: 21831 - DNA, 23 bp, Artificial Sequence
  Synthetic Construct
cacctcgcttcaaaatcctcttc

SEQ ID NO: 21832 - DNA, 24 bp, Artificial Sequence
  Synthetic Construct
gcaaataccgaccccactatgtca

SEQ ID NO: 21833 - DNA, 22 bp, Artificial Sequence
  Synthetic Construct
cagggtggagtgaagggctttt

SEQ ID NO: 21834 - DNA, 25 bp, Artificial Sequence
  Synthetic Construct
gcaggtgttttctttccacctgtag

SEQ ID NO: 21835 - DNA, 23 bp, Artificial Sequence
  Synthetic Construct
gctcacacaggctatgggtccta

SEQ ID NO: 21836 - DNA, 24 bp, Artificial Sequence
  Synthetic Construct
tccacttgtctatgtgcctcattc

SEQ ID NO: 21837 - DNA, 23 bp, Artificial Sequence
  Synthetic Construct
tctgcagcccaaaaatctcatct

SEQ ID NO: 21838 - DNA, 25 bp, Artificial Sequence
  Synthetic Construct
cccagcgattgtgtatctaggtgtt

SEQ ID NO: 21839 - DNA, 28 bp, Artificial Sequence
  Synthetic Construct
cctccctagaaggaactgtagttaatca

SEQ ID NO: 21840 - DNA, 23 bp, Artificial Sequence
  Synthetic Construct
gccagcagctgaaggtaaaccaa

SEQ ID NO: 21841 - DNA, 18 bp, Artificial Sequence
  Synthetic Construct
tcatgcgtgctgggcaaa

SEQ ID NO: 21842 - DNA, 20 bp, Artificial Sequence
  Synthetic Construct
gcttggtttacgcccaggaa

SEQ ID NO: 21843 - DNA, 22 bp, Artificial Sequence
  Synthetic Construct
ggccacagtctctgctgttgaa

SEQ ID NO: 21844 - DNA, 26 bp, Artificial Sequence
  Synthetic Construct
ctcagatatgggtatgtgaccatcaa

SEQ ID NO: 21845 - DNA, 20 bp, Artificial Sequence
  Synthetic Construct
ccctccatccactcgctact

SEQ ID NO: 21846 - DNA, 27 bp, Artificial Sequence
  Synthetic Construct
ccttatagctgcttgctaaccaaaagt

SEQ ID NO: 21847 - DNA, 21 bp, Artificial Sequence
  Synthetic Construct
gctatcctcctcacccagtca

SEQ ID NO: 21848 - DNA, 24 bp, Artificial Sequence
  Synthetic Construct
ggagcagtcaggtgagaggtaaga

SEQ ID NO: 21849 - DNA, 23 bp, Artificial Sequence
  Synthetic Construct
gccctggggaaagaaaagtcaga

SEQ ID NO: 21850 - DNA, 21 bp, Artificial Sequence
  Synthetic Construct
cagcaagtcatggcagggaaa

SEQ ID NO: 21851 - DNA, 24 bp, Artificial Sequence
  Synthetic Construct
gtcaggatcgctattcacgtcatc

SEQ ID NO: 21852 - DNA, 23 bp, Artificial Sequence
  Synthetic Construct
gtgagtgtggcaccatggatgta

SEQ ID NO: 21853 - DNA, 23 bp, Artificial Sequence
  Synthetic Construct
ccagccatgaaccttccttctgt

SEQ ID NO: 21854 - DNA, 22 bp, Artificial Sequence
  Synthetic Construct
ctctgtatgccagctccctttc

SEQ ID NO: 21855 - DNA, 24 bp, Artificial Sequence
  Synthetic Construct
ggtggaaggaacatagagttgcat

SEQ ID NO: 21856 - DNA, 26 bp, Artificial Sequence
  Synthetic Construct
gcatccattgctatctcagcatcagt

SEQ ID NO: 21857 - DNA, 23 bp, Artificial Sequence
  Synthetic Construct
gctatgccacttcctctgagact

SEQ ID NO: 21858 - DNA, 21 bp, Artificial Sequence
  Synthetic Construct
gcacagcactgaggacagctt

SEQ ID NO: 21859 - DNA, 21 bp, Artificial Sequence
  Synthetic Construct
agaaacaccaaagggcagaca

SEQ ID NO: 21860 - DNA, 22 bp, Artificial Sequence
  Synthetic Construct
gcactgtgagcacaggttcttc

SEQ ID NO: 21861 - DNA, 24 bp, Artificial Sequence
  Synthetic Construct
gacccttcaatctggagctgagtt

SEQ ID NO: 21862 - DNA, 23 bp, Artificial Sequence
  Synthetic Construct
gctgggccccataattgaaggta

SEQ ID NO: 21863 - DNA, 23 bp, Artificial Sequence
  Synthetic Construct
gaccttctgggaaccagttttct

SEQ ID NO: 21864 - DNA, 27 bp, Artificial Sequence
  Synthetic Construct
cactggaggatcacaaactgtattttc

SEQ ID NO: 21865 - DNA, 25 bp, Artificial Sequence
  Synthetic Construct
cggaaaacttggaaggaaggagaag

SEQ ID NO: 21866 - DNA, 23 bp, Artificial Sequence
  Synthetic Construct
gaactcccggctttgaacaattc

SEQ ID NO: 21867 - DNA, 22 bp, Artificial Sequence
  Synthetic Construct
gcgtctcagggcgcatttgtat

SEQ ID NO: 21868 - DNA, 22 bp, Artificial Sequence
  Synthetic Construct
gccactgtgtcgagtccttcaa

SEQ ID NO: 21869 - DNA, 23 bp, Artificial Sequence
  Synthetic Construct
tgaggaagagcgagctttcttag

SEQ ID NO: 21870 - DNA, 24 bp, Artificial Sequence
  Synthetic Construct
cctagaggccactgttactctgaa

SEQ ID NO: 21871 - DNA, 22 bp, Artificial Sequence
  Synthetic Construct
agctgtccaaatccagctctac

SEQ ID NO: 21872 - DNA, 23 bp, Artificial Sequence
  Synthetic Construct
ggaaaggcttatcgggaggttgt

SEQ ID NO: 21873 - DNA, 26 bp, Artificial Sequence
  Synthetic Construct
caggcaccaaagatgtaactactaga

SEQ ID NO: 21874 - DNA, 23 bp, Artificial Sequence
  Synthetic Construct
cgtcctcctaacctggtggtctt

SEQ ID NO: 21875 - DNA, 23 bp, Artificial Sequence
  Synthetic Construct
gctgagttctggcaaatgggaaa

SEQ ID NO: 21876 - DNA, 26 bp, Artificial Sequence
  Synthetic Construct
gccatcttcacagagttcatggtcta

SEQ ID NO: 21877 - DNA, 26 bp, Artificial Sequence
  Synthetic Construct
gcaaaggccctgctaattttctctgt

SEQ ID NO: 21878 - DNA, 24 bp, Artificial Sequence
  Synthetic Construct
ccggagtgagaagacaaggagtct

SEQ ID NO: 21879 - DNA, 26 bp, Artificial Sequence
  Synthetic Construct
gctaagaagaaaggctcactgaaagt

SEQ ID NO: 21880 - DNA, 21 bp, Artificial Sequence
  Synthetic Construct
ccttcaaacccggggatgcta

SEQ ID NO: 21881 - DNA, 22 bp, Artificial Sequence
  Synthetic Construct
cagggcttctctgcttttccaa

SEQ ID NO: 21882 - DNA, 22 bp, Artificial Sequence
  Synthetic Construct
ccctccactactccctggattt

SEQ ID NO: 21883 - DNA, 23 bp, Artificial Sequence
  Synthetic Construct
caaaaccgttcacccacacattg

SEQ ID NO: 21884 - DNA, 23 bp, Artificial Sequence
  Synthetic Construct
aagccttcagaacctgagacttc

SEQ ID NO: 21885 - DNA, 23 bp, Artificial Sequence
  Synthetic Construct
ggagccagttgtcagttgcgtta

SEQ ID NO: 21886 - DNA, 20 bp, Artificial Sequence
  Synthetic Construct
tcgtagcctcactcctgcaa

SEQ ID NO: 21887 - DNA, 22 bp, Artificial Sequence
  Synthetic Construct
ccaacaccacagttaccaggaa

SEQ ID NO: 21888 - DNA, 23 bp, Artificial Sequence
  Synthetic Construct
ggcagtaaccatagtccatgcaa

SEQ ID NO: 21889 - DNA, 20 bp, Artificial Sequence
  Synthetic Construct
gctgtggttggctggtaact

SEQ ID NO: 21890 - DNA, 25 bp, Artificial Sequence
  Synthetic Construct
cctcttccacccctttactttcagt

SEQ ID NO: 21891 - DNA, 23 bp, Artificial Sequence
  Synthetic Construct
ggaagtcccagaatgaggtttca

SEQ ID NO: 21892 - DNA, 24 bp, Artificial Sequence
  Synthetic Construct
ctgggaagggttacagtgagtcat

SEQ ID NO: 21893 - DNA, 21 bp, Artificial Sequence
  Synthetic Construct
agcttggagctctagggtctt

SEQ ID NO: 21894 - DNA, 24 bp, Artificial Sequence
  Synthetic Construct
ccaccaagacgggtctctctgtaa

SEQ ID NO: 21895 - DNA, 22 bp, Artificial Sequence
  Synthetic Construct
gctgttcactcctcctgctcta

SEQ ID NO: 21896 - DNA, 23 bp, Artificial Sequence
  Synthetic Construct
gtcacttagaagcacccatctgt

SEQ ID NO: 21897 - DNA, 24 bp, Artificial Sequence
  Synthetic Construct
ggagcagggctaactcacatgaag

SEQ ID NO: 21898 - DNA, 21 bp, Artificial Sequence
  Synthetic Construct
cgtgctgttaggagcaagaga

SEQ ID NO: 21899 - DNA, 25 bp, Artificial Sequence
  Synthetic Construct
cctgaatctgttgtggatcaagtgt

SEQ ID NO: 21900 - DNA, 22 bp, Artificial Sequence
  Synthetic Construct
tgggatgaggcagaggcttgaa

SEQ ID NO: 21901 - DNA, 23 bp, Artificial Sequence
  Synthetic Construct
gggcactacactccaagatgcaa

SEQ ID NO: 21902 - DNA, 22 bp, Artificial Sequence
  Synthetic Construct
caaacgtggtagacccgacact

SEQ ID NO: 21903 - DNA, 27 bp, Artificial Sequence
  Synthetic Construct
acttctgggcttaaaatggagttctac

SEQ ID NO: 21904 - DNA, 21 bp, Artificial Sequence
  Synthetic Construct
cggtggctatgcgtgtaaaga

SEQ ID NO: 21905 - DNA, 26 bp, Artificial Sequence
  Synthetic Construct
gctgaaccaatcaatctgagagtctt

SEQ ID NO: 21906 - DNA, 25 bp, Artificial Sequence
  Synthetic Construct
ggctgggatcaagttctgtctctgt

SEQ ID NO: 21907 - DNA, 25 bp, Artificial Sequence
  Synthetic Construct
tgctcttgtttcatttgtggctatg

SEQ ID NO: 21908 - DNA, 20 bp, Artificial Sequence
  Synthetic Construct
ccagccacagtgatctgctt

SEQ ID NO: 21909 - DNA, 27 bp, Artificial Sequence
  Synthetic Construct
ggttcttcattttggagagcacgattg

SEQ ID NO: 21910 - DNA, 28 bp, Artificial Sequence
  Synthetic Construct
ggctgagtccatttttataaccgtgtgt

SEQ ID NO: 21911 - DNA, 21 bp, Artificial Sequence
  Synthetic Construct
ggggctgtctcagctctttgt

SEQ ID NO: 21912 - DNA, 24 bp, Artificial Sequence
  Synthetic Construct
cccactggaagagtgacttagctt

SEQ ID NO: 21913 - DNA, 20 bp, Artificial Sequence
  Synthetic Construct
cttgcccaaacccactcctt

SEQ ID NO: 21914 - DNA, 24 bp, Artificial Sequence
  Synthetic Construct
ccccagtgcctcttgtctctgata

SEQ ID NO: 21915 - DNA, 22 bp, Artificial Sequence
  Synthetic Construct
gtgaaaaggggaagcgaagatg

SEQ ID NO: 21916 - DNA, 24 bp, Artificial Sequence
  Synthetic Construct
tctctcttcccctctcaactgatt

SEQ ID NO: 21917 - DNA, 23 bp, Artificial Sequence
  Synthetic Construct
cctgccttactaccccaatcatc

SEQ ID NO: 21918 - DNA, 20 bp, Artificial Sequence
  Synthetic Construct
aggctcagaggcaagacaga

SEQ ID NO: 21919 - DNA, 22 bp, Artificial Sequence
  Synthetic Construct
cccaggaccacaagcacacttt

SEQ ID NO: 21920 - DNA, 22 bp, Artificial Sequence
  Synthetic Construct
cacggaggtgagcatgatgcaa

SEQ ID NO: 21921 - DNA, 24 bp, Artificial Sequence
  Synthetic Construct
ctggggtctgtctctggatgatct

SEQ ID NO: 21922 - DNA, 30 bp, Artificial Sequence
  Synthetic Construct
gcctctccacctttttagaataagggtatc

SEQ ID NO: 21923 - DNA, 27 bp, Artificial Sequence
  Synthetic Construct
ctcctgcaatatcccttattcaagagt

SEQ ID NO: 21924 - DNA, 24 bp, Artificial Sequence
  Synthetic Construct
ccaagacacatttgcctctctact

SEQ ID NO: 21925 - DNA, 22 bp, Artificial Sequence
  Synthetic Construct
ctttcaccgttaacctgcgttt

SEQ ID NO: 21926 - DNA, 25 bp, Artificial Sequence
  Synthetic Construct
gccctgtattactccacagtgtatg

SEQ ID NO: 21927 - DNA, 23 bp, Artificial Sequence
  Synthetic Construct
gcctggatggttctagggctttc

SEQ ID NO: 21928 - DNA, 23 bp, Artificial Sequence
  Synthetic Construct
cttgcacacagagggtggtcatt

SEQ ID NO: 21929 - DNA, 27 bp, Artificial Sequence
  Synthetic Construct
gacactgactctcttctgtctcagatt

SEQ ID NO: 21930 - DNA, 22 bp, Artificial Sequence
  Synthetic Construct
ccctcttctccttccaccagtt

SEQ ID NO: 21931 - DNA, 22 bp, Artificial Sequence
  Synthetic Construct
gaggtggcaatagcgttgtgtt

SEQ ID NO: 21932 - DNA, 22 bp, Artificial Sequence
  Synthetic Construct
gcacaacttccccatcttgctt

SEQ ID NO: 21933 - DNA, 22 bp, Artificial Sequence
  Synthetic Construct
gccaccctgcatattgccttca

SEQ ID NO: 21934 - DNA, 22 bp, Artificial Sequence
  Synthetic Construct
gttccccacataccttgcttgt

SEQ ID NO: 21935 - DNA, 23 bp, Artificial Sequence
  Synthetic Construct
gcggatggatgtctaacccagtt

SEQ ID NO: 21936 - DNA, 20 bp, Artificial Sequence
  Synthetic Construct
agcgtttggccttgggtaag

SEQ ID NO: 21937 - DNA, 29 bp, Artificial Sequence
  Synthetic Construct
ccggaatatcagccccatatttatctaca

SEQ ID NO: 21938 - DNA, 22 bp, Artificial Sequence
  Synthetic Construct
ctgtgtggttgcattcccttga

SEQ ID NO: 21939 - DNA, 21 bp, Artificial Sequence
  Synthetic Construct
ctggctgtctactgcaagcaa

SEQ ID NO: 21940 - DNA, 25 bp, Artificial Sequence
  Synthetic Construct
gggacacagaacaattcaggactct

SEQ ID NO: 21941 - DNA, 25 bp, Artificial Sequence
  Synthetic Construct
cctggggcaagttttcaagcctatc

SEQ ID NO: 21942 - DNA, 24 bp, Artificial Sequence
  Synthetic Construct
gtcacccagttcctacttgacagt

SEQ ID NO: 21943 - DNA, 26 bp, Artificial Sequence
  Synthetic Construct
gtcacaaacccctacagttactcctt

SEQ ID NO: 21944 - DNA, 24 bp, Artificial Sequence
  Synthetic Construct
agtgcttgattccacgtatctgtt

SEQ ID NO: 21945 - DNA, 23 bp, Artificial Sequence
  Synthetic Construct
gttaggtgccattagcagcagta

SEQ ID NO: 21946 - DNA, 25 bp, Artificial Sequence
  Synthetic Construct
gcccctggttagttacaggaagaag

SEQ ID NO: 21947 - DNA, 24 bp, Artificial Sequence
  Synthetic Construct
cctaccagataagccttgagcaat

SEQ ID NO: 21948 - DNA, 23 bp, Artificial Sequence
  Synthetic Construct
gcagaccttgtctcgcttagttc

SEQ ID NO: 21949 - DNA, 28 bp, Artificial Sequence
  Synthetic Construct
gccagaagtgcctattcctaaaccaatc

SEQ ID NO: 21950 - DNA, 24 bp, Artificial Sequence
  Synthetic Construct
gcctccagttggttcagaaaatga

SEQ ID NO: 21951 - DNA, 22 bp, Artificial Sequence
  Synthetic Construct
cgctaccatgtccagctaggtt

SEQ ID NO: 21952 - DNA, 20 bp, Artificial Sequence
  Synthetic Construct
acagacaccagccagcttca

SEQ ID NO: 21953 - DNA, 24 bp, Artificial Sequence
  Synthetic Construct
gtggactctggtctacatgggaaa

SEQ ID NO: 21954 - DNA, 24 bp, Artificial Sequence
  Synthetic Construct
gcagttcttcacactccttgctat

SEQ ID NO: 21955 - DNA, 22 bp, Artificial Sequence
  Synthetic Construct
tgccaagaaccttagggacatc

SEQ ID NO: 21956 - DNA, 24 bp, Artificial Sequence
  Synthetic Construct
ggcctcaacccataaaaacgatca

SEQ ID NO: 21957 - DNA, 24 bp, Artificial Sequence
  Synthetic Construct
ctcattcctaacccaggactgaac

SEQ ID NO: 21958 - DNA, 25 bp, Artificial Sequence
  Synthetic Construct
gcaggcacctagtatcaagccaaag

SEQ ID NO: 21959 - DNA, 23 bp, Artificial Sequence
  Synthetic Construct
ccatatgactggcaggtcctcaa

SEQ ID NO: 21960 - DNA, 27 bp, Artificial Sequence
  Synthetic Construct
ccacaaccagctcttgtagtgaaagta

SEQ ID NO: 21961 - DNA, 24 bp, Artificial Sequence
  Synthetic Construct
gcaagccagggaagaatccagttg

SEQ ID NO: 21962 - DNA, 25 bp, Artificial Sequence
  Synthetic Construct
gggtgatgccaacttccaatcttag

SEQ ID NO: 21963 - DNA, 23 bp, Artificial Sequence
  Synthetic Construct
gctaatgttggtcctccagttct

SEQ ID NO: 21964 - DNA, 27 bp, Artificial Sequence
  Synthetic Construct
gtcctccttttgaagcacacttctttg

SEQ ID NO: 21965 - DNA, 25 bp, Artificial Sequence
  Synthetic Construct
ctgggaggctgggaaatttgatagt

SEQ ID NO: 21966 - DNA, 21 bp, Artificial Sequence
  Synthetic Construct
gacggggcttaaagctgtttg

SEQ ID NO: 21967 - DNA, 22 bp, Artificial Sequence
  Synthetic Construct
ttcccagctaggggaagctaac

SEQ ID NO: 21968 - DNA, 20 bp, Artificial Sequence
  Synthetic Construct
gctgctgttgcccgttcttc

SEQ ID NO: 21969 - DNA, 25 bp, Artificial Sequence
  Synthetic Construct
gtctgtttgctgattcctcctccat

SEQ ID NO: 21970 - DNA, 22 bp, Artificial Sequence
  Synthetic Construct
agccaccaaagggaaatgttct

SEQ ID NO: 21971 - DNA, 24 bp, Artificial Sequence
  Synthetic Construct
ccggtataacattgcctccctaag

SEQ ID NO: 21972 - DNA, 23 bp, Artificial Sequence
  Synthetic Construct
aagaaggcaggactgaatgtcaa

SEQ ID NO: 21973 - DNA, 23 bp, Artificial Sequence
  Synthetic Construct
acaacatggctgtcttcctgaaa

SEQ ID NO: 21974 - DNA, 21 bp, Artificial Sequence
  Synthetic Construct
tgctgagagttttcgctgtca

SEQ ID NO: 21975 - DNA, 22 bp, Artificial Sequence
  Synthetic Construct
tgtcccatctctgccagtgaac

SEQ ID NO: 21976 - DNA, 22 bp, Artificial Sequence
  Synthetic Construct
agagaaaagcaggcctggaatg

SEQ ID NO: 21977 - DNA, 20 bp, Artificial Sequence
  Synthetic Construct
aggcgtcactttctgctgtt

SEQ ID NO: 21978 - DNA, 20 bp, Artificial Sequence
  Synthetic Construct
ccaatgctgggaccggatct

SEQ ID NO: 21979 - DNA, 22 bp, Artificial Sequence
  Synthetic Construct
tccctccattcccatggcttca

SEQ ID NO: 21980 - DNA, 26 bp, Artificial Sequence
  Synthetic Construct
ctgccttagaagaaatctctgggaaa

SEQ ID NO: 21981 - DNA, 23 bp, Artificial Sequence
  Synthetic Construct
acagcacatagtctcagggttca

SEQ ID NO: 21982 - DNA, 23 bp, Artificial Sequence
  Synthetic Construct
gggccctgaaatatggagccttt

SEQ ID NO: 21983 - DNA, 22 bp, Artificial Sequence
  Synthetic Construct
gccataggatcaccagccatct

SEQ ID NO: 21984 - DNA, 22 bp, Artificial Sequence
  Synthetic Construct
gctctcaaactctggggacctt

SEQ ID NO: 21985 - DNA, 22 bp, Artificial Sequence
  Synthetic Construct
cccacgagatgcattccctcta

SEQ ID NO: 21986 - DNA, 23 bp, Artificial Sequence
  Synthetic Construct
ggattgaggcaaaagccaacaga

SEQ ID NO: 21987 - DNA, 21 bp, Artificial Sequence
  Synthetic Construct
ggggtgggcaaagcagttaga

SEQ ID NO: 21988 - DNA, 22 bp, Artificial Sequence
  Synthetic Construct
tgcagtgaaaatgcagcagatg

SEQ ID NO: 21989 - DNA, 26 bp, Artificial Sequence
  Synthetic Construct
cacatgctgccatttataccttgttc

SEQ ID NO: 21990 - DNA, 23 bp, Artificial Sequence
  Synthetic Construct
tccacgtagtctgtctccatgat

SEQ ID NO: 21991 - DNA, 20 bp, Artificial Sequence
  Synthetic Construct
cagcagcccaacctaagaca

SEQ ID NO: 21992 - DNA, 25 bp, Artificial Sequence
  Synthetic Construct
tgcagacactcaaactcatttgttg

SEQ ID NO: 21993 - DNA, 23 bp, Artificial Sequence
  Synthetic Construct
ataccacctgtgtgctgttacat

SEQ ID NO: 21994 - DNA, 21 bp, Artificial Sequence
  Synthetic Construct
tccttggccacacatgtcaag

SEQ ID NO: 21995 - DNA, 24 bp, Artificial Sequence
  Synthetic Construct
gcaagcctcagtgtgagttttcaa

SEQ ID NO: 21996 - DNA, 29 bp, Artificial Sequence
  Synthetic Construct
gacagtagtccctttattgcctataccta

SEQ ID NO: 21997 - DNA, 22 bp, Artificial Sequence
  Synthetic Construct
acacttgccagtggtccctaag

SEQ ID NO: 21998 - DNA, 24 bp, Artificial Sequence
  Synthetic Construct
agtggtttgctttagctgaactga

SEQ ID NO: 21999 - DNA, 24 bp, Artificial Sequence
  Synthetic Construct
gactataacccgcagacgaactca

SEQ ID NO: 22000 - DNA, 20 bp, Artificial Sequence
  Synthetic Construct
tgcttccgctgctcccagta

SEQ ID NO: 22001 - DNA, 24 bp, Artificial Sequence
  Synthetic Construct
cgtagtgattcagagacccaggtt

SEQ ID NO: 22002 - DNA, 24 bp, Artificial Sequence
  Synthetic Construct
cccttatgcctggtaggactggtt

SEQ ID NO: 22003 - DNA, 23 bp, Artificial Sequence
  Synthetic Construct
ccacacccacttctatgcctttg

SEQ ID NO: 22004 - DNA, 28 bp, Artificial Sequence
  Synthetic Construct
gctaaacttaacatctcagcctcctttc

SEQ ID NO: 22005 - DNA, 20 bp, Artificial Sequence
  Synthetic Construct
agagaccccagggtgctagt

SEQ ID NO: 22006 - DNA, 23 bp, Artificial Sequence
  Synthetic Construct
gtcgtctagggaaccatgtcagt

SEQ ID NO: 22007 - DNA, 20 bp, Artificial Sequence
  Synthetic Construct
gccctgaacgcatcttccta

SEQ ID NO: 22008 - DNA, 23 bp, Artificial Sequence
  Synthetic Construct
gccaagcaatgatgccttatgat

SEQ ID NO: 22009 - DNA, 25 bp, Artificial Sequence
  Synthetic Construct
tgctgtcactggaaatagttgagat

SEQ ID NO: 22010 - DNA, 30 bp, Artificial Sequence
  Synthetic Construct
gtgacattaaacaggacactgacattcttg

SEQ ID NO: 22011 - DNA, 26 bp, Artificial Sequence
  Synthetic Construct
caggtattagggacctctgagctact

SEQ ID NO: 22012 - DNA, 19 bp, Artificial Sequence
  Synthetic Construct
tgctcgatccgggaactgt

SEQ ID NO: 22013 - DNA, 26 bp, Artificial Sequence
  Synthetic Construct
cactccacacttaacgaaggctattc

SEQ ID NO: 22014 - DNA, 27 bp, Artificial Sequence
  Synthetic Construct
ccgcattgactgacacagttaaagaca

SEQ ID NO: 22015 - DNA, 25 bp, Artificial Sequence
  Synthetic Construct
gcagggatctaacccctaaaacatc

SEQ ID NO: 22016 - DNA, 28 bp, Artificial Sequence
  Synthetic Construct
cggagtgtgcacaagaatatttggatgt

SEQ ID NO: 22017 - DNA, 25 bp, Artificial Sequence
  Synthetic Construct
cagcccacatggtaattgccttaaa

SEQ ID NO: 22018 - DNA, 21 bp, Artificial Sequence
  Synthetic Construct
agaacccgaagagacccagaa

SEQ ID NO: 22019 - DNA, 24 bp, Artificial Sequence
  Synthetic Construct
cagcatcacccctacatgactaaa

SEQ ID NO: 22020 - DNA, 25 bp, Artificial Sequence
  Synthetic Construct
gcacttgtgtgatacctgcacttca

SEQ ID NO: 22021 - DNA, 22 bp, Artificial Sequence
  Synthetic Construct
gtctcagggtgcctgatctgtt

SEQ ID NO: 22022 - DNA, 18 bp, Artificial Sequence
  Synthetic Construct
tcagctccggacccatgt

SEQ ID NO: 22023 - DNA, 24 bp, Artificial Sequence
  Synthetic Construct
cggccctatctcatctctgtctga

SEQ ID NO: 22024 - DNA, 27 bp, Artificial Sequence
  Synthetic Construct
ggaaccactaaaacaaattgccgagta

SEQ ID NO: 22025 - DNA, 22 bp, Artificial Sequence
  Synthetic Construct
gcctcggaagcaatgggttatg

SEQ ID NO: 22026 - DNA, 24 bp, Artificial Sequence
  Synthetic Construct
gctctcacgaggacatttctcaca

SEQ ID NO: 22027 - DNA, 21 bp, Artificial Sequence
  Synthetic Construct
gggcacagtcctcccagtttc

SEQ ID NO: 22028 - DNA, 25 bp, Artificial Sequence
  Synthetic Construct
ggccagggagtgaacataaatccaa

SEQ ID NO: 22029 - DNA, 27 bp, Artificial Sequence
  Synthetic Construct
caccttagcaccctgaagaataaaatc

SEQ ID NO: 22030 - DNA, 25 bp, Artificial Sequence
  Synthetic Construct
ggttcagaagagtaagggcttcagt

SEQ ID NO: 22031 - DNA, 26 bp, Artificial Sequence
  Synthetic Construct
cccagtcctctttctcctgaaaccaa

SEQ ID NO: 22032 - DNA, 24 bp, Artificial Sequence
  Synthetic Construct
gcagagtgtccatgtgtaacaaag

SEQ ID NO: 22033 - DNA, 22 bp, Artificial Sequence
  Synthetic Construct
gggctcctttggcatcagcatt

SEQ ID NO: 22034 - DNA, 23 bp, Artificial Sequence
  Synthetic Construct
ctccccttgcatttaccctcctt

SEQ ID NO: 22035 - DNA, 27 bp, Artificial Sequence
  Synthetic Construct
tcctcctcttttaagacttagcacatc

SEQ ID NO: 22036 - DNA, 25 bp, Artificial Sequence
  Synthetic Construct
acctgctgactaatacaagctgaag

SEQ ID NO: 22037 - DNA, 21 bp, Artificial Sequence
  Synthetic Construct
gccctggctgaaatggtgagt

SEQ ID NO: 22038 - DNA, 24 bp, Artificial Sequence
  Synthetic Construct
cacaagaggttgatgacccataca

SEQ ID NO: 22039 - DNA, 24 bp, Artificial Sequence
  Synthetic Construct
tggtgcatccgatgagaatgaaaa

SEQ ID NO: 22040 - DNA, 25 bp, Artificial Sequence
  Synthetic Construct
cctcctaattagcaagggagctaac

SEQ ID NO: 22041 - DNA, 23 bp, Artificial Sequence
  Synthetic Construct
ccagagacttcggacaccagaga

SEQ ID NO: 22042 - DNA, 20 bp, Artificial Sequence
  Synthetic Construct
tgcccaaggccatggaacta

SEQ ID NO: 22043 - DNA, 25 bp, Artificial Sequence
  Synthetic Construct
cgaccttccaaacaaccatgcaaag

SEQ ID NO: 22044 - DNA, 25 bp, Artificial Sequence
  Synthetic Construct
cgtcaaaacaaagtgactgctcatt

SEQ ID NO: 22045 - DNA, 22 bp, Artificial Sequence
  Synthetic Construct
gccagaaatggggagaccagtt

SEQ ID NO: 22046 - DNA, 25 bp, Artificial Sequence
  Synthetic Construct
agcctgcctcgtatattaagtttca

SEQ ID NO: 22047 - DNA, 22 bp, Artificial Sequence
  Synthetic Construct
cctccccactttcgccttttca

SEQ ID NO: 22048 - DNA, 28 bp, Artificial Sequence
  Synthetic Construct
cccattagaaggtagcttttgactgaag

SEQ ID NO: 22049 - DNA, 24 bp, Artificial Sequence
  Synthetic Construct
acacctgactcactctgttcatac

SEQ ID NO: 22050 - DNA, 22 bp, Artificial Sequence
  Synthetic Construct
gacccacactgcccaattaaga

SEQ ID NO: 22051 - DNA, 25 bp, Artificial Sequence
  Synthetic Construct
tggggaactcaaccttcattttaca

SEQ ID NO: 22052 - DNA, 22 bp, Artificial Sequence
  Synthetic Construct
tgcctgatagggatgctgtttg

SEQ ID NO: 22053 - DNA, 30 bp, Artificial Sequence
  Synthetic Construct
gacccaaaatgcccttattttagtggagta

SEQ ID NO: 22054 - DNA, 26 bp, Artificial Sequence
  Synthetic Construct
ggcctttgcttgtcctagtaaactct

SEQ ID NO: 22055 - DNA, 22 bp, Artificial Sequence
  Synthetic Construct
gtcccttggaaaaggtggacaa

SEQ ID NO: 22056 - DNA, 26 bp, Artificial Sequence
  Synthetic Construct
gcatgaaacacttgggaaagcacata

SEQ ID NO: 22057 - DNA, 28 bp, Artificial Sequence
  Synthetic Construct
cgtggggtgtatagtctaaggattgaga

SEQ ID NO: 22058 - DNA, 25 bp, Artificial Sequence
  Synthetic Construct
acaagaaggctgtcactttacaaga

SEQ ID NO: 22059 - DNA, 27 bp, Artificial Sequence
  Synthetic Construct
gaagaaggtgcttctgagaaatgtagt

SEQ ID NO: 22060 - DNA, 25 bp, Artificial Sequence
  Synthetic Construct
gaggtctggtcgatcttgtgactac

SEQ ID NO: 22061 - DNA, 22 bp, Artificial Sequence
  Synthetic Construct
gccaccatggattcatcctctt

SEQ ID NO: 22062 - DNA, 27 bp, Artificial Sequence
  Synthetic Construct
cctaaacaaccctggttgaaaggtatc

SEQ ID NO: 22063 - DNA, 24 bp, Artificial Sequence
  Synthetic Construct
tggctgagggtcttttacttgatt

SEQ ID NO: 22064 - DNA, 27 bp, Artificial Sequence
  Synthetic Construct
cacggttagacttaaacaaggctagat

SEQ ID NO: 22065 - DNA, 20 bp, Artificial Sequence
  Synthetic Construct
cacccacccagtgcaaaaca

SEQ ID NO: 22066 - DNA, 26 bp, Artificial Sequence
  Synthetic Construct
ctccctaagtacatgggatctctttc

SEQ ID NO: 22067 - DNA, 22 bp, Artificial Sequence
  Synthetic Construct
gcacagccagtgttacccaaac

SEQ ID NO: 22068 - DNA, 20 bp, Artificial Sequence
  Synthetic Construct
tgggctcagaggatggactt

SEQ ID NO: 22069 - DNA, 23 bp, Artificial Sequence
  Synthetic Construct
gcgtgtgacatttcgctccctta

SEQ ID NO: 22070 - DNA, 27 bp, Artificial Sequence
  Synthetic Construct
gggtaagaaggcaagaatgatacaaca

SEQ ID NO: 22071 - DNA, 23 bp, Artificial Sequence
  Synthetic Construct
ctgctcaccctaacctgagaagt

SEQ ID NO: 22072 - DNA, 24 bp, Artificial Sequence
  Synthetic Construct
gcagggaggaaagcttccacttga

SEQ ID NO: 22073 - DNA, 22 bp, Artificial Sequence
  Synthetic Construct
gccaatctgagagatgcctgaa

SEQ ID NO: 22074 - DNA, 22 bp, Artificial Sequence
  Synthetic Construct
gcagccaaaactggaacagcaa

SEQ ID NO: 22075 - DNA, 27 bp, Artificial Sequence
  Synthetic Construct
ccagtgacctacttgggagatttctgt

SEQ ID NO: 22076 - DNA, 24 bp, Artificial Sequence
  Synthetic Construct
ttggtcacacgtagagtgtaacat

SEQ ID NO: 22077 - DNA, 22 bp, Artificial Sequence
  Synthetic Construct
tctgtgtggacccctggcaata

SEQ ID NO: 22078 - DNA, 23 bp, Artificial Sequence
  Synthetic Construct
cccgttaaccttgtggtccttgt

SEQ ID NO: 22079 - DNA, 23 bp, Artificial Sequence
  Synthetic Construct
gccacatgcaagcaagctaggta

SEQ ID NO: 22080 - DNA, 28 bp, Artificial Sequence
  Synthetic Construct
gggctatgccatgaaaacttagttgatg

SEQ ID NO: 22081 - DNA, 20 bp, Artificial Sequence
  Synthetic Construct
agtgtgtcccagctgcactt

SEQ ID NO: 22082 - DNA, 27 bp, Artificial Sequence
  Synthetic Construct
cactcacctttagctgacattgaggtt

SEQ ID NO: 22083 - DNA, 23 bp, Artificial Sequence
  Synthetic Construct
caatgcccacatacctcttcact

SEQ ID NO: 22084 - DNA, 23 bp, Artificial Sequence
  Synthetic Construct
gagtggcttttgggtgagagaag

SEQ ID NO: 22085 - DNA, 22 bp, Artificial Sequence
  Synthetic Construct
ctccagtgctcttgctgactgt

SEQ ID NO: 22086 - DNA, 25 bp, Artificial Sequence
  Synthetic Construct
gtggcagttcccaagctagagatag

SEQ ID NO: 22087 - DNA, 24 bp, Artificial Sequence
  Synthetic Construct
cacactggacgtactggacgtatg

SEQ ID NO: 22088 - DNA, 22 bp, Artificial Sequence
  Synthetic Construct
caaggtgtcagtgggtttgctt

SEQ ID NO: 22089 - DNA, 27 bp, Artificial Sequence
  Synthetic Construct
ccttgtaactgggatagaaaagcacat

SEQ ID NO: 22090 - DNA, 24 bp, Artificial Sequence
  Synthetic Construct
agatccacaaagcatttggtccta

SEQ ID NO: 22091 - DNA, 23 bp, Artificial Sequence
  Synthetic Construct
gcaattcctggacagctcctagt

SEQ ID NO: 22092 - DNA, 23 bp, Artificial Sequence
  Synthetic Construct
tcagaggccatttctagggtctt

SEQ ID NO: 22093 - DNA, 22 bp, Artificial Sequence
  Synthetic Construct
gcatggcagaatcaaggctcat

SEQ ID NO: 22094 - DNA, 23 bp, Artificial Sequence
  Synthetic Construct
acacacctggaagagaaaacctt

SEQ ID NO: 22095 - DNA, 27 bp, Artificial Sequence
  Synthetic Construct
gagcttgaactcgaagtattaggtgta

SEQ ID NO: 22096 - DNA, 22 bp, Artificial Sequence
  Synthetic Construct
cagcacggtagtggcaaaggta

SEQ ID NO: 22097 - DNA, 26 bp, Artificial Sequence
  Synthetic Construct
gcttgaaatctcatccccagcacttg

SEQ ID NO: 22098 - DNA, 21 bp, Artificial Sequence
  Synthetic Construct
gctgagtgtcgtccaaagtct

SEQ ID NO: 22099 - DNA, 24 bp, Artificial Sequence
  Synthetic Construct
cccaggatcaagagaaagggacat

SEQ ID NO: 22100 - DNA, 25 bp, Artificial Sequence
  Synthetic Construct
caccctcgagttctatttccaggta

SEQ ID NO: 22101 - DNA, 23 bp, Artificial Sequence
  Synthetic Construct
gggcttctaggtccctggtcttt

SEQ ID NO: 22102 - DNA, 23 bp, Artificial Sequence
  Synthetic Construct
tcaaactctggccttctgacttt

SEQ ID NO: 22103 - DNA, 20 bp, Artificial Sequence
  Synthetic Construct
cgctaactgcctgcctgact

SEQ ID NO: 22104 - DNA, 25 bp, Artificial Sequence
  Synthetic Construct
ccggttctgtacaagatccagattg

SEQ ID NO: 22105 - DNA, 23 bp, Artificial Sequence
  Synthetic Construct
ggctccaaatcaccacaccaaac

SEQ ID NO: 22106 - DNA, 22 bp, Artificial Sequence
  Synthetic Construct
gtgggacacagacagcatcctt

SEQ ID NO: 22107 - DNA, 24 bp, Artificial Sequence
  Synthetic Construct
ccaggtctctaccttctcctctgt

SEQ ID NO: 22108 - DNA, 23 bp, Artificial Sequence
  Synthetic Construct
gaggcgaataaggtaggctggtt

SEQ ID NO: 22109 - DNA, 24 bp, Artificial Sequence
  Synthetic Construct
gcacaccaaatcccacctctcttc

SEQ ID NO: 22110 - DNA, 22 bp, Artificial Sequence
  Synthetic Construct
tggccagtgggagtcagtacat

SEQ ID NO: 22111 - DNA, 26 bp, Artificial Sequence
  Synthetic Construct
tgagtaactgagatggtgcaacttac

SEQ ID NO: 22112 - DNA, 26 bp, Artificial Sequence
  Synthetic Construct
ggaagtggtttctatctcacctgtct

SEQ ID NO: 22113 - DNA, 21 bp, Artificial Sequence
  Synthetic Construct
gacgagaagtctggtgggttt

SEQ ID NO: 22114 - DNA, 23 bp, Artificial Sequence
  Synthetic Construct
ctgggatagtggcttctgagcaa

SEQ ID NO: 22115 - DNA, 23 bp, Artificial Sequence
  Synthetic Construct
ccacttcccactccagttaccat

SEQ ID NO: 22116 - DNA, 24 bp, Artificial Sequence
  Synthetic Construct
gtgagccttggtttcagtcacact

SEQ ID NO: 22117 - DNA, 22 bp, Artificial Sequence
  Synthetic Construct
gcggagatgacaaacctgttct

SEQ ID NO: 22118 - DNA, 25 bp, Artificial Sequence
  Synthetic Construct
tgcttaattgagtgctgtgtgattc

SEQ ID NO: 22119 - DNA, 24 bp, Artificial Sequence
  Synthetic Construct
cccagttgaagtaggaagcagcat

SEQ ID NO: 22120 - DNA, 24 bp, Artificial Sequence
  Synthetic Construct
ctcccaacaactcacatggactga

SEQ ID NO: 22121 - DNA, 22 bp, Artificial Sequence
  Synthetic Construct
gggtatggagataggggtcaca

SEQ ID NO: 22122 - DNA, 24 bp, Artificial Sequence
  Synthetic Construct
cctgtccattctgcattgcacttg

SEQ ID NO: 22123 - DNA, 26 bp, Artificial Sequence
  Synthetic Construct
cccttattgccatttggactcaaaga

SEQ ID NO: 22124 - DNA, 19 bp, Artificial Sequence
  Synthetic Construct
tggcagtaggcaggagtgt

SEQ ID NO: 22125 - DNA, 25 bp, Artificial Sequence
  Synthetic Construct
tcacccttgataagagagggaaatg

SEQ ID NO: 22126 - DNA, 23 bp, Artificial Sequence
  Synthetic Construct
aggaaagtgtccttgcaggattg

SEQ ID NO: 22127 - DNA, 21 bp, Artificial Sequence
  Synthetic Construct
tgatgcctacagggagacact

SEQ ID NO: 22128 - DNA, 23 bp, Artificial Sequence
  Synthetic Construct
gccaaagccactttctccagtgt

SEQ ID NO: 22129 - DNA, 23 bp, Artificial Sequence
  Synthetic Construct
gcacgggactcagaatagccaaa

SEQ ID NO: 22130 - DNA, 22 bp, Artificial Sequence
  Synthetic Construct
ctgattgccgtgctagttgtgt

SEQ ID NO: 22131 - DNA, 22 bp, Artificial Sequence
  Synthetic Construct
gtcagtcgcagttccagtcaac

SEQ ID NO: 22132 - DNA, 22 bp, Artificial Sequence
  Synthetic Construct
cgggacttgagtcaggttgtga

SEQ ID NO: 22133 - DNA, 23 bp, Artificial Sequence
  Synthetic Construct
ctcaggacttctggacattcaca

SEQ ID NO: 22134 - DNA, 24 bp, Artificial Sequence
  Synthetic Construct
gaaccaaggagtgacacaatctga

SEQ ID NO: 22135 - DNA, 28 bp, Artificial Sequence
  Synthetic Construct
ggcatggatatggcacagaataagaaac

SEQ ID NO: 22136 - DNA, 22 bp, Artificial Sequence
  Synthetic Construct
gaggttcacagggcttgggtat

SEQ ID NO: 22137 - DNA, 24 bp, Artificial Sequence
  Synthetic Construct
caatgaggttgtcttagcccttgt

SEQ ID NO: 22138 - DNA, 21 bp, Artificial Sequence
  Synthetic Construct
agcagatgtgctgccacatag

SEQ ID NO: 22139 - DNA, 25 bp, Artificial Sequence
  Synthetic Construct
gccaggaacgatgtgttaaatgctt

SEQ ID NO: 22140 - DNA, 20 bp, Artificial Sequence
  Synthetic Construct
accttccacccagtcactca

SEQ ID NO: 22141 - DNA, 22 bp, Artificial Sequence
  Synthetic Construct
gcctcaacccagttaggccaat

SEQ ID NO: 22142 - DNA, 20 bp, Artificial Sequence
  Synthetic Construct
ggaggctgcttttgcctgtt

SEQ ID NO: 22143 - DNA, 23 bp, Artificial Sequence
  Synthetic Construct
cccagtgtagctctgtgagtagt

SEQ ID NO: 22144 - DNA, 23 bp, Artificial Sequence
  Synthetic Construct
actggtcttgttccagcttcttc

SEQ ID NO: 22145 - DNA, 21 bp, Artificial Sequence
  Synthetic Construct
tggtgtttgactggggcctta

SEQ ID NO: 22146 - DNA, 21 bp, Artificial Sequence
  Synthetic Construct
aggccagatgtcctgccaatg

SEQ ID NO: 22147 - DNA, 30 bp, Artificial Sequence
  Synthetic Construct
gccaaggaacccaatactgataaacagaag

SEQ ID NO: 22148 - DNA, 23 bp, Artificial Sequence
  Synthetic Construct
ctggcaactgacccaacctattg

SEQ ID NO: 22149 - DNA, 24 bp, Artificial Sequence
  Synthetic Construct
gtgacctttggctctaccactaac

SEQ ID NO: 22150 - DNA, 25 bp, Artificial Sequence
  Synthetic Construct
cacagtgcctgttctatctctcgat

SEQ ID NO: 22151 - DNA, 24 bp, Artificial Sequence
  Synthetic Construct
ccagaatttgcccagaagctctca

SEQ ID NO: 22152 - DNA, 22 bp, Artificial Sequence
  Synthetic Construct
ccaccccagattcaggtacttc

SEQ ID NO: 22153 - DNA, 22 bp, Artificial Sequence
  Synthetic Construct
ctccaactgcacccaaatgctt

SEQ ID NO: 22154 - DNA, 19 bp, Artificial Sequence
  Synthetic Construct
agggcaactcggcggaaag

SEQ ID NO: 22155 - DNA, 22 bp, Artificial Sequence
  Synthetic Construct
ggaggcgcttacagtacctctt

SEQ ID NO: 22156 - DNA, 24 bp, Artificial Sequence
  Synthetic Construct
ggctgcttcttcaacccctagttc

SEQ ID NO: 22157 - DNA, 26 bp, Artificial Sequence
  Synthetic Construct
gactggatacttagctgtgcttcctt

SEQ ID NO: 22158 - DNA, 22 bp, Artificial Sequence
  Synthetic Construct
ccttcctgaacgtccacctgaa

SEQ ID NO: 22159 - DNA, 25 bp, Artificial Sequence
  Synthetic Construct
gccctccataatttggtccccttca

SEQ ID NO: 22160 - DNA, 26 bp, Artificial Sequence
  Synthetic Construct
cctaccccagactatgatgattgagt

SEQ ID NO: 22161 - DNA, 27 bp, Artificial Sequence
  Synthetic Construct
gaagtgcttgatctcagagtttagtga

SEQ ID NO: 22162 - DNA, 22 bp, Artificial Sequence
  Synthetic Construct
cagacaccctcaagctcagtca

SEQ ID NO: 22163 - DNA, 24 bp, Artificial Sequence
  Synthetic Construct
gtggggtatcacagcaatcctact

SEQ ID NO: 22164 - DNA, 22 bp, Artificial Sequence
  Synthetic Construct
tgacactggagtgacaggacaa

SEQ ID NO: 22165 - DNA, 19 bp, Artificial Sequence
  Synthetic Construct
agtgaccttgcgggagtct

SEQ ID NO: 22166 - DNA, 24 bp, Artificial Sequence
  Synthetic Construct
ttctgggttcattctgggtctatg

SEQ ID NO: 22167 - DNA, 23 bp, Artificial Sequence
  Synthetic Construct
cccacctttacttggaggtcaga

SEQ ID NO: 22168 - DNA, 20 bp, Artificial Sequence
  Synthetic Construct
aagggctgtgggcacctaag

SEQ ID NO: 22169 - DNA, 26 bp, Artificial Sequence
  Synthetic Construct
gttcctgtattgcaaaggctatcatc

SEQ ID NO: 22170 - DNA, 21 bp, Artificial Sequence
  Synthetic Construct
ccctgctaacccaccctgtct

SEQ ID NO: 22171 - DNA, 21 bp, Artificial Sequence
  Synthetic Construct
acccagggttccagtctaaca

SEQ ID NO: 22172 - DNA, 20 bp, Artificial Sequence
  Synthetic Construct
tcctccatggcagcagtgtt

SEQ ID NO: 22173 - DNA, 25 bp, Artificial Sequence
  Synthetic Construct
ctctcctgaaaggaatcatgcaaac

SEQ ID NO: 22174 - DNA, 25 bp, Artificial Sequence
  Synthetic Construct
gtgagcatgaagtgaagtggggatt

SEQ ID NO: 22175 - DNA, 24 bp, Artificial Sequence
  Synthetic Construct
gcatccaatcaccctatctgagaa

SEQ ID NO: 22176 - DNA, 22 bp, Artificial Sequence
  Synthetic Construct
tgaccttggtacttccctgtgt

SEQ ID NO: 22177 - DNA, 25 bp, Artificial Sequence
  Synthetic Construct
gttgggaaaagagtttggagtcaga

SEQ ID NO: 22178 - DNA, 23 bp, Artificial Sequence
  Synthetic Construct
gggaaatcgaggaaagggagctt

SEQ ID NO: 22179 - DNA, 23 bp, Artificial Sequence
  Synthetic Construct
gcaggagtgaggaaatggggaaa

SEQ ID NO: 22180 - DNA, 24 bp, Artificial Sequence
  Synthetic Construct
gtgaagcaagttggaggttgatga

SEQ ID NO: 22181 - DNA, 22 bp, Artificial Sequence
  Synthetic Construct
aggccctgactctcatcctaac

SEQ ID NO: 22182 - DNA, 24 bp, Artificial Sequence
  Synthetic Construct
ccctccacctgtacctagtgtcaa

SEQ ID NO: 22183 - DNA, 22 bp, Artificial Sequence
  Synthetic Construct
gcctacaagcatggcacgatct

SEQ ID NO: 22184 - DNA, 25 bp, Artificial Sequence
  Synthetic Construct
gttcaaaaatatggccaaggcttct

SEQ ID NO: 22185 - DNA, 19 bp, Artificial Sequence
  Synthetic Construct
ggtcagtggcgtgggctta

SEQ ID NO: 22186 - DNA, 23 bp, Artificial Sequence
  Synthetic Construct
ccacaggttgtaagacaggtcaa

SEQ ID NO: 22187 - DNA, 24 bp, Artificial Sequence
  Synthetic Construct
gaggtgttgcctatcaggttgaga

SEQ ID NO: 22188 - DNA, 23 bp, Artificial Sequence
  Synthetic Construct
caaacgagcttttggtgatggat

SEQ ID NO: 22189 - DNA, 24 bp, Artificial Sequence
  Synthetic Construct
tgcactcgacagttcatagagatg

SEQ ID NO: 22190 - DNA, 24 bp, Artificial Sequence
  Synthetic Construct
cacccgtaccctaactcaccatac

SEQ ID NO: 22191 - DNA, 26 bp, Artificial Sequence
  Synthetic Construct
ggaactttcaaagcaatagcctcctt

SEQ ID NO: 22192 - DNA, 25 bp, Artificial Sequence
  Synthetic Construct
gtgttccaaaaccggattgtagtga

SEQ ID NO: 22193 - DNA, 20 bp, Artificial Sequence
  Synthetic Construct
gctccacaaagggcaaccaa

SEQ ID NO: 22194 - DNA, 25 bp, Artificial Sequence
  Synthetic Construct
gtcttcccttttagtggaacccatt

SEQ ID NO: 22195 - DNA, 21 bp, Artificial Sequence
  Synthetic Construct
agctcgccacaatcttcttga

SEQ ID NO: 22196 - DNA, 26 bp, Artificial Sequence
  Synthetic Construct
gcgtaaagtcaaggaaaaccccttac

SEQ ID NO: 22197 - DNA, 20 bp, Artificial Sequence
  Synthetic Construct
cggaccgaaaggcagcatag

SEQ ID NO: 22198 - DNA, 22 bp, Artificial Sequence
  Synthetic Construct
gccccaaaagcttggagggtaa

SEQ ID NO: 22199 - DNA, 23 bp, Artificial Sequence
  Synthetic Construct
gcaagttagctcactgtcacctt

SEQ ID NO: 22200 - DNA, 20 bp, Artificial Sequence
  Synthetic Construct
gctgacctttgcccctgtaa

SEQ ID NO: 22201 - DNA, 22 bp, Artificial Sequence
  Synthetic Construct
gcagcgattgtgaggaaagagt

SEQ ID NO: 22202 - DNA, 23 bp, Artificial Sequence
  Synthetic Construct
ccatgaaagcctggcatcctgtt

SEQ ID NO: 22203 - DNA, 23 bp, Artificial Sequence
  Synthetic Construct
cttgcttaaaggcctccctcatc

SEQ ID NO: 22204 - DNA, 23 bp, Artificial Sequence
  Synthetic Construct
gacatctggagtagcaggagaca

SEQ ID NO: 22205 - DNA, 25 bp, Artificial Sequence
  Synthetic Construct
ggtgcggagaaatgtcattggtttg

SEQ ID NO: 22206 - DNA, 26 bp, Artificial Sequence
  Synthetic Construct
gagacaacctctccctttatggactt

SEQ ID NO: 22207 - DNA, 20 bp, Artificial Sequence
  Synthetic Construct
gcccatgtgccaaggagaca

SEQ ID NO: 22208 - DNA, 25 bp, Artificial Sequence
  Synthetic Construct
ttcacgcttctcaatacccctattt

SEQ ID NO: 22209 - DNA, 24 bp, Artificial Sequence
  Synthetic Construct
gccaggccttaggttttactgatg

SEQ ID NO: 22210 - DNA, 22 bp, Artificial Sequence
  Synthetic Construct
cctcctcgacagaagctgaaca

SEQ ID NO: 22211 - DNA, 24 bp, Artificial Sequence
  Synthetic Construct
ctgttcctctgatccctgagtagt

SEQ ID NO: 22212 - DNA, 25 bp, Artificial Sequence
  Synthetic Construct
gtgaaatattgccccatgctaggtt

SEQ ID NO: 22213 - DNA, 26 bp, Artificial Sequence
  Synthetic Construct
ctctcaggcataactgcagagttctt

SEQ ID NO: 22214 - DNA, 21 bp, Artificial Sequence
  Synthetic Construct
tggagggaaagtggtgtgtgt

SEQ ID NO: 22215 - DNA, 22 bp, Artificial Sequence
  Synthetic Construct
ccagcccaaatagcggtagctt

SEQ ID NO: 22216 - DNA, 26 bp, Artificial Sequence
  Synthetic Construct
ggtctctgttggacctccaatattct

SEQ ID NO: 22217 - DNA, 27 bp, Artificial Sequence
  Synthetic Construct
gctgtgaggttggttagaatcatttgt

SEQ ID NO: 22218 - DNA, 24 bp, Artificial Sequence
  Synthetic Construct
ggttggagtagcttgtccagtctt

SEQ ID NO: 22219 - DNA, 21 bp, Artificial Sequence
  Synthetic Construct
gcctcagcatcttgggctttt

SEQ ID NO: 22220 - DNA, 27 bp, Artificial Sequence
  Synthetic Construct
ggtgtcctaagaatgactaaggtctga

SEQ ID NO: 22221 - DNA, 26 bp, Artificial Sequence
  Synthetic Construct
gtgagagtaaggaagtgctttacaac

SEQ ID NO: 22222 - DNA, 21 bp, Artificial Sequence
  Synthetic Construct
tgctcctcaaagctcccaaac

SEQ ID NO: 22223 - DNA, 25 bp, Artificial Sequence
  Synthetic Construct
ctgcatttttccagaagcccactat

SEQ ID NO: 22224 - DNA, 24 bp, Artificial Sequence
  Synthetic Construct
ctggggctgtaacttcatctgttt

SEQ ID NO: 22225 - DNA, 26 bp, Artificial Sequence
  Synthetic Construct
ccccttcaggatagaaaggacctaag

SEQ ID NO: 22226 - DNA, 23 bp, Artificial Sequence
  Synthetic Construct
caagggcctacctacatccgttt

SEQ ID NO: 22227 - DNA, 22 bp, Artificial Sequence
  Synthetic Construct
gcacagagcacatcctggcata

SEQ ID NO: 22228 - DNA, 23 bp, Artificial Sequence
  Synthetic Construct
tggcattgagacacttcttggat

SEQ ID NO: 22229 - DNA, 30 bp, Artificial Sequence
  Synthetic Construct
gggagaccaaatcctttgtaatagacacat

SEQ ID NO: 22230 - DNA, 26 bp, Artificial Sequence
  Synthetic Construct
caccaatgactttgactgtgggagaa

SEQ ID NO: 22231 - DNA, 23 bp, Artificial Sequence
  Synthetic Construct
cagtggtgctactttcagtgtct

SEQ ID NO: 22232 - DNA, 24 bp, Artificial Sequence
  Synthetic Construct
gccaaccctgtaaaaactttgtgt

SEQ ID NO: 22233 - DNA, 19 bp, Artificial Sequence
  Synthetic Construct
atggctccagcaggggaaa

SEQ ID NO: 22234 - DNA, 21 bp, Artificial Sequence
  Synthetic Construct
acccagcacctagggttccaa

SEQ ID NO: 22235 - DNA, 22 bp, Artificial Sequence
  Synthetic Construct
gccaccttggctcattatgact

SEQ ID NO: 22236 - DNA, 24 bp, Artificial Sequence
  Synthetic Construct
ccacaggctgtcctaactcctctt

SEQ ID NO: 22237 - DNA, 25 bp, Artificial Sequence
  Synthetic Construct
gtggtggaagttctataccggagaa

SEQ ID NO: 22238 - DNA, 23 bp, Artificial Sequence
  Synthetic Construct
ccaatcaggggaatggcagaaag

SEQ ID NO: 22239 - DNA, 21 bp, Artificial Sequence
  Synthetic Construct
tcgccccagtttgtgcctaag

SEQ ID NO: 22240 - DNA, 23 bp, Artificial Sequence
  Synthetic Construct
gaggctacttcacatggcctaat

SEQ ID NO: 22241 - DNA, 25 bp, Artificial Sequence
  Synthetic Construct
gcatgattcagaaccgctagagcat

SEQ ID NO: 22242 - DNA, 20 bp, Artificial Sequence
  Synthetic Construct
gcgcgtgttgtggtcaatgt

SEQ ID NO: 22243 - DNA, 26 bp, Artificial Sequence
  Synthetic Construct
cacctttcaacttcacctctccgtta

SEQ ID NO: 22244 - DNA, 24 bp, Artificial Sequence
  Synthetic Construct
ggtggacattttcccttgcacttg

SEQ ID NO: 22245 - DNA, 20 bp, Artificial Sequence
  Synthetic Construct
cccacttggatgccagaaca

SEQ ID NO: 22246 - DNA, 25 bp, Artificial Sequence
  Synthetic Construct
gggtgcaaggaagcaaaaaggaaga

SEQ ID NO: 22247 - DNA, 27 bp, Artificial Sequence
  Synthetic Construct
gaagaatgacaaggcattagctaggat

SEQ ID NO: 22248 - DNA, 24 bp, Artificial Sequence
  Synthetic Construct
ggccattaaaggaatgacgtggat

SEQ ID NO: 22249 - DNA, 24 bp, Artificial Sequence
  Synthetic Construct
gctcctctgaactacaacaacctt

SEQ ID NO: 22250 - DNA, 22 bp, Artificial Sequence
  Synthetic Construct
ctttctgtgggcctgtgatagt

SEQ ID NO: 22251 - DNA, 23 bp, Artificial Sequence
  Synthetic Construct
caaccgtcttcccacaagtctga

SEQ ID NO: 22252 - DNA, 22 bp, Artificial Sequence
  Synthetic Construct
aggtactcagggctcaaaggaa

SEQ ID NO: 22253 - DNA, 25 bp, Artificial Sequence
  Synthetic Construct
gaaatggttaggcttctctctgctt

SEQ ID NO: 22254 - DNA, 21 bp, Artificial Sequence
  Synthetic Construct
ggggagtgagggaggagctta

SEQ ID NO: 22255 - DNA, 24 bp, Artificial Sequence
  Synthetic Construct
gggaatggcatgtcatgatttgtt

SEQ ID NO: 22256 - DNA, 23 bp, Artificial Sequence
  Synthetic Construct
gtcacagcctctcaaggttcagt

SEQ ID NO: 22257 - DNA, 23 bp, Artificial Sequence
  Synthetic Construct
cagtgtcagcttcttccgtggat

SEQ ID NO: 22258 - DNA, 22 bp, Artificial Sequence
  Synthetic Construct
gccacccaatggtgaatgctaa

SEQ ID NO: 22259 - DNA, 23 bp, Artificial Sequence
  Synthetic Construct
gaggtgaaggcagacatgtggaa

SEQ ID NO: 22260 - DNA, 24 bp, Artificial Sequence
  Synthetic Construct
tggggtcaaatacaacaagagaca

SEQ ID NO: 22261 - DNA, 22 bp, Artificial Sequence
  Synthetic Construct
ggcttggagcatggcaggaaat

SEQ ID NO: 22262 - DNA, 24 bp, Artificial Sequence
  Synthetic Construct
ctgctccttgacattgcagacact

SEQ ID NO: 22263 - DNA, 24 bp, Artificial Sequence
  Synthetic Construct
ccttagctgcaagagagcctgtta

SEQ ID NO: 22264 - DNA, 22 bp, Artificial Sequence
  Synthetic Construct
ctttgtagaggtggcaggaaca

SEQ ID NO: 22265 - DNA, 24 bp, Artificial Sequence
  Synthetic Construct
caccctcgcttactgggatactga

SEQ ID NO: 22266 - DNA, 24 bp, Artificial Sequence
  Synthetic Construct
ggtaggcccagtaattggtacttg

SEQ ID NO: 22267 - DNA, 26 bp, Artificial Sequence
  Synthetic Construct
cagtacccttttataggcagcaactt

SEQ ID NO: 22268 - DNA, 23 bp, Artificial Sequence
  Synthetic Construct
gttcccaaatctgcaacccaaag

SEQ ID NO: 22269 - DNA, 24 bp, Artificial Sequence
  Synthetic Construct
gttgcctcacacactagacctttg

SEQ ID NO: 22270 - DNA, 24 bp, Artificial Sequence
  Synthetic Construct
tccatcagggaagaaccacttatg

SEQ ID NO: 22271 - DNA, 22 bp, Artificial Sequence
  Synthetic Construct
cctgtgtattggggcaatgctt

SEQ ID NO: 22272 - DNA, 25 bp, Artificial Sequence
  Synthetic Construct
gacaggattccatagggtcttgttt

SEQ ID NO: 22273 - DNA, 23 bp, Artificial Sequence
  Synthetic Construct
cagagagcaagtgacagagtcat

SEQ ID NO: 22274 - DNA, 22 bp, Artificial Sequence
  Synthetic Construct
tctgcatgtccaacactgaact

SEQ ID NO: 22275 - DNA, 20 bp, Artificial Sequence
  Synthetic Construct
gcagtggcaatgtggcaaga

SEQ ID NO: 22276 - DNA, 24 bp, Artificial Sequence
  Synthetic Construct
gctctccacaagaagatggcagtt

SEQ ID NO: 22277 - DNA, 23 bp, Artificial Sequence
  Synthetic Construct
actttgggtctctggttcctgta

SEQ ID NO: 22278 - DNA, 23 bp, Artificial Sequence
  Synthetic Construct
ggctcccaatgcaaagaccttca

SEQ ID NO: 22279 - DNA, 25 bp, Artificial Sequence
  Synthetic Construct
gggtgcaggaacattacctggagta

SEQ ID NO: 22280 - DNA, 29 bp, Artificial Sequence
  Synthetic Construct
gcaaggggtatattgagtttcagtgacta

SEQ ID NO: 22281 - DNA, 20 bp, Artificial Sequence
  Synthetic Construct
ccaggggcattgatgggttt

SEQ ID NO: 22282 - DNA, 22 bp, Artificial Sequence
  Synthetic Construct
cagcaaaaccaatgcagtgtga

SEQ ID NO: 22283 - DNA, 26 bp, Artificial Sequence
  Synthetic Construct
agatcttaggatcaaggggaacacta

SEQ ID NO: 22284 - DNA, 27 bp, Artificial Sequence
  Synthetic Construct
ggcccagtctcactatctaagtacaga

SEQ ID NO: 22285 - DNA, 20 bp, Artificial Sequence
  Synthetic Construct
tggaagcaggctggatcact

SEQ ID NO: 22286 - DNA, 20 bp, Artificial Sequence
  Synthetic Construct
agcaggaaatgggcctgaag

SEQ ID NO: 22287 - DNA, 25 bp, Artificial Sequence
  Synthetic Construct
ggcctcatttacttttgttgccttt

SEQ ID NO: 22288 - DNA, 26 bp, Artificial Sequence
  Synthetic Construct
ctgtagaagacggacctcaacaatca

SEQ ID NO: 22289 - DNA, 22 bp, Artificial Sequence
  Synthetic Construct
gggtgactgccaagtccagaaa

SEQ ID NO: 22290 - DNA, 22 bp, Artificial Sequence
  Synthetic Construct
aggtgcaaggtatgcactgatt

SEQ ID NO: 22291 - DNA, 22 bp, Artificial Sequence
  Synthetic Construct
acggccttgaaaacaccattca

SEQ ID NO: 22292 - DNA, 24 bp, Artificial Sequence
  Synthetic Construct
ccatgaggacacaatcagtctcaa

SEQ ID NO: 22293 - DNA, 22 bp, Artificial Sequence
  Synthetic Construct
gcccatatcggtgaggatggat

SEQ ID NO: 22294 - DNA, 25 bp, Artificial Sequence
  Synthetic Construct
gccaagttcctctggtaacaaagtt

SEQ ID NO: 22295 - DNA, 23 bp, Artificial Sequence
  Synthetic Construct
ggtggtggctactaccaaaatgt

SEQ ID NO: 22296 - DNA, 24 bp, Artificial Sequence
  Synthetic Construct
cagaaacagccacctagctggtaa

SEQ ID NO: 22297 - DNA, 24 bp, Artificial Sequence
  Synthetic Construct
cccaggacatctcttccactgctt

SEQ ID NO: 22298 - DNA, 20 bp, Artificial Sequence
  Synthetic Construct
acgagccacgacggctctga

SEQ ID NO: 22299 - DNA, 22 bp, Artificial Sequence
  Synthetic Construct
gtcaagcaggtaacagcagact

SEQ ID NO: 22300 - DNA, 27 bp, Artificial Sequence
  Synthetic Construct
ccacaaataggcagtttacagcatgaa

SEQ ID NO: 22301 - DNA, 21 bp, Artificial Sequence
  Synthetic Construct
gggctttgacagtcagcagat

SEQ ID NO: 22302 - DNA, 22 bp, Artificial Sequence
  Synthetic Construct
ggtgctgcctttaggggagttt

SEQ ID NO: 22303 - DNA, 25 bp, Artificial Sequence
  Synthetic Construct
ccagcatctgtgagaaaacttcgtt

SEQ ID NO: 22304 - DNA, 21 bp, Artificial Sequence
  Synthetic Construct
gagtggccagctgcataaaag

SEQ ID NO: 22305 - DNA, 21 bp, Artificial Sequence
  Synthetic Construct
gcacagtttgcaagccacttc

SEQ ID NO: 22306 - DNA, 26 bp, Artificial Sequence
  Synthetic Construct
cgtgtttctgggatgagttagtctgt

SEQ ID NO: 22307 - DNA, 23 bp, Artificial Sequence
  Synthetic Construct
gggacattggtagagcaaagagt

SEQ ID NO: 22308 - DNA, 22 bp, Artificial Sequence
  Synthetic Construct
gcagcgagagcttagcacatct

SEQ ID NO: 22309 - DNA, 21 bp, Artificial Sequence
  Synthetic Construct
gtttgggtcagtggcaagaga

SEQ ID NO: 22310 - DNA, 22 bp, Artificial Sequence
  Synthetic Construct
gacagaggaaaccggggaaact

SEQ ID NO: 22311 - DNA, 24 bp, Artificial Sequence
  Synthetic Construct
gtggaggggatgatggagttcaga

SEQ ID NO: 22312 - DNA, 23 bp, Artificial Sequence
  Synthetic Construct
gggcagaagattagggaggtctt

SEQ ID NO: 22313 - DNA, 22 bp, Artificial Sequence
  Synthetic Construct
tgggcttggatcctatgggaaa

SEQ ID NO: 22314 - DNA, 25 bp, Artificial Sequence
  Synthetic Construct
cattcaggacttggtttttcgtaca

SEQ ID NO: 22315 - DNA, 23 bp, Artificial Sequence
  Synthetic Construct
cacaggggtctaggcaaatctca

SEQ ID NO: 22316 - DNA, 23 bp, Artificial Sequence
  Synthetic Construct
cctgttccttccactccttttca

SEQ ID NO: 22317 - DNA, 22 bp, Artificial Sequence
  Synthetic Construct
ccacaaagctcccctaccatgt

SEQ ID NO: 22318 - DNA, 26 bp, Artificial Sequence
  Synthetic Construct
caaaggctgtttcagaactgatctct

SEQ ID NO: 22319 - DNA, 24 bp, Artificial Sequence
  Synthetic Construct
gccctacccagtgaggagtagtag

SEQ ID NO: 22320 - DNA, 20 bp, Artificial Sequence
  Synthetic Construct
atccagaaggcagcaagcaa

SEQ ID NO: 22321 - DNA, 25 bp, Artificial Sequence
  Synthetic Construct
cctgctgtagacattcaacaaccaa

SEQ ID NO: 22322 - DNA, 25 bp, Artificial Sequence
  Synthetic Construct
cacgggaagtcaaatcaattacgat

SEQ ID NO: 22323 - DNA, 28 bp, Artificial Sequence
  Synthetic Construct
ggttttgacctcccggaatattaggaaa

SEQ ID NO: 22324 - DNA, 25 bp, Artificial Sequence
  Synthetic Construct
ggcttttgggtgtcaagaacacact

SEQ ID NO: 22325 - DNA, 26 bp, Artificial Sequence
  Synthetic Construct
tgcacgtagttgctaagagagttatg

SEQ ID NO: 22326 - DNA, 24 bp, Artificial Sequence
  Synthetic Construct
gactgattatgaggcaacgtgtgt

SEQ ID NO: 22327 - DNA, 20 bp, Artificial Sequence
  Synthetic Construct
tggccatcttgggcgtagaa

SEQ ID NO: 22328 - DNA, 21 bp, Artificial Sequence
  Synthetic Construct
ccggagcacaaagcaagtgaa

SEQ ID NO: 22329 - DNA, 21 bp, Artificial Sequence
  Synthetic Construct
acacaccaacaggcacagaag

SEQ ID NO: 22330 - DNA, 24 bp, Artificial Sequence
  Synthetic Construct
cgcttcatcaacctcaatggtaag

SEQ ID NO: 22331 - DNA, 26 bp, Artificial Sequence
  Synthetic Construct
gtcttaggaggaaagtgtccaggttt

SEQ ID NO: 22332 - DNA, 25 bp, Artificial Sequence
  Synthetic Construct
ccatcagtggagctttcagttcttc

SEQ ID NO: 22333 - DNA, 23 bp, Artificial Sequence
  Synthetic Construct
gcacagcatggaaatgagagaca

SEQ ID NO: 22334 - DNA, 24 bp, Artificial Sequence
  Synthetic Construct
aggcactaaaagctgacctaaagt

SEQ ID NO: 22335 - DNA, 20 bp, Artificial Sequence
  Synthetic Construct
agtggctccagtgtggatga

SEQ ID NO: 22336 - DNA, 22 bp, Artificial Sequence
  Synthetic Construct
gcttgccttgtagcttggtgtt

SEQ ID NO: 22337 - DNA, 23 bp, Artificial Sequence
  Synthetic Construct
agggtaaggggagagaggagtct

SEQ ID NO: 22338 - DNA, 20 bp, Artificial Sequence
  Synthetic Construct
agagtcttggtcccggagtt

SEQ ID NO: 22339 - DNA, 22 bp, Artificial Sequence
  Synthetic Construct
tggaagacaggggtggaaaaag

SEQ ID NO: 22340 - DNA, 22 bp, Artificial Sequence
  Synthetic Construct
tgtgcctgctagaagggtaaag

SEQ ID NO: 22341 - DNA, 22 bp, Artificial Sequence
  Synthetic Construct
cacttcgtttttgcaggacaca

SEQ ID NO: 22342 - DNA, 21 bp, Artificial Sequence
  Synthetic Construct
tgcagccatttggaggagaga

SEQ ID NO: 22343 - DNA, 23 bp, Artificial Sequence
  Synthetic Construct
ctcgtctgttggcagagacaact

SEQ ID NO: 22344 - DNA, 27 bp, Artificial Sequence
  Synthetic Construct
ggggaagagtaatctatgggagctaac

SEQ ID NO: 22345 - DNA, 23 bp, Artificial Sequence
  Synthetic Construct
ccctgaccatgtcccttttgaca

SEQ ID NO: 22346 - DNA, 24 bp, Artificial Sequence
  Synthetic Construct
gctgtagggtcaaagaatgtgact

SEQ ID NO: 22347 - DNA, 21 bp, Artificial Sequence
  Synthetic Construct
gcagcatgcaagccattgtca

SEQ ID NO: 22348 - DNA, 27 bp, Artificial Sequence
  Synthetic Construct
tggtgactaagattaagggcagtatct

SEQ ID NO: 22349 - DNA, 24 bp, Artificial Sequence
  Synthetic Construct
caacttgccagtcttccacgtatc

SEQ ID NO: 22350 - DNA, 23 bp, Artificial Sequence
  Synthetic Construct
ctggtcctctgcatagacctaac

SEQ ID NO: 22351 - DNA, 23 bp, Artificial Sequence
  Synthetic Construct
gcctgtgtcacatccctgagaag

SEQ ID NO: 22352 - DNA, 23 bp, Artificial Sequence
  Synthetic Construct
tcctccttcactccctgtcatag

SEQ ID NO: 22353 - DNA, 26 bp, Artificial Sequence
  Synthetic Construct
ggagaaggtctcattaagggagtaga

SEQ ID NO: 22354 - DNA, 22 bp, Artificial Sequence
  Synthetic Construct
ggagggatgatggaggtggatt

SEQ ID NO: 22355 - DNA, 26 bp, Artificial Sequence
  Synthetic Construct
caagccttattcagttcttggcatca

SEQ ID NO: 22356 - DNA, 25 bp, Artificial Sequence
  Synthetic Construct
gtcaatagccaggaaacatgggtaa

SEQ ID NO: 22357 - DNA, 21 bp, Artificial Sequence
  Synthetic Construct
gcaacctgcaccggtcttttg

SEQ ID NO: 22358 - DNA, 28 bp, Artificial Sequence
  Synthetic Construct
ctcccctagttattaagggtgaggtatc

SEQ ID NO: 22359 - DNA, 24 bp, Artificial Sequence
  Synthetic Construct
gggcttgtatcccactccaactac

SEQ ID NO: 22360 - DNA, 22 bp, Artificial Sequence
  Synthetic Construct
ttggggctgagaatacctctct

SEQ ID NO: 22361 - DNA, 24 bp, Artificial Sequence
  Synthetic Construct
cctgtgtactgtttgcttgggata

SEQ ID NO: 22362 - DNA, 24 bp, Artificial Sequence
  Synthetic Construct
gggcactaagaagggctcagagat

SEQ ID NO: 22363 - DNA, 25 bp, Artificial Sequence
  Synthetic Construct
cctagatccagcctctatcgagttc

SEQ ID NO: 22364 - DNA, 25 bp, Artificial Sequence
  Synthetic Construct
tgccaccaggatattgattgagatt

SEQ ID NO: 22365 - DNA, 22 bp, Artificial Sequence
  Synthetic Construct
cagccctaagggtgggatttca

SEQ ID NO: 22366 - DNA, 24 bp, Artificial Sequence
  Synthetic Construct
acgccaggccagaaaaatattaca

SEQ ID NO: 22367 - DNA, 21 bp, Artificial Sequence
  Synthetic Construct
gacccaagtcgcgtcaattct

SEQ ID NO: 22368 - DNA, 28 bp, Artificial Sequence
  Synthetic Construct
gggagagctggtctataagaggaacttg

SEQ ID NO: 22369 - DNA, 23 bp, Artificial Sequence
  Synthetic Construct
tgcctgtagcatttgacaaccat

SEQ ID NO: 22370 - DNA, 25 bp, Artificial Sequence
  Synthetic Construct
ggtgggtaaatctgcctatttcaga

SEQ ID NO: 22371 - DNA, 28 bp, Artificial Sequence
  Synthetic Construct
ccaccctagtcaatgtcactatcctttc

SEQ ID NO: 22372 - DNA, 22 bp, Artificial Sequence
  Synthetic Construct
gcctgtctgccaatttgaacat

SEQ ID NO: 22373 - DNA, 23 bp, Artificial Sequence
  Synthetic Construct
cagtaggcctgaagaaccactct

SEQ ID NO: 22374 - DNA, 20 bp, Artificial Sequence
  Synthetic Construct
ccactgacaggtctgctgtt

SEQ ID NO: 22375 - DNA, 20 bp, Artificial Sequence
  Synthetic Construct
tggggactctgcaggtcaaa

SEQ ID NO: 22376 - DNA, 22 bp, Artificial Sequence
  Synthetic Construct
tgggttgtcagtcacccaggta

SEQ ID NO: 22377 - DNA, 27 bp, Artificial Sequence
  Synthetic Construct
gcctcaaggtctcatttgcatagaaag

SEQ ID NO: 22378 - DNA, 22 bp, Artificial Sequence
  Synthetic Construct
gctgctggtccattctgagttg

SEQ ID NO: 22379 - DNA, 27 bp, Artificial Sequence
  Synthetic Construct
gtgcagaatcaaagacagtgtagaaac

SEQ ID NO: 22380 - DNA, 20 bp, Artificial Sequence
  Synthetic Construct
gccctgagaccaagcaatca

SEQ ID NO: 22381 - DNA, 28 bp, Artificial Sequence
  Synthetic Construct
gtggtatgccttccttccatactaaaca

SEQ ID NO: 22382 - DNA, 22 bp, Artificial Sequence
  Synthetic Construct
gtgcccttccttcccagtttca

SEQ ID NO: 22383 - DNA, 26 bp, Artificial Sequence
  Synthetic Construct
cacactagaataggtagggtgctctt

SEQ ID NO: 22384 - DNA, 22 bp, Artificial Sequence
  Synthetic Construct
tgcttcggagtaagacctccat

SEQ ID NO: 22385 - DNA, 23 bp, Artificial Sequence
  Synthetic Construct
gacatgtggccagttggatcagt

SEQ ID NO: 22386 - DNA, 20 bp, Artificial Sequence
  Synthetic Construct
tgtttccccactccccaaga

SEQ ID NO: 22387 - DNA, 23 bp, Artificial Sequence
  Synthetic Construct
gccagatgctatgtagtggcaaa

SEQ ID NO: 22388 - DNA, 26 bp, Artificial Sequence
  Synthetic Construct
tgatcaggcacaatactctagtctca

SEQ ID NO: 22389 - DNA, 24 bp, Artificial Sequence
  Synthetic Construct
ccaggtactatcagtgccgactgt

SEQ ID NO: 22390 - DNA, 23 bp, Artificial Sequence
  Synthetic Construct
ctgttgtttggagccaaaagtgt

SEQ ID NO: 22391 - DNA, 23 bp, Artificial Sequence
  Synthetic Construct
ccttccacaatgcagagcagtga

SEQ ID NO: 22392 - DNA, 28 bp, Artificial Sequence
  Synthetic Construct
ctctgccctgtaagttttctactgacta

SEQ ID NO: 22393 - DNA, 26 bp, Artificial Sequence
  Synthetic Construct
ggagaaggtctttctacagtgaaact

SEQ ID NO: 22394 - DNA, 26 bp, Artificial Sequence
  Synthetic Construct
cggcaagactaggaataccagaggaa

SEQ ID NO: 22395 - DNA, 27 bp, Artificial Sequence
  Synthetic Construct
gcatcttcacatacaggaaggagcaaa

SEQ ID NO: 22396 - DNA, 25 bp, Artificial Sequence
  Synthetic Construct
ggtaaagctgctcaatgggcaatag

SEQ ID NO: 22397 - DNA, 22 bp, Artificial Sequence
  Synthetic Construct
gcacccatgttgctctcagtgt

SEQ ID NO: 22398 - DNA, 25 bp, Artificial Sequence
  Synthetic Construct
cctgtttcctagcttggctctcttt

SEQ ID NO: 22399 - DNA, 25 bp, Artificial Sequence
  Synthetic Construct
tcaccaacaccttcctggaattaag

SEQ ID NO: 22400 - DNA, 25 bp, Artificial Sequence
  Synthetic Construct
tgcatggatcacagtttcttctgta

SEQ ID NO: 22401 - DNA, 27 bp, Artificial Sequence
  Synthetic Construct
ccatgtttcctctcaattctctgaaag

SEQ ID NO: 22402 - DNA, 20 bp, Artificial Sequence
  Synthetic Construct
ggtgatgtggccagacttgt

SEQ ID NO: 22403 - DNA, 26 bp, Artificial Sequence
  Synthetic Construct
cttgtgtagggacaaaagcataccaa

SEQ ID NO: 22404 - DNA, 21 bp, Artificial Sequence
  Synthetic Construct
ccaaaggcccaggagaggttt

SEQ ID NO: 22405 - DNA, 30 bp, Artificial Sequence
  Synthetic Construct
gagaactgactctcccagatataaagagtt

SEQ ID NO: 22406 - DNA, 27 bp, Artificial Sequence
  Synthetic Construct
tctctgtgatttaggttcctgctttag

SEQ ID NO: 22407 - DNA, 23 bp, Artificial Sequence
  Synthetic Construct
gcctggcctcaattctcattttt

SEQ ID NO: 22408 - DNA, 30 bp, Artificial Sequence
  Synthetic Construct
cttggtatggaatcctagtgtattctgact

SEQ ID NO: 22409 - DNA, 22 bp, Artificial Sequence
  Synthetic Construct
ttcctgtgagagcatgtgtgtt

SEQ ID NO: 22410 - DNA, 22 bp, Artificial Sequence
  Synthetic Construct
ccagctagaggctactctgtca

SEQ ID NO: 22411 - DNA, 23 bp, Artificial Sequence
  Synthetic Construct
ggcagagtcaaaaggaagtcaac

SEQ ID NO: 22412 - DNA, 23 bp, Artificial Sequence
  Synthetic Construct
tgctggactcagggttgaatatg

SEQ ID NO: 22413 - DNA, 25 bp, Artificial Sequence
  Synthetic Construct
acacctgcgaaacactttattgtag

SEQ ID NO: 22414 - DNA, 23 bp, Artificial Sequence
  Synthetic Construct
cctgtcattaccagtgactgcat

SEQ ID NO: 22415 - DNA, 24 bp, Artificial Sequence
  Synthetic Construct
ggcatcctttgacccatgatgaga

SEQ ID NO: 22416 - DNA, 20 bp, Artificial Sequence
  Synthetic Construct
aggaccaggcctccttgttt

SEQ ID NO: 22417 - DNA, 22 bp, Artificial Sequence
  Synthetic Construct
ccacaatgacctagcagacctt

SEQ ID NO: 22418 - DNA, 21 bp, Artificial Sequence
  Synthetic Construct
ccagcttcaccattggctttc

SEQ ID NO: 22419 - DNA, 27 bp, Artificial Sequence
  Synthetic Construct
gtgtctactaataagtaccagggcaaa

SEQ ID NO: 22420 - DNA, 26 bp, Artificial Sequence
  Synthetic Construct
tctgaaagtaccccattcaagtcaag

SEQ ID NO: 22421 - DNA, 24 bp, Artificial Sequence
  Synthetic Construct
gtggtcatttcctcagtgccagaa

SEQ ID NO: 22422 - DNA, 22 bp, Artificial Sequence
  Synthetic Construct
ggttttgcttccaagggactgt

SEQ ID NO: 22423 - DNA, 26 bp, Artificial Sequence
  Synthetic Construct
ggcatattcagcacaatctgctttac

SEQ ID NO: 22424 - DNA, 25 bp, Artificial Sequence
  Synthetic Construct
gccatgagttgatgattgcgaggaa

SEQ ID NO: 22425 - DNA, 22 bp, Artificial Sequence
  Synthetic Construct
gcagcaatgcccaggtactaca

SEQ ID NO: 22426 - DNA, 23 bp, Artificial Sequence
  Synthetic Construct
cttgtggggtctggaatttggat

SEQ ID NO: 22427 - DNA, 24 bp, Artificial Sequence
  Synthetic Construct
tggtcctgggtgtagtctggattc

SEQ ID NO: 22428 - DNA, 23 bp, Artificial Sequence
  Synthetic Construct
ggaggcacaaacatgcattcaga

SEQ ID NO: 22429 - DNA, 25 bp, Artificial Sequence
  Synthetic Construct
gtacttgtgcttggatgttttgcta

SEQ ID NO: 22430 - DNA, 24 bp, Artificial Sequence
  Synthetic Construct
tgggagttaagagtgagtggaatg

SEQ ID NO: 22431 - DNA, 22 bp, Artificial Sequence
  Synthetic Construct
ccagagcacacagcttcacaac

SEQ ID NO: 22432 - DNA, 21 bp, Artificial Sequence
  Synthetic Construct
tctcaccgatgttgggctcta

SEQ ID NO: 22433 - DNA, 22 bp, Artificial Sequence
  Synthetic Construct
gacacaatgctgcgtgttgctt

SEQ ID NO: 22434 - DNA, 22 bp, Artificial Sequence
  Synthetic Construct
gagtgagtgagggtgggaagtt

SEQ ID NO: 22435 - DNA, 20 bp, Artificial Sequence
  Synthetic Construct
tgcccaaagctcctgctagt

SEQ ID NO: 22436 - DNA, 24 bp, Artificial Sequence
  Synthetic Construct
cagaggcctgagtttgtttagttg

SEQ ID NO: 22437 - DNA, 21 bp, Artificial Sequence
  Synthetic Construct
aggccagcctccacacatact

SEQ ID NO: 22438 - DNA, 22 bp, Artificial Sequence
  Synthetic Construct
gccattttgagagctgccctat

SEQ ID NO: 22439 - DNA, 25 bp, Artificial Sequence
  Synthetic Construct
cccacacaatcacaccttacctttc

SEQ ID NO: 22440 - DNA, 26 bp, Artificial Sequence
  Synthetic Construct
gggacttctgtttctcagagtagttc

SEQ ID NO: 22441 - DNA, 22 bp, Artificial Sequence
  Synthetic Construct
tgagaaggcaggagcagtgata

SEQ ID NO: 22442 - DNA, 24 bp, Artificial Sequence
  Synthetic Construct
gggtctgtatagccccatttcaca

SEQ ID NO: 22443 - DNA, 24 bp, Artificial Sequence
  Synthetic Construct
ggatgcacttaattcgcccaacaa

SEQ ID NO: 22444 - DNA, 22 bp, Artificial Sequence
  Synthetic Construct
gcaagttttggcttgagagctt

SEQ ID NO: 22445 - DNA, 24 bp, Artificial Sequence
  Synthetic Construct
gcactgtctgcttccttctagact

SEQ ID NO: 22446 - DNA, 20 bp, Artificial Sequence
  Synthetic Construct
gcgggcagtgatcattggaa

SEQ ID NO: 22447 - DNA, 26 bp, Artificial Sequence
  Synthetic Construct
ggtgagggtgaaatcaatagcagaag

SEQ ID NO: 22448 - DNA, 22 bp, Artificial Sequence
  Synthetic Construct
cacagacccaaaacgcaacaca

SEQ ID NO: 22449 - DNA, 24 bp, Artificial Sequence
  Synthetic Construct
gacctcctggattttctccctttg

SEQ ID NO: 22450 - DNA, 26 bp, Artificial Sequence
  Synthetic Construct
gcatgggaggggtagtctattagcaa

SEQ ID NO: 22451 - DNA, 25 bp, Artificial Sequence
  Synthetic Construct
gtggtggttaggacagttgaaccaa

SEQ ID NO: 22452 - DNA, 21 bp, Artificial Sequence
  Synthetic Construct
acagctacccctcccattaca

SEQ ID NO: 22453 - DNA, 25 bp, Artificial Sequence
  Synthetic Construct
ggacagttgttgacctaggctgcta

SEQ ID NO: 22454 - DNA, 23 bp, Artificial Sequence
  Synthetic Construct
ggggcagactgagtgtataggaa

SEQ ID NO: 22455 - DNA, 25 bp, Artificial Sequence
  Synthetic Construct
gccacatgacaacatgtagctggaa

SEQ ID NO: 22456 - DNA, 21 bp, Artificial Sequence
  Synthetic Construct
cctgactgggtcagctttcaa

SEQ ID NO: 22457 - DNA, 22 bp, Artificial Sequence
  Synthetic Construct
cctggtttccccttcatgcaaa

SEQ ID NO: 22458 - DNA, 23 bp, Artificial Sequence
  Synthetic Construct
ggaacacaggactggttcagaaa

SEQ ID NO: 22459 - DNA, 26 bp, Artificial Sequence
  Synthetic Construct
ccgctcttcagagtgactaccctaac

SEQ ID NO: 22460 - DNA, 23 bp, Artificial Sequence
  Synthetic Construct
tggtccttgtagatgggaagaca

SEQ ID NO: 22461 - DNA, 22 bp, Artificial Sequence
  Synthetic Construct
ccagaggacttcagccagttgt

SEQ ID NO: 22462 - DNA, 23 bp, Artificial Sequence
  Synthetic Construct
cctggccctcatagggagataga

SEQ ID NO: 22463 - DNA, 22 bp, Artificial Sequence
  Synthetic Construct
ctggctgcgtattttggcatgt

SEQ ID NO: 22464 - DNA, 28 bp, Artificial Sequence
  Synthetic Construct
ggcaaaactgttatggtgacaagacaga

SEQ ID NO: 22465 - DNA, 22 bp, Artificial Sequence
  Synthetic Construct
ggggcacaaaatgcaccacaga

SEQ ID NO: 22466 - DNA, 23 bp, Artificial Sequence
  Synthetic Construct
tggatggagttcaccactcaatg

SEQ ID NO: 22467 - DNA, 22 bp, Artificial Sequence
  Synthetic Construct
ccccggtttttcacagtacaga

SEQ ID NO: 22468 - DNA, 21 bp, Artificial Sequence
  Synthetic Construct
ccagacagacgccttccagtt

SEQ ID NO: 22469 - DNA, 30 bp, Artificial Sequence
  Synthetic Construct
cagcctcaaaatatattacagggaccatac

SEQ ID NO: 22470 - DNA, 20 bp, Artificial Sequence
  Synthetic Construct
gcgtgctccaaccagtcttg

SEQ ID NO: 22471 - DNA, 21 bp, Artificial Sequence
  Synthetic Construct
cgtgtgcaatctggagcatgt

SEQ ID NO: 22472 - DNA, 23 bp, Artificial Sequence
  Synthetic Construct
gggttcaagtcctcatcgtgtct

SEQ ID NO: 22473 - DNA, 25 bp, Artificial Sequence
  Synthetic Construct
tctgtgtctgacctttcacttttct

SEQ ID NO: 22474 - DNA, 27 bp, Artificial Sequence
  Synthetic Construct
cggtacagtgagtttctgcatagattt

SEQ ID NO: 22475 - DNA, 27 bp, Artificial Sequence
  Synthetic Construct
cctgctactaaagttactctcccattg

SEQ ID NO: 22476 - DNA, 25 bp, Artificial Sequence
  Synthetic Construct
agtccagggaaagcattgatgatag

SEQ ID NO: 22477 - DNA, 22 bp, Artificial Sequence
  Synthetic Construct
acccatcccacaaaaccagatg

SEQ ID NO: 22478 - DNA, 24 bp, Artificial Sequence
  Synthetic Construct
ccgactgtccagctttttcgtaag

SEQ ID NO: 22479 - DNA, 27 bp, Artificial Sequence
  Synthetic Construct
ggagcatcttttccaacactatgaatc

SEQ ID NO: 22480 - DNA, 23 bp, Artificial Sequence
  Synthetic Construct
acctaagccacagagtgcttatc

SEQ ID NO: 22481 - DNA, 23 bp, Artificial Sequence
  Synthetic Construct
cccaactgtgttctgcctacaag

SEQ ID NO: 22482 - DNA, 21 bp, Artificial Sequence
  Synthetic Construct
ctgcaggcagatcatcccaat

SEQ ID NO: 22483 - DNA, 22 bp, Artificial Sequence
  Synthetic Construct
ggagtagcaggtttccgtgatg

SEQ ID NO: 22484 - DNA, 23 bp, Artificial Sequence
  Synthetic Construct
gactggaacaggtaaggggaaag

SEQ ID NO: 22485 - DNA, 24 bp, Artificial Sequence
  Synthetic Construct
tcaattcagtcttcctgagtgcaa

SEQ ID NO: 22486 - DNA, 22 bp, Artificial Sequence
  Synthetic Construct
ccacagtcagtccagtctccaa

SEQ ID NO: 22487 - DNA, 26 bp, Artificial Sequence
  Synthetic Construct
ctcatagccaggattcacagatccat

SEQ ID NO: 22488 - DNA, 26 bp, Artificial Sequence
  Synthetic Construct
gacagtgcaggattgagtaaatgcaa

SEQ ID NO: 22489 - DNA, 22 bp, Artificial Sequence
  Synthetic Construct
gcaggtatgctggctggtgaaa

SEQ ID NO: 22490 - DNA, 27 bp, Artificial Sequence
  Synthetic Construct
gacaaatggctttgcatatccccatac

SEQ ID NO: 22491 - DNA, 24 bp, Artificial Sequence
  Synthetic Construct
accaacgggaaatcccagttaatc

SEQ ID NO: 22492 - DNA, 24 bp, Artificial Sequence
  Synthetic Construct
gctccaggcttgcttaggctagaa

SEQ ID NO: 22493 - DNA, 25 bp, Artificial Sequence
  Synthetic Construct
gcttggaaaggcagtaggaaagtgt

SEQ ID NO: 22494 - DNA, 24 bp, Artificial Sequence
  Synthetic Construct
tggccatgaaaggaggtacaattc

SEQ ID NO: 22495 - DNA, 20 bp, Artificial Sequence
  Synthetic Construct
gccgtgtgtttccagagctt

SEQ ID NO: 22496 - DNA, 25 bp, Artificial Sequence
  Synthetic Construct
gggacttattgtagccccttagtca

SEQ ID NO: 22497 - DNA, 21 bp, Artificial Sequence
  Synthetic Construct
ataggaggtgcgggcagattc

SEQ ID NO: 22498 - DNA, 23 bp, Artificial Sequence
  Synthetic Construct
aatgtgatgaggaagtggcatct

SEQ ID NO: 22499 - DNA, 22 bp, Artificial Sequence
  Synthetic Construct
ggaagggattaagtggcaggtt

SEQ ID NO: 22500 - DNA, 26 bp, Artificial Sequence
  Synthetic Construct
gcagacactgatatcccctacccatt

SEQ ID NO: 22501 - DNA, 27 bp, Artificial Sequence
  Synthetic Construct
ctccctcagctaagctatacagtcagt

SEQ ID NO: 22502 - DNA, 25 bp, Artificial Sequence
  Synthetic Construct
cctccaaagagtctgtccacaatga

SEQ ID NO: 22503 - DNA, 21 bp, Artificial Sequence
  Synthetic Construct
gccagcaccatggaagaggta

SEQ ID NO: 22504 - DNA, 27 bp, Artificial Sequence
  Synthetic Construct
gtcatggaatcctcttctttagccata

SEQ ID NO: 22505 - DNA, 21 bp, Artificial Sequence
  Synthetic Construct
actccaccaacctgccctttg

SEQ ID NO: 22506 - DNA, 24 bp, Artificial Sequence
  Synthetic Construct
agaaccgtggtcttcaaatagcat

SEQ ID NO: 22507 - DNA, 21 bp, Artificial Sequence
  Synthetic Construct
agcaagagttgaggggcattg

SEQ ID NO: 22508 - DNA, 20 bp, Artificial Sequence
  Synthetic Construct
cccactaacagcgccaagtt

SEQ ID NO: 22509 - DNA, 24 bp, Artificial Sequence
  Synthetic Construct
gactccttggctttcacaaagaga

SEQ ID NO: 22510 - DNA, 24 bp, Artificial Sequence
  Synthetic Construct
cagccgtgcataatttgggtgtag

SEQ ID NO: 22511 - DNA, 24 bp, Artificial Sequence
  Synthetic Construct
ccctcctgtatctcatccccattc

SEQ ID NO: 22512 - DNA, 21 bp, Artificial Sequence
  Synthetic Construct
caccatgccattttgctgtga

SEQ ID NO: 22513 - DNA, 27 bp, Artificial Sequence
  Synthetic Construct
cagacatgaagctcactgaaggtgtaa

SEQ ID NO: 22514 - DNA, 26 bp, Artificial Sequence
  Synthetic Construct
gcacagctaacatactcagtggtgaa

SEQ ID NO: 22515 - DNA, 24 bp, Artificial Sequence
  Synthetic Construct
cagagcctttgctcatcccactac

SEQ ID NO: 22516 - DNA, 22 bp, Artificial Sequence
  Synthetic Construct
gtgaatcccagcgggttacaag

SEQ ID NO: 22517 - DNA, 19 bp, Artificial Sequence
  Synthetic Construct
gcacgtgctggtgctcaga

SEQ ID NO: 22518 - DNA, 23 bp, Artificial Sequence
  Synthetic Construct
ccctactcccagccaatttccat

SEQ ID NO: 22519 - DNA, 24 bp, Artificial Sequence
  Synthetic Construct
gtctacacacacagcctcactatg

SEQ ID NO: 22520 - DNA, 26 bp, Artificial Sequence
  Synthetic Construct
ggcacatactgtactcttgcatgttg

SEQ ID NO: 22521 - DNA, 25 bp, Artificial Sequence
  Synthetic Construct
cctaatccacgatctcctcatctgt

SEQ ID NO: 22522 - DNA, 24 bp, Artificial Sequence
  Synthetic Construct
gcaattccctgaagatacctgcta

SEQ ID NO: 22523 - DNA, 23 bp, Artificial Sequence
  Synthetic Construct
cgggtacacaattgtccccagtt

SEQ ID NO: 22524 - DNA, 20 bp, Artificial Sequence
  Synthetic Construct
acttgggcgaggtggctaag

SEQ ID NO: 22525 - DNA, 24 bp, Artificial Sequence
  Synthetic Construct
tcactggtatgtctgggaaagttg

SEQ ID NO: 22526 - DNA, 24 bp, Artificial Sequence
  Synthetic Construct
gcacccaagtggagagggtaaatc

SEQ ID NO: 22527 - DNA, 23 bp, Artificial Sequence
  Synthetic Construct
cccaagaagctctctgtgctatg

SEQ ID NO: 22528 - DNA, 21 bp, Artificial Sequence
  Synthetic Construct
gctcctgcacaagcacagatg

SEQ ID NO: 22529 - DNA, 25 bp, Artificial Sequence
  Synthetic Construct
ctgaacacctccttgagtacagttc

SEQ ID NO: 22530 - DNA, 24 bp, Artificial Sequence
  Synthetic Construct
cccagtttgcaagaagcatgaaag

SEQ ID NO: 22531 - DNA, 27 bp, Artificial Sequence
  Synthetic Construct
ggttattccgtgttcttgatcttgctt

SEQ ID NO: 22532 - DNA, 21 bp, Artificial Sequence
  Synthetic Construct
gcagtggcagaagggcatttg

SEQ ID NO: 22533 - DNA, 25 bp, Artificial Sequence
  Synthetic Construct
ctcctctaagaaactaagggcaaca

SEQ ID NO: 22534 - DNA, 23 bp, Artificial Sequence
  Synthetic Construct
cgctaggttgtgtactgggaaca

SEQ ID NO: 22535 - DNA, 26 bp, Artificial Sequence
  Synthetic Construct
gcccatagcttgtcccattgactgtt

SEQ ID NO: 22536 - DNA, 30 bp, Artificial Sequence
  Synthetic Construct
ccctaagctttaccttagatggagagaaag

SEQ ID NO: 22537 - DNA, 25 bp, Artificial Sequence
  Synthetic Construct
cacactggaaccaaagacctttatc

SEQ ID NO: 22538 - DNA, 24 bp, Artificial Sequence
  Synthetic Construct
gggctgagtaacaagagtggttct

SEQ ID NO: 22539 - DNA, 25 bp, Artificial Sequence
  Synthetic Construct
ggtttccctgtagcttaagaaccat

SEQ ID NO: 22540 - DNA, 24 bp, Artificial Sequence
  Synthetic Construct
ggtggagaatgacaacatgcagaa

SEQ ID NO: 22541 - DNA, 24 bp, Artificial Sequence
  Synthetic Construct
accagtgggattgatgagacaaaa

SEQ ID NO: 22542 - DNA, 22 bp, Artificial Sequence
  Synthetic Construct
ccacagagcctagcaaggtgtt

SEQ ID NO: 22543 - DNA, 22 bp, Artificial Sequence
  Synthetic Construct
cccttctgtgcaatgggacttg

SEQ ID NO: 22544 - DNA, 20 bp, Artificial Sequence
  Synthetic Construct
tgttggcttctgcagtgtga

SEQ ID NO: 22545 - DNA, 26 bp, Artificial Sequence
  Synthetic Construct
ccaactgagaacttgcttcccaaaag

SEQ ID NO: 22546 - DNA, 22 bp, Artificial Sequence
  Synthetic Construct
ctgcccaggcttttgacttttg

SEQ ID NO: 22547 - DNA, 23 bp, Artificial Sequence
  Synthetic Construct
gtgaaagctagcatctggggttt

SEQ ID NO: 22548 - DNA, 25 bp, Artificial Sequence
  Synthetic Construct
caaaatcctggggatacagactctt

SEQ ID NO: 22549 - DNA, 22 bp, Artificial Sequence
  Synthetic Construct
gaacccactggaatacgtcctt

SEQ ID NO: 22550 - DNA, 23 bp, Artificial Sequence
  Synthetic Construct
gacatgatctgacccttgacaca

SEQ ID NO: 22551 - DNA, 22 bp, Artificial Sequence
  Synthetic Construct
agggagcttagaggaaggtcaa

SEQ ID NO: 22552 - DNA, 22 bp, Artificial Sequence
  Synthetic Construct
cagccacattccagagccaatc

SEQ ID NO: 22553 - DNA, 25 bp, Artificial Sequence
  Synthetic Construct
gtgtgtgtgggctttatgaagaaaa

SEQ ID NO: 22554 - DNA, 24 bp, Artificial Sequence
  Synthetic Construct
gaagtgaagaagagtggtcagcta

SEQ ID NO: 22555 - DNA, 24 bp, Artificial Sequence
  Synthetic Construct
accatggtttccttgtcagcataa

SEQ ID NO: 22556 - DNA, 26 bp, Artificial Sequence
  Synthetic Construct
gaaatcagcttctctctcactcagtt

SEQ ID NO: 22557 - DNA, 25 bp, Artificial Sequence
  Synthetic Construct
tgtggtagaagagttgtctccattg

SEQ ID NO: 22558 - DNA, 23 bp, Artificial Sequence
  Synthetic Construct
gcctagcttcaagagctccttct

SEQ ID NO: 22559 - DNA, 22 bp, Artificial Sequence
  Synthetic Construct
gtggcttacccaccagcaaact

SEQ ID NO: 22560 - DNA, 22 bp, Artificial Sequence
  Synthetic Construct
ctgagtgttctggggctagttt

SEQ ID NO: 22561 - DNA, 24 bp, Artificial Sequence
  Synthetic Construct
cagagggctagtgtatctccaaga

SEQ ID NO: 22562 - DNA, 23 bp, Artificial Sequence
  Synthetic Construct
gtctctgggcttaatgtgcaagt

SEQ ID NO: 22563 - DNA, 26 bp, Artificial Sequence
  Synthetic Construct
cacagtggacttgtttgttcttgagt

SEQ ID NO: 22564 - DNA, 26 bp, Artificial Sequence
  Synthetic Construct
gctccatttatgttcccattgtgtct

SEQ ID NO: 22565 - DNA, 26 bp, Artificial Sequence
  Synthetic Construct
gcttatttggtaacgactaggcagat

SEQ ID NO: 22566 - DNA, 22 bp, Artificial Sequence
  Synthetic Construct
tctccagagcctttgcttccta

SEQ ID NO: 22567 - DNA, 24 bp, Artificial Sequence
  Synthetic Construct
ccaccagcattcaagtgcaatgta

SEQ ID NO: 22568 - DNA, 22 bp, Artificial Sequence
  Synthetic Construct
accttccaggtctcagctctct

SEQ ID NO: 22569 - DNA, 24 bp, Artificial Sequence
  Synthetic Construct
cacccttgagacaatgggttgtag

SEQ ID NO: 22570 - DNA, 25 bp, Artificial Sequence
  Synthetic Construct
ggacatggaaagattgggacaggtt

SEQ ID NO: 22571 - DNA, 21 bp, Artificial Sequence
  Synthetic Construct
ccagtgtcagctgggttttgt

SEQ ID NO: 22572 - DNA, 25 bp, Artificial Sequence
  Synthetic Construct
aggtaaaggggtggaaaaagacatc

SEQ ID NO: 22573 - DNA, 27 bp, Artificial Sequence
  Synthetic Construct
ccttctaacaccccttctctgtgagat

SEQ ID NO: 22574 - DNA, 23 bp, Artificial Sequence
  Synthetic Construct
gagtgaagaccagcagacagaag

SEQ ID NO: 22575 - DNA, 25 bp, Artificial Sequence
  Synthetic Construct
ggtggaaccaaagaagaaagggttt

SEQ ID NO: 22576 - DNA, 22 bp, Artificial Sequence
  Synthetic Construct
gctgccacctaggaaacaaagt

SEQ ID NO: 22577 - DNA, 21 bp, Artificial Sequence
  Synthetic Construct
ggggacatcgtggtcttgcat

SEQ ID NO: 22578 - DNA, 24 bp, Artificial Sequence
  Synthetic Construct
gccacttgcaaagaacacttttgt

SEQ ID NO: 22579 - DNA, 20 bp, Artificial Sequence
  Synthetic Construct
gcctttctgcctggctcttg

SEQ ID NO: 22580 - DNA, 25 bp, Artificial Sequence
  Synthetic Construct
ggaccatttagactcactgccatca

SEQ ID NO: 22581 - DNA, 27 bp, Artificial Sequence
  Synthetic Construct
acccgtgtattatgactttcagagttc

SEQ ID NO: 22582 - DNA, 24 bp, Artificial Sequence
  Synthetic Construct
tggggaggtaaccaaatcttttga

SEQ ID NO: 22583 - DNA, 21 bp, Artificial Sequence
  Synthetic Construct
ccaaggacttgggacgacttt

SEQ ID NO: 22584 - DNA, 22 bp, Artificial Sequence
  Synthetic Construct
gacgttgctgtgtcctttgctt

SEQ ID NO: 22585 - DNA, 25 bp, Artificial Sequence
  Synthetic Construct
gccactggatagcatcattggatct

SEQ ID NO: 22586 - DNA, 26 bp, Artificial Sequence
  Synthetic Construct
ccgcttccataacctggagataccta

SEQ ID NO: 22587 - DNA, 24 bp, Artificial Sequence
  Synthetic Construct
cccctctattcaaggctatgttgt

SEQ ID NO: 22588 - DNA, 21 bp, Artificial Sequence
  Synthetic Construct
catgccgaacagccttctttc

SEQ ID NO: 22589 - DNA, 24 bp, Artificial Sequence
  Synthetic Construct
cctgaggggaggtaggaggaaaaa

SEQ ID NO: 22590 - DNA, 23 bp, Artificial Sequence
  Synthetic Construct
tgaagcctcagatcctagagtca

SEQ ID NO: 22591 - DNA, 27 bp, Artificial Sequence
  Synthetic Construct
gggcatctaacaactacccatgcattt

SEQ ID NO: 22592 - DNA, 24 bp, Artificial Sequence
  Synthetic Construct
gagagccatcacattctggtcttc

SEQ ID NO: 22593 - DNA, 25 bp, Artificial Sequence
  Synthetic Construct
gaatccacccattcaaggaaagaag

SEQ ID NO: 22594 - DNA, 24 bp, Artificial Sequence
  Synthetic Construct
ggcagtagtgctccaaatatgcta

SEQ ID NO: 22595 - DNA, 23 bp, Artificial Sequence
  Synthetic Construct
tggctacagacaagtgaggatga

SEQ ID NO: 22596 - DNA, 24 bp, Artificial Sequence
  Synthetic Construct
actcaaagcaaaagagggacaact

SEQ ID NO: 22597 - DNA, 21 bp, Artificial Sequence
  Synthetic Construct
acacatggggtctcaggaact

SEQ ID NO: 22598 - DNA, 27 bp, Artificial Sequence
  Synthetic Construct
cctcactagaccttaactgggatgact

SEQ ID NO: 22599 - DNA, 26 bp, Artificial Sequence
  Synthetic Construct
gccatccttgcttgtatccttctctt

SEQ ID NO: 22600 - DNA, 24 bp, Artificial Sequence
  Synthetic Construct
ctgagtcacacagtccattgaaac

SEQ ID NO: 22601 - DNA, 22 bp, Artificial Sequence
  Synthetic Construct
tgctgacagccctcctaagcta

SEQ ID NO: 22602 - DNA, 26 bp, Artificial Sequence
  Synthetic Construct
gcctccattgtctctctcctggataa

SEQ ID NO: 22603 - DNA, 22 bp, Artificial Sequence
  Synthetic Construct
ggccggagaaaggtttggcatt

SEQ ID NO: 22604 - DNA, 27 bp, Artificial Sequence
  Synthetic Construct
gccaccaattcctttggatgatccttt

SEQ ID NO: 22605 - DNA, 23 bp, Artificial Sequence
  Synthetic Construct
tccattccatgttggagcaaaac

SEQ ID NO: 22606 - DNA, 24 bp, Artificial Sequence
  Synthetic Construct
tgagtaggaatggcaacagctaat

SEQ ID NO: 22607 - DNA, 21 bp, Artificial Sequence
  Synthetic Construct
cccattcagtggggtttcgtt

SEQ ID NO: 22608 - DNA, 25 bp, Artificial Sequence
  Synthetic Construct
cggcacagagtggttaagaataaga

SEQ ID NO: 22609 - DNA, 27 bp, Artificial Sequence
  Synthetic Construct
gcatcagaactcatagacacttgattg

SEQ ID NO: 22610 - DNA, 26 bp, Artificial Sequence
  Synthetic Construct
gtggcatggaagaatcatgtgcttag

SEQ ID NO: 22611 - DNA, 22 bp, Artificial Sequence
  Synthetic Construct
accttctcatagcccagtctgt

SEQ ID NO: 22612 - DNA, 25 bp, Artificial Sequence
  Synthetic Construct
gctcttaaatagctcacacgctagt

SEQ ID NO: 22613 - DNA, 23 bp, Artificial Sequence
  Synthetic Construct
cgtttgtggaatggctcaagatt

SEQ ID NO: 22614 - DNA, 21 bp, Artificial Sequence
  Synthetic Construct
tccccaccttgagtgctcagt

SEQ ID NO: 22615 - DNA, 25 bp, Artificial Sequence
  Synthetic Construct
gctctatacattgtggtgcctgcaa

SEQ ID NO: 22616 - DNA, 24 bp, Artificial Sequence
  Synthetic Construct
gagtatgggatcaggtccatgtca

SEQ ID NO: 22617 - DNA, 27 bp, Artificial Sequence
  Synthetic Construct
ggcaaaccctacattctgtgtaaaaac

SEQ ID NO: 22618 - DNA, 23 bp, Artificial Sequence
  Synthetic Construct
gctggtgactggttcatcctaga

SEQ ID NO: 22619 - DNA, 20 bp, Artificial Sequence
  Synthetic Construct
gcgtgctagccaaactgttg

SEQ ID NO: 22620 - DNA, 22 bp, Artificial Sequence
  Synthetic Construct
ggttgggaagactgtgggacaa

SEQ ID NO: 22621 - DNA, 25 bp, Artificial Sequence
  Synthetic Construct
ccaagtggtggcaattacaggacta

SEQ ID NO: 22622 - DNA, 21 bp, Artificial Sequence
  Synthetic Construct
tggtcactcagggtgggtaag

SEQ ID NO: 22623 - DNA, 20 bp, Artificial Sequence
  Synthetic Construct
acacactccccaccccaaac

SEQ ID NO: 22624 - DNA, 22 bp, Artificial Sequence
  Synthetic Construct
gcttcccactctgcccatcaat

SEQ ID NO: 22625 - DNA, 23 bp, Artificial Sequence
  Synthetic Construct
caccaccgtagatccaaaagtgt

SEQ ID NO: 22626 - DNA, 21 bp, Artificial Sequence
  Synthetic Construct
ggtgctattgctccctgttca

SEQ ID NO: 22627 - DNA, 23 bp, Artificial Sequence
  Synthetic Construct
gaacctctccttttacggtgcaa

SEQ ID NO: 22628 - DNA, 24 bp, Artificial Sequence
  Synthetic Construct
ctctctggccaggtgacattgtag

SEQ ID NO: 22629 - DNA, 23 bp, Artificial Sequence
  Synthetic Construct
gctcaaaaccggcattgatggta

SEQ ID NO: 22630 - DNA, 20 bp, Artificial Sequence
  Synthetic Construct
tcaaccaaccagcggtcaga

SEQ ID NO: 22631 - DNA, 23 bp, Artificial Sequence
  Synthetic Construct
gagtttccgtcacaacgttcctt

SEQ ID NO: 22632 - DNA, 23 bp, Artificial Sequence
  Synthetic Construct
agggagggagttattgtgctact

SEQ ID NO: 22633 - DNA, 22 bp, Artificial Sequence
  Synthetic Construct
gaagctgggttgaagtgctttg

SEQ ID NO: 22634 - DNA, 25 bp, Artificial Sequence
  Synthetic Construct
ggagagttatcaatgagccttctgt

SEQ ID NO: 22635 - DNA, 21 bp, Artificial Sequence
  Synthetic Construct
tggcaaagtgagaacctgcat

SEQ ID NO: 22636 - DNA, 23 bp, Artificial Sequence
  Synthetic Construct
cgtgtgtcctggaagagatggaa

SEQ ID NO: 22637 - DNA, 25 bp, Artificial Sequence
  Synthetic Construct
gagagacagcaattctggggaacat

SEQ ID NO: 22638 - DNA, 22 bp, Artificial Sequence
  Synthetic Construct
agggttggactaggggaagtga

SEQ ID NO: 22639 - DNA, 25 bp, Artificial Sequence
  Synthetic Construct
ggtttctccctgaaatcgtgtgtga

SEQ ID NO: 22640 - DNA, 22 bp, Artificial Sequence
  Synthetic Construct
ctgcaccttggcaacactttga

SEQ ID NO: 22641 - DNA, 23 bp, Artificial Sequence
  Synthetic Construct
ggaccccaggattgaggagacaa

SEQ ID NO: 22642 - DNA, 19 bp, Artificial Sequence
  Synthetic Construct
tgcacatgcgctcttctca

SEQ ID NO: 22643 - DNA, 26 bp, Artificial Sequence
  Synthetic Construct
ctcactaaacttttccccagaactca

SEQ ID NO: 22644 - DNA, 24 bp, Artificial Sequence
  Synthetic Construct
cctctgaagggagactgaaacaac

SEQ ID NO: 22645 - DNA, 20 bp, Artificial Sequence
  Synthetic Construct
gcaagaatgcttggctgcaa

SEQ ID NO: 22646 - DNA, 21 bp, Artificial Sequence
  Synthetic Construct
gtggcatttcactgccctttg

SEQ ID NO: 22647 - DNA, 23 bp, Artificial Sequence
  Synthetic Construct
gcagcttgttcaattgtggttca

SEQ ID NO: 22648 - DNA, 26 bp, Artificial Sequence
  Synthetic Construct
gtgaggatgagttttcagtggctatc

SEQ ID NO: 22649 - DNA, 27 bp, Artificial Sequence
  Synthetic Construct
ccctggacaaaatgtaacagccaaagt

SEQ ID NO: 22650 - DNA, 24 bp, Artificial Sequence
  Synthetic Construct
acctagctatccttccagcatttc

SEQ ID NO: 22651 - DNA, 23 bp, Artificial Sequence
  Synthetic Construct
gctggacaaactactgcctcttc

SEQ ID NO: 22652 - DNA, 22 bp, Artificial Sequence
  Synthetic Construct
gccaatagctgcttgatgcaat

SEQ ID NO: 22653 - DNA, 22 bp, Artificial Sequence
  Synthetic Construct
tagttgcccgggattcccaaga

SEQ ID NO: 22654 - DNA, 20 bp, Artificial Sequence
  Synthetic Construct
gggagaggctggtcctgagt

SEQ ID NO: 22655 - DNA, 25 bp, Artificial Sequence
  Synthetic Construct
gtttgtgaaaggtcaatgtgaggaa

SEQ ID NO: 22656 - DNA, 22 bp, Artificial Sequence
  Synthetic Construct
tcctcgggagctcacaacctta

SEQ ID NO: 22657 - DNA, 20 bp, Artificial Sequence
  Synthetic Construct
tcccactgatgccagaccaa

SEQ ID NO: 22658 - DNA, 27 bp, Artificial Sequence
  Synthetic Construct
cccagcttaagcaaaatagggcaagta

SEQ ID NO: 22659 - DNA, 26 bp, Artificial Sequence
  Synthetic Construct
tggccagtagtaagttgagaagacta

SEQ ID NO: 22660 - DNA, 20 bp, Artificial Sequence
  Synthetic Construct
ccggaagcttcacgttctgt

SEQ ID NO: 22661 - DNA, 22 bp, Artificial Sequence
  Synthetic Construct
ggagggagagctccatctctga

SEQ ID NO: 22662 - DNA, 20 bp, Artificial Sequence
  Synthetic Construct
ccggcaataggactcagcaa

SEQ ID NO: 22663 - DNA, 21 bp, Artificial Sequence
  Synthetic Construct
tagggcaggtgtcctctgcat

SEQ ID NO: 22664 - DNA, 28 bp, Artificial Sequence
  Synthetic Construct
gtgaaccaagctatactacctgcttttc

SEQ ID NO: 22665 - DNA, 25 bp, Artificial Sequence
  Synthetic Construct
ggcttctgtgctcatagttcacact

SEQ ID NO: 22666 - DNA, 22 bp, Artificial Sequence
  Synthetic Construct
gggcacacggaggtgaaaaagt

SEQ ID NO: 22667 - DNA, 23 bp, Artificial Sequence
  Synthetic Construct
cgggagccgttataccagcttag

SEQ ID NO: 22668 - DNA, 23 bp, Artificial Sequence
  Synthetic Construct
gcttcctatgaccaagtcccttt

SEQ ID NO: 22669 - DNA, 20 bp, Artificial Sequence
  Synthetic Construct
gtgttggccagacccactgt

SEQ ID NO: 22670 - DNA, 23 bp, Artificial Sequence
  Synthetic Construct
gggcacttttgagttgggctttg

SEQ ID NO: 22671 - DNA, 21 bp, Artificial Sequence
  Synthetic Construct
gcagctcggtgcctaatggtt

SEQ ID NO: 22672 - DNA, 24 bp, Artificial Sequence
  Synthetic Construct
cagacctggcaggatcagaatagt

SEQ ID NO: 22673 - DNA, 22 bp, Artificial Sequence
  Synthetic Construct
tgcaatgcagaggagaaaggtt

SEQ ID NO: 22674 - DNA, 25 bp, Artificial Sequence
  Synthetic Construct
agtcacaggtatcctgactctcata

SEQ ID NO: 22675 - DNA, 22 bp, Artificial Sequence
  Synthetic Construct
ggagcaatcagccttgcagaga

SEQ ID NO: 22676 - DNA, 18 bp, Artificial Sequence
  Synthetic Construct
tggcgcccggaaaaccat

SEQ ID NO: 22677 - DNA, 22 bp, Artificial Sequence
  Synthetic Construct
ttcaagagcatccttgcgctat

SEQ ID NO: 22678 - DNA, 24 bp, Artificial Sequence
  Synthetic Construct
accttgagaaggtggtatttgtgt

SEQ ID NO: 22679 - DNA, 24 bp, Artificial Sequence
  Synthetic Construct
agaaagaccccaggtaagaaccat

SEQ ID NO: 22680 - DNA, 23 bp, Artificial Sequence
  Synthetic Construct
cactcacacatccacaggagaca

SEQ ID NO: 22681 - DNA, 23 bp, Artificial Sequence
  Synthetic Construct
gacgcagtatcccacagagcatt

SEQ ID NO: 22682 - DNA, 21 bp, Artificial Sequence
  Synthetic Construct
accagctctgagtcaggaagt

SEQ ID NO: 22683 - DNA, 22 bp, Artificial Sequence
  Synthetic Construct
cccacagtccgacgagtgtttt

SEQ ID NO: 22684 - DNA, 25 bp, Artificial Sequence
  Synthetic Construct
tcactccactttacaggcacatatt

SEQ ID NO: 22685 - DNA, 23 bp, Artificial Sequence
  Synthetic Construct
acgaggatcagacaagtcacaga

SEQ ID NO: 22686 - DNA, 23 bp, Artificial Sequence
  Synthetic Construct
cccatgaccccaggttggaattg

SEQ ID NO: 22687 - DNA, 21 bp, Artificial Sequence
  Synthetic Construct
cactctgtgcagttgctggtt

SEQ ID NO: 22688 - DNA, 22 bp, Artificial Sequence
  Synthetic Construct
gtctgtggagcacaccttggaa

SEQ ID NO: 22689 - DNA, 20 bp, Artificial Sequence
  Synthetic Construct
gcctttccactgagccatga

SEQ ID NO: 22690 - DNA, 23 bp, Artificial Sequence
  Synthetic Construct
cagcctggttggttagattctgt

SEQ ID NO: 22691 - DNA, 24 bp, Artificial Sequence
  Synthetic Construct
cttatgtgtggctttggcttcttg

SEQ ID NO: 22692 - DNA, 21 bp, Artificial Sequence
  Synthetic Construct
ggggctgaatcagacaaggaa

SEQ ID NO: 22693 - DNA, 20 bp, Artificial Sequence
  Synthetic Construct
cacagcttggaaggcctgaa

SEQ ID NO: 22694 - DNA, 24 bp, Artificial Sequence
  Synthetic Construct
ctcatgatgtcaaatgctgctcaa

SEQ ID NO: 22695 - DNA, 23 bp, Artificial Sequence
  Synthetic Construct
gttctggtgacagacaaccttct

SEQ ID NO: 22696 - DNA, 21 bp, Artificial Sequence
  Synthetic Construct
tgagcagcacagtccaattct

SEQ ID NO: 22697 - DNA, 23 bp, Artificial Sequence
  Synthetic Construct
cccctgggaaagttactgtcgat

SEQ ID NO: 22698 - DNA, 21 bp, Artificial Sequence
  Synthetic Construct
gtcagtgagctgccagttttc

SEQ ID NO: 22699 - DNA, 21 bp, Artificial Sequence
  Synthetic Construct
tcccaaatcctgagcctgtca

SEQ ID NO: 22700 - DNA, 28 bp, Artificial Sequence
  Synthetic Construct
gccaacctatagacacaactttggttac

SEQ ID NO: 22701 - DNA, 25 bp, Artificial Sequence
  Synthetic Construct
gttgacttccggcagtaagtgatga

SEQ ID NO: 22702 - DNA, 24 bp, Artificial Sequence
  Synthetic Construct
actgggacatttctcacgttatca

SEQ ID NO: 22703 - DNA, 23 bp, Artificial Sequence
  Synthetic Construct
ggaatccagcccatcctcacatc

SEQ ID NO: 22704 - DNA, 20 bp, Artificial Sequence
  Synthetic Construct
actgcaccaccacacggaaa

SEQ ID NO: 22705 - DNA, 22 bp, Artificial Sequence
  Synthetic Construct
ccttcaagggctttctctcaca

SEQ ID NO: 22706 - DNA, 24 bp, Artificial Sequence
  Synthetic Construct
acttccacatggcttaaacagaga

SEQ ID NO: 22707 - DNA, 25 bp, Artificial Sequence
  Synthetic Construct
tcgtgaagaagatggagaggagtta

SEQ ID NO: 22708 - DNA, 21 bp, Artificial Sequence
  Synthetic Construct
ctgggaccaacccatttcaca

SEQ ID NO: 22709 - DNA, 22 bp, Artificial Sequence
  Synthetic Construct
aaggaagtggggtatggactga

SEQ ID NO: 22710 - DNA, 24 bp, Artificial Sequence
  Synthetic Construct
tgttggccacatacattgttctca

SEQ ID NO: 22711 - DNA, 19 bp, Artificial Sequence
  Synthetic Construct
ctcctgccttcggggatgt

SEQ ID NO: 22712 - DNA, 21 bp, Artificial Sequence
  Synthetic Construct
cacaggccagagattcaccat

SEQ ID NO: 22713 - DNA, 21 bp, Artificial Sequence
  Synthetic Construct
tgggaagcctaccttgactct

SEQ ID NO: 22714 - DNA, 24 bp, Artificial Sequence
  Synthetic Construct
aagcccctgagaatctaaaagcaa

SEQ ID NO: 22715 - DNA, 19 bp, Artificial Sequence
  Synthetic Construct
cgacagggcctcccaattc

SEQ ID NO: 22716 - DNA, 24 bp, Artificial Sequence
  Synthetic Construct
aggtagacaccggaagtaatcaca

SEQ ID NO: 22717 - DNA, 22 bp, Artificial Sequence
  Synthetic Construct
tcaggtagaggtcgccaaggtt

SEQ ID NO: 22718 - DNA, 24 bp, Artificial Sequence
  Synthetic Construct
ggaggctatgagaagtgaggtttg

SEQ ID NO: 22719 - DNA, 23 bp, Artificial Sequence
  Synthetic Construct
gggcggttaaagagcttcagaga

SEQ ID NO: 22720 - DNA, 24 bp, Artificial Sequence
  Synthetic Construct
tggtcttctttatgcccaacaaac

SEQ ID NO: 22721 - DNA, 20 bp, Artificial Sequence
  Synthetic Construct
ctcacacgggctcacattct

SEQ ID NO: 22722 - DNA, 19 bp, Artificial Sequence
  Synthetic Construct
cctgctcaccgatgctcaa

SEQ ID NO: 22723 - DNA, 24 bp, Artificial Sequence
  Synthetic Construct
ggtcagaaacagagcctgtaaaac

SEQ ID NO: 22724 - DNA, 25 bp, Artificial Sequence
  Synthetic Construct
cctgagacagaagcagtagcgtctt

SEQ ID NO: 22725 - DNA, 20 bp, Artificial Sequence
  Synthetic Construct
cgcaaaatgggctcctgctt

SEQ ID NO: 22726 - DNA, 22 bp, Artificial Sequence
  Synthetic Construct
gccggattaggggtgaactttg

SEQ ID NO: 22727 - DNA, 24 bp, Artificial Sequence
  Synthetic Construct
ggaggtattctggcttccctaaga

SEQ ID NO: 22728 - DNA, 26 bp, Artificial Sequence
  Synthetic Construct
ggaagggtgagtttagcacaatggtt

SEQ ID NO: 22729 - DNA, 22 bp, Artificial Sequence
  Synthetic Construct
cccacttgcacaaatgcaaaga

SEQ ID NO: 22730 - DNA, 21 bp, Artificial Sequence
  Synthetic Construct
agctgtggttttcctgtgtca

SEQ ID NO: 22731 - DNA, 24 bp, Artificial Sequence
  Synthetic Construct
tgtgtgtgtttagcaagggatttc

SEQ ID NO: 22732 - DNA, 21 bp, Artificial Sequence
  Synthetic Construct
cgtttggcaacggagatgtgt

SEQ ID NO: 22733 - DNA, 22 bp, Artificial Sequence
  Synthetic Construct
tgcccacccttttcttttgctt

SEQ ID NO: 22734 - DNA, 23 bp, Artificial Sequence
  Synthetic Construct
gggctatacatttctgggctcaa

SEQ ID NO: 22735 - DNA, 22 bp, Artificial Sequence
  Synthetic Construct
tacattcccctctcccgcaaca

SEQ ID NO: 22736 - DNA, 25 bp, Artificial Sequence
  Synthetic Construct
ccagccaatcaggatcatggacaga

SEQ ID NO: 22737 - DNA, 20 bp, Artificial Sequence
  Synthetic Construct
ggcccatgactctgctggat

SEQ ID NO: 22738 - DNA, 19 bp, Artificial Sequence
  Synthetic Construct
ggaggcatctccggctaca

SEQ ID NO: 22739 - DNA, 24 bp, Artificial Sequence
  Synthetic Construct
agtgcaaggttggagaatgaaaag

SEQ ID NO: 22740 - DNA, 22 bp, Artificial Sequence
  Synthetic Construct
cgagttggcctcgtcttaccaa

SEQ ID NO: 22741 - DNA, 22 bp, Artificial Sequence
  Synthetic Construct
cgtggcagctggctttagaatc

SEQ ID NO: 22742 - DNA, 22 bp, Artificial Sequence
  Synthetic Construct
tggtgcagccacctctcttatc

SEQ ID NO: 22743 - DNA, 21 bp, Artificial Sequence
  Synthetic Construct
ctctggcacatgcgttagttg

SEQ ID NO: 22744 - DNA, 24 bp, Artificial Sequence
  Synthetic Construct
ggggctttggataacaccaaggta

SEQ ID NO: 22745 - DNA, 20 bp, Artificial Sequence
  Synthetic Construct
ttgcaacccctccgacattc

SEQ ID NO: 22746 - DNA, 21 bp, Artificial Sequence
  Synthetic Construct
aggagaagttcaggggaccaa

SEQ ID NO: 22747 - DNA, 24 bp, Artificial Sequence
  Synthetic Construct
agagctgctatcatgatgtggaaa

SEQ ID NO: 22748 - DNA, 21 bp, Artificial Sequence
  Synthetic Construct
agggtgagtctggaagaggtt

SEQ ID NO: 22749 - DNA, 22 bp, Artificial Sequence
  Synthetic Construct
ccccactcccctcaaggtatgt

SEQ ID NO: 22750 - DNA, 22 bp, Artificial Sequence
  Synthetic Construct
gtcaccctctgaggtacacact

SEQ ID NO: 22751 - DNA, 23 bp, Artificial Sequence
  Synthetic Construct
atgacaacatcacggacagagaa

SEQ ID NO: 22752 - DNA, 22 bp, Artificial Sequence
  Synthetic Construct
tgacaaatgccgaagggattct

SEQ ID NO: 22753 - DNA, 24 bp, Artificial Sequence
  Synthetic Construct
ctatgtttcagccacaccacattc

SEQ ID NO: 22754 - DNA, 23 bp, Artificial Sequence
  Synthetic Construct
caggcttgttcgggaaatacaag

SEQ ID NO: 22755 - DNA, 20 bp, Artificial Sequence
  Synthetic Construct
gccgaggtttcaaggtccaa

SEQ ID NO: 22756 - DNA, 22 bp, Artificial Sequence
  Synthetic Construct
tgctcaactcaaacaggacact

SEQ ID NO: 22757 - DNA, 18 bp, Artificial Sequence
  Synthetic Construct
tgcggcgatgtggctgta

SEQ ID NO: 22758 - DNA, 23 bp, Artificial Sequence
  Synthetic Construct
cagagggtggatggatacagttc

SEQ ID NO: 22759 - DNA, 19 bp, Artificial Sequence
  Synthetic Construct
cgtggcctcctgcactgat

SEQ ID NO: 22760 - DNA, 21 bp, Artificial Sequence
  Synthetic Construct
gtgcaggctcaagttgcttct

SEQ ID NO: 22761 - DNA, 24 bp, Artificial Sequence
  Synthetic Construct
gcttgcttggaaccgattttggat

SEQ ID NO: 22762 - DNA, 19 bp, Artificial Sequence
  Synthetic Construct
ggcgggaccgagtgcttta

SEQ ID NO: 22763 - DNA, 26 bp, Artificial Sequence
  Synthetic Construct
cctcaattactccccagatgttcaga

SEQ ID NO: 22764 - DNA, 22 bp, Artificial Sequence
  Synthetic Construct
tcagcaggaggaaggatgtttg

SEQ ID NO: 22765 - DNA, 20 bp, Artificial Sequence
  Synthetic Construct
accttccggccatgtgtgaa

SEQ ID NO: 22766 - DNA, 26 bp, Artificial Sequence
  Synthetic Construct
caaatctgctctgtctatgctaggaa

SEQ ID NO: 22767 - DNA, 22 bp, Artificial Sequence
  Synthetic Construct
agctcctgacattatgcccaaa

SEQ ID NO: 22768 - DNA, 24 bp, Artificial Sequence
  Synthetic Construct
gggaaagccagacatcctctccta

SEQ ID NO: 22769 - DNA, 22 bp, Artificial Sequence
  Synthetic Construct
gcccaggtagaggaacaaatca

SEQ ID NO: 22770 - DNA, 26 bp, Artificial Sequence
  Synthetic Construct
ggagaatatcaagctgtcatgggatt

SEQ ID NO: 22771 - DNA, 23 bp, Artificial Sequence
  Synthetic Construct
ccaaacgaggccctctctcttct

SEQ ID NO: 22772 - DNA, 20 bp, Artificial Sequence
  Synthetic Construct
gcccagaagagtgcttgaca

SEQ ID NO: 22773 - DNA, 24 bp, Artificial Sequence
  Synthetic Construct
ggcagtccttaactcctggttttc

SEQ ID NO: 22774 - DNA, 23 bp, Artificial Sequence
  Synthetic Construct
ccagcacattcagtccagaatca

SEQ ID NO: 22775 - DNA, 20 bp, Artificial Sequence
  Synthetic Construct
cagccaagtgcagactggaa

SEQ ID NO: 22776 - DNA, 22 bp, Artificial Sequence
  Synthetic Construct
tcctggcaaatcttgcacaaag

SEQ ID NO: 22777 - DNA, 26 bp, Artificial Sequence
  Synthetic Construct
gtgggattacattcacagatgcagaa

SEQ ID NO: 22778 - DNA, 22 bp, Artificial Sequence
  Synthetic Construct
agaccttcacctctgccacagt

SEQ ID NO: 22779 - DNA, 22 bp, Artificial Sequence
  Synthetic Construct
ggaacaggagaagagcaaggaa

SEQ ID NO: 22780 - DNA, 24 bp, Artificial Sequence
  Synthetic Construct
actgatgctaccaaagaggctaga

SEQ ID NO: 22781 - DNA, 20 bp, Artificial Sequence
  Synthetic Construct
cacaaccgctttccccttga

SEQ ID NO: 22782 - DNA, 22 bp, Artificial Sequence
  Synthetic Construct
gggagacactgcaggacaaagt

SEQ ID NO: 22783 - DNA, 21 bp, Artificial Sequence
  Synthetic Construct
gtgcctgagagtttcctggtt

SEQ ID NO: 22784 - DNA, 22 bp, Artificial Sequence
  Synthetic Construct
cacagtgctgtagttgcctgtt

SEQ ID NO: 22785 - DNA, 23 bp, Artificial Sequence
  Synthetic Construct
gccacaatctaggacctgcagaa

SEQ ID NO: 22786 - DNA, 23 bp, Artificial Sequence
  Synthetic Construct
tttctgccctagttcaggtcatc

SEQ ID NO: 22787 - DNA, 29 bp, Artificial Sequence
  Synthetic Construct
ccttgaagatgcaacagacattcttctac

SEQ ID NO: 22788 - DNA, 18 bp, Artificial Sequence
  Synthetic Construct
ggatgcaggcaggcaagt

SEQ ID NO: 22789 - DNA, 24 bp, Artificial Sequence
  Synthetic Construct
gtgctagagagcgaaatacctgtt

SEQ ID NO: 22790 - DNA, 24 bp, Artificial Sequence
  Synthetic Construct
ccacagaactcccactcgaataag

SEQ ID NO: 22791 - DNA, 21 bp, Artificial Sequence
  Synthetic Construct
ccccagaccaatccgaagtgt

SEQ ID NO: 22792 - DNA, 21 bp, Artificial Sequence
  Synthetic Construct
aagcaacccagttccttccaa

SEQ ID NO: 22793 - DNA, 21 bp, Artificial Sequence
  Synthetic Construct
cagctgctgcctcatttgcat

SEQ ID NO: 22794 - DNA, 23 bp, Artificial Sequence
  Synthetic Construct
aatggtagcctttgagacgatgt

SEQ ID NO: 22795 - DNA, 24 bp, Artificial Sequence
  Synthetic Construct
gccccttcttttctatgaggatgt

SEQ ID NO: 22796 - DNA, 22 bp, Artificial Sequence
  Synthetic Construct
agcatgggaaccagtgttcatc

SEQ ID NO: 22797 - DNA, 21 bp, Artificial Sequence
  Synthetic Construct
tgacaggacgaggagactcaa

SEQ ID NO: 22798 - DNA, 23 bp, Artificial Sequence
  Synthetic Construct
tctgccttgcagagttacagaat

SEQ ID NO: 22799 - DNA, 23 bp, Artificial Sequence
  Synthetic Construct
aaccttttcgctacccatgtact

SEQ ID NO: 22800 - DNA, 21 bp, Artificial Sequence
  Synthetic Construct
ccgagctcgtctgggtttgaa

SEQ ID NO: 22801 - DNA, 20 bp, Artificial Sequence
  Synthetic Construct
ctatctgcccgcatcacctt

SEQ ID NO: 22802 - DNA, 19 bp, Artificial Sequence
  Synthetic Construct
cgacggctcggagagaatc

SEQ ID NO: 22803 - DNA, 20 bp, Artificial Sequence
  Synthetic Construct
cccacgggtttgggtagctt

SEQ ID NO: 22804 - DNA, 24 bp, Artificial Sequence
  Synthetic Construct
cttgaccttgctctagcagttttg

SEQ ID NO: 22805 - DNA, 22 bp, Artificial Sequence
  Synthetic Construct
ctcacgtagtctccaccgtcat

SEQ ID NO: 22806 - DNA, 22 bp, Artificial Sequence
  Synthetic Construct
aaccctttcaaccctccacatt

SEQ ID NO: 22807 - DNA, 21 bp, Artificial Sequence
  Synthetic Construct
agttctcaggccaccttgttc

SEQ ID NO: 22808 - DNA, 19 bp, Artificial Sequence
  Synthetic Construct
cccgcaggactgagcacaa

SEQ ID NO: 22809 - DNA, 21 bp, Artificial Sequence
  Synthetic Construct
catccaggcacaccgttaaga

SEQ ID NO: 22810 - DNA, 20 bp, Artificial Sequence
  Synthetic Construct
tcgggagcacgtttgcagat

SEQ ID NO: 22811 - DNA, 22 bp, Artificial Sequence
  Synthetic Construct
ggttgctctcacgggaataaga

SEQ ID NO: 22812 - DNA, 23 bp, Artificial Sequence
  Synthetic Construct
ccggtaaacccaatccaaacaaa

SEQ ID NO: 22813 - DNA, 18 bp, Artificial Sequence
  Synthetic Construct
tgcacactgcgtcagctt

SEQ ID NO: 22814 - DNA, 27 bp, Artificial Sequence
  Synthetic Construct
gcatgcttcacaaacattatcccattc

SEQ ID NO: 22815 - DNA, 22 bp, Artificial Sequence
  Synthetic Construct
gggcatccaaggagagaagaga

SEQ ID NO: 22816 - DNA, 21 bp, Artificial Sequence
  Synthetic Construct
tgtcagcctggcttctgtaag

SEQ ID NO: 22817 - DNA, 21 bp, Artificial Sequence
  Synthetic Construct
tgagctggcctggtgaaatag

SEQ ID NO: 22818 - DNA, 25 bp, Artificial Sequence
  Synthetic Construct
acctcaccttctaattctggactgt

SEQ ID NO: 22819 - DNA, 22 bp, Artificial Sequence
  Synthetic Construct
cgtgacagctaatcacccacat

SEQ ID NO: 22820 - DNA, 24 bp, Artificial Sequence
  Synthetic Construct
ggaacacctctccctcaattcttt

SEQ ID NO: 22821 - DNA, 23 bp, Artificial Sequence
  Synthetic Construct
ccttggcagagggagatttgaga

SEQ ID NO: 22822 - DNA, 20 bp, Artificial Sequence
  Synthetic Construct
gtgaagcgtcctcctgttga

SEQ ID NO: 22823 - DNA, 25 bp, Artificial Sequence
  Synthetic Construct
ccagactagccgaattttccaggat

SEQ ID NO: 22824 - DNA, 24 bp, Artificial Sequence
  Synthetic Construct
tctggagaaagtgacagggtaaga

SEQ ID NO: 22825 - DNA, 25 bp, Artificial Sequence
  Synthetic Construct
gaaaggctgggtatttttgaaccaa

SEQ ID NO: 22826 - DNA, 24 bp, Artificial Sequence
  Synthetic Construct
cacaacctcacattctccaggtta

SEQ ID NO: 22827 - DNA, 22 bp, Artificial Sequence
  Synthetic Construct
gagcccacgtatcagctcaaca

SEQ ID NO: 22828 - DNA, 22 bp, Artificial Sequence
  Synthetic Construct
actgcaacctttttgcctgaga

SEQ ID NO: 22829 - DNA, 20 bp, Artificial Sequence
  Synthetic Construct
tctcaccgcttggtcagagt

SEQ ID NO: 22830 - DNA, 21 bp, Artificial Sequence
  Synthetic Construct
tctccagccctcagtccttct

SEQ ID NO: 22831 - DNA, 21 bp, Artificial Sequence
  Synthetic Construct
tgagaggtcaccacacacaga

SEQ ID NO: 22832 - DNA, 25 bp, Artificial Sequence
  Synthetic Construct
tcatcccagcatcatttgttgagaa

SEQ ID NO: 22833 - DNA, 22 bp, Artificial Sequence
  Synthetic Construct
ccgcctctccacctttgaactt

SEQ ID NO: 22834 - DNA, 25 bp, Artificial Sequence
  Synthetic Construct
cgacaatttaaggcgagacatggaa

SEQ ID NO: 22835 - DNA, 21 bp, Artificial Sequence
  Synthetic Construct
gcacattgccaccgtccagat

SEQ ID NO: 22836 - DNA, 21 bp, Artificial Sequence
  Synthetic Construct
cccatccttcaagtcgtggtt

SEQ ID NO: 22837 - DNA, 22 bp, Artificial Sequence
  Synthetic Construct
acccggtggagtcaggatttga

SEQ ID NO: 22838 - DNA, 21 bp, Artificial Sequence
  Synthetic Construct
tggatgggttggcttggtact

SEQ ID NO: 22839 - DNA, 23 bp, Artificial Sequence
  Synthetic Construct
gctgtgtatttgttgagccttgt

SEQ ID NO: 22840 - DNA, 25 bp, Artificial Sequence
  Synthetic Construct
ggggtgaggtactgcagttaaacat

SEQ ID NO: 22841 - DNA, 19 bp, Artificial Sequence
  Synthetic Construct
atcggcgcgagccaggatt

SEQ ID NO: 22842 - DNA, 24 bp, Artificial Sequence
  Synthetic Construct
gcagtctctcaactctgctgttgt

SEQ ID NO: 22843 - DNA, 20 bp, Artificial Sequence
  Synthetic Construct
agggatgtcctccccaactt

SEQ ID NO: 22844 - DNA, 22 bp, Artificial Sequence
  Synthetic Construct
gtcagcaccatgtagcagatgt

SEQ ID NO: 22845 - DNA, 20 bp, Artificial Sequence
  Synthetic Construct
ccagcattggggcagcttct

SEQ ID NO: 22846 - DNA, 23 bp, Artificial Sequence
  Synthetic Construct
gccctttaaggaaccttgctaca

SEQ ID NO: 22847 - DNA, 21 bp, Artificial Sequence
  Synthetic Construct
tccaggtccactactgtgtca

SEQ ID NO: 22848 - DNA, 21 bp, Artificial Sequence
  Synthetic Construct
cccttgggtccctcttcttca

SEQ ID NO: 22849 - DNA, 20 bp, Artificial Sequence
  Synthetic Construct
ggcgggtattgtgcctgaca

SEQ ID NO: 22850 - DNA, 24 bp, Artificial Sequence
  Synthetic Construct
ccattctgccaaatttctgtgtgt

SEQ ID NO: 22851 - DNA, 24 bp, Artificial Sequence
  Synthetic Construct
ggggagcagaatggatttgtcact

SEQ ID NO: 22852 - DNA, 22 bp, Artificial Sequence
  Synthetic Construct
cagctactcaggcaaccacaga

SEQ ID NO: 22853 - DNA, 25 bp, Artificial Sequence
  Synthetic Construct
aggcagatcactaactggttctaag

SEQ ID NO: 22854 - DNA, 23 bp, Artificial Sequence
  Synthetic Construct
tcagtagagccttgaggtagctt

SEQ ID NO: 22855 - DNA, 21 bp, Artificial Sequence
  Synthetic Construct
cctgccctaccaacccacatt

SEQ ID NO: 22856 - DNA, 22 bp, Artificial Sequence
  Synthetic Construct
ccctctgcttttgctccagata

SEQ ID NO: 22857 - DNA, 24 bp, Artificial Sequence
  Synthetic Construct
aagccaagctaaatcttccctgaa

SEQ ID NO: 22858 - DNA, 19 bp, Artificial Sequence
  Synthetic Construct
aggccttcagcctgagaca

SEQ ID NO: 22859 - DNA, 20 bp, Artificial Sequence
  Synthetic Construct
tcttcctgggcacgttcttc

SEQ ID NO: 22860 - DNA, 22 bp, Artificial Sequence
  Synthetic Construct
gggatctctgcagcatgacttg

SEQ ID NO: 22861 - DNA, 23 bp, Artificial Sequence
  Synthetic Construct
tcaacacctttttcggtgacagt

SEQ ID NO: 22862 - DNA, 22 bp, Artificial Sequence
  Synthetic Construct
ccgcgctctacctcttgattta

SEQ ID NO: 22863 - DNA, 23 bp, Artificial Sequence
  Synthetic Construct
tctgttcttgaacatgccagtga

SEQ ID NO: 22864 - DNA, 20 bp, Artificial Sequence
  Synthetic Construct
gcagtaggtggagggtgttc

SEQ ID NO: 22865 - DNA, 22 bp, Artificial Sequence
  Synthetic Construct
agaccttcctggcttccttttg

SEQ ID NO: 22866 - DNA, 20 bp, Artificial Sequence
  Synthetic Construct
atgggcctgaggcagattgt

SEQ ID NO: 22867 - DNA, 22 bp, Artificial Sequence
  Synthetic Construct
gcaagaggaaagaccagcatca

SEQ ID NO: 22868 - DNA, 19 bp, Artificial Sequence
  Synthetic Construct
caaccctgggctggactgt

SEQ ID NO: 22869 - DNA, 20 bp, Artificial Sequence
  Synthetic Construct
cagccgcaaagagagcctaa

SEQ ID NO: 22870 - DNA, 26 bp, Artificial Sequence
  Synthetic Construct
gaacacaccaggtttctgcactagat

SEQ ID NO: 22871 - DNA, 20 bp, Artificial Sequence
  Synthetic Construct
ccccgctctctgtcccatca

SEQ ID NO: 22872 - DNA, 20 bp, Artificial Sequence
  Synthetic Construct
atcgggagtcacagcacttg

SEQ ID NO: 22873 - DNA, 26 bp, Artificial Sequence
  Synthetic Construct
ctgagagaggagtctatcttccttga

SEQ ID NO: 22874 - DNA, 21 bp, Artificial Sequence
  Synthetic Construct
ggccaagggtgaactggagaa

SEQ ID NO: 22875 - DNA, 20 bp, Artificial Sequence
  Synthetic Construct
ccccgccaggtactgtctca

SEQ ID NO: 22876 - DNA, 19 bp, Artificial Sequence
  Synthetic Construct
ggaccagggctgcgagaaa

SEQ ID NO: 22877 - DNA, 25 bp, Artificial Sequence
  Synthetic Construct
gtgggacatcttatgatccgcttag

SEQ ID NO: 22878 - DNA, 25 bp, Artificial Sequence
  Synthetic Construct
tgagtgtctaaacatgggcacatac

SEQ ID NO: 22879 - DNA, 20 bp, Artificial Sequence
  Synthetic Construct
agcctgccctaccccaatct

SEQ ID NO: 22880 - DNA, 25 bp, Artificial Sequence
  Synthetic Construct
tgactatttgactggtcctggtaac

SEQ ID NO: 22881 - DNA, 23 bp, Artificial Sequence
  Synthetic Construct
gggacttgaccttgcttccacaa

SEQ ID NO: 22882 - DNA, 20 bp, Artificial Sequence
  Synthetic Construct
aagtaccgccctcgtctgtt

SEQ ID NO: 22883 - DNA, 20 bp, Artificial Sequence
  Synthetic Construct
tgccatggcgtgttggatct

SEQ ID NO: 22884 - DNA, 21 bp, Artificial Sequence
  Synthetic Construct
agagacccttggcaggtgcat

SEQ ID NO: 22885 - DNA, 23 bp, Artificial Sequence
  Synthetic Construct
cacattagtctgggagcttggtt

SEQ ID NO: 22886 - DNA, 23 bp, Artificial Sequence
  Synthetic Construct
ccccagtactcaggggactttgt

SEQ ID NO: 22887 - DNA, 19 bp, Artificial Sequence
  Synthetic Construct
gatgggccatgtggcttct

SEQ ID NO: 22888 - DNA, 21 bp, Artificial Sequence
  Synthetic Construct
tctccccagtggagcttatgt

SEQ ID NO: 22889 - DNA, 20 bp, Artificial Sequence
  Synthetic Construct
caccaacaagctggctctga

SEQ ID NO: 22890 - DNA, 19 bp, Artificial Sequence
  Synthetic Construct
cggctccaagttcccacat

SEQ ID NO: 22891 - DNA, 21 bp, Artificial Sequence
  Synthetic Construct
tgtccaaggttgaggggttgt

SEQ ID NO: 22892 - DNA, 23 bp, Artificial Sequence
  Synthetic Construct
ctggaatggctgttaggcacctt

SEQ ID NO: 22893 - DNA, 27 bp, Artificial Sequence
  Synthetic Construct
gcacataactgtacctcctaagccata

SEQ ID NO: 22894 - DNA, 25 bp, Artificial Sequence
  Synthetic Construct
gggaaagcaatgctgtgtgtttatg

SEQ ID NO: 22895 - DNA, 21 bp, Artificial Sequence
  Synthetic Construct
tcccacagtcaggccaaccat

SEQ ID NO: 22896 - DNA, 21 bp, Artificial Sequence
  Synthetic Construct
acagctggacccagggaagtt

SEQ ID NO: 22897 - DNA, 22 bp, Artificial Sequence
  Synthetic Construct
cctggtggcataagggatgctt

SEQ ID NO: 22898 - DNA, 23 bp, Artificial Sequence
  Synthetic Construct
gatgttggtactcgcttctcagt

SEQ ID NO: 22899 - DNA, 25 bp, Artificial Sequence
  Synthetic Construct
gggttactaaagggcagttctgttc

SEQ ID NO: 22900 - DNA, 21 bp, Artificial Sequence
  Synthetic Construct
tcctaggctgaccagtgtcat

SEQ ID NO: 22901 - DNA, 21 bp, Artificial Sequence
  Synthetic Construct
gcctttccccagtccatttct

SEQ ID NO: 22902 - DNA, 21 bp, Artificial Sequence
  Synthetic Construct
tgtctttcaccagcccagact

SEQ ID NO: 22903 - DNA, 26 bp, Artificial Sequence
  Synthetic Construct
cgtgtgagaaaaacctctcctactac

SEQ ID NO: 22904 - DNA, 25 bp, Artificial Sequence
  Synthetic Construct
tgtccaacagctttacatagcacat

SEQ ID NO: 22905 - DNA, 21 bp, Artificial Sequence
  Synthetic Construct
cagaagcagtgagctgtggtt

SEQ ID NO: 22906 - DNA, 20 bp, Artificial Sequence
  Synthetic Construct
ctgggcctgcagaaatgcta

SEQ ID NO: 22907 - DNA, 22 bp, Artificial Sequence
  Synthetic Construct
cactgaggcgatgctctgatct

SEQ ID NO: 22908 - DNA, 24 bp, Artificial Sequence
  Synthetic Construct
tggcctccttctctaaaagcattc

SEQ ID NO: 22909 - DNA, 23 bp, Artificial Sequence
  Synthetic Construct
cactcacaactcctttcccaagt

SEQ ID NO: 22910 - DNA, 19 bp, Artificial Sequence
  Synthetic Construct
gcgtgggcaaagcctccat

SEQ ID NO: 22911 - DNA, 20 bp, Artificial Sequence
  Synthetic Construct
atccactgccctgaccttgt

SEQ ID NO: 22912 - DNA, 20 bp, Artificial Sequence
  Synthetic Construct
actccaaaccccacctgcta

SEQ ID NO: 22913 - DNA, 22 bp, Artificial Sequence
  Synthetic Construct
gggtcctaaccctcagtcttgt

SEQ ID NO: 22914 - DNA, 21 bp, Artificial Sequence
  Synthetic Construct
acagggctcctggttctaact

SEQ ID NO: 22915 - DNA, 23 bp, Artificial Sequence
  Synthetic Construct
ctctaggagcatgggtcaccaaa

SEQ ID NO: 22916 - DNA, 18 bp, Artificial Sequence
  Synthetic Construct
aagccggcaggctgagtt

SEQ ID NO: 22917 - DNA, 22 bp, Artificial Sequence
  Synthetic Construct
ggagccacaaggaatgcagagt

SEQ ID NO: 22918 - DNA, 20 bp, Artificial Sequence
  Synthetic Construct
caagaccctgccacctctct

SEQ ID NO: 22919 - DNA, 18 bp, Artificial Sequence
  Synthetic Construct
ggtgcagccttgctcact

SEQ ID NO: 22920 - DNA, 21 bp, Artificial Sequence
  Synthetic Construct
gcggaaggtggaagaaccttt

SEQ ID NO: 22921 - DNA, 24 bp, Artificial Sequence
  Synthetic Construct
gggcacactgaagtctagaagcaa

SEQ ID NO: 22922 - DNA, 21 bp, Artificial Sequence
  Synthetic Construct
tgggcccatctcttgactttc

SEQ ID NO: 22923 - DNA, 22 bp, Artificial Sequence
  Synthetic Construct
gaaggatgagcggatggctcta

SEQ ID NO: 22924 - DNA, 25 bp, Artificial Sequence
  Synthetic Construct
gcagtacttggggtcgtatatctgt

SEQ ID NO: 22925 - DNA, 21 bp, Artificial Sequence
  Synthetic Construct
tccacctacctgtgggcaatc

SEQ ID NO: 22926 - DNA, 21 bp, Artificial Sequence
  Synthetic Construct
cccgggtacaacagtgacctt

SEQ ID NO: 22927 - DNA, 22 bp, Artificial Sequence
  Synthetic Construct
tctcccggaaagtccggttcta

SEQ ID NO: 22928 - DNA, 22 bp, Artificial Sequence
  Synthetic Construct
cacccaagctctcactgttact

SEQ ID NO: 22929 - DNA, 19 bp, Artificial Sequence
  Synthetic Construct
gggccagctgaccaactac

SEQ ID NO: 22930 - DNA, 20 bp, Artificial Sequence
  Synthetic Construct
ctccctgaagcagcagcaaa

SEQ ID NO: 22931 - DNA, 22 bp, Artificial Sequence
  Synthetic Construct
gctgtcacactgaccctggatt

SEQ ID NO: 22932 - DNA, 20 bp, Artificial Sequence
  Synthetic Construct
gccatgctgagagcctctgt

SEQ ID NO: 22933 - DNA, 24 bp, Artificial Sequence
  Synthetic Construct
gtccacgtgtggaacatgtttatt

SEQ ID NO: 22934 - DNA, 24 bp, Artificial Sequence
  Synthetic Construct
gcaaggagctgatctcatctgtgt

SEQ ID NO: 22935 - DNA, 22 bp, Artificial Sequence
  Synthetic Construct
caaagggctccttccccacaaa

SEQ ID NO: 22936 - DNA, 20 bp, Artificial Sequence
  Synthetic Construct
gggaagcctttgagggttgt

SEQ ID NO: 22937 - DNA, 20 bp, Artificial Sequence
  Synthetic Construct
tctgcacccctgccctgtgt

SEQ ID NO: 22938 - DNA, 22 bp, Artificial Sequence
  Synthetic Construct
tccccagagtgcacaactcctt

SEQ ID NO: 22939 - DNA, 23 bp, Artificial Sequence
  Synthetic Construct
gtttggctgcacgtagagaaaag

SEQ ID NO: 22940 - DNA, 19 bp, Artificial Sequence
  Synthetic Construct
gttggcactggggccttct

SEQ ID NO: 22941 - DNA, 24 bp, Artificial Sequence
  Synthetic Construct
gactcagtcagtagagagggagaa

SEQ ID NO: 22942 - DNA, 20 bp, Artificial Sequence
  Synthetic Construct
cgtggggagggagaccactt

SEQ ID NO: 22943 - DNA, 25 bp, Artificial Sequence
  Synthetic Construct
tcttcttttgacagactgggaacat

SEQ ID NO: 22944 - DNA, 22 bp, Artificial Sequence
  Synthetic Construct
accttctgaggtttggggtaga

SEQ ID NO: 22945 - DNA, 22 bp, Artificial Sequence
  Synthetic Construct
tgtaaggctaagccgcattttg

SEQ ID NO: 22946 - DNA, 22 bp, Artificial Sequence
  Synthetic Construct
tgaccagaaccactcggacaga

SEQ ID NO: 22947 - DNA, 20 bp, Artificial Sequence
  Synthetic Construct
acaggcccactgccctgtct

SEQ ID NO: 22948 - DNA, 20 bp, Artificial Sequence
  Synthetic Construct
gctgacggctggaatcatct

SEQ ID NO: 22949 - DNA, 24 bp, Artificial Sequence
  Synthetic Construct
agctcaggtaaaaggtcaaagaca

SEQ ID NO: 22950 - DNA, 21 bp, Artificial Sequence
  Synthetic Construct
gcaggccagtaacgtcaattc

SEQ ID NO: 22951 - DNA, 22 bp, Artificial Sequence
  Synthetic Construct
agtgcttcaagcctgagattgt

SEQ ID NO: 22952 - DNA, 21 bp, Artificial Sequence
  Synthetic Construct
cccggttccctccttctccat

SEQ ID NO: 22953 - DNA, 22 bp, Artificial Sequence
  Synthetic Construct
ggtgaccgatggcactgaatgt

SEQ ID NO: 22954 - DNA, 22 bp, Artificial Sequence
  Synthetic Construct
caccctgatcacctgggaaaag

SEQ ID NO: 22955 - DNA, 21 bp, Artificial Sequence
  Synthetic Construct
tgctgtcagccactctacaca

SEQ ID NO: 22956 - DNA, 24 bp, Artificial Sequence
  Synthetic Construct
ttcccttaatgcaatggaggtcaa

SEQ ID NO: 22957 - DNA, 20 bp, Artificial Sequence
  Synthetic Construct
caagcttgctccctgacact

SEQ ID NO: 22958 - DNA, 20 bp, Artificial Sequence
  Synthetic Construct
aggcagtgccaggtcctgaa

SEQ ID NO: 22959 - DNA, 22 bp, Artificial Sequence
  Synthetic Construct
tccttccagggttcgtttgttt

SEQ ID NO: 22960 - DNA, 24 bp, Artificial Sequence
  Synthetic Construct
gcagttaccagggacattactgaa

SEQ ID NO: 22961 - DNA, 24 bp, Artificial Sequence
  Synthetic Construct
ggacctgaagtggatgagctttgt

SEQ ID NO: 22962 - DNA, 20 bp, Artificial Sequence
  Synthetic Construct
agccctggaccagattgaga

SEQ ID NO: 22963 - DNA, 24 bp, Artificial Sequence
  Synthetic Construct
gcagaaggagcacctctctccata

SEQ ID NO: 22964 - DNA, 20 bp, Artificial Sequence
  Synthetic Construct
gtcacagccatccagtgcaa

SEQ ID NO: 22965 - DNA, 20 bp, Artificial Sequence
  Synthetic Construct
gagcgagccttgccttgtta

SEQ ID NO: 22966 - DNA, 22 bp, Artificial Sequence
  Synthetic Construct
aaggctagagtgggaactgact

SEQ ID NO: 22967 - DNA, 23 bp, Artificial Sequence
  Synthetic Construct
acattgttcatggaggagtgcaa

SEQ ID NO: 22968 - DNA, 24 bp, Artificial Sequence
  Synthetic Construct
gagggaaactgaagatggagcttt

SEQ ID NO: 22969 - DNA, 19 bp, Artificial Sequence
  Synthetic Construct
caagggctggggctcacat

SEQ ID NO: 22970 - DNA, 20 bp, Artificial Sequence
  Synthetic Construct
cagacacagtcagcgtccat

SEQ ID NO: 22971 - DNA, 23 bp, Artificial Sequence
  Synthetic Construct
tgttcttcagaatgtgccgtttc

SEQ ID NO: 22972 - DNA, 23 bp, Artificial Sequence
  Synthetic Construct
ctgcaaaaatcctgacccagtct

SEQ ID NO: 22973 - DNA, 20 bp, Artificial Sequence
  Synthetic Construct
ccaccttgttggctctgagt

SEQ ID NO: 22974 - DNA, 20 bp, Artificial Sequence
  Synthetic Construct
cctggagcggctgtctcata

SEQ ID NO: 22975 - DNA, 27 bp, Artificial Sequence
  Synthetic Construct
cagtctgtctgaacccatttacaccaa

SEQ ID NO: 22976 - DNA, 24 bp, Artificial Sequence
  Synthetic Construct
cagtgtgagtgctgagaaacaaag

SEQ ID NO: 22977 - DNA, 22 bp, Artificial Sequence
  Synthetic Construct
cacccctgggaaggatggaaat

SEQ ID NO: 22978 - DNA, 18 bp, Artificial Sequence
  Synthetic Construct
agggctgcatgccacaga

SEQ ID NO: 22979 - DNA, 23 bp, Artificial Sequence
  Synthetic Construct
cctgtactcccttccctggtatc

SEQ ID NO: 22980 - DNA, 19 bp, Artificial Sequence
  Synthetic Construct
tctctgtgccaggctgtgt

SEQ ID NO: 22981 - DNA, 22 bp, Artificial Sequence
  Synthetic Construct
tctgagacttcctcccttgtga

SEQ ID NO: 22982 - DNA, 24 bp, Artificial Sequence
  Synthetic Construct
cctcatggtcggtcttggtgactt

SEQ ID NO: 22983 - DNA, 19 bp, Artificial Sequence
  Synthetic Construct
agacggagagcccctgttg

SEQ ID NO: 22984 - DNA, 24 bp, Artificial Sequence
  Synthetic Construct
catgggtacaagctccaattcctt

SEQ ID NO: 22985 - DNA, 24 bp, Artificial Sequence
  Synthetic Construct
gagggaaagggttggggaaaaatc

SEQ ID NO: 22986 - DNA, 24 bp, Artificial Sequence
  Synthetic Construct
gcactagaaagggaaggaactaca

SEQ ID NO: 22987 - DNA, 22 bp, Artificial Sequence
  Synthetic Construct
gaggtaagccttgggcatttct

SEQ ID NO: 22988 - DNA, 21 bp, Artificial Sequence
  Synthetic Construct
gtgaggtgatgggcagactac

SEQ ID NO: 22989 - DNA, 22 bp, Artificial Sequence
  Synthetic Construct
ccttaccagcaggccttcacaa

SEQ ID NO: 22990 - DNA, 22 bp, Artificial Sequence
  Synthetic Construct
tacccacccacccagtcccatt

SEQ ID NO: 22991 - DNA, 23 bp, Artificial Sequence
  Synthetic Construct
cgaacttgctgggagtgtagaac

SEQ ID NO: 22992 - DNA, 22 bp, Artificial Sequence
  Synthetic Construct
ctgtggtccttggtgtcagaga

SEQ ID NO: 22993 - DNA, 22 bp, Artificial Sequence
  Synthetic Construct
ccaaggggctacagtgacaaca

SEQ ID NO: 22994 - DNA, 22 bp, Artificial Sequence
  Synthetic Construct
cagcagtgtggcctttctctac

SEQ ID NO: 22995 - DNA, 20 bp, Artificial Sequence
  Synthetic Construct
tgccacacggagcttgtttc

SEQ ID NO: 22996 - DNA, 25 bp, Artificial Sequence
  Synthetic Construct
caccatgtacttgcactctcagaaa

SEQ ID NO: 22997 - DNA, 20 bp, Artificial Sequence
  Synthetic Construct
cgccaacgtggctgatgttt

SEQ ID NO: 22998 - DNA, 22 bp, Artificial Sequence
  Synthetic Construct
cctggccttactcttcctgagt

SEQ ID NO: 22999 - DNA, 23 bp, Artificial Sequence
  Synthetic Construct
gacttcctgcaagcatttcaaca

SEQ ID NO: 23000 - DNA, 21 bp, Artificial Sequence
  Synthetic Construct
tcaagccaggagacccataca

SEQ ID NO: 23001 - DNA, 22 bp, Artificial Sequence
  Synthetic Construct
cccggaagcactagctcgtaag

SEQ ID NO: 23002 - DNA, 21 bp, Artificial Sequence
  Synthetic Construct
cgctcgcagctttgactgtag

SEQ ID NO: 23003 - DNA, 22 bp, Artificial Sequence
  Synthetic Construct
gcgtctggtctgtgagggtaga

SEQ ID NO: 23004 - DNA, 23 bp, Artificial Sequence
  Synthetic Construct
gagcgtggagagaaaagcaatgt

SEQ ID NO: 23005 - DNA, 21 bp, Artificial Sequence
  Synthetic Construct
cgataagcccgtgttcctgtt

SEQ ID NO: 23006 - DNA, 21 bp, Artificial Sequence
  Synthetic Construct
acgctggatctccaggacact

SEQ ID NO: 23007 - DNA, 24 bp, Artificial Sequence
  Synthetic Construct
caccctcttccctgttaaaggatt

SEQ ID NO: 23008 - DNA, 25 bp, Artificial Sequence
  Synthetic Construct
gctgattctgtgcaaagtccagtgt

SEQ ID NO: 23009 - DNA, 22 bp, Artificial Sequence
  Synthetic Construct
cgatgaaaggctgggagctgaa

SEQ ID NO: 23010 - DNA, 20 bp, Artificial Sequence
  Synthetic Construct
ccggccactggctgctatac

SEQ ID NO: 23011 - DNA, 22 bp, Artificial Sequence
  Synthetic Construct
ctctgcatgtggagcaaaccaa

SEQ ID NO: 23012 - DNA, 21 bp, Artificial Sequence
  Synthetic Construct
aggtaaggggaggctgcagaa

SEQ ID NO: 23013 - DNA, 23 bp, Artificial Sequence
  Synthetic Construct
gctagataatgctgcctgctttg

SEQ ID NO: 23014 - DNA, 26 bp, Artificial Sequence
  Synthetic Construct
ctgaaaagatcactaccaggatgcta

SEQ ID NO: 23015 - DNA, 22 bp, Artificial Sequence
  Synthetic Construct
agacaacagcgttgcttgagta

SEQ ID NO: 23016 - DNA, 23 bp, Artificial Sequence
  Synthetic Construct
agggagagcctctgatgaaaagt

SEQ ID NO: 23017 - DNA, 22 bp, Artificial Sequence
  Synthetic Construct
ccagtgtaggctcacattctgt

SEQ ID NO: 23018 - DNA, 22 bp, Artificial Sequence
  Synthetic Construct
cccaggagtctctgtccattgt

SEQ ID NO: 23019 - DNA, 22 bp, Artificial Sequence
  Synthetic Construct
tcctggtgtggacgtgtctcat

SEQ ID NO: 23020 - DNA, 22 bp, Artificial Sequence
  Synthetic Construct
cgtcaggggtcccttctttttg

SEQ ID NO: 23021 - DNA, 24 bp, Artificial Sequence
  Synthetic Construct
gccagagccttcatttgggagaaa

SEQ ID NO: 23022 - DNA, 19 bp, Artificial Sequence
  Synthetic Construct
tgggcctcctccagccttt

SEQ ID NO: 23023 - DNA, 23 bp, Artificial Sequence
  Synthetic Construct
gttttcccaggcctctcttcttc

SEQ ID NO: 23024 - DNA, 23 bp, Artificial Sequence
  Synthetic Construct
gggatgtacccaaaggcttctct

SEQ ID NO: 23025 - DNA, 22 bp, Artificial Sequence
  Synthetic Construct
ggtgcttcacagggttcacagt

SEQ ID NO: 23026 - DNA, 20 bp, Artificial Sequence
  Synthetic Construct
agccagcaggtgccattcat

SEQ ID NO: 23027 - DNA, 23 bp, Artificial Sequence
  Synthetic Construct
gggaagtaaacatcccagcttca

SEQ ID NO: 23028 - DNA, 21 bp, Artificial Sequence
  Synthetic Construct
gcagttctccctgcaggcttt

SEQ ID NO: 23029 - DNA, 27 bp, Artificial Sequence
  Synthetic Construct
cttcccgtattgctaaggaactattct

SEQ ID NO: 23030 - DNA, 22 bp, Artificial Sequence
  Synthetic Construct
ctgtgcagcagaggcagttatg

SEQ ID NO: 23031 - DNA, 21 bp, Artificial Sequence
  Synthetic Construct
gggcctcgaaaggcagaaatc

SEQ ID NO: 23032 - DNA, 22 bp, Artificial Sequence
  Synthetic Construct
gcatccatccgggcagttttca

SEQ ID NO: 23033 - DNA, 26 bp, Artificial Sequence
  Synthetic Construct
gaagagcaggagctacttctatccat

SEQ ID NO: 23034 - DNA, 24 bp, Artificial Sequence
  Synthetic Construct
gaccccagactcagtcagtagatg

SEQ ID NO: 23035 - DNA, 24 bp, Artificial Sequence
  Synthetic Construct
caaactggaaaccatacccacttc

SEQ ID NO: 23036 - DNA, 20 bp, Artificial Sequence
  Synthetic Construct
tggggctccaccagccagaa

SEQ ID NO: 23037 - DNA, 22 bp, Artificial Sequence
  Synthetic Construct
gcgtctaacagcctcacccaat

SEQ ID NO: 23038 - DNA, 21 bp, Artificial Sequence
  Synthetic Construct
ctggtgggagtgggcttattt

SEQ ID NO: 23039 - DNA, 28 bp, Artificial Sequence
  Synthetic Construct
gcaagtgttatcagaagtccaccttagt

SEQ ID NO: 23040 - DNA, 24 bp, Artificial Sequence
  Synthetic Construct
tgagccaaagactttccctgtatt

SEQ ID NO: 23041 - DNA, 20 bp, Artificial Sequence
  Synthetic Construct
gccagacgcaggcctagtaa

SEQ ID NO: 23042 - DNA, 20 bp, Artificial Sequence
  Synthetic Construct
tggccacgtcctctccacta

SEQ ID NO: 23043 - DNA, 24 bp, Artificial Sequence
  Synthetic Construct
acagcaggcttaatcctagaggta

SEQ ID NO: 23044 - DNA, 24 bp, Artificial Sequence
  Synthetic Construct
cccagagttgcagtaggacacagt

SEQ ID NO: 23045 - DNA, 19 bp, Artificial Sequence
  Synthetic Construct
ctgcttgccccgacctctt

SEQ ID NO: 23046 - DNA, 19 bp, Artificial Sequence
  Synthetic Construct
tgcccggctcagtttgaat

SEQ ID NO: 23047 - DNA, 23 bp, Artificial Sequence
  Synthetic Construct
ctgccttagggatctgggtgatg

SEQ ID NO: 23048 - DNA, 22 bp, Artificial Sequence
  Synthetic Construct
ggctttggaaggagccatctgt

SEQ ID NO: 23049 - DNA, 20 bp, Artificial Sequence
  Synthetic Construct
ccagcttcagtgtgcaccaa

SEQ ID NO: 23050 - DNA, 25 bp, Artificial Sequence
  Synthetic Construct
cctgagagctgtactgttgctcgaa

SEQ ID NO: 23051 - DNA, 21 bp, Artificial Sequence
  Synthetic Construct
tttcctcactgggtgggatct

SEQ ID NO: 23052 - DNA, 20 bp, Artificial Sequence
  Synthetic Construct
gcgggcaattccacatctga

SEQ ID NO: 23053 - DNA, 22 bp, Artificial Sequence
  Synthetic Construct
ccaactcagggcaagtggttct

SEQ ID NO: 23054 - DNA, 26 bp, Artificial Sequence
  Synthetic Construct
ggttgcaaagtactgtgggaataaag

SEQ ID NO: 23055 - DNA, 22 bp, Artificial Sequence
  Synthetic Construct
gaggacttgggcctttcctatc

SEQ ID NO: 23056 - DNA, 19 bp, Artificial Sequence
  Synthetic Construct
tctgcgatgcgttcctgtt

SEQ ID NO: 23057 - DNA, 20 bp, Artificial Sequence
  Synthetic Construct
gtgaagcttgggctggtttg

SEQ ID NO: 23058 - DNA, 24 bp, Artificial Sequence
  Synthetic Construct
ccatacaaagcaagagtgggaagt

SEQ ID NO: 23059 - DNA, 22 bp, Artificial Sequence
  Synthetic Construct
gggaggggtttccccactaaga

SEQ ID NO: 23060 - DNA, 23 bp, Artificial Sequence
  Synthetic Construct
catcttccaatgtggagctgtca

SEQ ID NO: 23061 - DNA, 19 bp, Artificial Sequence
  Synthetic Construct
cagccgctgactgcctcat

SEQ ID NO: 23062 - DNA, 21 bp, Artificial Sequence
  Synthetic Construct
cgaaaaggggatggtgctttc

SEQ ID NO: 23063 - DNA, 20 bp, Artificial Sequence
  Synthetic Construct
cccctgctggtggtctgttc

SEQ ID NO: 23064 - DNA, 19 bp, Artificial Sequence
  Synthetic Construct
gggcctgggttctccttct

SEQ ID NO: 23065 - DNA, 22 bp, Artificial Sequence
  Synthetic Construct
cagtgcctgtggttctcacact

SEQ ID NO: 23066 - DNA, 23 bp, Artificial Sequence
  Synthetic Construct
gcttacactgacgctgcaactga

SEQ ID NO: 23067 - DNA, 19 bp, Artificial Sequence
  Synthetic Construct
tgccctgcacctctgatct

SEQ ID NO: 23068 - DNA, 20 bp, Artificial Sequence
  Synthetic Construct
ggaggccaccacacctccta

SEQ ID NO: 23069 - DNA, 21 bp, Artificial Sequence
  Synthetic Construct
tctcagccgactcagatcact

SEQ ID NO: 23070 - DNA, 22 bp, Artificial Sequence
  Synthetic Construct
cattctggagtgtgggtggatt

SEQ ID NO: 23071 - DNA, 22 bp, Artificial Sequence
  Synthetic Construct
acggtgaaaaatgaggctgtgt

SEQ ID NO: 23072 - DNA, 19 bp, Artificial Sequence
  Synthetic Construct
ggggacaggaggcatgaga

SEQ ID NO: 23073 - DNA, 20 bp, Artificial Sequence
  Synthetic Construct
tgccactgcgtcatctgtga

SEQ ID NO: 23074 - DNA, 19 bp, Artificial Sequence
  Synthetic Construct
ggcgcctggggacttcatt

SEQ ID NO: 23075 - DNA, 22 bp, Artificial Sequence
  Synthetic Construct
ctctggccccacaaatcaatgt

SEQ ID NO: 23076 - DNA, 24 bp, Artificial Sequence
  Synthetic Construct
accctgtccccaataccctgtatc

SEQ ID NO: 23077 - DNA, 24 bp, Artificial Sequence
  Synthetic Construct
gcctgacctatgaccttcagtaac

SEQ ID NO: 23078 - DNA, 20 bp, Artificial Sequence
  Synthetic Construct
ggagccaccatgacgactgt

SEQ ID NO: 23079 - DNA, 24 bp, Artificial Sequence
  Synthetic Construct
cctgagccctaacaatgatccaaa

SEQ ID NO: 23080 - DNA, 18 bp, Artificial Sequence
  Synthetic Construct
tgagcctcctgcctgcta

SEQ ID NO: 23081 - DNA, 18 bp, Artificial Sequence
  Synthetic Construct
gtgccctttggccaccat

SEQ ID NO: 23082 - DNA, 21 bp, Artificial Sequence
  Synthetic Construct
gctggatgggcagacaggaaa

SEQ ID NO: 23083 - DNA, 19 bp, Artificial Sequence
  Synthetic Construct
acacggccgtccagtcagt

SEQ ID NO: 23084 - DNA, 20 bp, Artificial Sequence
  Synthetic Construct
tgcgtgacaaggggcaagat

SEQ ID NO: 23085 - DNA, 21 bp, Artificial Sequence
  Synthetic Construct
ccaccaggactcgggtcttct

SEQ ID NO: 23086 - DNA, 24 bp, Artificial Sequence
  Synthetic Construct
ggacctccctggatgaagatgaga

SEQ ID NO: 23087 - DNA, 20 bp, Artificial Sequence
  Synthetic Construct
ggggacaccgatgggagaca

SEQ ID NO: 23088 - DNA, 21 bp, Artificial Sequence
  Synthetic Construct
gtggaatgcaggactgtgtct

SEQ ID NO: 23089 - DNA, 23 bp, Artificial Sequence
  Synthetic Construct
ccagaccccttgactctatccaa

SEQ ID NO: 23090 - DNA, 20 bp, Artificial Sequence
  Synthetic Construct
tccacttcagctgcgccaaa

SEQ ID NO: 23091 - DNA, 22 bp, Artificial Sequence
  Synthetic Construct
gtgtgtgatttggcccggatct

SEQ ID NO: 23092 - DNA, 20 bp, Artificial Sequence
  Synthetic Construct
agaagggatcaccccacctt

SEQ ID NO: 23093 - DNA, 24 bp, Artificial Sequence
  Synthetic Construct
ctccgcctcaagtaccttgaattt

SEQ ID NO: 23094 - DNA, 22 bp, Artificial Sequence
  Synthetic Construct
gcttggactcatggtacacgtt

SEQ ID NO: 23095 - DNA, 25 bp, Artificial Sequence
  Synthetic Construct
catcgccactacaattcacctctga

SEQ ID NO: 23096 - DNA, 22 bp, Artificial Sequence
  Synthetic Construct
ctcccttgccactttcctctga

SEQ ID NO: 23097 - DNA, 22 bp, Artificial Sequence
  Synthetic Construct
gccaacaccttgatggcaggtt

SEQ ID NO: 23098 - DNA, 23 bp, Artificial Sequence
  Synthetic Construct
gttatcccatcgattccctgcat

SEQ ID NO: 23099 - DNA, 18 bp, Artificial Sequence
  Synthetic Construct
tgcgaggcagagcacgtt

SEQ ID NO: 23100 - DNA, 24 bp, Artificial Sequence
  Synthetic Construct
ggggatgggttacaatgtatgtct

SEQ ID NO: 23101 - DNA, 23 bp, Artificial Sequence
  Synthetic Construct
gattggggaatgcagcttacaga

SEQ ID NO: 23102 - DNA, 21 bp, Artificial Sequence
  Synthetic Construct
caggctttggggcaacagaga

SEQ ID NO: 23103 - DNA, 21 bp, Artificial Sequence
  Synthetic Construct
ggggcatctgccttctggaat

SEQ ID NO: 23104 - DNA, 22 bp, Artificial Sequence
  Synthetic Construct
cactagagccagctcggaatac

SEQ ID NO: 23105 - DNA, 24 bp, Artificial Sequence
  Synthetic Construct
cggattctcagagagcaagcgtaa

SEQ ID NO: 23106 - DNA, 18 bp, Artificial Sequence
  Synthetic Construct
gctgcacccttggagcat

SEQ ID NO: 23107 - DNA, 21 bp, Artificial Sequence
  Synthetic Construct
tttccgtgccctgaccactct

SEQ ID NO: 23108 - DNA, 22 bp, Artificial Sequence
  Synthetic Construct
gctttcagggtggtgagtgagt

SEQ ID NO: 23109 - DNA, 26 bp, Artificial Sequence
  Synthetic Construct
gccagaggacatatttccaagcaatc

SEQ ID NO: 23110 - DNA, 22 bp, Artificial Sequence
  Synthetic Construct
cacagactcacacgggtgttca

SEQ ID NO: 23111 - DNA, 22 bp, Artificial Sequence
  Synthetic Construct
ccctcaggcaaaatcccataca

SEQ ID NO: 23112 - DNA, 24 bp, Artificial Sequence
  Synthetic Construct
ctctctgtccctctggagtaagaa

SEQ ID NO: 23113 - DNA, 24 bp, Artificial Sequence
  Synthetic Construct
tctctgactaccatcttccactgt

SEQ ID NO: 23114 - DNA, 22 bp, Artificial Sequence
  Synthetic Construct
cgcagcaccatagtcacagcaa

SEQ ID NO: 23115 - DNA, 21 bp, Artificial Sequence
  Synthetic Construct
gccttggatgatggagcaagt

SEQ ID NO: 23116 - DNA, 24 bp, Artificial Sequence
  Synthetic Construct
gtctccaaactgtcctttcctcaa

SEQ ID NO: 23117 - DNA, 22 bp, Artificial Sequence
  Synthetic Construct
aagtgagggctgcaaggagtca

SEQ ID NO: 23118 - DNA, 20 bp, Artificial Sequence
  Synthetic Construct
acgtggtgatctgggagaga

SEQ ID NO: 23119 - DNA, 19 bp, Artificial Sequence
  Synthetic Construct
aggccgaggagctggactt

SEQ ID NO: 23120 - DNA, 24 bp, Artificial Sequence
  Synthetic Construct
caaggtgtgcccaatccaactatc

SEQ ID NO: 23121 - DNA, 19 bp, Artificial Sequence
  Synthetic Construct
ggtggtggtccctcagtct

SEQ ID NO: 23122 - DNA, 19 bp, Artificial Sequence
  Synthetic Construct
aagggcacggccagtaaac

SEQ ID NO: 23123 - DNA, 20 bp, Artificial Sequence
  Synthetic Construct
agcctggggcctgggaatta

SEQ ID NO: 23124 - DNA, 20 bp, Artificial Sequence
  Synthetic Construct
caccgtggctgtgtggagat

SEQ ID NO: 23125 - DNA, 22 bp, Artificial Sequence
  Synthetic Construct
tggagagatgggctctccttag

SEQ ID NO: 23126 - DNA, 24 bp, Artificial Sequence
  Synthetic Construct
ctgcattacctgccctacctatct

SEQ ID NO: 23127 - DNA, 20 bp, Artificial Sequence
  Synthetic Construct
ccctgcgggacttgtggtaa

SEQ ID NO: 23128 - DNA, 23 bp, Artificial Sequence
  Synthetic Construct
cagtggtgtccctaaagcactct

SEQ ID NO: 23129 - DNA, 23 bp, Artificial Sequence
  Synthetic Construct
acggggctgctataaggattaag

SEQ ID NO: 23130 - DNA, 24 bp, Artificial Sequence
  Synthetic Construct
cgacagaggctgtgaatccccaaa

SEQ ID NO: 23131 - DNA, 22 bp, Artificial Sequence
  Synthetic Construct
gccactgatccaggtgacttct

SEQ ID NO: 23132 - DNA, 22 bp, Artificial Sequence
  Synthetic Construct
gccagctcgacagtttcttaca

SEQ ID NO: 23133 - DNA, 20 bp, Artificial Sequence
  Synthetic Construct
agtgggatggggctgctgtt

SEQ ID NO: 23134 - DNA, 23 bp, Artificial Sequence
  Synthetic Construct
gcagagtcccttggtggtgtaag

SEQ ID NO: 23135 - DNA, 21 bp, Artificial Sequence
  Synthetic Construct
caggcccacattctccacaga

SEQ ID NO: 23136 - DNA, 22 bp, Artificial Sequence
  Synthetic Construct
tgcaaacatggacgggtttgat

SEQ ID NO: 23137 - DNA, 24 bp, Artificial Sequence
  Synthetic Construct
gtgttgcagcactaaaacatcaca

SEQ ID NO: 23138 - DNA, 24 bp, Artificial Sequence
  Synthetic Construct
acaaagggaaatccaatggtcact

SEQ ID NO: 23139 - DNA, 20 bp, Artificial Sequence
  Synthetic Construct
gctgggaagctctgcctcaa

SEQ ID NO: 23140 - DNA, 21 bp, Artificial Sequence
  Synthetic Construct
tgggaagtccacccactccaa

SEQ ID NO: 23141 - DNA, 22 bp, Artificial Sequence
  Synthetic Construct
ccacggaggaagaaccagaagt

SEQ ID NO: 23142 - DNA, 20 bp, Artificial Sequence
  Synthetic Construct
atcacccggaggacccatgt

SEQ ID NO: 23143 - DNA, 21 bp, Artificial Sequence
  Synthetic Construct
aggggcctaagtgggctcttc

SEQ ID NO: 23144 - DNA, 22 bp, Artificial Sequence
  Synthetic Construct
gaaaaacgggttagggcagaga

SEQ ID NO: 23145 - DNA, 20 bp, Artificial Sequence
  Synthetic Construct
cggaatgggatgccttggaa

SEQ ID NO: 23146 - DNA, 18 bp, Artificial Sequence
  Synthetic Construct
cactgtcccgctgcagat

SEQ ID NO: 23147 - DNA, 24 bp, Artificial Sequence
  Synthetic Construct
tgtcacagatcagttggtgaatgt

SEQ ID NO: 23148 - DNA, 21 bp, Artificial Sequence
  Synthetic Construct
ccaggacccgagatggtctgt

SEQ ID NO: 23149 - DNA, 23 bp, Artificial Sequence
  Synthetic Construct
agagaccaagggcttctctctaa

SEQ ID NO: 23150 - DNA, 23 bp, Artificial Sequence
  Synthetic Construct
gagggaggtgaatccacgagaga

SEQ ID NO: 23151 - DNA, 20 bp, Artificial Sequence
  Synthetic Construct
agggccaccacggtgagaaa

SEQ ID NO: 23152 - DNA, 22 bp, Artificial Sequence
  Synthetic Construct
agagagccatcctcccttccaa

SEQ ID NO: 23153 - DNA, 23 bp, Artificial Sequence
  Synthetic Construct
acttctgagcaagtgtgatgtga

SEQ ID NO: 23154 - DNA, 22 bp, Artificial Sequence
  Synthetic Construct
ggcgacagttcctctggactta

SEQ ID NO: 23155 - DNA, 22 bp, Artificial Sequence
  Synthetic Construct
cagattggcgacccacccttat

SEQ ID NO: 23156 - DNA, 24 bp, Artificial Sequence
  Synthetic Construct
ggcctttcctaagctgatggttga

SEQ ID NO: 23157 - DNA, 24 bp, Artificial Sequence
  Synthetic Construct
gctggcatctaatgctgccatgtt

SEQ ID NO: 23158 - DNA, 22 bp, Artificial Sequence
  Synthetic Construct
gctgctcagagagaaactgcat

SEQ ID NO: 23159 - DNA, 22 bp, Artificial Sequence
  Synthetic Construct
gatccgcctgagaaggaacaag

SEQ ID NO: 23160 - DNA, 22 bp, Artificial Sequence
  Synthetic Construct
atgccctcgagaccagctagaa

SEQ ID NO: 23161 - DNA, 21 bp, Artificial Sequence
  Synthetic Construct
gaggtttggggtgcgaatgat

SEQ ID NO: 23162 - DNA, 22 bp, Artificial Sequence
  Synthetic Construct
gcagaagttgctggttctgttt

SEQ ID NO: 23163 - DNA, 20 bp, Artificial Sequence
  Synthetic Construct
gggcagaggcaggaccattg

SEQ ID NO: 23164 - DNA, 24 bp, Artificial Sequence
  Synthetic Construct
gctggtattttcgtttctgcatgt

SEQ ID NO: 23165 - DNA, 19 bp, Artificial Sequence
  Synthetic Construct
ttgcccctcctcccctcaa

SEQ ID NO: 23166 - DNA, 23 bp, Artificial Sequence
  Synthetic Construct
acatgcctacacccaaagtcatc

SEQ ID NO: 23167 - DNA, 20 bp, Artificial Sequence
  Synthetic Construct
tgcctggaggaaggaagtca

SEQ ID NO: 23168 - DNA, 23 bp, Artificial Sequence
  Synthetic Construct
ccttccctctggattttgggttt

SEQ ID NO: 23169 - DNA, 20 bp, Artificial Sequence
  Synthetic Construct
agctcctcacccagcctcaa

SEQ ID NO: 23170 - DNA, 21 bp, Artificial Sequence
  Synthetic Construct
acacctgtggaccatgtctga

SEQ ID NO: 23171 - DNA, 22 bp, Artificial Sequence
  Synthetic Construct
gccccaggtatgcttgaccatt

SEQ ID NO: 23172 - DNA, 20 bp, Artificial Sequence
  Synthetic Construct
acccagcaacccacgaaatc

SEQ ID NO: 23173 - DNA, 25 bp, Artificial Sequence
  Synthetic Construct
ggagaccagaacatgacactccaat

SEQ ID NO: 23174 - DNA, 20 bp, Artificial Sequence
  Synthetic Construct
ctgggcaccttgcagctttt

SEQ ID NO: 23175 - DNA, 21 bp, Artificial Sequence
  Synthetic Construct
aggccctgtttccctggaatg

SEQ ID NO: 23176 - DNA, 21 bp, Artificial Sequence
  Synthetic Construct
atctgccgagccaggtcactt

SEQ ID NO: 23177 - DNA, 21 bp, Artificial Sequence
  Synthetic Construct
ggttttgcccaccacctctga

SEQ ID NO: 23178 - DNA, 23 bp, Artificial Sequence
  Synthetic Construct
aaggttgtgctttctctcgctat

SEQ ID NO: 23179 - DNA, 22 bp, Artificial Sequence
  Synthetic Construct
ccttagctcggtcgcctaaact

SEQ ID NO: 23180 - DNA, 23 bp, Artificial Sequence
  Synthetic Construct
cccactatggcaaagatccatca

SEQ ID NO: 23181 - DNA, 20 bp, Artificial Sequence
  Synthetic Construct
tggcacccagtcatctgcta

SEQ ID NO: 23182 - DNA, 23 bp, Artificial Sequence
  Synthetic Construct
catccccgtgtttcaaaggaaag

SEQ ID NO: 23183 - DNA, 23 bp, Artificial Sequence
  Synthetic Construct
aaggacgtacaatttcggagtca

SEQ ID NO: 23184 - DNA, 21 bp, Artificial Sequence
  Synthetic Construct
tccttccctagctgggccttt

SEQ ID NO: 23185 - DNA, 19 bp, Artificial Sequence
  Synthetic Construct
ggggcgataggcacacaca

SEQ ID NO: 23186 - DNA, 22 bp, Artificial Sequence
  Synthetic Construct
ctgacataggtggctggagtga

SEQ ID NO: 23187 - DNA, 22 bp, Artificial Sequence
  Synthetic Construct
ccgcagacagagaagcagtcta

SEQ ID NO: 23188 - DNA, 20 bp, Artificial Sequence
  Synthetic Construct
gactgccgcagctcttgtaa

SEQ ID NO: 23189 - DNA, 22 bp, Artificial Sequence
  Synthetic Construct
gccatggtttagggtcctggat

SEQ ID NO: 23190 - DNA, 20 bp, Artificial Sequence
  Synthetic Construct
ctccccgggtagagcagtga

SEQ ID NO: 23191 - DNA, 22 bp, Artificial Sequence
  Synthetic Construct
cactggggcttccctttacgat

SEQ ID NO: 23192 - DNA, 22 bp, Artificial Sequence
  Synthetic Construct
ccgatggccaaaggctctcaaa

SEQ ID NO: 23193 - DNA, 21 bp, Artificial Sequence
  Synthetic Construct
acacacttcatcacgccttgt

SEQ ID NO: 23194 - DNA, 24 bp, Artificial Sequence
  Synthetic Construct
tccttgatctcccactccattttc

SEQ ID NO: 23195 - DNA, 20 bp, Artificial Sequence
  Synthetic Construct
acctggctggccacttctca

SEQ ID NO: 23196 - DNA, 19 bp, Artificial Sequence
  Synthetic Construct
acctgcctgcctcgtgttc

SEQ ID NO: 23197 - DNA, 20 bp, Artificial Sequence
  Synthetic Construct
aagtctcagggccactccat

SEQ ID NO: 23198 - DNA, 21 bp, Artificial Sequence
  Synthetic Construct
atcaggcccagagagacatga

SEQ ID NO: 23199 - DNA, 22 bp, Artificial Sequence
  Synthetic Construct
ggatgaggggctggcttcatac

SEQ ID NO: 23200 - DNA, 19 bp, Artificial Sequence
  Synthetic Construct
accccagggaagcaagcat

SEQ ID NO: 23201 - DNA, 18 bp, Artificial Sequence
  Synthetic Construct
cgcgtggctgcttgagaa

SEQ ID NO: 23202 - DNA, 23 bp, Artificial Sequence
  Synthetic Construct
agctcaagggaagatgtctccta

SEQ ID NO: 23203 - DNA, 23 bp, Artificial Sequence
  Synthetic Construct
gccctcctcaaagttaggactga

SEQ ID NO: 23204 - DNA, 22 bp, Artificial Sequence
  Synthetic Construct
tcgccctagccctggaaattca

SEQ ID NO: 23205 - DNA, 20 bp, Artificial Sequence
  Synthetic Construct
gggcagtgtccgcaaagttc

SEQ ID NO: 23206 - DNA, 22 bp, Artificial Sequence
  Synthetic Construct
agactccgtcaccctccacaat

SEQ ID NO: 23207 - DNA, 21 bp, Artificial Sequence
  Synthetic Construct
ttgtagccgttccaagagcaa

SEQ ID NO: 23208 - DNA, 24 bp, Artificial Sequence
  Synthetic Construct
ccagaaaacctgtaggcaagatgt

SEQ ID NO: 23209 - DNA, 20 bp, Artificial Sequence
  Synthetic Construct
cgactcacccgctcagcaaa

SEQ ID NO: 23210 - DNA, 19 bp, Artificial Sequence
  Synthetic Construct
ctgccaggcctctctcaca

SEQ ID NO: 23211 - DNA, 20 bp, Artificial Sequence
  Synthetic Construct
cctgtccctgagccctctgt

SEQ ID NO: 23212 - DNA, 20 bp, Artificial Sequence
  Synthetic Construct
acggctggtccttccagtca

SEQ ID NO: 23213 - DNA, 21 bp, Artificial Sequence
  Synthetic Construct
ctcgagcctttgtggacatct

SEQ ID NO: 23214 - DNA, 20 bp, Artificial Sequence
  Synthetic Construct
catgcacactctgcctcgaa

SEQ ID NO: 23215 - DNA, 24 bp, Artificial Sequence
  Synthetic Construct
gccaaatcacctccatcactcaag

SEQ ID NO: 23216 - DNA, 23 bp, Artificial Sequence
  Synthetic Construct
cggacaccaactgtcttgttttg

SEQ ID NO: 23217 - DNA, 20 bp, Artificial Sequence
  Synthetic Construct
ccaccatgcctgttctcact

SEQ ID NO: 23218 - DNA, 25 bp, Artificial Sequence
  Synthetic Construct
gatttagttgcacctttcccaagtt

SEQ ID NO: 23219 - DNA, 20 bp, Artificial Sequence
  Synthetic Construct
tgtgctgccagctgtggtta

SEQ ID NO: 23220 - DNA, 20 bp, Artificial Sequence
  Synthetic Construct
cagcccctcgtttctgttct

SEQ ID NO: 23221 - DNA, 21 bp, Artificial Sequence
  Synthetic Construct
ttcctcttccgccccaacact

SEQ ID NO: 23222 - DNA, 23 bp, Artificial Sequence
  Synthetic Construct
cctctgagacctgaatggtgtga

SEQ ID NO: 23223 - DNA, 21 bp, Artificial Sequence
  Synthetic Construct
ggaagagccgtctccccttga

SEQ ID NO: 23224 - DNA, 19 bp, Artificial Sequence
  Synthetic Construct
acgtggccccagtgtgact

SEQ ID NO: 23225 - DNA, 21 bp, Artificial Sequence
  Synthetic Construct
ggctgcagcagagactgcttt

SEQ ID NO: 23226 - DNA, 23 bp, Artificial Sequence
  Synthetic Construct
ctcaatgagaccgatgcaagttc

SEQ ID NO: 23227 - DNA, 22 bp, Artificial Sequence
  Synthetic Construct
tggacacagaggcagaagagat

SEQ ID NO: 23228 - DNA, 22 bp, Artificial Sequence
  Synthetic Construct
cctcgctagccaactcttctga

SEQ ID NO: 23229 - DNA, 22 bp, Artificial Sequence
  Synthetic Construct
aaggctcccctgcatcctaaag

SEQ ID NO: 23230 - DNA, 26 bp, Artificial Sequence
  Synthetic Construct
ccaggctagacacagaggatgtttac

SEQ ID NO: 23231 - DNA, 23 bp, Artificial Sequence
  Synthetic Construct
agaagcagcatatggtggaaact

SEQ ID NO: 23232 - DNA, 18 bp, Artificial Sequence
  Synthetic Construct
gcgtggtgctggttggaa

SEQ ID NO: 23233 - DNA, 23 bp, Artificial Sequence
  Synthetic Construct
tgctttgctggggatcttttctt

SEQ ID NO: 23234 - DNA, 22 bp, Artificial Sequence
  Synthetic Construct
cctgacccgaatgccaacttca

SEQ ID NO: 23235 - DNA, 19 bp, Artificial Sequence
  Synthetic Construct
ctgatgcccagtgccacat

SEQ ID NO: 23236 - DNA, 21 bp, Artificial Sequence
  Synthetic Construct
acgctggcaggctctcaatag

SEQ ID NO: 23237 - DNA, 20 bp, Artificial Sequence
  Synthetic Construct
gccttggcccctcaaacaag

SEQ ID NO: 23238 - DNA, 21 bp, Artificial Sequence
  Synthetic Construct
tgctacctttggcagggtgta

SEQ ID NO: 23239 - DNA, 22 bp, Artificial Sequence
  Synthetic Construct
agaaggaacggctccagtgatg

SEQ ID NO: 23240 - DNA, 27 bp, Artificial Sequence
  Synthetic Construct
gcctaaggtttttcttaggtcttggta

SEQ ID NO: 23241 - DNA, 24 bp, Artificial Sequence
  Synthetic Construct
ccagaggaagcttgtttgatgaga

SEQ ID NO: 23242 - DNA, 20 bp, Artificial Sequence
  Synthetic Construct
tctccccacacttgcccttt

SEQ ID NO: 23243 - DNA, 19 bp, Artificial Sequence
  Synthetic Construct
gcaggcacctgcagtcaca

SEQ ID NO: 23244 - DNA, 22 bp, Artificial Sequence
  Synthetic Construct
ccagcaaaggctccttccttct

SEQ ID NO: 23245 - DNA, 23 bp, Artificial Sequence
  Synthetic Construct
ccgccaaaatctactgggacttt

SEQ ID NO: 23246 - DNA, 19 bp, Artificial Sequence
  Synthetic Construct
agccctgccgagtgacgat

SEQ ID NO: 23247 - DNA, 23 bp, Artificial Sequence
  Synthetic Construct
ctcccaccacccttcctagaaca

SEQ ID NO: 23248 - DNA, 20 bp, Artificial Sequence
  Synthetic Construct
aggttagagcccctgtgcaa

SEQ ID NO: 23249 - DNA, 23 bp, Artificial Sequence
  Synthetic Construct
ggaaaatgcacggtggaaagaga

SEQ ID NO: 23250 - DNA, 21 bp, Artificial Sequence
  Synthetic Construct
aggtacatgggctcagagaca

SEQ ID NO: 23251 - DNA, 20 bp, Artificial Sequence
  Synthetic Construct
gaggtgggtttgcagtggtt

SEQ ID NO: 23252 - DNA, 23 bp, Artificial Sequence
  Synthetic Construct
tccaccctttcctagcctttctt

SEQ ID NO: 23253 - DNA, 25 bp, Artificial Sequence
  Synthetic Construct
gcaacatagaagcaaggcagttttt

SEQ ID NO: 23254 - DNA, 24 bp, Artificial Sequence
  Synthetic Construct
cacagggcatgatttcctggctta

SEQ ID NO: 23255 - DNA, 20 bp, Artificial Sequence
  Synthetic Construct
atgggcggagttgtgttcaa

SEQ ID NO: 23256 - DNA, 26 bp, Artificial Sequence
  Synthetic Construct
gctacttcccaatttggtttgacaca

SEQ ID NO: 23257 - DNA, 19 bp, Artificial Sequence
  Synthetic Construct
tgctggggcaaggctcaaa

SEQ ID NO: 23258 - DNA, 20 bp, Artificial Sequence
  Synthetic Construct
acatgtgaccccagggatgt

SEQ ID NO: 23259 - DNA, 20 bp, Artificial Sequence
  Synthetic Construct
tggtccctgtcttgcagtct

SEQ ID NO: 23260 - DNA, 23 bp, Artificial Sequence
  Synthetic Construct
cccagaccctggaataggacttg

SEQ ID NO: 23261 - DNA, 19 bp, Artificial Sequence
  Synthetic Construct
agggctgccccttcacctt

SEQ ID NO: 23262 - DNA, 22 bp, Artificial Sequence
  Synthetic Construct
ggctgaggcaaggtttttgcat

SEQ ID NO: 23263 - DNA, 21 bp, Artificial Sequence
  Synthetic Construct
cctccccttctctccactgat

SEQ ID NO: 23264 - DNA, 21 bp, Artificial Sequence
  Synthetic Construct
agtgaccacaggtgcaagaag

SEQ ID NO: 23265 - DNA, 24 bp, Artificial Sequence
  Synthetic Construct
tgtgtatccttgggatctggtaca

SEQ ID NO: 23266 - DNA, 23 bp, Artificial Sequence
  Synthetic Construct
gagctttcctgatgccttacact

SEQ ID NO: 23267 - DNA, 19 bp, Artificial Sequence
  Synthetic Construct
cgcaggcttctgctgttga

SEQ ID NO: 23268 - DNA, 24 bp, Artificial Sequence
  Synthetic Construct
tgacctgaaagctctttgttccat

SEQ ID NO: 23269 - DNA, 22 bp, Artificial Sequence
  Synthetic Construct
cctctggaggccccactgtaat

SEQ ID NO: 23270 - DNA, 25 bp, Artificial Sequence
  Synthetic Construct
ttctagtacatgccttttggtggat

SEQ ID NO: 23271 - DNA, 21 bp, Artificial Sequence
  Synthetic Construct
gcatggaaccagggcatgact

SEQ ID NO: 23272 - DNA, 21 bp, Artificial Sequence
  Synthetic Construct
cgctttgtccccactcttaca

SEQ ID NO: 23273 - DNA, 23 bp, Artificial Sequence
  Synthetic Construct
cactctgtgcaaaccagttgtag

SEQ ID NO: 23274 - DNA, 21 bp, Artificial Sequence
  Synthetic Construct
tcagcacccatcttgctcatc

SEQ ID NO: 23275 - DNA, 20 bp, Artificial Sequence
  Synthetic Construct
ggagactcctaccccagctt

SEQ ID NO: 23276 - DNA, 23 bp, Artificial Sequence
  Synthetic Construct
ggggattgttaatggccgagact

SEQ ID NO: 23277 - DNA, 21 bp, Artificial Sequence
  Synthetic Construct
acccaccacttgcacagttac

SEQ ID NO: 23278 - DNA, 23 bp, Artificial Sequence
  Synthetic Construct
gggtccctaagcactgtgagaag

SEQ ID NO: 23279 - DNA, 20 bp, Artificial Sequence
  Synthetic Construct
aaccaggccttgcggtaaag

SEQ ID NO: 23280 - DNA, 24 bp, Artificial Sequence
  Synthetic Construct
cctagggaacagtccactgagaga

SEQ ID NO: 23281 - DNA, 24 bp, Artificial Sequence
  Synthetic Construct
gcccgtgttttgaagctactgtct

SEQ ID NO: 23282 - DNA, 24 bp, Artificial Sequence
  Synthetic Construct
gccaaccagttcagttgggagtca

SEQ ID NO: 23283 - DNA, 24 bp, Artificial Sequence
  Synthetic Construct
gccagctagtggctttaaccaagt

SEQ ID NO: 23284 - DNA, 20 bp, Artificial Sequence
  Synthetic Construct
gcttcgcccatggctgtctt

SEQ ID NO: 23285 - DNA, 22 bp, Artificial Sequence
  Synthetic Construct
cgtgatctaccccactgagaca

SEQ ID NO: 23286 - DNA, 20 bp, Artificial Sequence
  Synthetic Construct
agttgggcatggaggcatgt

SEQ ID NO: 23287 - DNA, 21 bp, Artificial Sequence
  Synthetic Construct
aggccttgcaggagagaaatg

SEQ ID NO: 23288 - DNA, 25 bp, Artificial Sequence
  Synthetic Construct
cacctctgctttaggtctcaggttt

SEQ ID NO: 23289 - DNA, 25 bp, Artificial Sequence
  Synthetic Construct
cgatgctgagactaaggagcctaaa

SEQ ID NO: 23290 - DNA, 24 bp, Artificial Sequence
  Synthetic Construct
gtcactcattctgctctacccaaa

SEQ ID NO: 23291 - DNA, 25 bp, Artificial Sequence
  Synthetic Construct
gagcatcctcgagaattgcatttga

SEQ ID NO: 23292 - DNA, 25 bp, Artificial Sequence
  Synthetic Construct
gacaagtcagctggtgaagagtgaa

SEQ ID NO: 23293 - DNA, 23 bp, Artificial Sequence
  Synthetic Construct
gcctgtggcaaacttgaacatga

SEQ ID NO: 23294 - DNA, 23 bp, Artificial Sequence
  Synthetic Construct
tccactgtggtttgagtggaaag

SEQ ID NO: 23295 - DNA, 24 bp, Artificial Sequence
  Synthetic Construct
agactcgctcattcactctcattt

SEQ ID NO: 23296 - DNA, 22 bp, Artificial Sequence
  Synthetic Construct
gaatccagctcagccccttcta

SEQ ID NO: 23297 - DNA, 23 bp, Artificial Sequence
  Synthetic Construct
tcaagcagaacaggactgacaat

SEQ ID NO: 23298 - DNA, 20 bp, Artificial Sequence
  Synthetic Construct
tctcagccttcccgcttcat

SEQ ID NO: 23299 - DNA, 19 bp, Artificial Sequence
  Synthetic Construct
agggcccaggttccttctt

SEQ ID NO: 23300 - DNA, 22 bp, Artificial Sequence
  Synthetic Construct
tcccttccaggatgaccattga

SEQ ID NO: 23301 - DNA, 19 bp, Artificial Sequence
  Synthetic Construct
agccaggaagcctcagagt

SEQ ID NO: 23302 - DNA, 22 bp, Artificial Sequence
  Synthetic Construct
ttgctctaccctcctccagctt

SEQ ID NO: 23303 - DNA, 25 bp, Artificial Sequence
  Synthetic Construct
cccctgccctattttaaccacaaag

SEQ ID NO: 23304 - DNA, 20 bp, Artificial Sequence
  Synthetic Construct
ccactgcacccagccaatct

SEQ ID NO: 23305 - DNA, 20 bp, Artificial Sequence
  Synthetic Construct
aggcaggaagcctgttcaga

SEQ ID NO: 23306 - DNA, 25 bp, Artificial Sequence
  Synthetic Construct
tgtgcaaactctgtgatggaatgta

SEQ ID NO: 23307 - DNA, 20 bp, Artificial Sequence
  Synthetic Construct
aggggcccttctggaggttt

SEQ ID NO: 23308 - DNA, 22 bp, Artificial Sequence
  Synthetic Construct
tcgttccaccatgcttttcctt

SEQ ID NO: 23309 - DNA, 22 bp, Artificial Sequence
  Synthetic Construct
tgcttaaacgaacagggctttg

SEQ ID NO: 23310 - DNA, 21 bp, Artificial Sequence
  Synthetic Construct
tctgcaggggtgtggtatttc

SEQ ID NO: 23311 - DNA, 22 bp, Artificial Sequence
  Synthetic Construct
ccacctatgccacccaaggtat

SEQ ID NO: 23312 - DNA, 23 bp, Artificial Sequence
  Synthetic Construct
cccctccctcgcagaagtataag

SEQ ID NO: 23313 - DNA, 24 bp, Artificial Sequence
  Synthetic Construct
gccttcctaatgccacccagatca

SEQ ID NO: 23314 - DNA, 22 bp, Artificial Sequence
  Synthetic Construct
gcctcagtctcggttagcttca

SEQ ID NO: 23315 - DNA, 20 bp, Artificial Sequence
  Synthetic Construct
tgccctgtgccctcaattct

SEQ ID NO: 23316 - DNA, 23 bp, Artificial Sequence
  Synthetic Construct
accctgtactcctctcattcaca

SEQ ID NO: 23317 - DNA, 19 bp, Artificial Sequence
  Synthetic Construct
ccgcgtctggtcgcttctt

SEQ ID NO: 23318 - DNA, 20 bp, Artificial Sequence
  Synthetic Construct
ctggaggagagggcagtcat

SEQ ID NO: 23319 - DNA, 23 bp, Artificial Sequence
  Synthetic Construct
gggattacaaagttgcgcgtttc

SEQ ID NO: 23320 - DNA, 20 bp, Artificial Sequence
  Synthetic Construct
ggatggagacggcaggaatg

SEQ ID NO: 23321 - DNA, 24 bp, Artificial Sequence
  Synthetic Construct
ggacagagaatcaggtcacggtat

SEQ ID NO: 23322 - DNA, 20 bp, Artificial Sequence
  Synthetic Construct
acctcggcctcaggacttct

SEQ ID NO: 23323 - DNA, 22 bp, Artificial Sequence
  Synthetic Construct
tgctcacaggctcggagatagt

SEQ ID NO: 23324 - DNA, 21 bp, Artificial Sequence
  Synthetic Construct
agcagtcaggtgctcctcctt

SEQ ID NO: 23325 - DNA, 19 bp, Artificial Sequence
  Synthetic Construct
tggtatggggcggcagtga

SEQ ID NO: 23326 - DNA, 20 bp, Artificial Sequence
  Synthetic Construct
cccagctgacacaggctcat

SEQ ID NO: 23327 - DNA, 25 bp, Artificial Sequence
  Synthetic Construct
gtgtccagtctccttgagtcatttg

SEQ ID NO: 23328 - DNA, 19 bp, Artificial Sequence
  Synthetic Construct
ggaggcatgccccatctca

SEQ ID NO: 23329 - DNA, 20 bp, Artificial Sequence
  Synthetic Construct
gtggtgcttgttgccactgt

SEQ ID NO: 23330 - DNA, 24 bp, Artificial Sequence
  Synthetic Construct
gggcagtgatagaactgacatttg

SEQ ID NO: 23331 - DNA, 20 bp, Artificial Sequence
  Synthetic Construct
ggaacgtcagtggtcagctt

SEQ ID NO: 23332 - DNA, 23 bp, Artificial Sequence
  Synthetic Construct
tgtcaccctctctgctcataagt

SEQ ID NO: 23333 - DNA, 22 bp, Artificial Sequence
  Synthetic Construct
gttccatccccaaggacacaga

SEQ ID NO: 23334 - DNA, 23 bp, Artificial Sequence
  Synthetic Construct
gggactggaccaagaagggtatg

SEQ ID NO: 23335 - DNA, 22 bp, Artificial Sequence
  Synthetic Construct
ccatggcagaagctcaggaaac

SEQ ID NO: 23336 - DNA, 22 bp, Artificial Sequence
  Synthetic Construct
ggtctcgctctgtgacaccatt

SEQ ID NO: 23337 - DNA, 23 bp, Artificial Sequence
  Synthetic Construct
gcttccccgtgactgtctcctat

SEQ ID NO: 23338 - DNA, 25 bp, Artificial Sequence
  Synthetic Construct
gagagggtactggtagaagcatttc

SEQ ID NO: 23339 - DNA, 20 bp, Artificial Sequence
  Synthetic Construct
aagtgtggggccctcctaag

SEQ ID NO: 23340 - DNA, 22 bp, Artificial Sequence
  Synthetic Construct
gcagctgctgtctctgcaattc

SEQ ID NO: 23341 - DNA, 21 bp, Artificial Sequence
  Synthetic Construct
ccttgtcctgtgcatctctgt

SEQ ID NO: 23342 - DNA, 23 bp, Artificial Sequence
  Synthetic Construct
caaaggcaaaaagtggcatctgt

SEQ ID NO: 23343 - DNA, 22 bp, Artificial Sequence
  Synthetic Construct
gagcctacctctgtggacttca

SEQ ID NO: 23344 - DNA, 24 bp, Artificial Sequence
  Synthetic Construct
ggaaaaccctctgagcctcacatt

SEQ ID NO: 23345 - DNA, 22 bp, Artificial Sequence
  Synthetic Construct
cggccccttagcttgagttagt

SEQ ID NO: 23346 - DNA, 21 bp, Artificial Sequence
  Synthetic Construct
gaggctgcctagagagacaga

SEQ ID NO: 23347 - DNA, 19 bp, Artificial Sequence
  Synthetic Construct
ggccacgcatgggcatttg

SEQ ID NO: 23348 - DNA, 19 bp, Artificial Sequence
  Synthetic Construct
ggggctcgcgtctctgttt

SEQ ID NO: 23349 - DNA, 22 bp, Artificial Sequence
  Synthetic Construct
ctgtgggatgtcctggaactac

SEQ ID NO: 23350 - DNA, 24 bp, Artificial Sequence
  Synthetic Construct
cttcgagaaaggcttggagatact

SEQ ID NO: 23351 - DNA, 19 bp, Artificial Sequence
  Synthetic Construct
tggccctcaaggagctgta

SEQ ID NO: 23352 - DNA, 22 bp, Artificial Sequence
  Synthetic Construct
gcacccagccagcaattggata

SEQ ID NO: 23353 - DNA, 20 bp, Artificial Sequence
  Synthetic Construct
ccccgattctgcgtttgctt

SEQ ID NO: 23354 - DNA, 22 bp, Artificial Sequence
  Synthetic Construct
agaacccggtccacatgctaac

SEQ ID NO: 23355 - DNA, 22 bp, Artificial Sequence
  Synthetic Construct
ccaaggccctcctctctctaag

SEQ ID NO: 23356 - DNA, 23 bp, Artificial Sequence
  Synthetic Construct
cacaggcagttagggtaggttct

SEQ ID NO: 23357 - DNA, 21 bp, Artificial Sequence
  Synthetic Construct
tccccacgatggcagtgagtt

SEQ ID NO: 23358 - DNA, 22 bp, Artificial Sequence
  Synthetic Construct
tggagcaatatggtgcactgtt

SEQ ID NO: 23359 - DNA, 24 bp, Artificial Sequence
  Synthetic Construct
cactctgtcaagttttgccgtctt

SEQ ID NO: 23360 - DNA, 22 bp, Artificial Sequence
  Synthetic Construct
gcaggcatgacagactttcctt

SEQ ID NO: 23361 - DNA, 23 bp, Artificial Sequence
  Synthetic Construct
gcgttccccatggcatgtctaaa

SEQ ID NO: 23362 - DNA, 24 bp, Artificial Sequence
  Synthetic Construct
ttggagtggacgtcttcctatttc

SEQ ID NO: 23363 - DNA, 20 bp, Artificial Sequence
  Synthetic Construct
cagggctccctcctccattt

SEQ ID NO: 23364 - DNA, 26 bp, Artificial Sequence
  Synthetic Construct
cagcactgagttcattgcctcaaaaa

SEQ ID NO: 23365 - DNA, 23 bp, Artificial Sequence
  Synthetic Construct
gccataggagagaccctgaatct

SEQ ID NO: 23366 - DNA, 22 bp, Artificial Sequence
  Synthetic Construct
gactgcaacagaggctgaccta

SEQ ID NO: 23367 - DNA, 18 bp, Artificial Sequence
  Synthetic Construct
tgccctgggtggtcttgt

SEQ ID NO: 23368 - DNA, 25 bp, Artificial Sequence
  Synthetic Construct
cagcagagacctgatagccctatgt

SEQ ID NO: 23369 - DNA, 23 bp, Artificial Sequence
  Synthetic Construct
gcaacaggttttgtcctctggtt

SEQ ID NO: 23370 - DNA, 22 bp, Artificial Sequence
  Synthetic Construct
cctcgtcctcctcccatccaaa

SEQ ID NO: 23371 - DNA, 19 bp, Artificial Sequence
  Synthetic Construct
ctggaaacggccccagagt

SEQ ID NO: 23372 - DNA, 22 bp, Artificial Sequence
  Synthetic Construct
tggtggggacattttcctgaag

SEQ ID NO: 23373 - DNA, 20 bp, Artificial Sequence
  Synthetic Construct
ctggttgcagtgtggagcat

SEQ ID NO: 23374 - DNA, 21 bp, Artificial Sequence
  Synthetic Construct
tcagatgtcaaccccgcctat

SEQ ID NO: 23375 - DNA, 20 bp, Artificial Sequence
  Synthetic Construct
cggcgactactggaggcttt

SEQ ID NO: 23376 - DNA, 22 bp, Artificial Sequence
  Synthetic Construct
aggtagcccagcagttctccat

SEQ ID NO: 23377 - DNA, 20 bp, Artificial Sequence
  Synthetic Construct
tggcctgcctcacttgctta

SEQ ID NO: 23378 - DNA, 21 bp, Artificial Sequence
  Synthetic Construct
tccggaagacacgagaggaaa

SEQ ID NO: 23379 - DNA, 23 bp, Artificial Sequence
  Synthetic Construct
acatgggttttgagtcagccatt

SEQ ID NO: 23380 - DNA, 25 bp, Artificial Sequence
  Synthetic Construct
gaaccttggctctttgcaagtcatc

SEQ ID NO: 23381 - DNA, 20 bp, Artificial Sequence
  Synthetic Construct
tgactgactgggccttcaga

SEQ ID NO: 23382 - DNA, 25 bp, Artificial Sequence
  Synthetic Construct
ggcaaggcagccaataaaggatgta

SEQ ID NO: 23383 - DNA, 21 bp, Artificial Sequence
  Synthetic Construct
gggcctgttgggcttgttttg

SEQ ID NO: 23384 - DNA, 24 bp, Artificial Sequence
  Synthetic Construct
caaagtggtgagttccttgggttt

SEQ ID NO: 23385 - DNA, 20 bp, Artificial Sequence
  Synthetic Construct
ttgccctcccagtggcttca

SEQ ID NO: 23386 - DNA, 19 bp, Artificial Sequence
  Synthetic Construct
ggtgctctagggcctcaca

SEQ ID NO: 23387 - DNA, 24 bp, Artificial Sequence
  Synthetic Construct
cagtgaggaacgtattcagcctat

SEQ ID NO: 23388 - DNA, 19 bp, Artificial Sequence
  Synthetic Construct
ggcatcgctccacccaagt

SEQ ID NO: 23389 - DNA, 23 bp, Artificial Sequence
  Synthetic Construct
aaagaaagaggccatgtggtaca

SEQ ID NO: 23390 - DNA, 19 bp, Artificial Sequence
  Synthetic Construct
tctggccacctggcgattt

SEQ ID NO: 23391 - DNA, 24 bp, Artificial Sequence
  Synthetic Construct
gacatgacccacaaagccttcctt

SEQ ID NO: 23392 - DNA, 20 bp, Artificial Sequence
  Synthetic Construct
tgcctgacctccatggaaac

SEQ ID NO: 23393 - DNA, 21 bp, Artificial Sequence
  Synthetic Construct
gcccatgtgaggcatagactt

SEQ ID NO: 23394 - DNA, 20 bp, Artificial Sequence
  Synthetic Construct
agaaagccgaggctcagaga

SEQ ID NO: 23395 - DNA, 24 bp, Artificial Sequence
  Synthetic Construct
aggcaagctagctgatatcctttc

SEQ ID NO: 23396 - DNA, 22 bp, Artificial Sequence
  Synthetic Construct
ggtggagtgacccaaaccttca

SEQ ID NO: 23397 - DNA, 27 bp, Artificial Sequence
  Synthetic Construct
ggcatgctttcaatatatcctcctagt

SEQ ID NO: 23398 - DNA, 20 bp, Artificial Sequence
  Synthetic Construct
ccgggaaacctgggaagtga

SEQ ID NO: 23399 - DNA, 22 bp, Artificial Sequence
  Synthetic Construct
cctggtgagtaacggagagtca

SEQ ID NO: 23400 - DNA, 24 bp, Artificial Sequence
  Synthetic Construct
caggcatgggcagtttcttttatc

SEQ ID NO: 23401 - DNA, 22 bp, Artificial Sequence
  Synthetic Construct
accctctgcttctggtgtcagt

SEQ ID NO: 23402 - DNA, 20 bp, Artificial Sequence
  Synthetic Construct
acgcctacagtgagcggaaa

SEQ ID NO: 23403 - DNA, 21 bp, Artificial Sequence
  Synthetic Construct
ggggcatggaatcaggaactt

SEQ ID NO: 23404 - DNA, 22 bp, Artificial Sequence
  Synthetic Construct
ttagagtgggagcggagacctt

SEQ ID NO: 23405 - DNA, 24 bp, Artificial Sequence
  Synthetic Construct
gcaatgatcagtggcgttttcaga

SEQ ID NO: 23406 - DNA, 20 bp, Artificial Sequence
  Synthetic Construct
accacagggttgggcaatga

SEQ ID NO: 23407 - DNA, 19 bp, Artificial Sequence
  Synthetic Construct
acggtgcccggccatttct

SEQ ID NO: 23408 - DNA, 23 bp, Artificial Sequence
  Synthetic Construct
gcatgtgcctgttttctaaccat

SEQ ID NO: 23409 - DNA, 24 bp, Artificial Sequence
  Synthetic Construct
gcccaccttatacctcgctcaact

SEQ ID NO: 23410 - DNA, 22 bp, Artificial Sequence
  Synthetic Construct
cctcctgccaccacatctatca

SEQ ID NO: 23411 - DNA, 21 bp, Artificial Sequence
  Synthetic Construct
tggtgacggaggatggcagaa

SEQ ID NO: 23412 - DNA, 22 bp, Artificial Sequence
  Synthetic Construct
tgcatcccacctgtctatgact

SEQ ID NO: 23413 - DNA, 21 bp, Artificial Sequence
  Synthetic Construct
agccagagttctgccttcttg

SEQ ID NO: 23414 - DNA, 20 bp, Artificial Sequence
  Synthetic Construct
aggctgcgagtttggcagat

SEQ ID NO: 23415 - DNA, 18 bp, Artificial Sequence
  Synthetic Construct
gtccctgctggtgcactt

SEQ ID NO: 23416 - DNA, 23 bp, Artificial Sequence
  Synthetic Construct
gcactatgcagcaggaacctaag

SEQ ID NO: 23417 - DNA, 20 bp, Artificial Sequence
  Synthetic Construct
acaggcctggttggctttgt

SEQ ID NO: 23418 - DNA, 26 bp, Artificial Sequence
  Synthetic Construct
ccaggtcagggtatattatggaaaca

SEQ ID NO: 23419 - DNA, 20 bp, Artificial Sequence
  Synthetic Construct
ccgtggccactcattcaaga

SEQ ID NO: 23420 - DNA, 24 bp, Artificial Sequence
  Synthetic Construct
gggctcacttggatggtcctaaag

SEQ ID NO: 23421 - DNA, 24 bp, Artificial Sequence
  Synthetic Construct
ccaagtgtgacagtgtctttgttt

SEQ ID NO: 23422 - DNA, 26 bp, Artificial Sequence
  Synthetic Construct
cgatacaagtggatggctcttcattc

SEQ ID NO: 23423 - DNA, 25 bp, Artificial Sequence
  Synthetic Construct
catctcaccagatcttgagtgctaa

SEQ ID NO: 23424 - DNA, 20 bp, Artificial Sequence
  Synthetic Construct
aggtggagctgccatcttga

SEQ ID NO: 23425 - DNA, 24 bp, Artificial Sequence
  Synthetic Construct
agacacagttagccagacctattg

SEQ ID NO: 23426 - DNA, 26 bp, Artificial Sequence
  Synthetic Construct
gacatgtcgggaggcttaatctgaac

SEQ ID NO: 23427 - DNA, 23 bp, Artificial Sequence
  Synthetic Construct
cctgcctaaaggtttgcagacaa

SEQ ID NO: 23428 - DNA, 24 bp, Artificial Sequence
  Synthetic Construct
ccacccagatggacctccctttta

SEQ ID NO: 23429 - DNA, 20 bp, Artificial Sequence
  Synthetic Construct
tgcctgtgtgactgccctta

SEQ ID NO: 23430 - DNA, 23 bp, Artificial Sequence
  Synthetic Construct
gaattctgccgtctggttctttc

SEQ ID NO: 23431 - DNA, 22 bp, Artificial Sequence
  Synthetic Construct
acccaatgtcctttgccagtag

SEQ ID NO: 23432 - DNA, 20 bp, Artificial Sequence
  Synthetic Construct
ggctgcagtacacccagact

SEQ ID NO: 23433 - DNA, 28 bp, Artificial Sequence
  Synthetic Construct
gtctttggggtaatcacccacagttaaa

SEQ ID NO: 23434 - DNA, 22 bp, Artificial Sequence
  Synthetic Construct
cacacaccttttggcccttttg

SEQ ID NO: 23435 - DNA, 23 bp, Artificial Sequence
  Synthetic Construct
tctggaggggtaaaaagctgact

SEQ ID NO: 23436 - DNA, 24 bp, Artificial Sequence
  Synthetic Construct
gtaggaccaaaacatggagactgt

SEQ ID NO: 23437 - DNA, 22 bp, Artificial Sequence
  Synthetic Construct
cactaagtgcccgagtcaggtt

SEQ ID NO: 23438 - DNA, 21 bp, Artificial Sequence
  Synthetic Construct
caaccattggtgcggcaaaac

SEQ ID NO: 23439 - DNA, 23 bp, Artificial Sequence
  Synthetic Construct
gacagcacatgctatccctactt

SEQ ID NO: 23440 - DNA, 23 bp, Artificial Sequence
  Synthetic Construct
agaaaccagactgtgagggaaga

SEQ ID NO: 23441 - DNA, 20 bp, Artificial Sequence
  Synthetic Construct
aggggaagggtccctcattt

SEQ ID NO: 23442 - DNA, 22 bp, Artificial Sequence
  Synthetic Construct
accttaggtaccagctcagaca

SEQ ID NO: 23443 - DNA, 20 bp, Artificial Sequence
  Synthetic Construct
agggctcttgagaccagcaa

SEQ ID NO: 23444 - DNA, 22 bp, Artificial Sequence
  Synthetic Construct
gtgtggattgttgcaggaggaa

SEQ ID NO: 23445 - DNA, 24 bp, Artificial Sequence
  Synthetic Construct
cagcaaagactggattcctactca

SEQ ID NO: 23446 - DNA, 25 bp, Artificial Sequence
  Synthetic Construct
ggcatcattgcattcaaagacattc

SEQ ID NO: 23447 - DNA, 20 bp, Artificial Sequence
  Synthetic Construct
cacccatggccacctttctt

SEQ ID NO: 23448 - DNA, 25 bp, Artificial Sequence
  Synthetic Construct
cctctctgatcatttggcaggaaga

SEQ ID NO: 23449 - DNA, 25 bp, Artificial Sequence
  Synthetic Construct
tcattgtaactagggactccacgta

SEQ ID NO: 23450 - DNA, 25 bp, Artificial Sequence
  Synthetic Construct
catattaccctgggaatcacagcaa

SEQ ID NO: 23451 - DNA, 21 bp, Artificial Sequence
  Synthetic Construct
ttggcctgccacatcccctat

SEQ ID NO: 23452 - DNA, 21 bp, Artificial Sequence
  Synthetic Construct
cccaaatggcagaggctgtgt

SEQ ID NO: 23453 - DNA, 24 bp, Artificial Sequence
  Synthetic Construct
cctgattcccttcagttctgttct

SEQ ID NO: 23454 - DNA, 26 bp, Artificial Sequence
  Synthetic Construct
tgcactaatgtcttagaggagctttc

SEQ ID NO: 23455 - DNA, 22 bp, Artificial Sequence
  Synthetic Construct
caaggccacacaggatgtgtct

SEQ ID NO: 23456 - DNA, 23 bp, Artificial Sequence
  Synthetic Construct
gggtccagggtataggtggaaga

SEQ ID NO: 23457 - DNA, 22 bp, Artificial Sequence
  Synthetic Construct
gcgcctctggaaaggtgagatt

SEQ ID NO: 23458 - DNA, 27 bp, Artificial Sequence
  Synthetic Construct
ggcctggtgtaaatttctacctacata

SEQ ID NO: 23459 - DNA, 23 bp, Artificial Sequence
  Synthetic Construct
tgagtgaaatgcaaaggctgcta

SEQ ID NO: 23460 - DNA, 23 bp, Artificial Sequence
  Synthetic Construct
cacctggatgattgccattgctt

SEQ ID NO: 23461 - DNA, 23 bp, Artificial Sequence
  Synthetic Construct
ggtcagtgacagatccaggacta

SEQ ID NO: 23462 - DNA, 22 bp, Artificial Sequence
  Synthetic Construct
tttcaggccctagctccaggat

SEQ ID NO: 23463 - DNA, 23 bp, Artificial Sequence
  Synthetic Construct
cagcctctttcctagggttgtgt

SEQ ID NO: 23464 - DNA, 25 bp, Artificial Sequence
  Synthetic Construct
ggcagttattgcagcaaggaaatct

SEQ ID NO: 23465 - DNA, 20 bp, Artificial Sequence
  Synthetic Construct
gccaccctaagtgctcatgt

SEQ ID NO: 23466 - DNA, 23 bp, Artificial Sequence
  Synthetic Construct
caggacaaggtgctcagagtttc

(The sequence listing continues in the following parts.)

What is claimed is:

1. A method for preparing a deoxyribonucleic acid (DNA) fraction from a cancer patient useful for analyzing copy number variation and mutations of a cancer in a subject, comprising:
   (a) collecting blood from the subject;
   (b) extracting cell free DNA from the blood;
   (c) producing a fraction of the DNA extracted in (b) by
      (i) ligating adaptor tags and molecular barcodes to the extracted cell free DNA to generate barcoded DNA;
      (ii) performing universal amplification using the adaptor tags to produce a sequencing library from the barcoded DNA;
      (iii) enriching for a plurality of loci comprising 100-2,000 loci from the sequencing library using hybrid capture probes that target the plurality of loci;
   (d) analyzing the cell free DNA in the fraction of DNA produced in (c) by
      (i) performing massively parallel sequencing on the enriched plurality of loci to obtain sequence reads for the plurality of loci; and
      (ii) determining the genetic state of the plurality of loci based on the sequence reads obtained from the massively parallel sequencing, wherein the possible genetic states comprise repeats and mutations, thereby detecting copy number variation and mutations of the cancer in the subject.

2. The method of claim 1, wherein the plurality of loci comprises between 100 and 1,000 loci.

3. The method of claim 1, wherein the plurality of loci comprises between 300 and 2,000 loci.

4. The method of claim 1, wherein the molecular barcodes are not unique with respect to the cell free DNA to which they are attached.

5. The method of claim 1, wherein the cell free DNA comprises mixed DNA from the cancer and from the host.

6. The method of claim 5, wherein the method further comprises determining the fraction of DNA that is of cancer origin based on the sequence reads from the cancer DNA and the host DNA.

7. A method for preparing a deoxyribonucleic acid (DNA) fraction from a cancer patient useful for analyzing a ploidy state of a cancer in a subject, comprising:
   (a) collecting a blood sample from the subject;
   (b) extracting cell free DNA from the blood sample;
   (c) producing a fraction of the DNA extracted in (b) by
      (i) ligating adaptor tags and molecular barcodes to the extracted cell free DNA to generate barcoded DNA;
      (ii) performing a universal amplification using the adaptor tags to produce a sequencing library from the barcoded DNA;
      (iii) enriching a plurality of loci from the sequencing library using hybrid capture probes that target the plurality of loci;
   (d) analyzing the cell free DNA in the fraction of DNA produced in (c) by
      (i) performing massively parallel sequencing on the enriched plurality of loci to obtain sequence reads for the plurality of loci; and
      (ii) determining the ploidy state of the cancer in the subject based on the sequence reads obtained from the massively parallel sequencing, wherein the plurality of loci comprises 300-2,000 loci.

8. The method of claim 7, wherein the plurality of loci comprises between 300 and 1,000 loci.

9. The method of claim 7, wherein the method further comprises determining mutations in the plurality of loci based on the sequence reads.

10. The method of claim 7, wherein barcoded DNA from each targeted locus have a unique barcode.

11. The method of claim 9, wherein the method further comprises determining the number of unique molecules in the blood sample for each locus based on sequence reads from the barcodes and the cell free DNA.

12. The method of claim 7, wherein the molecular barcodes are not unique with respect to the cell free DNA to which they are attached.

13. The method of claim 7, wherein the cell free DNA comprises mixed DNA from the cancer and from the host.

14. The method of claim 13, wherein the method further comprises determining the fraction of DNA that is of cancer origin based on the sequence reads from the cancer DNA and the host DNA.

* * * * *